United States Patent 10,212,939 (METHYLOBACTERIUM COMPOSITIONS AND PLANTS, PLANT PARTS AND SEEDS COATED THEREWITH) - sequence listing, part 2

SEQ ID NO: 6317 - DNA, 804 bp, Methylobacterium sp.
atgagtgctgaagccgagacacaggacgccggcgaggacctgctgttctccgtcgccgacggggtggcgaccatcacgctgaaccggcccgagcggaagaacgccttcaccttcccgatgatcgaggcctggacggaggccctgcagcgctgccgcaccgacgcggcgatccgcgtcgtggtggtgaccggcgcgggctcggccttctgcagcggcggcgacatcgtcgagatgggcgagcgcctcgaccagccgccggcacgacgcaaggaggagctttacgggcggatccagcgcatcccgctgacgctggaggatctcgacaagccggtgatcgccgccctgaacggcgtggccaccggcgccggcctcgacctcgccctgatgtgcgacctgcgctacgccgcgcagagcgcccgcttcgccgagacctacgtgcgggtcggcctcgtccccggcgcgggcggcgcccatttcctgccccgcctcgtcgggaccgcgaaggcgctggagctgttcttcaccggcgatttcgtcgacgccgacgaggccctgcggatcggtctcgtcaacggcgtccacgccgacgcggacctgagcccggccgtggcggcgctggcgcggaggatcgccaaggcgccgccgctgacgctgagcctgatcaagcgcgcggtctaccagggcatgcgcaacgacctgcgcaccaacctagacctgatctcctcccactacgccgtcgtcaccgcgacgcccgagcatcgggaggccgtgcaggctttcatcggggcgcgcgacaggacctga

SEQ ID NO: 6318 - DNA, 390 bp, Methylobacterium sp.
gtgcgcgcctggtatcaggccgacaaggaggccagcatcgaggtcgtggtgcacaaacccgacggccagccctataacgcctatctgtgcgagactttcgagagactagcggaacacgcaggtttggcggacaggaaagtcggaggcatctctgcgaaggttacgccacacgtgtttcggcacacgatcatcaattggctcttgcgggccggctgctcgttgaattcggtcgcggattttgccggatgcagtgtcctcaccctcgtcaggcattacggaaggcaatcgatggatggtcaagctgccgtgctcacctgtatcgaccgccccatactgctaaagaggcttgatgtcggtgcaatgggccgcagcaggacgggctcggtctga

SEQ ID NO: 6319 - DNA, 1716 bp, Methylobacterium sp.
atgaccgacgcccacgccgccccgggctacgacgccgacgtgatcgtcgtcggcgcgggccccgtcggcctgaccgcgggctgcgccctgcgccatcacggcgtgtcgtgcctgatcctggagcagcgcgcggaggtcagggcgtactcgcgggccaacaatctctgggcccgcccgcaggagttgctcgccggcatcggcctgcgcgacgccctggcggagaacgcctacgcggtccgcaccatcaacttcttcgtcgacggcgcgccgacgacgccgatccccatcgccgacgtcgccagcccctatcccgacgtcctgtacagcgggcaggacgtgatcgagcggaccttgatcgacgcgttcgaggcccgcggcggtcggctggaccggggctgcacggtgaccggcatcgaccaggacgcggcgggcgtcaccgtgaccctccggcggggcgcggacgggccggagacgcggctgcgcgcccgctactgcgtggccgccgacggggcccggagcacggtccgcgcccggctcggcctggatttcgagcccgagcggctcgcgggctgcatgaaccggcaggtcgacgcccggctgtcctggcgccgcgggtccgagccggaccagctctggttcttctactacccgcgcggcttcgccggcatcatgccggtctggggcggctaccaccggctgttcttcctggccgacgacgccggcgtgccggaccgcgacccgacgctcgcggagatccaggccctcgcccgggaggtcaccggcgacgagaccctcaccctgagcgacccgcaatggctcacccacagccgcttcgcctacggggtctcccccggctacgcgcggggccgcgtgttcctggcgggcgatgccgggcacctgtccctgccgatcggcggccaggggatgaatgccggcctccacgacgcggtcgagatcgcgtggcggctggccatgaccctgcggggcgaggcggcgcccgccatcctcgactcctacgacggcgagcgcggcggcgagcacgcccggctgagcgcccagcaggtgcgcgggttccggtggaccgtctatcgcggccccgtcaccgacacggtgctggggctggccgcgaaggcgctgccgaacctgggctccctgctgcaggggacggacgacatgcagcagatgggcgtcgcctatcccggcagcctcctgaacgcggatcacctgtcgggcctcgcgaacctgacgcacctgctgcggccggggccgaagccgggccagcgcgcgccggacgcgccggtgacgcgggacggggtgcgcacgcgcctgttcccgttcctctacaacccggacggatggacgacgggctgggcgctcctgtgcttcgacggacggtcgccggaggcggcgcccttccttctggaggcggtccaggccgtggcgccctggccctggctgcgtccgcggctcgtcctcgccggccccctgatcgcggcggagatgcccgtcctgtcggatctggacggccgggcacacggcgcctacgggctggagggccggccggcgctcgtgctggtgcgcccggacgggcacatcgccttccggagcggcgcggaccggaccgatcgcctgatcgcgtattgccgcgcgctcttcgacgcggcggggcgcgcggccggggaagtggtgcggccggaggcggcttgcgccgggtga

SEQ ID NO: 6320 - DNA, 1455 bp, Methylobacterium sp.
atgccggactcgatcagcgcgcggctgcgcgcggccatcgcggatcatgcggggacgggccgcacggcgctctcgggctccgacgtcgtatcctatgccgacctcggcgcgcggatcgacgccgccgcgggcgcagtccgggactggggtgccgccaagggtgaccgggtcggactgatcgcgcccaagagtgcggcggccatcgtggcctacttcggggccatgcaggccggcgcctgcgtctgcttcctggagccggggctcgcgccggaggtggtggccgagcaggctgcgctcgtcggcatgcggcatctcatcgtcgcccaggtcgacgcctcgcccgtcgctctgaccggcctggacgtccgcgcactggacagcctcgccgacggcgcggccttcgcggccgaggtcagcccgcgggatgaggccatgctgcttttcacctcggggagcaccggccggccgaagggcgtgctgctgcgccacgaaggcctgatctgcaacgccgcgggcgtgctccgtcacaccggtacggggcctgcggaccggcttctccacgtcatgccacttcatcacacgaacggcatcaacaaccagttgatcgtgcctctcctggccggagccgagatcgtgttgatggagcgcttccaggccgaggccgccctcgaccgcctgcgatctggcggcatcacctacatgaccggcgtgccgacgatctacgcgcggatgctgcccctgctgcgccccggggagcgcttcccgggcctgcgcttcctgcgctgcggctcggcgccgatcaccccgaccctgcatcggcagatcgaggaggccttcggcgtgccgctcctcgtctcctacggcctgtcggaggcgacctgcacctcgaccatgaacccgccgggccggcgtcgcatcggcacgatcgggaccgtgctcgcgggccagaatgtggacctgttcgatccggccacggatcgcccggtcgaggccggccgggaaggggagatccgcatctccggcccggccctgatggccggctatctcggcagcgcggaccagccgatcgtggacggctggctgcgcaccggtgatctcggccgcttcgacgccgacggcttcctcgccatcacggggcgcatcaaggacgtgatcattcgcggcggcgagaatatctcgcccgcgttgatcgagcggcaactcgctgcccatccggccatctgcgactgttgcgtggtcggcgcccccgacgcggatctcggcgaggtaccggtggccttcgtggtgctgcgggagggcgagggcctcgacgagccggggctcaaggatttcgtacggggttccctcgcgcggatctacgtgccggcgcagattcgcaggcttgacgtgctgccggtcaacggcgtcggcaagaccgaccgcaaggcgctgcgtagcttgttggccgcttcctag

SEQ ID NO: 6321 - DNA, 627 bp, Methylobacterium sp.
gccaagcgggtctaccgggtcatgaaggtgcacggcctcctgctccagcgacatgtgggcggagccgagacgcgccgtcacgagggcaaggtggcggtggccacgcgcaatacacgctggtgctcggacgggctggagatcgcagcagagaacggtgagcgtgtgcgggtcgccttcgcgctcgactgctgcgatcgggaagcgatgagctacgtggcgaccacggcgggcatcacgggcgaggacgtccgcgacctgatggtggcggccgtcgagcatcgcttcggggcggtcaaccagctaccgagcctgatcgagtggctgactgacaacggcagttgctacgtcgcccgcgacacgcgccgcttcgcccgcgaactcggcttgataccgaagacgacgccgctggagagcccgcagagcaacggcatggccgaagcgttcgtgcgaaccttgaaacgcgactacgtgcgtgtctcggtgctaccggatgccgagagcgtgctgcgccagctccccgtttggctggcgcactacaacgaccttcatcctcatcgcgcgctcggctaccgctcgccgcgcgagttcatcacccgatcaacccaggagaccctgtccggtttttag

SEQ ID NO: 6322 - DNA, 1179 bp, Methylobacterium sp.
atgctgcgcagatacgcgatcatcgaaagcccgaggcggcgtcgggccggcggggcggtggcgagcggcagcggaccggacgccggtgggttgcgcgtccttgaggccgacctctccgcccgggacgtgcgcgagatcgggagggaccccaatgtcgaagaccacgggctcatcatgccgacgcgcttgatccgcccggtcacgacacgggagatcgacaccgcggatgcaaagccgccggcttggggcatctccgcggtcggggccgatcggacaaccctcgacggctcgggcatcatggtcgccgttctcgacacgggcatcgaccgggcccacccggctttcgacaacgtggatatcgaagaggaagacttcagcggatctggcaacggcgaccggcacgggcatggaacccactgcgccgggacgatcttcgggagggacgtcgagggtctccgcatcggcatcgcccggaagatccgcaaggcgtacatcgcgaaagtgttccccgacgacggtcggggcgactccctggccgtcttccaagcgatcgagcaggccgcgaagaaaggggcaaatatcgtctccatgtcgctcggcttcgatttcgccggcatggtgagggaccttgtggaggacggatatccggtcgagctggcgacctcgatcggccttgaacacttcaaggacaatctccgcatgttcgactcgataatgcgcgtggtcgaggccggacgggcgttcggacggggaccattggtgatcgcggcatcagggaacgagagccagcggagccgtgattcacggttcaggatatcggcttcgcttccttcggcggcggccggcgtgatctcggtatcagcggtgcgacaggcagacggcgcattcgagatcgccgatttctcgaacggacgcgccaagatctgcgcgcccggcgaggagatcgtctcggccgcccccggcagcggtctcgcgacgatgagcggcacgagcatggcgtgtccgcacgtggcgggcctcgccgcgctctggtggcagaaaatcgcggcatcgtcggtccgggccaacgcggaaacggtcggccaaaagctcctcacctcggccatcacaacatcgatcaagtcattcgatcccgacgactcggaagtgggattcgctttggcgccatcgtcggcctga

SEQ ID NO: 6323 - DNA, 1158 bp, Methylobacterium sp.
atgcgaccgctgtccggtatccgcgtgatcgagttctgcagtgtcgcggccgggccattctgcgccatgctgctcgccgacatgggagccgacgtcatcaaggtcgagaatccggagggcggcgactcgatgcgggcctggccgcccctcaacgcgggcttcagcgagaacttcgcctcgctcaaccgcaacaagcgctctgtgacgctggacctgaaggatccggccgacaaggcgcgcgccctggacctgatcggctctgccgacgtggtgctggagaacaaccgccccggcgtgatgaagcggctcggcctcgactacgtgcgcgtcagcgccgggcggcccggcttggtctattgctcgatctcagccttcggccaggaggggccgcgctccgccgaggccgggttcgacctgacgctccaggcgatgagcggcgtgatgagcgtcacgggcgagcccggcgcgcccccggtcaagtgcggcgtaccgatctcggatttcggcaccggcctctacgcggcctacgccatcgcggcggcgctgctccaggtgcgggcgggcggacccggcgcacacatcgacgcctcgatgttcggcgcctccctggcgatgggggcgctccagaccagcgagtatttcggcagcggccgcgacccgaagcgcctgggctcggcccatccgcgcaacgccccctatcaggccttccgcgcccaggacgggtacttcgccatggcggcgggcaacgacgccctctaccgcgccgcctgcgcggcgatcgggcgcgacgacctcgccgaggatccgcgcttcgcctcgaccgccctgcgggcgcagaaccagggcgaactcctggcgattctggagcgcgacttcgccgacctcacctgcgccgacctgctggcccggttccgcgccgcgggcgtgccctgcgcaccgatcaacggctacgccgacgccctggccgacccgcaggtcgcgcatatgggctgggtccagccggtgaccctgccgtccggcgctgagacgcgcaccttcgtgtcgccgctgaagttctcaggggagggcttcccgatctaccgggagccgcccgccctcgggcagcacaacgccgaactgttcggcgaggccgcgccggctcgcgcgcgcacggcttga

SEQ ID NO: 6324 - DNA, 717 bp, Methylobacterium sp.
atggacgaactcctgaaagagcgcagcggcgacacgctgaccctgacgctcaaccgccccgacaagatgaacgccctgtcggccaccctggtcgacgcgctgctcgacgccgtcgcggctgcggccggcgacgggacacggctcctcgtgctgaagggcgcggggcgcaacttcagcgccgggttcgacttcggcggctacgcggacctgtcggagggcgacctgctgctccggttcgtgcggatcgagcagctcctccaggcgctggcccacgcgccgttcgacacgctggcgctcgcgcacgggcggaacttcggcgccggggtcgacgtgatctgcgcctgcggccggcgggtcagcgatccggccgccaccttccgcatgccgggcctgtccttcgggctggtgctcggcacgcggcgctacgccgagcgggtcggcggctccaaggcccggctcgtcctccaggaggggcgggtcttcgacgccccggaggccctgtccgacgggttcctcaccgccgtcgcggcgaccgactcgtggttcgacaccgtcgcggccgcctcggaagcggcgacgcggctgtcttcctgggccggggcggccctgaaccgcgccgccgcccgcgacacccgcgcggacgacctcgccgacctcgtcgcctcggccgcgcgcccggggctgaaggaccggatccgcgcctaccgcgcggcctga

SEQ ID NO: 6325 - DNA, 828 bp, Methylobacterium sp.
gtgagcgccggaacccagaagatcgtccccctcgcagacctcgcagcccgcgtgccggacggcagctccctggcgctcggcggcagcttcctgcaccgcggccccttcgcgttcgtgcgcgagctgatccgccagggccgccgcgacctcgaagtcgtcaagcagtcgcccggctatgacatcgacattctctgccgcgccggcgccctgtcgcgggcgaaggcggggatcgtggccatggaaggcaatttcggcctcgcgccctggtaccgccgggcgatcgagtccggcgaggtccgcctggaggagcacgcctgcgccagcctgacggcgggcctgcgggcggctgccttcggcgtgccgttcatgccctgcggcggcatccacggctcggacctgccggcgctcaacggctggaagacgatcgaggacccctacggcagcggcgaggcggtctacgccatcccgcgcatccagccggacttcgcggtgatccaggccaacgaggtcagcgcgtcgggggacgtgcgcgtcttcgggacctcgcactgggaccggatcatgagccgctcggccaagcgcgtgctcgtggtggccgagcgggtcgccccggacgcctccttccgcgaccagcccgaactgacgctggtgccccacttcctcgtcgaggcgttgagcatcgtgccgaacggggcttggcccggctcgctctggccggattacgagatcgattacccggccgtggaggcctacatggccgacgccccgggcgtgctcgccgatcacctcgccgccggccccgaggcccgggaggctgcccatgtctga

SEQ ID NO: 6326 - DNA, 756 bp, Methylobacterium sp.
atgtctgaggcgccgtccaacgcgatcgaggcctggtcgggcttttcctacatcgtcaccaatctcgcccggttcgtgcggccgaacgagatcaccttcagcggcgtgaactcggccctgccgatgctggcctgcctcctggccaagcaggcctatcccttcgcgttcacctacatcaacgtcgccggcggcgtcgacccgaacccgtcgaaggtgccgatctcgtcctccgacccggtcctcgccgagggctcgcgggcgatcttcgccaatgaggatttctacgatctctgcacccgcggcctgatggacctgtgcttcctgggcgccgcgcaggtcgacgggctgggccgcacgaacgtctcctgcatcggcgactggcacgcgccgcgggtgcggctgccgggcggcggcggcggcgccgtgatgctgcccaccgcccgccgggcggtcacgtggcgtacggaacattcccgccgcaccctcgtcgagaccctcgacttcgtcaccgcggccggcggcatgcacggcgtggtcacgccgatcgccgtcttcacgaagcgcgagggccggctcgtgctggcctcctggcatccggaggcgagcctcgacgaggtccgggaccgcaccggcttcgcgttctcggcggacggtgccgcctcgacgcctccgccgaccccggcggagcgggcggcgctggcggtcctcgacccggagggccggttcgaggccgatgcgggcatccgcctgcgctga

SEQ ID NO: 6327 - DNA, 492 bp, Methylobacterium sp.
ttgatctgcctgctcggcttcctcggtgtcacggccgccttgaagctgcgcgacggcatgaggccggcgccggtggccctcgccgtcacgccgccgccggagcccgttcccgcagtcgacgccgccggcgtggctctccaggccgggcgcaacggccacttcttcgtcaacgcgctgctggacggccgctcgctgccgatgatggtcgatacgggagcgagcgcctgcgcgttctccgaggaggatgccgcgcggatcgggatccaggtcactccggccgatttcacccgcgtctggaacaccgcgaacggcacggtccgcgtggcgccgatccggatcgccatcgtgcagatcggatcgatcacggtccgggacgtcgatgcggtcgtgatcccgcgcgggctcctgtcgacgagcttgctgggcatgtcgttcctcaggcgtctgcgcgatttcggcatctccggcagcacgatgacgctcaggggctga

SEQ ID NO: 6328 - DNA, 861 bp, Methylobacterium sp.
atgttcgacgcgaccaagatgctcgccgacgccctcggcgagcacctggccctgacctaccagcggaccttcggcagccgggagccgcgctacgccgagatcatcgaggccgcggcgcgcctgacgatcgagcggatcgtcgggagcgacgccctctaccatgacggcgaccacacggccctcgtcaccctggtcgcccaggacatcctccgcggccgcttcctgcagcagggcatcacgcccgaggactggctgcacatgatcctggccgccctctaccacgacatcggctacgtgcgcggcgtctgcgccggagaccggctgcaggccttcgtcatcgacgcgcagggcacgaccgtcagcctgccccggggcgcctctgacgcggcgctggcaccctaccacgtggagcgctcgaagctggccgtgcaggagcgcttcggcacgcacgatctcgtcgacgcgtcccgggtcatccgggcgattgagctgacccgcttcccggtccccgaggacgattcccatcgcgagaccgggaccgaggccggcctgctgcgggcggccgacctgatcggtcagctcggcgacccgctctacccgcgcaaattgaacgccctgttccacgaattcgccgagatcggcgtcaacgcggaactcggctacgacagcccggccgacctcgcggagcgctacccgtcgttcttctggggcaagatcgagcccgtgatcggggacgcgatccggttcctcgacctcacggtcgaggggcggggctgggtcgcgaacctctacgcccacgtcttcgccatcgagcacgaccgccggcgcatgggcccgcatcccgggccgggccctctctga

SEQ ID NO: 6329 - DNA, 981 bp, Methylobacterium sp.
gtgatcaccggtccgtgcctcatcgtccagccgatccacgcggcgggcctcgaccggttgcgcgcggccggcctggagccgcgcccggcgagcgggaccgatcccgagacgctggcgcgcgaggtcgccgactgcgtcgccgtcatcacccgcaacaccggcttcccggcccgcgccatcgcggcggcgccggccctgcgggtgatcggggtgcacggcaccggcaccgaccacgtcgccacggccgaggcgaccggggccgggatcgtggtggtgaacacgcccggcgccaacgccgtctcggtggccgagcagacgctggcgctgatcttcgccctggccaaggccctgccggaggccgaccgctcggtccgggccggcgacgacagcttcaagttcaccgcccggctgatcgagctcgccggcctgacactgggcctcgtcggcttcggggcgatcgggcaggcgaccgcccggctcggcgccaccctgggcctgcgggtgctggcctacggcccgagccgcccggacgcggacttcgccaatgccggcgccctgcgggccgcctcggtcgacgcgctcctggcggagtccgacatcgtctccctgcacgtgccgctgaccccgggcacccgcggcctgatcggccgggaccagctcgcccggatgaagcgggaggccttcctgatcaacaccagccgcggcggcctgatcgacgaggcggccctggtggaggcgctggcggcgggcacgatcgcgggcgccgggctcgacgtcttcgcccaggaaccgctgccggtcgaccacccgctggcccgccagccccgggcgatcctgacgccccatgtcggcggctccaccggggcggccctgatccgcaccgccgagaccgccgcggcccgcgtggtcgacgccctcgccggccggcggccgggcgggctggtcaacccggccgtctgggagcggcgccgcggggtgtga

SEQ ID NO: 6330 - DNA, 114 bp, Methylobacterium sp.; identical to SEQ ID NO: 5254

SEQ ID NO: 6331 - DNA, 810 bp, Methylobacterium sp.
atgaaccgccgccacgtcctcgccctcgccgccctctgcgccagcctcggcgcagggatcctcgccgcccccgcgacccgcgcggccgagggcaagctggagctgatcgagcccggcaagctgatcgtggcgacggacagcaccttcgcgcccttcagcatgcgcacgccgagcggcgagctcgacgggctggaggtccgggtcatgcgcgaggtctgccgccggctcgggctcgagtacagcccggtcaacatcaagttcgacgccctgctggtgggcctgatggccgaccagtacgacatcaccagcgagtcgatggacatcacccccgcccggcagaagcaggtcgccttcgcggacgggtggctcgaatccggcgcgcggatcgtcacccgcaaggataccggcatcaaggggccggcggatctcaagggccgcaacgtcggcgccctctcggcctcgaccttcggcaagctcgccgaggagaacggcgccaccctgaagagctacaagacggccgcggacgccatgcaggacctcgtcggcggcaacatcgacgcggtgatcaacgacgcggtggccggcaactacgccatcaaggcgcgcaagctgcccctggtgatgatcgagaccccgctgagcacggtccagaagggcttcgccatcaagaagggcaagccgaacctgcacgccgccgtcaacaaggcgctcggcgagatggtcgcggacggtacctacgccaagctcgttaccccgctgatcggctatgatccggccccgaaggagccgatccgcacgcccgccatgtga

SEQ ID NO: 6332 - DNA, 681 bp, Methylobacterium sp.
atgaagaccctcgacgccgcgtcgtacacgacggcgctcagtgcacggcgcgagcagagcctcggccagatggcctacgaccgcctgctcgacatgctcgtccgccgcgaccttccggccggcaccgtgctgcacgagcgccgcctcgccgagatgctcgacatctccaggaccccgacccgcgaggcgatgtcgcggctggagaccgaggggttgatcgagcggcaacccggcgggatgctcgtggtcaaggaattctccctgcgcgagctgatcgagatcctgcatgtccgccgcctgctggagcgggagagcgtcgcgctggccaccggccgcatcgccgacgcggtgctggcggacctgcagcgtcagatggaggcactcttggcggcgggcgacccggacgcgccgggcaactgggaggtcgaccggcgcttccacgacctgatcgcggagcacagccagaacgcgaccctcgccaagacgatcaaggacctgcggctcaagacgcagatgttcaacctaagccggatgcccgagcggttcgaggcggtccatcgcgagcacctcgcggtggtcgccgccctgcgggccaaggacgcggcggcggcggcggacgcgatcgcggcccatctcgagaatttcaagcagggcatcatccagcgcctgagcgaagtctga

SEQ ID NO: 6333 - DNA, 759 bp, Methylobacterium sp.
ttgcttctcctgctgctgacctgcgccgcccccgtgcaggcccggcccgccaccttcctggcggtgcacgccgtcggcatggccgcgctgccgccggtcccgcccgcgcctgcggccatgcccgcacccgcaccggtcgccgccgacgcccgcgcccgctacctgccgctcatcgcccgcgaggccgccggcaccggcctgcccctcgcggtggccgacgccgtcgcgcggatcgagagcggctacgaccccacagtggtcggcagcgtcggtgaggtcggcctgatgcaggtccgcccgaccaccgcggcgatgctcggcttccgcggcaccgtcgccgagctggcatcgccggagatcaacgtccgctacggtgtccgctacctcgccgaggcgtggcgccgggccgacggcgacctctgccgggccctgatgaagtaccgggccggccacggttcggaggcgatgtcgccgctgtcgcagctctactgcgcccgcgctcaggcgattctcggcaacccggaggcgcgcgtcgtccgggcgagcgcccgcgcggccgcgccggaccgcctcgccgcgcgttcggcgggccccgtccaccggacgcgcgtcgccgccgtcccggcgaagccgatgtcgttctgggaggcgcaccgggcgcgcatcgcccggctcaacgccgccgtggtgtcgcgctggcgggcgcgcggctggtcggccgcgcccgacgggtcctccggcgagccggccggcggctag

SEQ ID NO: 6334 - DNA, 1329 bp, Methylobacterium sp.
gtggcgtcctggatcgaacaggcagtctggtggcaggtctttcccctcggcttcgtcggagcccccgacgaagccgatccggccgcaccggtcacgcaccgcctcgcccacctgcacggctggctcgactacgcggtcgagctcggcgcgtccgggctggcgctcgggccgatcttcgcggcctccacgcacggctacgacacgatcgaccatttccgcatcgacccgcgcctcggcgacgaggccgatttcgacgccctggtcgcggcggcccgggcccgcggcctccgcgtcctgctcgacggcgtgttcaaccatgtcgggcgggcgcacccggccttccaggacgtcctgcggcacgggcccgaatccgagcgggccggctggttccggctgtcctggccgcggggctccggcccgggcatcgagccggactacgcctgcttcgagggacaccggcagctcgtcacgctcaaccacgacgacccgcgcgtcgctgaccacgtcgccgccgtcatgggccactggctcgcccggggcgccgacggctggcggctggacgcggcctacgcggtgccgccgcgcttctgggcgcgcgtgctgcggcaggtccgcctcgcgcatccggaggcctacatcgtcggcgaggtgatccacggcgactacgcccgcatcgtgcaggacaccggcatggattcggtgacccagtacgagctctggaaggcgatctggagcgccctcaacgatcgcaacctgttcgagctggcccacgccctggaccggcacaacggccttctcgacaggttcgcgcccctgaccttcgtgggcaaccacgacgtgacgcgcatcgcgagccggctcaccgacgagcggcacctgccgcacgcgctggcgatcctgctgacctgcggcgggacgccctcgatctatgccggcgacgagcaggccttccgcggcgtgaaggaggagcgggtcggcggcgacgacgctatccggccggccttcccgccgacgcccgcggatctcgctccctacggctggccgatctaccggctgcaccgggacctgatcgccctccggcggcgccacgccggactccaccgcgcgcgggcgcgggcgctgcacctcgccaacgcgcagatcgtgctcgcgctgggcgacgggagcgcgcgggtgctgacggccctgaacctcgccgacgcggacgcgacgctgccggtgccggaagcccgggcgatcgaggccggcaccggcgatctcgccgaggccggcagcaccggcgcccgcgtgacccttccggcccacggctgggccgtcctgaccgtgtga

SEQ ID NO: 6335 - DNA, 660 bp, Methylobacterium sp.
atgccggatgccgcactgctcatgcggatccgcgccatcctggccgacagccccttccacggcgaaggccatcgcaaggtctgggcacggctgcgcatgaagggcgtgcgcacctccaagcgccgggtgctgcgcctgatgcgcgcccacgacctgttggcccccacgcgggtcggtacgccgcgcggtccgcgcaaccacgacggcaccatcatcccggacagggtcgacacgatgtggggcaccgacctgaccaccacctggacggccgaggggcaggtcgcggtgttcgtggccatcgatcactgctcggccgagtgcgtgggcatccatgcggcccgccgggccacgcgcttcgaggcgctggagccgatccgccaaggggtgcggcagcgcttcggcggcttcgcggccgagatcgcttccggcctgagcgtccggcacgatcacggaagccagtacatggcggacgccttccaggcggagctcgcgttcctaggcatcgcgagttcgcccgccttcgtgcgcgccccggaggggaatggctgcgccgagcgcttcatccgcaccctcaaggagaacctgttgtgggtcgagcacttcgatacggtcgaggatctgcgccacggcctgctggcgttccgggatctctacaatgag

SEQ ID NO: 6336 - DNA, 630 bp, Methylobacterium sp.
atggtcctgctgggagatctcctcatgatcctcgacctgcaccgacaggggctgtcggtcaccgccatcgcccgccggacagggcgtgatctgaagacggtccggaagtacatcgagcgcggcctcgaaccaccagcctacggtccccgccaagccggacgtccgagcaagctcgccccctacctcgtctacctgcgcgagcgcgtcacggccttccccgatctcagtgccgtgcgcctgccccgcgagctgcgggagcgaggctatactggggcctacaccgccgtgaagcggttcgtggccgcgacccgtccgcccgaggccaagccctacgaggttcgcttcgagaccaccgccggccagcaggcgcaggtcgacttcgctcgcttcgtggtcaccttcacggacgcaccgggcgcgagctgcatcgtctggttgttctcgctcgtgctcggccaagttgcggtacttgtacaggaacgggctgaatgccggcacgcgcttgcggttgggcatcggcttcacgttcgcccacgcgacctgtttcttcatccgagtgcgaagcgcgtcgctgtcataggctcgatccctgtcaacgccgagtgcatcatggttcttccgcacttcgta

SEQ ID NO: 6337 - DNA, 3906 bp, Methylobacterium sp.
atgcagcgttacgagctgacggcgggaacatccgcgaagttctgggaggccggagccgaggacagcgttctcatcgtgagattcggccggatcggcacgcaggggcagtccaagacgaagagctttccgagcgcgcaggcggcccgggtcgaactcgaccggctggtgcgggagaagaccggcaagggctatcgcccggcgggtgaggccgcgccggccggaccggatccggcctccggagcgggcgccgcggcaacgggcaacgccgccgcatccccggcggccgaagctcaggtcgccgaggcccgatccgccgaggtccggtccgccgagaccggggccgccgggacgtcgcccgcccccgccgccggcgcggaggcgcgccgcgtcccgatcttcaccggtacgcccctgcccgcccgcagccggcccggcgcgcccctcgacgccgccgccgactgggccgccttcgcggcgcggatccgcccgctgctggcggccgccccggacgaggcgcgcgtgccggccgaggccctcgccgcccggctcgacggcgcgccgccggccctcgacccggacgaggtccgcgcttggctggagcaactcgaggcggcctgcccggcgttgagccagcgcccctggggcgccaagcccggaccgcaggggccggcggcccgggcggcgttcacgcatctcgcccgctggctcgtggcccgctccggcaccggggggacgctcgtggccctgctcgaccggctgcggccccgtccctccgtccgctacggctcgctcccggtctcggcctgggacatccccaccaccttgggtctccgggcggccctggtcgccgcccccgaggcggcgtacgcggaggccctggacgcggccctccggctcgccgcttcggacccggagcccaccctcgcccgctggctcgcggtgatcttcgcggacgaccggcccggcgccgaccacgccctctccgcccgcgcggtgctggcgcgctgcgacccgcccgatcccaaggcctacggcaattcccacgtcgccctgccgctgatcgtcgacctgccgcccgcgcaggccgcgccctggtacgccgcgccctatcaccgggcgacgctggcgacctgcgatgtcggggccgaggaggccgccgcgaccgtgatcgccgtcgccgacgcggccggcgagccggccacccccggcctcgtctggctcctggagggggcggtcggccccgagcgcacgatcgtcgcccgggccctgctggagacccgcgccgccgacgccctcgacgcgctcctgcccttcgtgggcaccaagctggtccgcgacgccctcgatgccgccgacgcggccttccccgactggatgctgcgggcctatctgggcgcgctccagggcaagggggagcccgcctacggcccccgggccgtgaccctcgccgcgcgccacgggcacgagaccgcccgcgcctgggcggcggccgagggcggccggggcgcggggcgcctggaccggctgctcgccgccgggagcgcgccgcaggcggcgccggaggccctgccgcccgtgctccgggatccgccctggcggcggcgcggggccgcgcgcgcccggtcggaacgggcggtggcgccgatcccgacgcccttcgcgcacggcttcgaccccgacgaggccctcgaccgcagcaccttctatttcgaggccgggacgctggtggagtccatgacggacctcgcggcgcggatccgcgccaccgaggcggaggccctctacgacatgccgatcccgccgccggccgagcccgtgcccgccgccgacgcggatccggccaccgccttggcgtggctcgaccgacggctcgacctggaccgcgacgcgttcaccggcttcttctacttcaactacgggccctggttccggatggtcgggtggcagcccgagcccctggcgctgatgctgtgggagaagaccgggccgcagcgcgcccactacgtcgcgtggcggcgcaccatcgcggtgatgctgtcgcgcttcggcgcgcgggccgtgcccggcctcgtccgcctcgtcgcggcggatccggcgcagctcctgccggaggtcgagccggtggacgccgccgacctcgccccggtcgccgcccgggcgttccaccgcacccgcaagctgcggccggccgcggccgcgtggctgcgcgcccatccccgcaccgccgcgctgcggctccttcccgagaccctcggggccgccggcccggaccgcgacgcggccgacgcggccctgcgcttcctctccgccgaacccgcggggcgcgccgccctcgacgccgccgtcgcggcctacgcggagcgggatcccggcgtgcccggggcggtggccgccggcgtcgacagcgacccgctggagcaggtgccgtccaagccgccgaagctccccgactgggtggtccccgccgccctgccccgcccggtcctgcggagcggcggcgccctgcccgacgccgccgtcaccgccctgtgcgagatgctcgccttctccgacccgctcgcgccctacgcgggcgccgcgcaggtccgcgccgcctgcacgccggagagcctcgacgccttcgcggtcgcgctgttccagtcctggatcgccgccggcgccaaggcgacgggagagtgggcgatgcaggcgctcgccctgatcgggggcgaccacgccgcccgcgacctcacccggcagatccgcgcctgggggcaggccggcctcaagccgcgcggcaaggccggcatcgccgtgctcgccgggatcggcaccgacgtggcgctgatgaacctcagcgccatcgccgagaagagcccgctgctgcaactgcgcgaggccgcccgcgccgccatcgtcgacgccgccgaggcccgcggcctcgacgaggtcgacctcgccgaccggctctcccccgatctcggcctcgacgcgcgcggcgggctggacctgtccttcggggagcgccggttccgggtcggcttcgacgagaccctgaagcccgtcctgcgcgacgccgagggccggcggctcgccgccctgccccgcccgaccaaggcggacgatcccgaatccgccaaggcggcgtcccggcactgggcggccctgcgcaaggacgcggaggcggcggccggcctgcagatcacccggctcgaggccatgctggcgtcccagcgccgcgtcgcccccggggtgttctggccgttcttcgccgcccacccgctgatccgccacctcgccgggcggctcgcctggggcctctacccggacgccgcgcccgcgacgccgccggggcacgtcttccgcctcgcggaggatctctcgccgaccgacgccgcggacgacgccctcgccctcgacgtcgcggcggccgagggcgtggtcggcctcgtccacccccttcacctcgacccggaggaacggaccgcctggagcggcctgttcgccgattacgagatcgcccagccgttcccgcagatcgcccgcgagaccttcgcgttcaccgaggccgagcggggcgccgccgagacccaccgcttcgacggggtccgggtgggcggccgccgcctgcgggggctgcggccccagggctggtcgaccgacacggggagcgagcacgtccatgcggtgcagcgcccggtcgcgctgcccgacggcacccgcctcgtcgcggtcctgcgcttcgaggacgggttctggcaccggcccggcccggagggcgacgggatccagacgctgcggaccctgaccctgtccgataccggctggcgcgccgcggcggcccaccggttcggcgacctcgacccggtgaccgcgagcgaggtcctgcggacgccgagcctgctcgccgcctccggcgacgcgtga

SEQ ID NO: 6338 - DNA, 3495 bp, Methylobacterium sp.
ccgcgtccggccgcggtcttcgcggcggtgccgctgccgacccgcctgcgccccggtccgcgcccggacgcggcggaggcctggcgggcgatcgcggcgccgctggcagccgcgctcggcgatgccgaggccgcgcgcctcgccggagcgccgccggaccgggacggcctcgccgcctggctggacgcgatcgtcgacgccgcggaggcgcgccgacaggggaatccgtcccgggccgccaccggcgacgccgtccttcgaggggcactggaggcggtcctgcgctacgccgtggccgagggcgggacggaggccgtcgcccggctggccgaccgccgccgcccgaccccgaagacgccgcgcgcctaccagcgcctgtcctgggccgagccgctccacctcgccctgcgggccgccctggtgcacgccccggaggccgattacgacgccgcggtcgcgctcctgaacgcccggatcgccgaggaccacgactggccggcggcctgcgccttcgcgttcatcctggccgacgaccgggccgccccgcacccgctccagcccgtcgcggtggtcgaggccgccgcgtcggcggggatcgacgtcgcggccgatacggcctacctgccgctgctggccgacgcgccgccggaagcggtcgcgcgctggcgcgccaagcgcagctaccacctctacttcgtctactgcgccctcgacgcggccgaggcggccgcgaccctgctggcggtggcccgcgccgccgggcagccggccctgccggccctcgactggctgctgcactacgcccttgacgagcagcgtcgcacggtcgccctggcgatcctgtcgacgggcgaggccggggcgctcccggtcctgctgccccacctccacgagaagcccgtcgcggccgccctcgacgcggcgctggaggcggaccccgccgcgatcctgccccgctgcctcgcggccctcgcgggcggccggtccgagcccgccctgcgcgcccgggtgaaccgggcgctcgacgcccacgggctcgacacggtccgcggctggctcgcggcgtcgggcgggcgcggggccggcatcctcgacgccctggcggaagcccgcgcggtgcccctcgcggagcccgccgcctggccgcgggtgctgcgcgacccgccctggcgggccaaggcccggacccgggacgacctcgtcctcgcgctcgcgccgctgccgacgccgttcgcccacgcagtgccggaggtcgcgccgagctactggcgcgcgcggaacgccgtcaccctcgacggcccggaggcgctgcgggccttcgtggcggccgccgagctttcccatccgacgcagggctggagccggatcccgcccccgctctccgagccgccgcgcgacgatccgccggccctgatcgcctgggtcgccggccgcgtcgcccagatcgacgaggcctgccattactgggcgaactcgccctatcgccagctggtcggcagcctggagcggcagcccgagcccctggcgctcgccctctgggcccagtcgcgcgtcgttgcgggatgcttccacgtctcgcagtggccggagatcgtgtgggcgatgctgtcgcggttcggcgagcgggcgatgccgggcctcgtcgggctggtcgaggccgatccggtcgggctcctgccggccgtcctggcggtggacgatggccgcctcgccgggcccgccgcccgcgccctcacgaagctcaagaaggcccgcgagccggccctggcctggctgcgccgccatcccgagaccgccctcacccgcctcttgcccgacgccgtgggccggcccggggcgctgcgcgacgccggcgagcacgccctgcgcgtgctggcgcaggaccgggcggacggccgcgccatcatcgcttccgtggtcgcgcgctacgcggaccaggcaccggacgtgaccgaggcggtcgcgcaggtgctcgaccgcgatcccctcgcccgcgtccccgccaaggtcggcaagccgcccgcctgggtcgtgccgtccatgctgacccggccgcgtctgcgggacgggaccgccctgccggacgcggcgatcctgaccctgtgcgagatgctgtccttcaccaacccggacgccgtctatgccggcgtgccgatggtccgcgaggcctgcaccgaggcgagcctcgcggccttcgcgtgggacctgttctccgcctggatcgccgccgggacgccctccaaggacggctgggccctgcgcgcgctgggctggttcggcaccgacgccaccgcccgcgacctgacccgcctgatccgccgctggcccggcgaggccgcccacgcccgcgcggtcaccggactcgacgtgctggtcgacatcggcaccgacgtcgcgctgatgaacctcaacggcatcgccgagaagctgaagttcaaggggctccaggagaaggcccggcagaagatcgcccagctcgccgaggcccgcggcctcacccccgaggagctggccgaccggctcgcccccgacctcgacctcgacgagcgcggcggcctcgacctcgatttcggcccccgcgggttccgggtcgggttcgacgagaccctcaagccctgggtccgggacgccgccggccagaggctcaaggatctgcccaagcccgccaaggccgacgaggccgggaaggccgcggcggcggtggcccgctggggcgccctgaagaaggacgcgcgggccgtggcgagcctgcaggtggcccgcctggaggcgatgctcgccggcgcccgccgggtccagccgacggtgttcggcccctgcttcgccgcgcacccgctcctgcgccacctcgcccagcgcctcgtctgggccaccttcgcggatgccgacccgcggaccggtccgggcctgaccttccggatggccgaggacctgaccttcacggatgccgacgacgcgccgctcgacctcgacctgaccggggcggccccgggcctgatcggcctcgtccatcccctgcagctcgacgccggggcgctggcggcctggggggcgctgttcggcgactacgagatcgtccagcccttcccgcagctcgcccgcgagacctacgccttcacggaggccgaggccgccgcatcgaccacgagccgcttcgccgggaccgtcgtggaggccaaccgcctgcgcggcatggccgcccggggctggcccctcggggcgccccaggatgccggggtggtgtggtggatcgagcgcgccgtgaccttcccgggcggcgcggccggccaggcgtcgctgaccttctcggagggcctgttcaccggcgcggtggagttcgaggaccgggagcagaccctcggcgacctgaccctcggctcgccctggagcagccggtcggatccgggccagcgcaccttcggcgagctcgcgccggtgacggcgagcgagctcctgcgcggaccgagcctcctcgccgggacgcggctgcggtga

SEQ ID NO: 6339 - DNA, 441 bp, Methylobacterium sp.
atgtgcaatctgtactcggggatgccgtccgccgactacgagggcgagacccgctccatccggctcggcggacactcgacctcgatcaggatcgaggtgatgttctggaacgtgctcgaggacatcgccgccgctcagggcatgacccttccccgcctcgtgacgcttctctacgacgaagtgctcgctctccacggtgaggcacgcaatttcgcctcgctcctgcggtgcgcgtgcctgaggcacctcgagatgaaggcggaccgcctcgcctcggcgcagcggcgcgccgtggaacagcgcggcagggtcgcgggggacgtcgatggcgccctggaccggatcgacgaccgtgacgtcggcgtcggacacgtcgcgcggaccgcgcgcgccctgcgcggcgacgcggtccggccgcgcgatgcccgcggcgagggctga

SEQ ID NO: 6340 - DNA, 1527 bp, Methylobacterium sp.
atggatgagcctgtcgacgtcgtcgtggttggagccggtccggtcgggctcctcacagccatcgagctgaccctcgggggcgcgcgcgtccgggtgctggagcgcctcaccgagccgagcaccaccatcaaggcgctggggctcggccccctgggcgtcgaggcgctgcagcggcgggggatgggcgcggcgatcgaggccgccgaggcgcggagcctcgcggcgatggaccgcctgccgggtcaggtcggcggcggcccgcgcggggcgcagttcagcggccatttcggcttcctgttcatccgccgcggcccgcaggcggagccggaccggcgcatgcgcgcggtcgatcagcagagcctcgaagccatgctgctcgaccgcgccgcggcgctcgggatcgacctgcgccgcggttgcacgctcacgggcttcacggaggcggccgacagggtcgaggtggcctggaccgcgccgacgggcgacgcgcgcgtccgctgcgcctatctcgtcggctgcgacggcggccgcagcgcggtccgcaagatggccggcttcgccttccccggcacgccgccgacgctcaccatgtaccaggcgatcgccgatctcgacgatcccgccggcgcgctgccggtcggctggcaccgcgggccggggggcgtctacggccacgggccgttcccgcgccgcctgttcatgctggatttcagcggcccgccggccgaccggcaggcgcccgtcacgcgcgacgagatcgagaccgcgctgcgccgggtcagcggcacggacgtccgcgtcgcccgggtcgcggtcgcgaaccggtgggccgacaacacgcgcctcgtcgacacctaccgccggggccgcgtgctgctcgccggcgacgcggcgcatgtccacgcgcccttcgacggccagggcctgagcctcggcctgggcgacgccgccaatctcggctggaagctcgccgccgtgctgcgcggggagatgcccgagaccctgctcgatacctacacggccgagcggcgcccggtggccgaggccgtcacggccaacacccgcgcccaggcggcgatcctgcggcccgatccgcaatcgggcgcgctgcgcgacctgatggcgcggctcctggagagcgacgaggtcagccggatcctcggcggcctgatgcgcggcctgagcgcccggtacgatctcggctcgcccgaggacgcggtcggccggatggccggcgacgggccgctcggcgccggtggcgcgacgctctacggcgcgatgcaggacggccggggcctcctcgtcgacggcagcgccgacggcgcggcctcccggatggtcgccgcggcgacgggccgggtgagctgcgtggcggtcccggacgggccctcgacgctggtccgccccgacggctgcgtcgcctggacgggcgcggcaacggccctcgacggcctgcgggaggcggtgggccgctggttcggcccgtcaccggccgggccgctcggcgcgccggctccgatgtgctaa

SEQ ID NO: 6341 - DNA, 1134 bp, Methylobacterium sp.
gtgcagctgatcccggcggaggccggtccgacacggtcgagctgcttgggcgtcgaggcgcacgcgcgcgccgcacccgactggttcgcgacgctctaccggttcctcttcttcgccggatccaccgtcagcctgccgctcgagcatcaggggtcgcggatcgggatcgtcgaagcggacttcgatcccgacgcggtcgtcgggtcggcgtggatcgtgctgaagcaggtgtccggcgctctcgcggccatgaccgtcgtcctgtgcgtgctggtctacggcgcggtggcgcacgcgctgcgtcccgccaacgagatcctgatcggtatcgatcgcgtcgcgaagggcgacctcgcgtggcgtctgcccagcctccgcctgcgcgagctccgacgcatcgcgacggtcttcaatcagctcgccagccatctccaagtcgccacgcgggaacgtgccgagctcgcgcgccggctgatcgatgcccaggagcaggagcggcggtggctgtcgctcgaactgcacgacgacgtcgcgcagcgtctgacggcgttgagccttctcgcccggtcgatccaggagggcgcgcgctcctcgtcgccttcggtcgtggccgagagtgccgaactcgccaccatggcgtcggacgccgtgcgcgcgctccggagcaccctcgccgcactcaggccgcccgagatcgacgatctcgggctgcgggtcgcgctccggagtctgatcgccgcccaggcgcagcgcgccgggggccggatccacgtcacgctcgcggccgacgcgcaggccgatcgcctgccctccgacgcggcggcccatatctaccggatcgtccaggaaggcctcaccaacgccgtccgccacgcggccgcgcgcaccgtcgcgatcgcgctgaacgtcgcggagaccgacggcggcgccgaggtccagctgatcctcacggacgacgggagcggcgcccccgtggaggcgctggagcgcccgcattccggtctcggcctgctcggcatgcgcgatcgcgtccacgcgctcggcgggcagatcgtgacggaaacggccccgggcggcgggttccgcttgcgggtccgctttcacgccgcgctcgcgggcgacgaggtgtcatga

SEQ ID NO: 6342 - DNA, 477 bp, Methylobacterium sp.
atggcgagtgtcgtgcaccgcgggcccggcccgaacgccgtcatcggcggcatgcgggtctcctatctcgcgcgcagcgacgagacggccgacggcctcggcatctaccgcgtcgcgatggatccccggacgccgggcgcgggactgcatcgccacgcccgactgaccgagaccttctcggtcgaggcgggccggctcgcgctccacgtcgacggtgccgaccacgacctcggacccggcgacttcgcgctgatcccgcccggcgtcgcgcacgccttcgccaatcgcggcgaccgcccggtgcgcttcacgctgagcttcgcgccggcgctcggccgcgagggcttcttcgagggtctggcccgcctcgccgtggagggacggctcggcgacgccgccgcgatgaccgacctgatggcccgctacgatcaggaaccgctggccgggttcgccggctggagttcggtcagcggctga

SEQ ID NO: 6343 - DNA, 294 bp, Methylobacterium sp.
atgatggccgcgcggcgctggctaagcgcgacggggctcgcgctgcttccgacgacttcccaggccgccctgccgccgtcctggcaacgcgtgcgtgaagtccaggccgtcgcggaggcggccgcgcgggtgctgggatcgcgtccgatcgatgcagtcgagcgcgtcgacggggagcgctaccgcgtccgggcgggtgactgtcgggtcacggtccgcgtcgtcgtccgcccccgagcacagccgggaccgcaggccttcgacgcgattccggacgctccggactgcccctag

SEQ ID NO: 6344 - DNA, 2439 bp, Methylobacterium sp.
atggacaagcgggcgctcagcgagcgagacatctgcaccaagttcatcacacctgcgctcgaaaaggcggggtgggatgtcgtctcgcagatccgggaagaggtaacgttcacgaaggggcgcatcaccgtccgcggaaagctcgtcacgcgcggcaaatccaagcgggcggactacatcctctacgccaagcccaacattcctttggcgctaatcgaagccaaggataacaaccacagtgtcggcgacggcatccagcaagctcttgagtacgcggaaacgctcaacgtaccgttcgtcttttcatcgaacggcgacggcttcctctttcacgaccgaaccggtgggagcactcaggcggagatcaacctgggcctcgatgcctttccatcgcccaatgacttgtgggaccggtatcgaagttggaagggcctaaatccgcaagctgaggagcttgtacttcaggactactacgacgacggcagcaacaaggctccgcggtactatcaggtgaatgcggtcaacgcggcgatcgaggccgttgctaatggccatgatcgcatcctcctggtgatggcgactggtaccggcaagacctacacggcgttccagatcatctggaggctgtggaaagccggccggaagaagcgcatcctattcctggccgatcgcaacgtgctgatcgaccagacgatggtcaacgatttccgtcccttcggtgccgcaatggcgaagctctcgacccgctccaagacgatcgagcgaagcgacggcaccaaggctgacgtgccactcgccctcgataacaaacgtcgaatcgacacagctttcgagatctacctcggcctgtaccaagctatcaccggaccagaggagcggcagaagctcttcaaggagttctcgcccagctttttcgacctcatcgtgatcgacgagtgtcaccgcggcagcgctgcagcggactcggcgtggcgtgaaattcttgatcatttctcgactgcgacgcaggtcggcctgacagccaccccgaaggaaacggcttacgtctcaaacatcgactactttggcgccccggtcttcacgtattctcttcggcaaggcatcgacgacggcttcctcgccccctacaaagtcgtgaaagtccacatcgaccgtgacgttgagggataccgaccagagaagggacagcttgaccgtgaaggcaacgaggtcgaagatcgcatctacaatgccaaggatttcgaccgtaccctggtgctcgacgaccggacgaaactgacagccaagaaggttaccgagtttctaaaagagagtggcaaccgctttcagaaaacaatcgtcttctgtgtcgatgaagagcacgctgcccgtatgcgtcaggctctcgtgaacgaaaacgaggatttgtacggcgcgaatcaccgctacatcatgcggataaccgggagcgataaagaaggtcaggaccagataggaaactttatcgaccccgagtcgaagtatccagtgatcgtcactacatcaaagcttctatctacgggtgtagacgctcagacctgccgcctcatagcacttgatcgttccgtgggctcgatgaccgagttcaagcagattgtcggacggggaacgcgagtccacgaagacacgaacaagcttttttttacccttatcgactttcgaggcgcgactagccatttcgccgatccggagttcgacggcgatcccgtgcagatctatgtgcccggggcccatgatcccatcacaccacctgacgaaacgctcccttcctcagataatgctccgtcaccgataccaataagcgcggagaacggcgatgagccgccgtatgccccaaacagcagcgggggtagaatccgcaagatctatgttaacggtgtcgagaccaaaatcatcgcagagcgcgtcgagtacctcgacgagcatggcaagctcgtaaccgagacattacgtgacttcacgaaagctgctctcaagaagcgcttcgccagcctcagcgactttctgaagcgttggaaggcagcggcgaggaagcaggcagtcgtcgaggagctcgcggcagagggcctaccactcgaagtgatcgcggacgagctgggcaaagatctcgatccattcgatctgatttgccacatcgcctttgacgccaagccgcttacacgtcgtgaacgagctgagcaggtcaagaaacgcgacgtattcaccaaatacggcgagcaggcccgttcggtcctcgatgcgctgctcgcgaaataccaagatgagggcgttctgaccctcgataacactaacgatttgaaaatcgcgccattcgataagatgggcaccgttgttcaactcgtcaaagcattcggcggcaagacagacttcgaaaaggccgttcacgagctgcaagacgcgatgtatcaggaagtagcgtag

SEQ ID NO: 6345 - DNA, 405 bp, Methylobacterium sp.
atggatgacaggcagatggcccgcgggctggcttggttcgggatcgggctcggcctcgccgagaccttcgcgccccggcgcgtcgcggccgcgaccggcctcgacggccacgagggcctgatccagctctacggccttcgcgagatcgcctcgggggcggcgatcctggctgccgccgagccggagcggcttctcggcctgcgggtgggcggggatctcctcgatgccggcctgctggcggcccgcgccacgccctcgaacccgcggcgcaaccgcaccctggcggcggccctggcggtggcgcccgtcgtcatgctggatgccgccatctggctgagggcgcgcgacaggcgcagccagtctccgggtgatcccggccggaagcccggcgcgatcgcgcgatga

SEQ ID NO: 6346 - DNA, 906 bp, Methylobacterium sp.
atggcaactttcgcacgctcggaggtcctggcgcccgatcgcgcgccccgggcccggccgcgaatccccccgggggtcggcgatgtcctgccgggcacgctgttggtcgtcctggcgcttctcgggccgctcgccctgatgctccgctacagcttcaaccggttcgtccccggtgagctgatggttgaggggcttaccctcgccaactacgccaagttcctgcacgatagcttttatcgggatgtcctgctgacgaccctctgggtggcggccctctcgactctgatctgcctcgtgctcggcttccccgtcgcctatgccctggtgcggcaggtcgggcaacgctggaagtcgaagctcctgatcctcatcatcctgccgctcctcatgggcaacgcggtccgcaccgccgcctggatggtcatcctcggcgacaagggccttctcgccgccctgctctccggggtggggctcacgccaacccggctgatgtacacccccaccgccgtggtgatcggcctcgtctcggtgacgctgcccttcatgatcgtgacgctgcagagcgtgctcgagcggatcgatccggtcctggaggaggcggccgagagtctgggcgccgggcacctcacgatcctgcggcgggtcgtgctgccgctcgcgctgcccgggctgctcgccggcacgatgctgtgcttcatcctgtcgatgaacgcctacgccacgccggtgctgatcggcggcccgcaattccacatgatggcgcccgaggtctaccagcaagtggccaaggcgatgaactggccattcggtgcagccctcgccttcgtgcttatgagcgtcaccctcgtgctgaccaccaccgccaacgtcctcgtgcagcgccgctaccggcgctggtcggagtag

SEQ ID NO: 6347 - DNA, 819 bp, Methylobacterium sp.
ttggcggcgatttggctgacggccctgatccgggcgctgacctcagggaccgtggtggtgctcgcctccgtcctggccgaatggctgggaccggtctggggcgcgctcgtcgtcagcctgccggtctccgcggggccggcctacgtgttcatggcgatggagcacgacgccgccttcgtggccggggcggccctgaacggcttcgcggcgaacgccgcgacgggcctgttcctgatcgtctacgcccaccgggctgccggccgggacatgaccgccaccctcgggccggcgatcctcgcgtggctcgcggcggccctgccggtctcggcactcacctggacgccgacgacggcgttcctgctgaacgccctggtctacggggccggcgcgctctcgacccggcacgtcgtgcgcgcgaccctcgtgcggagcaccgtcgtcgcgcggccgcgcccgctggatctgctgatccgcgcgagcgccgtcgcgctgttcgtcgcggccctcctggcgctgagtacggcgctgggccccgccaggaccggggtcatcgccgccttcccggtcacgatgacgagcgccttcgtcatcctccatcgccgcatcggcggggcggcgatggcgcggctggcgagcgtcgcgatccgcggggtgttcggcttcggcctgaccttgctgacactccacctgatgatccagccctacggtgccgcgctcgcgctgacggtcgcgctcctcgtctcgctgatctactcggcgggtctcctcgtggtgcagccccgtcccggtcggcaggagcccggcatcgtcacgcgctga

SEQ ID NO: 6348 - DNA, 894 bp, Methylobacterium sp.
atgagcggtctgccccgcgccgcgccggacgcggtcccggacgcggtcccggacgtgatcccggacacggccccggccccggctccggcggcggccccgctggcgcgcaccggaatccgccgccgcggtgggatcctggtgccgacggtcagcgccgccacggtgctggcagccctcggcctctggctggtcgccacccgtgccggctgggtgaagccgctgttcctgccgccgccggaggcggtcctggcggccttcggtcaggcctggcgcggggagatcgacggcgccccgctcgggctccacatcggcgacagtctcctgcgcgtcctcggcgccttcgcgctcgccgccctggtgggcatcccggccgggctcgccatgggcacgagccggatcgcccggggcatcctcgacccgccgatcgagttctaccggccgctgccgccgctcgcctacctgcccctgatgatcatctggttcgggatcggcgagctgtcgaaggtgctgctgatcttcctcgcctgcctcgccccggtggcgctcgccgcgcgggcgggggtgcgctccgcctcggtcgaccagatcaacgccgcgcgcgccctcggggcgagccgctggcaggtcctgcgccacgtggtcttcccggcggcgctgccggagatcctgatcggcctgcggatcggcatgggcgtgggctggaccaccctggtggccgccgagatggtggcggcccaggccgggctcggccagctcgtcctcaacgcctccaatttcctgcgcaccgacgtggtggtgatgggcatcctgctgatcggcctgttcgcgggcctgttcgagctcgggatgcggggcctggagcgcgtgctggtgccctggaagggccgacactag

SEQ ID NO: 6349 - DNA, 462 bp, Methylobacterium sp.
atgcgtcgcgccctcgccgccctggctctcgccctcccgcccgccgtcccgctcaccgccgcggcggacgatctcccgccgccggtcgcggcgtcggccgcgcgggccgaggcgtcctgcgggtccgagccggccacgctcaagccgggcttcatcacccgccaggacgtgaacggcgacgctgtaccggacttcatcctggatttcgcggccgtccaatgcggcgatgacgggtccgccgcgtgcggcaccgcgggctgcgagatgcaggtcttcgcctcgacgacggacgggttcgtggacgccttcgacgccgtcgcccacgacctccgattccgcacggtgggaggccgcccggcggtcatcgtcgatatgaccggggcgacgtgcggacgatccgggcaggatccgtgcggcgcgatcgccgtctggaacggcaggacattcggccggacacggtag

SEQ ID NO: 6350 - DNA, 450 bp, Methylobacterium sp.; identical to SEQ ID NO: 5276

SEQ ID NO: 6351 - DNA, 753 bp, Methylobacterium sp.
atgcgcatcctgctcctcaaccccaacacctcggcggcgatgaccgcgcgcatggcgcgggccgccgaggcggcgctcgcccccgacgcgcacatcaccgcgctcaccgccgcgacgggcctgccctacatcgcgagccgggccgaggcgcagctcgccggcgcggcggttctggagacgctcgccgcccaccattccggccacgacgccgcggtgatcgccgcctacggcgatcccgggctggtcgccgcgcgggagctgttcgacctgccggtcgtcggcatggccgaggccgcgatgctgaccgcctgccagctcggggcgcggttcgcggtcgtcaccttcgcgcccgccttgctgccctggtacgaggacgcggtggcgctggccgggctgtcggcgcggtgcgccggcctccacgcggtgcgccggccgttccaggcggtgacggacgtgcaggacgagttgcggcccgagatcctggccctggccgagcgggcggtgggggagggggccgacgtcgtgatcctggccggcgcgccgctcgccggcctcgccacggtcctgcgggacgcggtgccggtgccgctcgtcgacccgctggcggccgccctgggtcaggcgcaggccttggtgcggctcgggacgcggccgccgcgggccggccgcttcgcccggccgcccgcgaagccggccacgggcctcgccgggccgctcgcccgctggatcgcccatcgcgaggaggagtcatga

SEQ ID NO: 6352 - DNA, 1419 bp, Methylobacterium sp.
atgaacgcccccgttcccgccccgcggacccgcccggacgcggcgacgatcgcgggtctcgccgaggccctgcgggccgtgctcggggaccgggtgacggcgagcccggcggtgcgcgagcagcacgccaaccagctcacctgggcgccgtgcgagccgccggacctcgtggtcttcccgcactccaccgcggaggtgcaggccgtcgtgcgcgcctgtgccgagcgcgacatgccgatcgtgccctacggcgtcggcacctccctcgagggccacgtcaacgcgccgttcggcggcgtctcgatcgacacgggggcaatgaaccgcgtccgcgcggtccatgccgacgacctcgactgcacggtcgaggccggcgtcacccgcagggcgctgaacgcgtacctgcgcgacaccggcctgttcttccccatcgatcccggggcggacgccacgatcggcgggatggcggcgacgcgggcgtcgggcaccaacgccgtgcgctacgggacgatgaaggacgcggtgctcgggctcaccgcggtgatgccgaacggcgacatcgtcacgaccgcccggcgggcgcgcaagtcgtcggccggctacgatctcacccggctcctcgtcggctcggagggcacgctcgggatcatcaccgaggtcacgctgcgcctgcacggcatccccgaggcgatctcggcgggcatctgcccgttcccctcgatcaaggcggcctgcgacgccacgatcctgacgatccagtccggcatcccggtcgcgcgcatcgagctgctcgacgaggtgcaggtggcggcctgcaaccgctactcgaagctcgccctgccggagaccccgctgctcctcgtcgagttccacggcacggacgcgggcgtgcacgagcaggccgagcggttcggcgagatcgccgccgatctcggcggcggcccgttcgactgggcgaccggggccgacgagcgcgcgcgcctctggcaggcgcgccacgacgtgtactgggcctcggtcgcgctgcggccgggtcccacgatcaagaacatgtcgaccgacgtctgcgtgccgatctcgcggctcgcggaatgcgtggaggcgacgaagcgcgacatcgccgcgaccgggctcacggcgccgatcgccggccatgtcggcgacggcaacttccacaccctgccgctcgtcgatgccgacagccccgaggagatgtccgcggtggccggcttcctcgaccggctcgtcgcccgcgcgctggacctgggcggcacctgcacgggcgagcacgggatcggccagaagaagatgcgcttcatggaaagcgagcacgggccggaggcgctcggcctcatgcggaccctgaagcgcgcgatcgacccccggaacctcatgaatcccggcaagctgattccctga

SEQ ID NO: 6353 - DNA, 477 bp, Methylobacterium sp.
atgacgcgccgctacgccgccgacacgtcggtcccgatggaccgcagcatctccgagatccggacgaccgtccggcgctacggcgccagcgagttcgcgcacatggagagcgacacgcaggccgcgatccacttcaccatgcgcggccggcggatcctcttccggctcgcgatgcctgatccgacggctggcgagttcgtgctgaccgagaccggcaaggtgcgctctgccagagtcgccgaggccgcgtgggagcagtcctgccgctcgcgctggcgggcgcttgccctggtcatcaaggcgaagctggaggcggtcgaggtcggcatcgtggtgttcgaggacgagttcctcgccaacaccgtcccgccgggcgcgagcgtaaccttcggcgaggccgtccgcgaggacatgcggctcgcccacgagaagcgcgagctgacaccgctgttgccgtacctgggaggaggggaatga

SEQ ID NO: 6354 - DNA, 1455 bp, Methylobacterium sp.
atgtccgttcgcaatatcgttaagtccgtccaggacatcatgcgccaggacaccggcatcgacggtgatgcgcagcgcatcagccaattatgctggatgtttttcctcaagatcattgacgaccaggatcaagagcttgagctcacgcaggaaagttacagatctccgatccctgccaagttccagtggcgcacctgggctgcggaccctgagggcattacgggcgaccgtcttctgacgtttatcaacagtgagctgtttccaaccttaaaggaactttcgctgacgggccaagaaggcgaccgccgtcgcgttgtccgagacgtattcgaagacgcttacaactatatgaagtcgggacaactcatcaggcaggtcattaacaagatttcttccgtcgatttcaacgatttatctgagcgccagcactttggtgacatctacgagcagattctcaacgaccttcagtccgccggaaacgcgggtgagtactatactccacgtgccgtaactgcattcatggttgatcggattgacccacggcctggagagacgctgtttgatccggcttgcggcacggggggcttcctcagctgtgctatccgccacatgcgcgatcgatacgtgaagagaacacacgaagagtgggctctgcagggtggcctacgcgcggtcgagaaaaagcagctgccgcacatgctctgcgtcaccaatatgctgttacacggcgtagaagatccgagcttcgtccgtcatgacaatacgctggcccgtcctctcatcagctggggcaaggatgagcgcgtcgacatcgtgctcaccaatccacccttcggtggtcgtgaggaagacgggatcgagaacaacttcccggctttccgtaccaaggaaacagcagacctttttctggcgctcatcgttcgtttgctgaagcccggaggtcgcgcagccgttgtactgccggacggtacactttttggggaaggtataaaggctaagctcaaagagcatttattagaggaatgcgatctccacacgatcgttcgcctgcccaactccgttttcaagccgtatgcctcgatcggtacgaacctgctattcttcgagaaaggtacgcccaccagagatatctggttctacgagcatagagtacccgaaggccagaaggcttattcgatgacaaagccgatccggctggagcatctgcaaagttgcatggattggtggggcggcaaggaccgcaagggccgggtagagacgcctcaggcctggaaggtgagcgccgatgaggtcaaggcgcgcggctacaatctggactgcaagaaccctcacgcggtagctgacgatcacggcgatccggacacccttctaggcgatcttgtccgagccgaggccgaagcagcgagctatcgcgaccagctaaagacgatccttgccgaggcactgacccgatga

SEQ ID NO: 6355 - DNA, 1107 bp, Methylobacterium sp.
gtgcccgtgacggacgacatcaccttcgagcccgactggttctcgaagccaggcgacacgatcgtatcgctgatggagcgtaggcaagtcactccatgcgatcttggcggcgtgataggcggcggcatagacaccttgcgcggcatccttgcgggttcggtaaccatcgacgccccccttgcccgcgacctgtcgaacgccctcggcggatcggccgatttctggctccgacggcaggcgaactacgatcgcgcccttgaccgcgtcgtgcgcgtcgcgacggtgagcgagggcgagcgatggcttgaactcgtccccgttcctggtccgcagccgcgcccacggccgggtgtggacgggcgtatggacgccgtccgtagacggctcgtctttttcgacgtcaacaacctgcggacttggacaacgcgctacggctcggtcaggagcgagacccagttcaggacttcgcccacgctggtttcggatgagggggcggtcgcagtctggctgcgccggggcgagctcgacgccgcgcttgtcgtgacgtgcccctgggacgccgacggccttcgcggccggctcgacgagatccgagcgctcagcaggataggacagccgtctcggttccttccgaagctacgggatattctcgcttccgtgggggtcgcgctcgtcgtggtgcgcgctccgagagggtgtcgtgcgagcggggcgacgcgtcctttggcatctggcaagcggatgctgctacttagcttccgctttcgagcagacgaccaattctggttcacagtcttccacgagctaggccacctgctccttcacgacggtcagactttcgtcgacgacgaggaaacccttcaggacgatcgcgagcaggaggcgaacgcgttcgctcgggattgcatcgtcccgccccaattacgggcggagttcgagcgtctaccgccgagcaggaagtctatccttcgctttagcgtttccgtgggcatcgcggccgggttgacgatcggccagatgcagcatgggcggatgatcgggcacgagcaatttaactccttgaagcgccggtggacttgggacgagattgagccagctctaggctag

SEQ ID NO: 6356 - DNA, 759 bp, Methylobacterium sp.
atgatgcgcgcgctcgaagggcaggtcgcctgggtgacgggggctggatccgggatcgggcaggcggcctccgtcgctctggcgcgggccggcatgcggctcgcgctcaccggacggggacaggaggccctcgcgcgcaccgcggagatggtccgcgctgcgggcggcgaggcgctggtcgccccggccgacatgggcgtggccgacgacgtgcagcgcgcctgggaggcggttcacgccgcgtggcggcgctgcgacctgctggtgaactcggcgggcctcaacgtgccgcagcgcggctggagcgagatcacgccggccggcatcgacgccgtggtcggcgtcaatctcaacggccccttctacgcggcgcgggcggtgctgccgaccatgcgggcgcagcggagcggcctgatcatccacgtctcctcctgggccggccgctacgtctccaagctgacgggaccggcctattccgctgccaagcacgggctcgtggcgctctcggagagcctgaaccaagaggagtgcgggcacggcatccggtcctgctgcatctgccccggcgaggtcgcgacgcccctcctcgacaagcggccagtcccggtcaccgcggaggatcgcgggcgcatgctccagccggaggatctcgccgagacgatcctgttcgtcgcccgcctgccggcctccgtctgcgtcaacgagatcctgatcagcccgacctggaaccgcggctatctcgagggcgtgaagctctga

SEQ ID NO: 6357 - DNA, 1611 bp, Methylobacterium sp.
gtgggcgtccaggtctcgtccgtcggcgcggtgatgatggaggggcgcaaggccgccatccgcgcccaggtcgagtcggcgcacggcatcgtggcggcgttcgcccggcaggcggaggccggcgccgtctcggccgacgaggcgcggcggcgcgcggcggaggcgctgcgggccatgcgctacaacggcggcgactacgtcttcgtctacagctcggagccgggcaacatcggccgcaacgtcgtgcatcccgatcccaagatcgagggcacgcggtcccgcgacgacgcggcgatgaagaagaccttcgtctggacgatgatccagcacgcccgggagggcggcggcttcaccgagtaccgctgggcccgcctcggcgagaccgagcccgccccgaaggtcgcctactcgctcgcctacgagccctggcaatgggtcatcaattcggccctgtacgtggacgacatccacgccctggaccgggcgcggatggtcaccaccctgctctggctgatccccctcgcgatcgggatcgggctggtcgggttcctgctggcgcgcagcatcacccgccccctgagcgccttcacggccgccctgcgccgcctcgccggcggcgcgacggacgtcgccatcccgggtctcggccggcgcgacgagatcggccagatggccgaggccgccggcgtgttccgggacagcatgatcgaggcgcggaccctgtcgaccgagcagcgcgccgagcaggagcgtcggcaggagcgggcccagtggatggaggcggtgacccgcagcttcgacaccgaggcgagccagctcctggcacgggtcgacaccgccgcggccggcatgcgggaggcctgtcgggcgatggccgacaccgccgcgcaggcgtcgcggcaggccggctcggccgccggggcggcgcagcaggccgccgccaacgtgcagacggtggcggcggcgaccgaggagctgtccgcctcgatcggcgagatcggcgggcaggtcaccaagtcggccgcgatcgccggtcaggcggtgagcgaggcggagcggaccgaccggcagatccgcggcctcgccggggcggcggagcggatcggggaggtcgtgcggatcatctcggcgatcgccgagcagaccaacctcctggcgctgaacgccacgatcgaggcggcgcgggcgggcgagtcggggcgcggcttcgcggtggtcgccgccgaggtgaagggcttggccgggcagaccgcgaaggccacggaggagatcaccgcgcagatcgcggcgatccagggcgagacgacggaggcggtcggcgcggtccactcgatcgggaggaccgtcgacacgatgaacgcgatcgccagcgcgatcgcggcggcggtcgagcagcagcggttcgccaccgggcacatctctcagaacatcgacgaggccgcccgggggaccgacgcggtgagcgcgaacgtggtctcggcctcgtcggcggcggaggcgacgcaccgcgtggccggggaggtcggtgccgcggccggcgacgtctgccgcagcgccgaggccctgcgcgccgaggtgatgcgcttcctcgtcgagatgcgcgccgcctga

SEQ ID NO: 6358 - DNA, 1206 bp, Methylobacterium sp.
atgaccagggaccgcaagctgaaagttgtggctgtcgcgggcagcggcacgctgttcttccacgcggcggtgctcggcaccttcctcgccgcgtccgccgctccgacgccgctgtaccggttctaccaggagacctacgcgctctcccccgtgctcacgaccgcggtgttcgccgtctacgcgctggcgctcctcaaggcgctcctcgtcgccgggtcgatctcggaccatctgggccgacggccggtgatcttcggcgcgctgctcctcgagctggtggcgatggccctgttcacgacggccagcggggcgtggggactcatcgcggcgcgcttcgtccagggcgtggcgaccggcatcgcggcgagttcgctgggcgccgcgctcgtcgacgtcgaccgggcgcgggcccagctcgtgaacgcgatcatgccgctgattgggatggcggcgggcgcgctcgggaccagcgccctcgtgcagtacggcccgcaccccctccacctcgtctacgcgatcctgggcgcggtgttcgccgcgcaggccgctctcctctggctcacgcccgagaccggcgagcgccgcgcgggcgccctgcgggccctgaggccgcgcgtcgtggttccgccacaggccaggcggccgctggccgcgatcacgccgaccaacatcgcgacctggatgctcggtggcttctacctctccatcgttccctcgctggtcgtcgccgcgacgggcagccggaccccgttgacgagcggcgtcatggtcgcggccctgatggtcgccggcgccttcgcggtcctccagcggcgcggccgggacgccgcggccaacctgacgatcgggacgctcgccatgaccgccggtctcgtcatcgtgctcgccggcatgcacggcgggagcgtgccggtcctgatcggcgggaccctggtcggcggggccggcttcgggacgagcttcctcggcgccctcggcacgatcgtcccgctggcgaagccgagcgagcgggcggagctcctcgcgagctactacgtcgagagctacctggcgttcagcctcccggtgatctgtgccgggtatctcgtgcgccggatcggctacgtgacgaccgccgacctctacgcggccgcgatcctcgccatgagcgcggccgggttcctggcgcggcgggcgctgacgtcgcgacgcgtctcgcccggctga

SEQ ID NO: 6359 - DNA, 267 bp, Methylobacterium sp.
atgctgcgcgacaatgtcgagcgaggccgcttcgagctgcaggtcggcggtgacgtcgtcttcgcgacctatcggcgggagcccggccagctcgtcatcagccacgtctacgcgccgccggtcctgcgcggcaccggggcggccggccgtctcatggaaggcgtcgcggcgcacgcgcgcgccgagggcgatcggatcgtgcccctgtgcggctacgcccgggcgtggctgcgcgggcatcggacgcatcgcgacctgctcgcgtga

SEQ ID NO: 6360 - DNA, 1542 bp, Methylobacterium sp.
atggccacatcgctgatccgcagccggcggatgatcacccgcaccctcgaccacgatcgctgggaggagatcgccgacggcgcggttcttcagaaggacggggtcatcgccgcggtcggcacctacgcggacctgcacgcccgctatcccgacgcacccgtgatcgggtccggccgcgagatcctgctgccgggcttcgtcaacggccaccaccatgtcggcctgacgccggtgcagctcggctcccccgacatgcccctggagctgtggttcgtcacccgcatggtggcacgcaacctgaacctctacctcgacaccctgtactcggccttcgagatggtcggctccgggatcaccacggtccagcacatccacggctggatgcccggcagcctggaagaggtcgaggcgcgctccaacgaggtgctgcgcgcctatcgcgacatcggcatgcgggtctcgtactgcttcgcggtccgcgaccagaaccgcctcgtctaccaggccgatagggacttcgtggcgagcctgccggcgccgctgcaggacccgatgaagcgctggttcgagcgcttccagatgtccctggaggacaatttctcgctcttccgcagcctgcatgccggtcaggagggcgcgtcgcgggcgaagatccagctcgcccccgccaacctgcactggtgctcggacgcggccctcgagggcttggccggcctgtccgaatcctacgacgtgccgatgcacatgcacctcgtcgagaccgcctaccagaaggcctacgcggagaagcgcggcggcgggaccgcggtcgagtacctcgaccggttcggcatgctggggcccctcctgacgctcggccacggcgtctggctcaacgagtccgacatcgaccgggtggcggcgaccggcacctgcatctgccacaactgttcctcgaacttccggctgcgctccggcgtggcggcgctcaaccgcttcgaggcgaaggggatcaacacggcgatcggcctcgacgaggcgggcatcaacgacgaccgcgacatgctgcaggagatgcgcctcgtgctgcgcgcccaccgggtgcccggcatggacgaggccgacgtgccgagcatggcgcaggtgctgcgcatggcgaccgtcggaggcgcccgcaccaccccctacggcgacagcctcggcacgatcgaggtcggcaagggcgccgacatggtcctgatcgactgggaccagatcgcctacccgtatctcgacccggagacgccgctcctcgacgcggtgatccagcgggccaagaccggcggcgtcactgcggttctgtgcgagggtgaggtgctctacgcggacggccgcttcacccgggtcgaccgcgacgccgccctgaaggcgctccacgacgacctgtcgcgggcgctctcggacgacgaggtcgagcggcgccagctgtcgaaggcgctgctcccccacgcgcggcgcttctacgccgactacatcgacccgtcgcggcacgagccgttctaccgcccgagctcgcgcgtctga

SEQ ID NO: 6361 - DNA, 807 bp, Methylobacterium sp.
ttggcctctgatcccgcatccgaggacgccgtcgcgtgccgcggcgtcgccaaggtctgggcggccggcaccgcccgcgcccacgaggccctgcgcgacatcgacctgaccgtgcggcccggcgagttcgtggtgttcctcggcccctcgggctgcgggaagagcacgctgctctacctgatcgccgggctcgaacccacctccgggggcgaactcctggccttcggcgaggccgtcaccggtccgtcgccggagcgcagcctgatcttccaggagacctcgctgctgccctggctcagcgtctggcagaacgtcagcttcggcctgtcgctgaagggcgtgccggaggccgagcgccggagcgtcgcccgggcggcgctccagcgcgtcggcctcgccgaggccttcgacaagcggccggacgagctgtccggcggcatgcgccagcgcgtggcggtggcgcgggcgctggccatgcgcccgaaggtactgctgatggacgagcccttcgcggcgctcgacgtccagacccgccagaagatgcaggacttcctgctcgacgtctggcgcgacagcggcgcctcggtgctgttcgtgacccaccacatcgacgaggcggtggcgctcgccgaccgggtggtggtgttcaccgcccgccccgggcggatcaagacgatcgtccgcaacgacctcgcccgcccgcgcgacccgttctcgcccgaggcggaggccttgcggcggcacctcaccgagctcctgcgcgacgaggtcgaccgggccttcgccgagcaggaagcgctcgtctga

SEQ ID NO: 6362 - DNA, 930 bp, Methylobacterium sp.
atggccaccttcctcgcccgcgccgccgccgtcccgcaggaccggccgcgcctcccgctcggtcaacgcctcgcgctgcccgaagggttcgtccccctgctccgccggatcggatggatgctggtctcggtcggttccttcgccggcctctgggagctgctctgggcgctcggcatcgccgacgccaagctcctgccgccgccgcacatcttcctcggcaacctcgccgagcaggcgcgcttcttcaacaccgcgcagcgctggcagatcggcaccgggatgaataccggccccagccccgccatggcggtgctgatcaccgtgctcgcctcgaccggccgggtgctggcgggcctcgccctggcggcctccctgtcgatcctggtcggggtggcgatccgctacttcaagctgttcgagcggctgaccctgccgaccatcacgctcctggcgccggtctcgccgatcgcgtggctgccggtggcgatcttcatgttcgggatcggcaacgccccggcgatcttcatggtgttcatcgccctgttcttcacgatggtgctctcgaccatccagcagatcgacggggtcaaccgcaacttcatcaacgtcgcccggaccatgggggcgtcgaagcgccagatctacgcccgggtgatcgtgccggcgatcctgccgggactgctcgcggtgctgcgcctcaacctgttcggcgcctggatggtggtgctcgtcgccgaggcgaccggcgtcggctacgggctcggccaggtgatcatgctggcgcgcaacaccttcaacccgtcgctcgtgttcttcaccatcacgctgatcggcctgctcggcttcgccttcgacctgctgttccggctggtccaacggcggctgctgtactggctgccgcgcgacgcggggtcctcccttggcctctga

SEQ ID NO: 6363 - DNA, 1053 bp, Methylobacterium sp.
atgtgcgaccgtcacggcgattatcgcgtcccggatctcacgcggttcaagcccagtcgcaggcgcttcctcggcgggaccgccgccgcgctgaccctggcggtgggcccgggcctgaccagcccggccgcggcggccaccggcatccgcgcgacccacggcaccgggttctgcaacctcaacttcttcctggccgaggcgatgcagctcgccaaggatgacgggctgaccatcgacttcgtcaacacgccgaccttctcggatcaggtcaccttcctcggcatgggccaggtcgatgccggcgtgatgccctacacgagcttcatggccctctacgacgcgggtgctcccgtgaagatcgtggccggcggcggcatcgagggctgcgtgctcgtggcccagcccggcctcgacagcccggagaagctcaagggcaagacgctcgggaccttccagctcgatacgctcgaggtcctgccttacgactggctgaagaagaacggcgtcgccttcaaggacatcaccgtccgctacatgggctcgaccccggaggccgtggaggcgttccgcgccggggcgctggacatcatctcgaccatcgagccctacggcacggcgctgctcaccgacgtgaagggcgcggtgaagctctccgacgggaccgacatctacggcaagggctacaccgactgcgtgctggcggtccgcaacgagctgatcgccaagaacccggccgccgtgaaggccctgatcaagggcatgatgaaggcccaggcgctggcggagggcgacccccaggccgccctaaacaagctcgtcggctcctactacaagacctcgatgagcaacgcccagctcgccatgggccggcagccctcggtggtcgacgcccgcaaccagacgcagttcatcctcgaccggaccgattccgtcgccgagatgggctacatcaagaagaagcccggccgcgacgcgatcgactggaccctgctggaacaggtcatcgccgagaacccggacctctacggcaagctcaagctgaagtcggcctga

SEQ ID NO: 6364 - DNA, 954 bp, Methylobacterium sp.
ttggcggacagcgcgcacacggccgatcggtcgatccccccctgcccgatcaccggtgcccccgctctgcgctgcgtcgagcgcctggacgccggcttcctgacgctcctctggcactattccggccgcgtcgatgtcgggccgctgctccgccccgccggcacgttccggctctgggaatctcctacgggactgatcttcttcgatccgccggtggccggcgacgcggccttctaccgggcgttttacggccggatcgccgcgcacgataagctcgctggcccggagacggagcgcctggaattccgccaggccgccgcgcacgtcccgtccggagcccgggtgctcgatgtcggctgcggacacggcgggttccgcgcctacgtgccggacgccacctataccggcctcgatccgaacttctccgccgaggacccgaccggcgcgatcctcgacgagaccgtggaggcgcacgcggcgcgcgtcgggccggtctacgacgtcgcctgcgcgttccaggtgatcgagcacgtggcggacccgctgggtttcgcccgggcgctcgcggcctgcgtcaagccgggtggcgtggtcctgatcggcacgccgctatggccctcgcccaacaccacggtcccgaatttcgtcatcaacgcgccgccccaccacctgacgtggtggacgcccagagccctggaggcgctggccgggacgctcggctgcacgcccgaggccgtccacgccatcggcatggaccggcacgattcgctgatccactggatggccaaggtcagccccgtccgctgccgcgaccgcttcttccggcggacatggtcctgggcggcggcgctcgccttcgcgtacggcgtcggcgccgtcctcgaccgcgtcctgccggtgccgaagcggacccgcccgaacgcgctgctgctcgcggcgcgcaaggcggcctga

SEQ ID NO: 6365 - DNA, 1467 bp, Methylobacterium sp.
atgcaggacgaagctccggacgccaccgccgaaatcacgctggtgaagggggcccggtgggtcgtcgcctgggatccggacagcggcagtcacgtctaccgcaccggcgcggacgtcgccttcgcggacggcgccctcatccatgtcgggccgggctacgcgggtcccgagccggcccggactgtcgacgcctccggctgtctggtcatgcccggcctcgtggacatccacacccacctgttctcggagccgatgaacaagggcatgtgggacgaggtcggcagccagcggctctacaacacctcgctctacgagtacctgccgatcctgcggcccgacgcggaggggacgcgggccgcctacggggtggcgctcgccgaactcgcgctctcgggcgtcaccaccgtctgcgacctcgccctgccgagcgcgggctggctggatctcctcggcgcctcgggcctgcgggtctgcatcgccccgatgttccgctccgggcgctggctcacccgcaacggccacagcgtggactacgagtgggacgcggcggcgggccagcgcggcctggagcaggccctcgccgagatcgcggcggcggaggggcacccgagcggccgcctctccggcatgctctgcccggcgcaggtcgacacctgcacggcggagctgctgcgggacgcccattccgaggcggtcgcgcgcgacctgcgcttccacacccacgcggcgcagtccctgtcggaattccacgagatcacccgccgcaccgggatgacgccgatcgagtggctcgacgatctcggcgtgctcaccgagcggaccatcgtgggccacgggatcttcctcgatgaccatccctggacccactggcacagcccgggctcggacctgcgccgcctggccgagcgccgcgccacggtcgcccactgcccgacggtcttcgcccggcgcggcatcgcgctccaccatttcgggcgctacctccaggccggagtcaacatggggatcggcaccgacgtctacccgcacaacatgctcgacgagatgcgcctcgtctcgtacctcgcccgggtcgtcgccgagaatccccgcgacacccgcgcggcggacgtgttccacgccgccacggtgggcggcgccagggcgctcgggcgcgaggacatcggccggctcgaaccgggctgcaaggccgacttcgtgctcgtggactgcgggcatccggccatgcgcccgtgccgcgatcccgtgcagtcgctgatctactcggccggcgaccgcgcggttcgacaggtcttcgtcggcggccgcgagatcgtccgcgacgggcgcgccctgacgatcgactacgccgccgccgcggccgcgctggaggaggcgcagggccgcgcgctcgcgcaggtccggcagctcgactgggccgggcgcggccccgacgccatcgcgccgccgaccttcccggggctgtga

SEQ ID NO: 6366 - DNA, 681 bp, Methylobacterium sp.
atgcggcctcgcgacaccaccgagcccgcgcgcatcctgatcatcaacccgaacgcgtcccgggcggtgacggccgccatcgacgccgccctggcgccgctgcggctgccgggcggccccatcctcgcggtgaccgacctgccggagggcccggagagcatcgcgacccagcgggacgcggattcggtggtgatgccgctcgtccggtgtgtggcggacgatccgtccgacgccttcgtgatcgcctgcttcagcgatccgggcctgcacgcggtccgggaggcggcgagcggtcgcccggtgatgggcatcgccgagtgggggatcctgcgggccctgacgctcggggagcgcttcggcatcgtggccctgtccgagggcagcgtccggcgccagcgccgcacggtgcgccagatgggcctcggggatcgctatgccgggagccggccggtggaggcgcgggcctccgagacggcggacgccgcgatgggcccgcgcctgatcgcggccggtcggaccctggtcgagcgcgacggcgccgacgtggtcgtgctcggctgcgccggcatggtgcgccaccgggccgccgcggaggccgcgatcgggtgccccgtcatcgagccctgccagcaggcggccgccgcggccctcggggccgtgctgctccgggccgccccgtga

SEQ ID NO: 6367 - DNA, 1536 bp, Methylobacterium sp.
atgtccgccatgcccacccgcgcccccatcccggatcaggccttcgacgtcgtcatcgccggcggaggctccgcgggcgccgtgctcgcgcgccggctcagcgagaatccgaaccggacggttcttctgctggaggccggaccggcctacgcgccgggggcgtatccggacgtcatcgcgaacgcgaactgggtcggcggcgacgcggcgcacgactggggctaccacacccaggaccgctccggcctcggccacgacgtgcgcgcgatccgcggcaaggtgctcggcggcagctccggcgtgaacgccgcggtcgccatgcgggcgcggccgtccgatttcgcccgctggaccgcgcgcggtctcgacggctggtcgtgggacgaggtgctcccggtcttcagggcactggagaacacgccggccggcgacgacgctcggcgcgggcgctccgggcccttcccgatccgccagcgcacgatggaggagatcaccccctccatgcgcgccttcgtgctggccgcggaggcggccggcctgtcccgcatcgccgacttcaacggcgcggagcagcacggcgtctcgccctacccgctgaacgtggtcgagggccgacgcgtcaacacgggcatggcctacctgactgaggacgttcggcgccgaccgaacctcgccatcgtcgggggcgccgaggtcgacgccgtgctgttcgacggccggcgggcgcgcggcctccggcttctgggcggcgcgacggtggaggccggacgggtgatcctctcggccggggcattcggcagccccgccatcctgatgcggtcgggcatcgggccggcggcgcacctgcgcgacctcgacattcccgtgctgcaggacgcgccggtcggcgagcggctcaaggagcatccgttctactacaacgtctacgcgctcaagcgggaggtgcgggcgatggacccggtcgcgggcgcgatcatctggacgcggtcgcgtgaggccgccccggacgagttggaccttcacatctcggggacgcacatcttcgatccggcgcagagcccgaccggcggggccatcgtactggcctgctcggtcacgctgccgaggtccgtcggctcggttcggctgacgagccgcgacccccgcgccatgccgctcatccgctacaacttcttcgaggacccggccgacctgaggcgcatgttggaagcggtgcgcctgtcgcggcgcatcggccggacggccccgttcagcgacgtggtcgcggcggagctgtatcccggtcccgatgtccgtgacgacgacgcgctgcggcgagccgtgctctcggcagtcgacggctacgcccacccgacctcctccgtcccgatgggcggccgcgacgacccgtgggcagtggtcgatgggagcggggcggtgcgcggggtggacggcctgaacgtcgtcgatgcctcgatcatgcccgacatcgtctcggcgccgacgaatgtgaccacgatcatgctcgccgaggcgatcggccggaggctcggctag

SEQ ID NO: 6368 - DNA, 501 bp, Methylobacterium sp.
atgaaggatcgctggctcggtctccgtgccgacgactgcgtgacgccgtcgggtcacatcgtcgatccctattacgtgctcgagacgccggacatcgcgctcgtgctgggcatcgacgcggccgatcacgtcatcctcgtacgccagtaccgtcacgcccatgggggcccgagcctggagcttccgggcggggccatcgaccccgccgaccccgatatcctcgcggccgccgagcgcgagatgcgcgaggaaaccggctacatcttcgccgatgccgagcgcgtggtcactctgaacgcagatccggcccgctacgccaaccgcatgcatctcgtccgcgcgcgcgtgaccgcggccgggccggcgcgtccggatcccgccgaggacatcgccgtggtgcgcgtaccgcgggccgaggccttacagctcgcccaatcgggcgccatcgtcggagccgtgcacgccgccatgctcctgatcggcctgtccagcaccggatga

SEQ ID NO: 6369 - DNA, 759 bp, Methylobacterium sp.
atggattccatggaacgagcgaacggcacgacgcgtctgggcatgctgacgccctcgtcgaacagcgtcctcgagccggccacggcgcatctgctggccggcgtcgcgggcgtcagcgcccacttcgcccgcttccgcgtgacggagatcggcctgtcggcggcggcgctggaccagttcgaccccgagccgatcctggcggcggccgaactgctcgccgatgcccgcgtcgccgcgatcctgtggaacggcacctccggcgcgtggctcggcttcgacgcggacgagcgcctgagcgccgcgatcaccgaccggaccgggtgcccggcctccaccgcggcgctcgccttccgcgacctgttccgcgcccgggatttccggcggatcggcctcgtcacgccctataccggcgacgtgcagcgccggatccaggccaactggggcgcggccggcttcgactgcgccgccgagcgccacctcggcctgtcggagaacttcgccttcgccgagaccggcccggaggccatcgccggcatggtccgggcggtggcggccgagggcgtcgacgcggtggcgatcgtgtgcacgaacctcgcgggcgccgcgctcgccccggccctggaggccgaactcggcgtgccggtggtcgattccgtggccgtcaccctgtggaagggcctggagctggcgggctgcccgacggcgcatctcgccgcgcacggccgcgccttcgcggcggacggggcgggccgcccgtga

SEQ ID NO: 6370 - DNA, 915 bp, Methylobacterium sp.
atggacaccgcgcccgacgatccccgccggcccgagaaccgcctcgcctaccgcgccgccgtcgaccggccgcgcctgacgctgccgggcggcaagcacgtcgcggtctggccggtggtcaacgtcgagcactggctgatcgacaacccgatgccgcgccagatcctggtgccgccgaccgccgcgagcctgctcccggatatccccaactgggcgtggcacgagtacgggatgcgggtcgggttctggcgcttcctcgaggccttcgccagccgcggaatccgcccgacgctgtcgatcaacggctcggtctgcacggcctatccccgcgtcgccgaggccgcccacgcggccggctgggagttcatggcccacggcttccaccaggtcccgacgcaccggatcccggaccagccggcgatgatcgctcgcaccatcgcggcgatcacccagaccacggggcgcccgccgcgcggctggctgggaccgggcctcaccgagaccctcgacacgcccgaccacctgcgcgcggccggcctcgagtacgtcggcgacttcgtggtcgacgaccgcccctgccgggtggcgacgcgcacgggcgacctcgtcgccctcccctactcggtcgagctcaatgacatcccgctgctggccatccagcaccaccgggccgacgagttcgtggaacgggcgctcgcccatctcgaccggctcgccgccgaggccgccggccctggctccctcggcggggccaaggtgatgagcttcgcgatccacccctacatcaccggcgtgccgcaccggatcggcctgctggagcggctgctcgacgccatcctggcccgcgacgacgcggtgttcatgcagggggtcgagatcctcgactggtaccgcgccaccggcgacgaatcctga

SEQ ID NO: 6371 - DNA, 300 bp, Methylobacterium sp.
atgtccaggcagcgcaagcgggacgcggtgttgcggcttctgcgtggtgaggacctggagagcgtctcgcgcggcctgggcgtgacggcggcgaccttgtcgggctggcgcgatgctttcctggcggcgggcgaggccagcctgtccacccggcccctcgatgcggacgcgctggagagcgggcgtctcaaggccaagctcggcgagatgctgcttgagcgcgagctgctggaggccaaggtcgccgccctggaggcgcgtggcgccggccctttggcccgcaggcggtcgcggccatga

SEQ ID NO: 6372 - DNA, 402 bp, Methylobacterium sp.
atgcctaaattctacttccacctccgtggtccggacggtctggaccacgacgacgaaggcttggatctcgccagcgttgaggcggcatatcttgaggccttcaaggctgtgccgggaatgggctccgatctggcctccaccgcgaagaaccctatccggtatggcttcgagatcaccgatgcgcatggcaccgttctgatggcggtgcctttcgctgaggtactcgatcgcgggcaaaagcgcacaaaacaaccggccaagctacagctccacaaaggtcgagcggagatgaggcgcacggcaggactgattgtagagcttcgcgaagcgcacgcgaagttgaatgtgacgctggcagagacccagcgtctcctcgatatcgcgaagcgaactggtcgctag

SEQ ID NO: 6373 - DNA, 363 bp, Methylobacterium sp.
atgcagagacaaaccctgcgggactgggtgcaccgctacaatgtggacggcgttgcagggctgatggatcggccgcgtcccgcacgtcccggcctgctgagtggggcgcaacgggcggagttcgaccggatcgtcgaggcgggtccagacgtggcggcggacggggtggtgcgctggcgccgccgcgatctcaagcgggtggtcgaggctcgcttcggcgtggtcatggccgagcgcacgatcggggatctgctgcacgcccgcggcttccgccacgtttcggtgcggccgcgtcacccgaactgtgacgcggcggcccaggcggattttaaaaaaccttcgccgcgcgggtcgcgcaggtga

SEQ ID NO: 6374 - DNA, 150 bp, Methylobacterium sp.
ttggatgactacgtcaccgccgacaatctggttcaggtgatcaaggtcttcatcgacgaactcgatctgggcgccctcggcttcacccgcttcgagcccgcggcgacgggacggccagcctatgatccggccatgctactgaagctctaa

SEQ ID NO: 6375 - DNA, 1602 bp, Methylobacterium sp.
atgatgaccagaatcaaggcgctgttactgggctcctcggccctgatgatcccgatcggcggtgcgtacgctgccgatctcccgacgtttaaggctgcgccggtcgagttcgtaagcgtttgcaacgcctacggcgccggcttcttctacattcccgggaccgatacctgcattcgtctgtccggacgggcgcggtatgacttcctgtatcagaccagcaaggttcgcacgggcggcggcggcgacctcaccggctatctcggcctgatgcgtctgaacctcgattcgcggacccagaccgattacggaaccctgcgcgccttcctgcgcctcgatgtcgccaaccgcagcggcccgttcctgacctcgggatcccggcagcgcgagagcttggccatcgcgggcctcggcgccgacgccttcggccgcacgcagacctatgtcaacgccgataaggccttcattcagttcgccgggctcaccgcgggccgcgcgtcctccttcttcgacttctatgcgcacgacttcgagctgatcggcggcacggccggctcggatacgttcagcacgaacctgctcgcctactcggcgattctcgggaacggcatcacgctgaccgcctcgatggaagatccgacctaccggcgcttcccgatcttcggcaccggttcggccgtcggggccttcacggccggtggcggcttcgcgggctacagcaacgccttcaacccgttcaccccctcgacctggctggcgccgatcgtcgtcggtcccggcaatgtcgccttcgtcgacgtcacccagaagagccgcatgccggacttcgtcggcgcggcccgcatcgaccaggcctggggctcggcgcagctctcggccgccgtccacgagatcaatgccggcgatgccggcagcacggtcgcgggcatcaccaccgccacgaccggcctgggcatctcgccgacgggacgcgcctcgaacgcctacggctgggcggtccagggcggcctgaaggtcaacctgccgttcatcgcgacgggcgacacgctctacctccagggcgcctacgggcagggtgccatcgcctatacgggcatctccaactacaccgcgccgtacgacgccctcggcgcggcgccggtcggcggcggctcgttcgcgcaatactacgccgacgcggtgctcgaccccgcgaccggccgcctcgaactgtcgacctcgttctccgctgtcgcctccctgctccattactggtcgccggcctggcgctcggccttcttcggaagctacgcgcagatcgactacaactccaaggggcgcaacgcgctgggcctcctcggcttcggcttcgccccggccggcgccagtgcgtcgaatgccctggccttcgccacgagtcccatcctgcggggcaacaaccagatgatcaccggcgccagcttgatctggacccccgtgaaggatctcgatatcggcgtcgagggcgagtacatccgcacggcgctcaacagcggcgtcacgccggacatctcgaagaacgcgctgcgctacgtcaattcgcaggatgcggcccaattccggttccgcgtgcagcgggatttctga

SEQ ID NO: 6376 - DNA, 294 bp, Methylobacterium sp.
atgaagaacatcgtcctcgcctgctcgatgggcgcgatgctgatcgcgggacctgctctcgctcaggacggtggcgcgacaatagaccccagcctcatcgtccggaccaacggcagcggcctcgacgcgtggtccgcctccgagggcaacgacaaggcgggcggcatgtgggagggggcgaccggctacagcgccgcgatccagcggcccagcgcggtcgagaccgtcccggccaatcgccagtggagccatctcaacagccgcgagcgccgccgcggccagcccgcctactga

SEQ ID NO: 6377 - DNA, 1386 bp, Methylobacterium sp.
gtgcgccttcttgaggtccggcgcaccagcggcttccgggtcgcgtgcctgttcttcgcgaccttcgggaccgcctcgctggcactctcgggcttcctctacgtcgacacgcgcagctacggccgcaaggccgcgttcgagtgggtcgagtgggaatcgaagcacctcctgaacctgtcgccgcgcgcgctgcgcgagcggatcgacgcgtccgaggatttcgccgagggcggccgcccgctcgtcctgttcgggcccgaccacgtgcgccgggccggcgcgccgatcgccttccccgacagggcgccgatcgggaagccgttcatcctggcacagccgctggatcaccgcagccgcacgctcttcagccagctcaccgagcttccgagcggcgagtacgtgctggtcagccgctcggcccaggatctccagtccctcgagaaggcgctggtcgagacctttgtctggggcatggccgccaccatcgtgatcggcctgatcggcgccgtcgtgttcggcgccggctcgctgcggcagaacgatgcgatcaccaaggcggtcgagcgcatcatgcgcggcgacctgagcgagcgcctgccgacgcgcggcgtctcggccgacctcgctcacctcacgcgcgtcgtgaacgacatgctcgaccagctcgagcggctgatgctggagatcaagggcgtcaacgagaacatcgcccacgacctgcgcaccccgctgacccgggtggtcggcacgctggagcggtcgctgcgcaaggccgacagcgtcgcggccttccgcgccttcaacgaggacgtcctcgccgaggtcaagagcatcgtcgtccggttctcggccctgctgcgcatctccgagatggaggaccgcctgcgccgatcgggcttcacccaggtcgatctcggccggctgctcgaggatgcggtggagtactacgagcccctggcgatcgagcgcgacatccgacttctctgggagcggcctgacggcccgtgcgcgatcgagggcgaccgcagcctgatcttcgaggcggtgagcaacctgatcgacaacgccctgaagttcacgccggccggcgggcaggtgacggtcgcgctgctccggaatccgacggggatccaggtcaccgatacgggctgcggcatccccgcagaggagctgagcgccgtgcgcgcccggtaccgccgcggtgcgctgaagaccgacaagagcggcttcgggatcggcctgagcctcgtcgattccatcgcgcggctgcacagcgccaccttcgacatcgcctccgacgggagcggctgccgcgtgaccctcagctggacccacagcgtcgcggggcacccgtcgatcgacctcctgccggccgcatccctctga

SEQ ID NO: 6378 - DNA, 669 bp, Methylobacterium sp.
ttggtagtcgaggacgaccggcgggtcgccgcggagatcggttcggccctcgcggaatacggatttcaggtcgacgaagcccccagtggcagcatcggactacgcaaggccctggacggtaactttgacgtgatcgtgctcgaccggatgctcccggagatcgacggcctgtcgctgctgaccgagctgcgcgccgcgaaggtctcgacgccggtcctgatcctcagcgccctgtcggccgtcaacgagcgtgtcgacgggctgcgcgccggcggagacgactacttggccaagccattcgagttcatcgagctgaccgcccgcgtcggcgcgctggcgcggcgcaagatggccgcggaggcggtgaacgaactcgtcgtcggcgacctgcgcctcgacctgatcgagcgcgtcctccactgcgggaaccgggaaattgagctcctgcccaaggagttcgcgattatcgagttcctgatgcagaacgccggcacgctggtgagccggaagatgatcttcgaatccgtctggggctacagcttcaatcaccagtccagcgtcatcgacgtccacatcggcaagatccgcaagaagctcgatcccgacgggctgaacccgcggatccacacggtgcgcaacacgggcttcatcctccgtgcgccttcttga

SEQ ID NO: 6379 - DNA, 1386 bp, Methylobacterium sp.
atgacccgtttcaacgacgcccccgggagcggcgccgaggctgccgcgcgggcgcaccagcacgcggtcgagatcgacccgctgcggcaggacggggccggcgaggccctcgtccacgcggtgccgccgccgccgcgcaagcgcccgttcctcgtggcgttcctcgcgctcggcagcgccctcgggctcggcgcctggcaccattgggaaacctaccaggcctccctggagacccaggccgaggccgtgaacttcgttccgacggtccgcaccgggccggcgcaggtggatgacgggcccatgacgctgaccctgccgggccagaccgaggccttcgaccatgccgacatcttcgcccgcgccaccggctacatcgccgagcgccgggtcgacatcgggtcgcgggtcaagaagggcgacctgctggtccggatcgccgcgcccgacctcgaccagcaggcccggcaggccgaggcccaactcggccagttcaaggcgcagctcgccgtcgcgcaggcggatgtggagcaggccaaggccagcgtgacgctcgcgaacgtgaccgacgcccgcaccgcgaccctggccggacaaggctgggcctcgaagcagaacgccgaccagacccgcgcggggatgctgaccgccaccgcgaccctcgccgccgcgcaggcgaaggtgaaggtcgcggaagccaacatcaccgcccagcaggcgaccgtcgaccggctccgcacgctgaccaccttcgagaacgtcgtcgcgccgttcgacggcatcgtgaccgcccgcaaggtcgatgtcggcgacctcgtccacggcgatgccggctccgggacgccgctcttcacggtcgacagcaccgatgtcctgcgcgtcgcggtgcaggtgccgcaatcggccgccgtgggcatccgcgacggggtgaaggcgcgcgtccaggtcgcgcagatcccggaccggaccttcgacggcacggtctcgcgcagctcggtggctctccaatcctcggtgcggacgctggacacggaggtcgacgtcgccaatcccgacggaatcctgcggccgggcctctacgtcgccgtcaccttcgcggtgccgcgcacgcatccgcgagtgatcgtgccgtccgaggcgctcatcttcgacgcggaggggacgcgcgtggccgtggtcggggcggacgacaccgtccggctccggccgatcacgatcgcgcgcgatctcggcacgcgcctcgagctgcgcagcggcctcgacagcggcgagaccgtcgtcctcaacccgcccgccggccttcaggacggcagccgcgtcgtcccccgcggctccgtcgcctcccaggtcccgacagccaagctctccgagcaggcgagcgcggagtga

SEQ ID NO: 6380 - DNA, 1215 bp, Methylobacterium sp.
atggcgtcgatccggagttgcgtgctctcggtcgcgatcggcttcgccgcgctcgccgggccggccgttgccgagccgatccgcgtcaaggtcggcgtcctcaacgacatgtccggcgtctacgccgataccggcggcaagggctccgtcgtcgccgcgcagatggcggtcgaggatttcgccaagaccgagccgggcgtgcaggtcgagatcgtctcggccgaccaccagaacaaacccgatatcggcgccgccgtcgcccgccagtggtacgaccgcgacggcgtggacgcgatcctcgacgtgccgacctcctcggttgcgctggcggtgagtcaggtcacccgcgagaagaacaaggtcttcatcgactcgggggccggcaccacggagctgaccggcaagcagtgctcgccgaacacgatccagtggacctacgacacctacgccctggcgcacggcacggccggcgccatgctcaagcgcggcggcgacacgtggtatttcctcaccgccgactacgccttcgggctctcccttcagaacgaggcgaaggccgtgatcgatacgggcggcgggcgcgtattgggcgccgcgcgggtcccgttccccgccacggacttctcctcgttcctgctgcaggcgcaggcctcgggcgcgaaggtggtgggtctggccaacgcgggcggcgacacggtcaacgcggtcaagcaggcgcacgagttcgggctgaccgacggcggccagaaactcgccgccctgctgatctacgccgtcgacgtccacgcgatcggcctgcagaccgcgcagggcctcgtgctgacggagtcgttctactgggatctcaacccggagacccgggccttctcggagcgcttctacccgcgcaacggcaacagcatgccgacgatgaaccacgcgggcgtctatgccgggctcctgcactacctgaaggccgtagcggcgacgaagtcgacggacccgcagaagaccatggcctggatgaaggccaacccgaccgacgacccgctgttcggcaagggtgtggtccgggcggacgggcgcaagatccacccgatgtacctgttcgaggtgaaggcgccgtccgagtcgaagggcccgtgggacctctacaaggtgctggagacgatccccgccgagcaggccttccgccccctcgccgagggcggctgcccgctcgtcgccaagccgtag

SEQ ID NO: 6381 - DNA, 1626 bp, Methylobacterium sp.
atgcagaccctgcgcggcgccgacatcgtggcccggaccctggaggcgctcggcgtcacccggatcttcaccctgtcgggcaaccacatcatgccggtcttcgacgccctgctggagaccgggatcagcctcatccacacccgccaggaggcggcctgcgtccacatggccgacgcctggggccggctgaccggcgaggtcggcgtcgccctggtgaccggtgggcagggccacaccaacggcgcggcggcgctcaccacggcgctcgcggccgagtcgcccgtgctgctgctctccggccatgcgggcctgtcggagctcgggcgcggcgccttccaggaactggcccaggccgacatcgcccggccgatgaccaaggccgcctggaccgccgggtcggtcgccgccctcgggccggacctcgcccgggccttccggatcgcccgggaggggcggcccggcccggtccatctgagcctgccggtcgacctgctagagacggccgtccccgccgcctcggtgcggatcccggaccgggccgcggccgccatccggatcgccgagccggcgccggatctcgtggccgatctcctcgctgccctcgcgggggcggaacggccgctgatcgcctgcggcccggccctgtgcgacgcctccggccgggctgccatggcaacgctggaagaaactctcggcctgccggtcgtcggcatggagagcccgcgcgggatcaacgatccggcgctcggcgccttcgcggagatcctggcgcggaccgatctcctcgtgctcctcggcaagccgctcgacttcaccctgcgcttcggcgcggcgcccgccctcgcgcccgactgccgcttcgccgtcgtcgatcccgatccggcgctgttggcccgcgcgccggccgaccgcctcgccgtctcgggcctcgccgatccgcggccggtgctggcggcgctgaccgcgcgcgccaccgccctcccccgccgggaggcctggcaccgggaggcgcgggccgccctcgcctaccggccgcccgcctgggcggagctgcgcgggggtggtgcgcgcctgcacccggtggagctgtgccgggcggtcgacgccttcctggaacgccaccccgacggcacgctgatctgcgacggcggcgagatcgggcagtggccgcaggccctggtccgcgccgggcgccggctgatcaacggcgtctcgggcacgatcggcgcgtcgatccccttcgcgatcgccgccgcgctggagcgccccggtgcccccgtggtcgcggtgctgggcgacggcaccttcggcttccacatggccgagttcgacaccgccgtgcgctatcgaatcccgttcgtcgcggtggtcggcaacgacgcgcgctggaacgccgagcaccagatccagctgcgcagctacggccccgagcggacgcgccactgcgacctgctcccgacccgctacgacgcggtcgtccaggccctcggcggcttcggggtgctggtgaccgaggcggccgagcttccggcggcgctggaggcggcccaggccagcggcctgccggcctgcatcaacgtgatgatcgcgagcgtggcggcgccggtgatccgccgccccggctga

SEQ ID NO: 6382 - DNA, 744 bp, Methylobacterium sp.
atggtcaacgagcacgtcgcgatccggaccgaggacggcgtatgcgggacgcacgtcgtcgcgccggacggcgcggggccctggccggccgtgatcctgtacatggatgccggcggtatccgaccggccctcgtcgacatggcgcggcggctcgcgaccggcggctatctcgttctgttaccggacctcttctaccgctacgggccctatggccccttcgtccccgcggacgtgttcaaaggcgatttccgagcgatcctcggcccgctgatggcgacgacggacaatctcaaggccgcgaccgatacagcggcgctcctcgcctatctcgacacgcgcgacgacgtcgcggggcgcgcggtcggggcggtgggcttctgcatgggcggccgcatggccatcacggcggccggcacgtatccggaccggttcgccgccgtcgccagcttccacggcggcaatctcgcgaccgaggaacccgcgagcccgcatcgtctggcacccgcgctgagggccgaggtgtatatcgcggcagccgagaacgacggaagctacccgtccgcgatggccgagcggctggagacggcgctgtcgcgagccggtgtccggtatgcagcggagacctatcccgccgcgcacggctggatgatgccggatttccccgtccacgatcgcgtaggcgcggagcgcggctgggcggcgatgagcgccctgttcgaccgcaccctgcgcagcacgggctga

SEQ ID NO: 6383 - DNA, 792 bp, Methylobacterium sp.
atgccacccgccgaggggacacccatctggttcgagctgaacgcgtccgacccggacgccgcgcaggccttctacgaggcggtcgccggctggcgcgtcgcgccgtcgccgatgcccgagcacggcggctaccggatcgcggaggccgacggggcgcccgtggccgggatccggcggccgatgcccgaggcccccggcctccccggctgggcggtctacctcgcgacctcggacgtcgacgccctggcttcccgcgcggtcgatctcggcggcgcggtccggttcgggcccgtcgacatcccccatgtcggccgcttcgccatggtgagcgacccgcagggcgtggtcttcgccgcgatggatccggcccgtcccggcgcgagccgggccttcgggccggtgccgctcgagacggagcggacgcgcggccacggcgtctggatcgagctcgccacccccgatcccgcggcggccctcgccttctacggggcgctgttcggctgggagaagctcggtgccatgccgatgggcgacttgggcgagtacgccttcatcgggcggggcgacctgcgccccggcgcgatgatgtcgagcgcggccaccggcgcgccggcccgctggaactggtacatccacgtcgccgacatcgacgccgcgctcgcgaccgtccgggcggcgggcggcacggtcctccagggacccgacccgatccccggcggcagctacgcggccaacatcgccgatccggcgggccaccagctcggcctcgccggcccgcggcaagccacgtga

SEQ ID NO: 6384 - DNA, 144 bp, Methylobacterium sp.
atgagcaagtcgaagcctccgaccaacgcgctcctgacaccggagaagcgcaccgaggacgtcgatcagacgatccgtcctctgagccttgccgagttcatcggtcagcgcgcggcgcgggcgaacatgcaggtgttcatcgag

SEQ ID NO: 6385 - DNA, 1434 bp, Methylobacterium sp.
atgacccggatcgacgcggacggaccgctctggaccctctcggccgccgccctgggccgccgctacgccgccgggacggcgagcccggtcgcggccccccgcgcctgcctggagcgggccgaggccgtgaaccccacgctcaacgccctcgtcgccgtcgatcccgagggcgcggagcgcgccgccgcggcgagcgccgcgcgctggcgggcggggcagccgctcgggcccctcgacggcgtgccgctgaccgtcaaggacagcctgaacgtcgccgggttcgcgacgggctggggcagccggctctacgcgggggagggggccgggcaggccgtcgagcgcgacgagacgccggtggcgcgcctgcgcgcggcgggggcggtgatcctgggcaagaccaacgtcccggagctgaccgtccagggctacaccggcaacccggtccacggggtcacccggaatccgtgggatccggcgctgacgccggggggctccagcggcggcgccgtcgcggcggtggcgtccgggatcgggcccctggcgctcgggaccgacgcgggcggctcgatccgccgccccgcctcgcataccggcctcgtcggcctgaagccgacggccggtcgggtgccgcggaccggcgggctgccgccgatcatgctcgacctcgaggtggtcgggccgatggcgcgcaccgtcgacgacctcgcggcggccatgcggctcctcggggcggtcgacccggatgccgtcgcgccgcacggcttcggcccgttcgggaccaccgcggtgccggagcgcccgctgcggatcctccacgtcccggccttcggcacggccccggtcgatcccgacatcgccgacagcgtcgccgaggcggccgggcgcctcgccggcctcggccaccgggtcgagattggccgcttcgacgcggcgagcgccatcacggaggcgtggccggtcctcggccaagcgggcatcgcgtggctgatgcgcgcgcatccgggcggacgcgacgcgctcggccccgacatccgcgccctggcggaggccggggcggccctgtcggcggccgacctgttcgaggtgcagcggatggcgctggcgctgcgccgggacctcgccgcccagttcgccgaccacgacgtcctcatgacccccgcggccgcggcgctgccctggccggcggaggacacccatccgccgcgcatcgccggggtgccggtgggcccccgcggctcggcgaccttcacgggcttcgtcaacgccgccggctgcccggggatctcgatcccctgccgaccctcgggcgccgggctgccgatcgggttccagctcgtggcgccctggggcggcgacgagaccctggtcgcgatggcggccgcctacgaggcggcccatccctggcggatggtctgggaggaatcggctccgtga

SEQ ID NO: 6386 - DNA, 201 bp, Methylobacterium sp.
atggcctacgatcgtcctgcctggactggctccacgccctacgatgtcgaaaccacgggctcgttcggcgccccgttcggcggccgctacgaccgcgacccctggacctgcccgcagagctcggccgcggagggcaatgccaaccagcagaacttcccggtcaagcagtacggccagaccgccggcggcaaccgctgctga

SEQ ID NO: 6387 - DNA, 1245 bp, Methylobacterium sp.
atgagcctgcacctggacgatcccgtcaccgacccggtcgaagatcggctgccgccgccgccggcgccgccgcaccggatccgctcggacgccgaggcgatcgcggccgcgcgggccgtggcccggatcttcgcggcgggcgcggccgagcgcgaccgcgaccggcgcctgccctgggcggagatcgcggccttcacggagagcgggctcggcggcatcacggtgccgcgcgaacacggcggcgccgaggtctcgcacgcgacgctcgcggaggtcttcgcgatcctcgccgccgccgacggctcggcggcgcagatcccccagaaccagttcggcgtcctggcgctggtcgcggccgccgccagccccgcccagcaggcgcggatctaccgggacgtgctcgccggccaccggatcggcaatgccgggcccgcccgcaacggcaaggcgatcaccggcgtggacacgcggctgaccgccgggccggagggcccgcggctcagcggcacgcgcttctactcgacgggcgcgctcttcgcccactggatcccgacgcgcgcggtcggccccgacggcgggccgctcctggtcttcgtgcgccgggacgcccccggcgtgcgggtggtggacgactggcagggcttcggccagcgcaccacggcgagcggcagcgtgatcttcgcgcaggccccggtcgaggcggagctgacgatcgacctcgcgcccctggccgggcgcccgggcctgttcgggccggtctcgcagctgatccacgcggcgatcgacgccgggctcgcccggggcgcggccgccgccgccctcgacttcctgcgcacccggacccggccctatcccttcaccgccgagaccgtcgcggaggatccccacatcctcggcgaggtcgggcggctcaccgtcgacctgcacgccgccgaggaggtcctggcccgggccggacgggcgctcgaccggatcgccgcggccccagtcaccgcccagagcgcggccgaggcctcggtggcggtggcgcaggccaagatcctcaccaccgaggcggccctggaggcctccgagcggctgctcgagctcgccggcgcctcggcgacccgcgacgggtacaatctcggccggtactggcgcgacgcccgggtccacaccctgcacgaccccgtgcggtggaagtaccacctcctcgggaaccacgccctgaacggcgtgctgcccgcccggcaccagtggaactga

SEQ ID NO: 6388 - DNA, 963 bp, Methylobacterium sp.
gtgccgctgcgacggcgtccgacggccgcgcggcggccgagcgagaagcggatcgcgccgaccgtctcgtctcccgaccacggcctttccgaactcgctcagatcgaagtcaatctcgaaaccgacaccagcaccctgtgggccttcatgcgcccgcagggccgcccgtgccagaatcccgagatgctggccgacttcagccgcctgcaggatggcatcgagcgcggtttcggcaacggcagcctcgacctgaactactttgtcttcggttcacgatttcccggcgtgttcagtctcggcggtgatctgagcctgttcgcgagcaagatccgcgcgggcgacgaggccgcgctggtcggttacggcaacgcgtgcgtcgatgttcttcatcgcaacatgaacgcgctgaacctgccgatcatcacgatcggcctcgttcagggcgacgcgctgggcggggggttcgagggcctgctctcgttcgacgtgatcatcgccgagaagggcaccaagttcggcttcccggagatcctcttcgggctcttccccggtatgggggcctacagcttcctcgcccggcgtctggggaccatcagggctcaggagatgatcctcgatgggagaacctacaccgcggaggagatgcacgaactgggaatcgttcacgtcctcgccgagcgtggccagggcgaagcggccgtgcgcgcgtacatcgccggcaaccaccggcgccgcaacgggcagcaggcgatctatcgagccgcccgggaggtcaatcgcatatcgttggaggaactgagaaagatcgtctcggtctgggcggccgccgcgatgaatctcacggacagggatctgagcatcatggagcggctcgtcctggcgcaggacaggctcaggggaaaagcccaggccgctcaggcccgcacggtgaccgcgcggggactggcggcgtcagctcgctag

SEQ ID NO: 6389 - DNA, 927 bp, Methylobacterium sp.
atgccggggcctgagcgcgacatcgtcataggggcggacggcttcctcgggcgcaacctcgtcccgcggctccgggccgagggccgcgaggtcgtcgagatcggtcgggcggcgggcgacctctccgcgtgggcgaacgtcgagcgggcgttgcgcgctgcgcccccggccggccggatcttccacgtggtgacccgccagcgcaccggcgcggtgcagtacgacatccagggcgagctcctggcgatcaacgcccgggtccacctgaacgtccttgaggcgtggcgcctgttccagccgcaggccaagctcgtctccacgggctcgtcctgcacctatccggaatcggcggagccgcttcccgaggcgcggttcgggcagggacccacgcacccgtcggtgatcggctacgggctcgccaagcaggtcctggcgacgggctcggcggcctacgcgcaccagtacggcctgagcttcctgcactgcgtgctggcgaccctgtacgggccgcacgacaacaaggcctccgaccgcagccacttcgtcggcgccctgctcaaccgggccgtgcgggagaaggcggcgggcgctgcgcagttcgaggtctggggcaacccgcagaccgtccgcgaggtgctgtacgtcgacgaccagatcgacgcgatcctggcggcagaccgggcgttcgacaacgagatcctcaactgcgccgccaacacgcccgtcaccgtcgaggcggtggcgcaggcggccctggccgccctcgactggtccgtgcccctggtgagtccgccgggctcgttccagggcgcggcctacaagatgctcgactcgtcgcggttcctcgaccggaccggctggcggccgcttatcgatctcgaggcgggcctgcgcaggctcgccgcggcggagtacgccgagcactga

SEQ ID NO: 6390 - DNA, 954 bp, Methylobacterium sp.
ttgcccgagaccgtcgtcgtcgtcggtgcgaccgggttcgtcggccgcaacctcgtcgcgcatctcgccgaccgcgtgccgcggctgatcgcggtcagcccctccggccgcgcggtgccgggggcgcatgaagccgcgcgcttcgatgccctggaggcgctgtcggtccccgccgacgcgatcgttgtcaacgtcgccgcgcagcgctacgacgccgacaagttcgagacggcgcagagcgacctgctgaccgggaatgccgagatcgccaaccgcctctaccggttctgcctgacgaagggcatccgcgaagtgcgcgcggcctcgagcgtcgcggtctacccggcagccctcgatcccctcgacgacgcgcaggctgtcgacctcaacgcgccgcccaaccggaacgaggccttctacgcgtggtcgaagcgctggtccgaggtgatcgccgacctccacgccgagcgctacggcatccacacgatcagcttccgcctgagcaacccctacggtccccacgactcgacggatccgcgcaaggctcacgtcctgccagccttcgtgatgcgcgctctcgcaccgggggagcgcttcgagatcaagggcaacccgctggtcgagcgcgacttcatctacgtcggcgacgtcgtcgacgtgttcgcccgctccctggagatgcgggagacgagcgacgcgctcaacctctgccgcggcgagaccacgaccctgctcgacctcgcccgcaccatcctggaggtggcgggcgagaagcggccggtgcacgcccccgacacggcgacccacggcgtgctcgcccgccgctcgaccaaccagcggctgcgcgagcgattcgggatgtcgacctttacgggactcgcggacgggctgcggccgacgatcgcgtggtatcgcgaggcctatcgcgggggggctcagcatgccggggcctga

SEQ ID NO: 6391 - DNA, 933 bp, Methylobacterium sp.
atgcgaattctgatcaccggcggcgcgggctatatcgggacgatcctggtgccgatgctgctggagcgcgggcaccacgtgacggtgctcgacacgttcaagtccggcgccccggacctgttctcggcctgccagtacgacacgttcgagccgatcaagggtgatgcgcgcgacacgcgcatcctggacgagctgatcccgaagcacgatgtgctcatccctctcgccgccctggtcggcgctcccctgtgcaaggaggacgcgatcggcgccacgacgctcaaccgcgacgccgtgatcgccctagtcgagcgcgcgggcggcgaccagaggatcgtctacccgacgaccaactcgggctacggcgtcggcgaggccggcaagtactgcaccgaggactcgcccctgcggccgatctcgctctacggcacgaccaaggtcgaagccgagaaggccgtgctcgacagcggccgcggcgtcagcctgcggctcgcgacggtgttcggcatggcgccgcgcatgcggctcgacctcctcgtcaacgacttcacgcaccgggctgtgaccgaccgggcgctcctggtgttcgagggccacttcaagcgcaactacatccacatccgcgacgtcgccaaaggcttcatccacgcgatggacaattacgaccggatgcgcggcgaggcgtacaatctcggcctgtcgagcgccaacctgtcgaagctggaactctgcgagcgcatcaaggcgcacgttccgaacttcgtctacgtcgaggccccgatcggcgaggatcccgacaagcgcgactacatcgtgtcgaacgagaagctggaggcgaccggctggttccccgatttcgatctcgaccggggcatcaaggaactgatcaagggcttccggatgatccgcaactcgcggttcgccaacgtctga

SEQ ID NO: 6392 - DNA, 396 bp, Methylobacterium sp.
gtggccgccgcgacggagcccttgacggagggcgccgacgcgttggtcttgggcacagacttcttcggcttcttggcttcgcgatttccgcgcttctgttccgctgccatgatctcgctcctggatacggtgacagccccgacgacgtcgtcctcaccgttcgggcgtcggctggtctggaagcaaccggatcgcggtcgcgacgggggtctcgaacaggccgaagacggcaacgaggcggtcgcttgcccagagttcggcatgatgccccgcgatcagacccgctgcctgccgcttggcgtcgccgtcgttgcgcgccgtgatgacgcaagtcgtgagcacgccaccggtcggggcgagccggtggacctgataggcgcggcgcgcgtgtcgtga

SEQ ID NO: 6393 - DNA, 246 bp, Methylobacterium sp.; identical to SEQ ID NO: 5327

SEQ ID NO: 6394 - DNA, 942 bp, Methylobacterium sp.
atggcgctgcgggagccccgcgcggacacggcggacgcctgttccgggctcgctggcggtgtcgggcgacgggcgcgggccgttcccctccgccgacacctcgccgtcgcggcggcggggcgcggccggctcctcgccgcggcgccgctgccgctgctcctggcgctcgcggccacgacgacgcccgagcccgtcacggtcgggctcggcgggctcgccctggcatggctctcgctgcgggtgcaccgcctgcgcggcgccgcgtgcgccgcgacgcggcagcggaacaacctcgcgcgcctgaccgcgccgacggtcgcccgatgggtcgccgagacggatcgcgccgcccggcgccccggctgggagcaggaggcgacggtgctcttcgccgacatccgcggcttcacccgcctctgcgagggcatggcgcccggcgaggtcgcggcgttcctcgccgcgttccggtcccgtgccgcgcgggcgatcgaggcggcgggcggcttcgtcgacaagttcgtcggcgacgaggtgatggcggtgttcggcgtgccggacgcagcgcccggggatgccggtcgcgccgtcgcggcggcccgcgcgctcgcggccgcgatggcgacctggagccgggagcgcggacaggccggcctgccaccggtgcgggtcggcatcgggctgcatcgcggcccggtcttcatcggcgtcatcggggcggagcgggtcgagttcacggcagtcggcgacaccgtcaacgtggcccgtcggctggaacagatgacccgcgcgctgccctgcgactgcctcgcctccgaggcggtcgtccgggcggcgccgtccggcggggcgcggatcgtggctgtcgggcccgtgcgcggcggccgcaccgtcctgcgcctgttcaccctccggctcgatccggccgggacgcgtgcggactga

SEQ ID NO: 6395 - DNA, 1095 bp, Methylobacterium sp.
atgaatctgctgaagcggctgttcggacgcgccgatgcggcaccggcggaggcggcgccggacgaaccgcttctcgtcaacgcctacgcgaccgtgcgcgacctgcccgcgctccccttcgaccacgcgctgaacggccggcgggacctgtccgaccccgaattgcagccgcatctcgacgggttcatcggctacgtcatgggacggggcgacgggcagatgaccgcccaccgctaccatctctggcgccacctgcagcgcgtccgcaaccacgtcagcttcgcggtcgccgcgtccgacctgccgcgcgtggaagcctgggcgctcgcggcgaacgccgtcctcttcctgcccgacggatccgtgcgggcgcccgacatggcgctcctcctgtcggccgcgggcgagacggacgccgccgcgcgtctgccctacccgcccgacgccgtcgcgcgccgcgcccggaccctggagcacctcgaggatctggacccgaagccgccggccggcatgccccccgcgctcggcgaggcggagctcgcgctgcgaccgccggcggaggtgctccggcgggctctggccctgctctacatcgcggcctgggggcaggccttcggcgccggcacgacgctgcgcgagccggggcagaggacgctgaatccgatcggcttcgcggccctgtcgccggccgagcgcgcccagatcgaggcggcggacccgaaggacgccgcggcggcgtcctggcgctacgaggccgcgaacaccctgctgtgggcgctcggcgtgcgcgcggcccggatcgccgacagcgacgccacggtcgacgtcgacgcgctctggcgggcggtcgcgccgctcgcccgggacgcgggcgcggccgacgccgcgcggctgcggccgcccggcgagatcctggaggcgctggaccgcgcgtggcgggcgcactgggtcgtccggcaggcgcggcagaaggggacagcccccgcggggctcaacggcgacgtcgtggcggagcgccacgtcgcgctgaactggctgaccggattccagaacgaccgcgacacgccctgggacgcgaccgacacgccgacgtga

SEQ ID NO: 6396 - DNA, 348 bp, Methylobacterium sp.
atgcagtcgtcgcggtgggccggcgccttcctggctgccggcctggtcgtcgcgttcgccccgccggcgcgggccgacgccgccctggtcctgcgggagacccggctgcacacgccgccggactcgcacgagccgcagcgggcgatggtcaacctgcgcaacaccggcccggacctcgcgacgaacgtgaccgtgctgtgcaccttcacgggggccggcgggacggtgctcgacacgcagcaggcctcggtgccggaggtcgtgagcctcgccgacgtgcaggccgagacgatctactacggctggccccgcgcgagcagcgccacctgccgcctcgccgagccgtag

SEQ ID NO: 6397 - DNA, 1503 bp, Methylobacterium sp.
atgcggcttccggaggagctggagcgggcctgcgaagggcgtatcgtccttggcaccatcgagccgtccgatttgacgctcgtcgtgcggcggatcgtcgggtccgctccgacaacgattgtttgccccgagctcgccgcggaagtcggcccgatcgacctgcgcatagcacttcatccggcgcgcgggccggaaggcgcactcgaacgtctgaagttcgtattggagcggggacgcacgcacccgacggcaagcaaggcgccgcgactatccgaccttcacggctacggtgctgcggccgagtgggggctcgcagcagcagccgatctcatggcttacagccgcggccaacattggtcgtcatgcgagcagggagcgctcctcaccggggtaccaggcgtaggcaagactctgctcgcggcagcgatcgcgagcgaggctggcgttccattcctggccggatcgcttgcccagtggcaggccgaaggcgaggcgcatctcgggaccacgctcaaagcaatgcgcgccttcttcgggcacgcgaagaaggtcgcgccgtgcgttgcgctggtggacgagctcgactcgttcggagatcggcgcaaactggaaagccataaccaccactatggcgtgcaggtcatcaacggcttcctcgagtgcctcgatggcgacggtggccgcgagggcgtgctgctggtcggcgcgaccaacaacccgagatggattgatcctgcaatcctgcgatcaggccgattcgaccgtcagatcgcgatcgaagctccttcactaaccgatctcgcttcgattctgcgtcaccacctcgggtcggatctttccggagccgacctgcttgagatcgcaagaagaggtctcggcgggacgggtgcggattgcgccgcctgggtccggcgggctcgtagccgggcacttcgcgacggtcgcgccgtcgccgaactggatctcataagggaacttacgggtttaaccgagggaacgtgcatcgacgaggagcggcgagcagccgtacatgaggccggccacgcggtcgccgcatacgcgttggatctgccggtgggcgagctcgtactccgaacgcctggccatgcaggcgacggctttatgcggtttcggccgaagcgagtcggcacgcgtcgcagcgtggaagacctgctgacggtggtgatggccgggcgcgccgcggagatgctcgtatgcggcgcgccatctgcaggagcatcggccgacctcgctttcgccaccgcgatcgcgcgagacctgcagactcgatggggccttgggaagcggcttgccgtgctccacccgaatgagccgagttccacttttgcgcccggcgtcgagcgcgccttgcaatgtgccgccaaagccgcgttcgaccttttggccgcacgccgtgaacatctcgaaggcctagccgaagttctgtcgatgcggagatcgctttcgaagctggaagtggaaacgctgctgaacggcgactga

SEQ ID NO: 6398 - DNA, 2643 bp, Methylobacterium sp.
gtgcccctgcccctcgcacgcctcgaccaacccggcctcgacgctctcctggccgacgcccgcgcggccggtaccctcgaccccgacagcctcgccgacctctacccgctcacccccctgcaggagggcctgctcttccacgcccgcctcgcccccggggacgcggcctaccgcaaccaggtccgcctcgacctcgaacccctcgatcccgaccgcttcgcccgcgccgtccgcgccaccctcgagcgccacgacgtcctgcgcaccgccatcctcgaccccgccgacggcccgcccctccaggccgtcctcgaccccgtgcccctacccctcgcacgcctcgactggaccggggcgccgtcgagccaggatgcgccgcacgaggacgccccggacgaggatgcccgcgccgaccgcctcaccgaccgcctcgccgccctggccgccgaggagcgcgcccggcccttcgacctcgcccgggccccgctcctgcgcctcgtcctggtccgcaccggaccggaccgccaccacctcgtactcaccgtccaccacctgatcctcgacggatggagcaccgcacgcctcgtcgccgaggtgctcgcccgctaccgcggagaggagcccgagaccgtcacaggacgcttcgccgactacctcgcctggctcgcccgccagccgcgggccgccgccgagcgcttctggcagcacgccctcgccggcctcgacgcccccacccgcctcgccgacaccttcgacccgcccggcacgcccggcgcccgcgacggacagcgcccgcccggccacggcgaggtccggcaccgggtgccgccggccgcagccgggcggctgctcgcccgcgcccgggccgcgcacctcaccctcaacacctgcgtccaggccgcctgggcccggctcgtggccgcccgcaccgggcaggcgcgggtcgccttcggcacgaccgtggccgggcgcccggccgacctgcccggggccgagaccgtgctcgggctgttcatcaacaccctgccggtggtcatcgacctcgacccggcccggccgctcggcgcgtggctggcgggcgtgcaggaggccggtctcggcctgcgcgagcacggccacctgcccctggccgccatccagcgcctcgccggccccgcgggcacgggcacgggcacgggcacagggacgggcggcctgttcgacagcctggtggtgttcgagaactaccccgtcgacgccgccctcgccgccgtgcgccacggacgggacggcgacggaaacggggacggcgacgctgccgacccgcacgccttgcgcctcggcccggccatcgtcgccgagaccacgcactaccccgtcaccctggtggtccacccggagaccggccccgacgggacgcggctggccctgcgcctgagctacgccgccgaccgcctcgcgcccgcggatgccgaggcgctgctcgccgccttcgtggcccagctcgccgccctggccgaggccgacccggcaaccccgctcggggcgctgccgccgccgctgcccgacagcgaccgggcgatgatcgggtcggcgaacgcgaccgcgcgggcctacccggacggcgccggcgacgtcctcgccgccttcgcagaccaccgcgcgcacgacccggacgcgatcgcggtgaccgacgggcagggcgcgctcacccgccgcgccctcgacagcgcggcctccgcgctggcccgtcgcctcgcccgcgccggggccggtcccgacactctggtcggcgtcgggctggagcggtcctgcgcgctgctcgtcgcctggctcgccgttctcaagacgggggccgcgatcctgcccctcaaccccgagctgccgcgcccgcgcctcgtcgcgaccgcccgagaggcggccctgcgcctcctcgtcaccgagtccggcccggccgcgcggatgcccgggccggcggagcttccggacctgcagatcctcaccccggatctggcagaggcggcggacgatcccgccctgccggccgcggcgccgcacccggacgccctggcctacctcatctacacgtccggctcgaccggcacgcccaagggctgcgccaacacccgcgccgccatcgccaaccgcctcgcctggatgcgggcccatttcgcggtcggccccgccgacgtgatcctgcacaagaccccggtctccttcgacgtcgccgtctgggagatcctcctgcccctcgtcaccggcgcacgcctcgtcatggcgccgccgcaggcccaccgcgatccggacgcgctggccgccctgatccggcgggacgcggtgacgatcgtgcacttcgtgcccgccctgctggaggcgttcctggcgtccggccggctcgccgcctgctcgagcctgtcccgcatcgtgtgcagcggcgaggcgctcgcccccgacctcgcggccgccgtccgcgcccagagccgggccgacctggccaatctctacgggccgacggaggcggccatcgacgtcagcgcctggacctgcgggcccgagcgggacgccccgcgggtgccgatcgggcacccgatcgccaacacgcagctccacgtcctcgacgacgcgctgcacccggtgccggtgggggtggtgggcgagctctac

SEQ ID NO: 6399 - DNA, 1659 bp, Methylobacterium sp.
gacgccgtcgcccgctccgacaccttcttcgagcgcggcggcgattccatcctcgccctccagctcgtcacccgcgcccgtcaggccggcctgacgctcaccccccgcgacgtgttcacccaccagagcctcgccgccctcgccgcgcacgccgagcgccagggcgcacgcccggcgctccccgcgcgcgacgcggcgaccgatccgggcctcgaggccggcccggtgccgctgaccccgatccagagctggttcctggccgcgccgatgccgcggcgcgcgcactggaacatggccgtgctgctcgtcccgcgggcgcgcctcgcggcggaccgcgtcgcggaggcgctcgccgcgctgtccaccgcccatccggccctgcggctgcgcttcgcgcaggcggccgacggcggctggcggcagacctgcaccgccgccgacgccgtcgcggccgccgagtcgctgtggcgccgcgaggcccgggacgcggccgccctggcggcgctggccgaggccgcgcagacgagcctcgacctcgcccgcggaccggtgctgcgcgccgtcctggtcgatccggccccggacggcgggcagcgcctcctcctcgtggcccaccacctcgtggtcgacgccgtctcttggcgcatcctggtggcggatctcgccctggtcctcgcggggcggaccctgccggcgcccgcgacctccttccccgcctgggcccggcacctcgacaccctggcccgggatccggccgaggccgaccgccgccgcgcctgggccgaggcctgggcggcgcagctcgcgcctcccgcatggggcctcgaacctgcgcggcccgacgcccccaacgtcgaatccgcccagaccgagatcgccgacagcctcgacgccgacaccaccgacgccttcctgcgccgggccggccggccctaccgcacgcgccccgacgaactcctgctcgcggcgctcgcggtggcggtgtcgcgccgctgcggcgggcgagccgtgcgcgtcgtgctcgagggccacggtcgcgatgccgacgccctggcggacagcttggcggacagcttggcggacgcggccggcgaggcggcgcgccacgacctgagccggacggtgggctggttcaccacgctggtgccgctgcggctcgaccccctcggcggcgagccggacctgccgccggacctgccgccggacgacgccgcccgcggcctcgccctcggtccactcctcggccgcgctctctgccgggtgaaggaagcccgccgcgccctgccccagcccgatctcagccacgacctcctgcgccacggccccgtcgcggacctgcgccaccgcatcgccgcggcacccgagcccggcatcctcctcaactacctcggccagatcgacgccgaccgcgccgaccccgacgcgcccttcgccctcgcccccgagagcgcggggcccatgcgcgccccccacagccccgcgggcgccgagctcaccctcaccgccctcgtgcgcgacggccgcctccacctcgcctggcgcttcagccccgaccgccacgatgccgccgccatcgccgccatcgcccgcgacacccggcacaccctcgaagccctcgttgcccactgcgccgatccgcgaaccccgcgccggcccaat

SEQ ID NO: 6400 - DNA, 204 bp, Methylobacterium sp.
atgttcaagactacggcgcgcgctgctctttgcctggcctgtctctggtcggtcacgccggccctggcggccccgaaggagatgcctcagggcaagcgtgacgagatgtcgatgaaggacaccaagcacgaagtggtgatgcaacggaaggagaataaggaagccaacaagaacgtcgacagcctcatcacgaaccgcaagtga

SEQ ID NO: 6401 - DNA, 1383 bp, Methylobacterium sp.
ttgaccaaggacgcccgcatcgtggagattggcccgagcttcagcccgctcgcgccgaagcgcgacggctggaacacattcgtcatcgatcacgcgccgcgctcggagctcatcgagaagtatcacgaccagacggtcgaccgcatcgaggaggtcgatttcgtctggacaggcggctcgatcgcggacgcggtcccggtcgaccagcacggcaccttcgacgcgttcatcgccagccacgtcatcgagcacacgaccgacatcgtgaccttcctgcgcgccgccgagacgctgcttcggccggacggcgtggtgatcctggccgtgcccgacaagcgcaaatgcttcgatttctaccgttccctcaccgggacggcggacgcggtcgcggcgttcctggagaagcggaaccggcacacggtccggacccacatcgactacgccctgaacatggcgctgaaggacaacggcacggtcggcgcttggtcgggccaggacacgcggccggccattcccgcgaatccgctcaccgacgagccgcagtggctcggcgccgcgcaactgccctactacgccgacgcccatgcctgggtgttcgtgccggcgagcttcaatctgatgatcctggagctggcgcagctcggctacatcgatctgcgcgtcgaggatttcctcgaccgggacgcgacggaattcttcgtgtggctccgcaagggacgccagcagctggcgccggacgagatccgcgagcagcgcaccgcgctgatgcagcgcgccatcgttgagctggcggaacaggtgcagcaactgcccgagacgtccttcgtcgagatggcctcggcgcgggcgctgcgggatcagctcctcaaggcgacctaccggaccgaggcgctccgcaccgtgctggcggcgctgcgggccagcatcggccgtttcgggctggatcgggccaagttcaagcgcctgatcggcgcagcgagccagaaggttccggggaacctctcggcggcggtccagcacaagatcctgctgaccgaggcgaccaagatcctcgacggcatcacgaattctgcggtcgagaccgacgaccgggatcccgccgttatcgacggcgccgtcttggtggcgccgctcggcgcggcccagttcggggatccgctgcttgccgccgaactggagcgcgagcgccagcgcgcccgggccgtccgcatggtgctggacgccgtgctcggaagtctgcgcggccgcgccctcgacaagaagcggttccgggacctcgtcacgcaggcggccgcgcggacgccgaatgacggccccgaatcggcgcgccacgcggtgctgtccgaggaatcgcggcgggtcctcggcctgccggtcgcctga

SEQ ID NO: 6402 - DNA, 687 bp, Methylobacterium sp.
atgagcgtcgtcgccacggcactgctcaccggcgcgagtctcggtctgtccatcgccgcgccgatcgggccgacgagcttgctgtgcgttcagcgaacgctgtcaggcggcctgtcgaccggcctcgccaccgggctcggtgtcgccaccgtgcacctgacatacgggggtctcgtcatgcgctggggcgcggagctcgccgcggtgtggtcgaacggcgccgttctctccctgatctcgggggctgtgctgctcgccctcgcggtccgggtgcttcgcagcgtctcggtgctgcaggagggccgcgcgtgccgcgacacgctggcggtgagctacggcagcgcggtcgtgctggccctgacgaatccggtcacccccgtgctgttcctggccgcgacgccggccttcctcgagcgcgggaccgcgccgttcccggtcctggcggccggtgtcttcgtcggctcgttcggctggtgggtggtgctcaacaccgcggtgtccctgttccggcgctgcgtgaccagccaggtcctgaatcggatgaacaaggccgcgggccttcttctcgccctcctggcgctgagcttgctcgtccgggggctggacggtggcacggcggcccgttcgagcagcgcgggcgtgagcggggtgtcgggcgcgggcacccgagcgccgagccggctctga

SEQ ID NO: 6403 - DNA, 711 bp, Methylobacterium sp.
atgcctgaggcgctcctcgcgacgaccggcctccgcgccggctacggcggcaagcccgtgctgcagggcatcgacctcgcggtccggcccggcgagatcgtggcggtgatcggccgcaacggcgtcggcaagtcgacgctgatgcgcagcctcgtcgggctcctgcccgcctccgcgggcggcatcgcgttccggggtgcggcggtcgaggggctcgccgcccaccggcgcgcccgcctcggcatcggctacgtgccgcaaggccgcgatgtcttcccgcgcatgagcgtcgtcgacaatctgacggtcggagcgtcgctgctgccgaagggggagcggccggattacgagcgcgccttcgggcctttcccgatcctgcgggagcggcgcgggcagcgggcggggacgctctcgggcggccagcagcagcagctcgccatcggccgcgtcctcgtcggcgaacctgcgctgatcctcctcgacgagccctccgagggcatccagccctcggtggtgcagcagatcggccgcaccctggtcgatctcaaccaccgcaccggggtgacgatcgtgttcgtggagcagaacctcgacctgatccgcgccatggcccagcgcagctacgtcatggacaagggccggatcgtcgcggagctgacggcccgcgacctcgacgaccgcgacctcgtgcggcgccacctcgccgtctga

SEQ ID NO: 6404 - DNA, 993 bp, Methylobacterium sp.
atgcagtggctcgaccagtccatcatggcccgcaagggcgtcgccggcggcaagcccggccgggagtacacgatcaccgaggtcgagcagggccgctaccactacgtctacgggcctttcgccgagccggtgctgaccgtcgatcccggcgcggtcgtcaccgtcgagacccacgacgccttcgagggcaagatccgccacgagaccgacagcccgacgcagatcctgaacttcccctacctcaacccgcagaacgggccgatctacgtcaacggcgccgagaagggcgactgcctcgcggtggcgatccgctcgatccggccgcgcggcccgcagccctgcggcacgacgctgatcatgccggaattcggcggcctcgtcgccaccggcgacaccgcgctcctcaatccgccgctccccgagcgggtgcgcaagctcgaggtcacggccgagaccggcgtgcgctggaacgaccggatcacgttgccctaccagccgttcatcggcacgatcggcacctcgccggagatcgaggcgatctcctcgctgcagccggactattacggcggcaacatggacctgccggacgtgggcgtcggcgcggtgatctacctgccggtgaatgcgaagggcgcactcctctacctcggcgactgccacgccgcgcagggcgacggcgaactctgcggcgtcgcggtggagcacccgacccacacgacggtgcagatcgacctgatcaagggctggaccttccgctggccgcggctcgagaccgaagacttctacatgacgatcggctcgtcccggccgatggaggacgcggcgcgcatcgcctaccgggagctgatccgctggctcgcggccgatttcggcttcgacgagatcgacgcctacatgctgctcacgcagtgcgggcgcgtgcggctcggcaacatggtcgatccgaaatacacgctcggcgcctcgatcacgaaggcgatcgcccacgcctga

SEQ ID NO: 6405 - DNA, 924 bp, Methylobacterium sp.
atggacccggcctcggggggtgccctcgcggcggcggtgagcgccgccggcggcctcggcctgatcggcggcggctacggcgaccacgcgacgctcgaccgggaattcgcccgcgcgggcaatcagcgggtcggctgcggcttcatcacgtggtcgatggcccgggacccgtcgctcctcgacgcggcgctcgcccggtcgcccgcggccctgatgctctccttcgcggatcccgcgccgttcgcggaccggatccgcgccgccggcgtgccgctgatctgccaagtgcacaccctggcgcatgcgaggcgtgccctggaggtcggcgcggccgcggtggtggcgcaggggacggaggccggcggccacggcctcaccgcccgcggcaccgcggcgttcgtcccggcggtcgccgacctgatcgcccgcgagcgccccgagacgctgctcctcgcggcgggcggcatcgcggacgggcgcggcctcgccgccgccctggcgctgggggccgacggtgtcctgatggggacccggttctgggccagccgggaggcgctgatccacccggccgcgaagcagcgggttctcgccgcgaccggcgacgacacgatccgcacgcaggtctacgacatcgcccgccagcgggcctggccgaagccctataccggccgactcctgcgcaacgccttcatcgagacgtggcacggccgcgaggacgcgctgcgcgcggcctcggccgagcggcgccgggacgtggaggatgccgacgcggcgggcgactacgacgtcgccaacgtcacggtcggcgaggccgtcgggctcatcgccgacctgccgggcgccggcgacctcgtcctacgcatcgccgaggaggccgaagccgcgatccgccggatctccggcatggccgcggcggcgccgtga

SEQ ID NO: 6406 - DNA, 1305 bp, Methylobacterium sp.
atgaggctgcttcggtcgatctacggccaggtcctgctcggcatcgcgctgggcatcgcggtcggggtggtggcccccgatttcgccgtgggctgcaagatcctcggcgacatgttcatcaacctgatcaagatgatcgtcgcccccgtgatcttctgcacggtcgtggtcggcatcgcgcatgtcggcgacatgaagagcgtcggccggatgggcctgaagaccatcctgtacttcgaggtcgccacgaccgtggcgctcgccgcgggcctcctgttcgtcaacctgctgcggccgggcgacggcgtgaacgccacggtcgacagcctcgacgccaagctggtcgccggcatcgccggcaaggcccacgcgcagtcgccgatggagatcgtcgccaacatcatcccgcacagcgcggtcgacgccttcgccaagggcgacctgatccaggtgatgttcttctcggtgctcgtcggcatgggtctggcgatgctcggccggcgcggcgagttcccgctcaaggtggtccacgccttcggcgacgtgctgatgaaggtcgtcggcctgatcatgcacttcgcgccgatcggagccttcggggcgatggccttcaccatcggcaagttcgggctcggcatcctcgcccagtacgggatgctgatcgtctccctctacctgaccttcatcgtgttcatcgcggtcttcctcggcggcgtgatgcgcttctacgtcggcctgagcctgtggaagctgttccgctacagccgggaggagctgttcatcctgctcggcaccacgagctcggaatcggtgctgccgcggatcatggccaagctcaatggcctcggggtcgacaagagcgtcaccggcctcgtgatgcccgccggcctgtccttcaacatggacggctcgtgcatctacctgaccatggcgatcggcttcatcgcccaggctctcaacgtgccgctgacctgggagcaggagctcggcatcctcgccatcgcgctggtgacctcgaagggcgtggcaggcgtggccggcgccatcctgttcgtgctcgccgcgacgctccaggcctcgcagctcctgccggtggcgggcatcgccctgatcatcggggtggaccgcatcctgaacgagctgcgctgcgtgaccaacgcggtcggcaacatggtggcgaccctcgtgatcgcccgctgggagggcaagatcgacctcgcccacgcccgggcggtgctcgacggccgcatcaccccgaacctcgaccttctcgacgacgaggacgaggcggcggacgcgatccac

SEQ ID NO: 6407 - DNA, 1005 bp, Methylobacterium sp.
atgcgcagacgcgacgttctggccggggcagcggcgttcctggcgagtcccgtcccggggcgggccgacgaggtcggcgcggtggcgatcgcccgccagccgagcctcggccacctgccgctgatgctgatggaggagcagggcctgctccagaaggccgcggccgcccgcggcgtggcggggctccaggcgcgctacctcaccctcgcgggcggggcggcgatgaacgacgccctgctctccgggacgatccagttcgcggccggcggcgtgccgcccctcgtgctgctctggtcgaagaccgagggcaccgccatggcggtgaagggcgtggcggcgatgaacagcatgccgctcctgatgaacaccagcaatccgaaggtgcaccggctcgccgacttcaccgaccgggacaagatcgcgctccccgccgtgaaggtctcggtccaggcgatgttcctgcagatggccgccgagaaggagctcggcgcaggccgccgcaacgacctcgaccggctcaccgtcaccctctcccatcccgacggcatggcggcgctcctcgggggcagcgaggtgacggcccatttcaccgccgcgccgatccaggagctggagctgcgccggcccggcatccgcacggtgctgaacagcttcgacgtgctgggcgaaccctcgaccttcaacgtcgtctgggcgtcctcggccttcgcgggcgccaatccccgtgtcgtcgcggctttcaacgccgccctggacgacgcgctcgccgcgatcacggccgatccgtcggaggcggcgcgcgcctacgtgcggctcgcccgcaacgggagcgatgtcgggctgatcaccgagatcctgaaggacccgcaggtctccttcacggcgacgccccgggcggtcggaaaggtcgccgacttcatggcccgcaccggcacgatccgtcgccggccggagagctggaaggacctgttcttcgcgggcgtccacgacaaggcgggcagctga

SEQ ID NO: 6408 - DNA, 747 bp, Methylobacterium sp.
atgaacacgatcctgatcaccggctgctcgtccggcttcggcctggagacggcccgcaccttcctcgaacggggctggcgcgtggtcgccacgatgcgcgggccgcggagcgacctgctcgcgccctccgatcgtctgagcatcctgccgctcgacgtgaccgaccacgacagcatcgaccgcgcggtcgcggcggccggaccggtcgacgcgctggtcaacaacgccggcgtcgggctcctgaacgcgctggagggcgtctcgatggacgccgcgcgggaggtgttcgagaccaacaccctcggcaccatcgcgatgacccgagcggtgctgccgcagttccgggcgcgccgcgcgggcgtcgtcgtcaacgtgacgtcgagcgtgacgcagcgcccgctgcacctgctgtccgtctacacggcgagcaaggcggcggtgaacgccttcaccgagtccctggcgctggaactcgaaccgttcggcatccgcgcccggctggtcattcccggacggtccccggagaccgcgttcggcgccaacgcgcgcgcccgcatgggcatggacatccccgaagcctacgcggcggtggccgcgaaggtcttcgccggcatccagcaggcggacggggacctgacccggtcctcggacgtggcggaggcggtgtggcgcgcggcgaccgacccatcgtgccccatgcgtctgcccgccggtgccgacgcggtggcgtgggccaaggcgagctga

SEQ ID NO: 6409 - DNA, 906 bp, Methylobacterium sp.
atgcccgatccgctcacccaggtggtcggcctcctccggccgagcgccccgctgtccaagctcgtcaccggctgcggtcactgggcggtgcggcgcacggattccgggcttccgttctacgccgccgtgctcgagggcgggtgccgcctcgcgatcgacggcgaggccgggatcgtgctcggagagggcgacttcgtcctcatccccgcggcccacgcgttcaccaccaccagcctcgagccgccgcccccgcggcgcgcagcgcagcgtcccgtcgctgtgagccccggcgtgttccggctcggcgacgccgaggggccgccgaatgtccggatgctcgtgggccactgcgtcttcgcgtcgagcgacgcggatctgctcgtctcgctgctgccccggtatgtccatgtgcgcggcgccgcccggctgaccactctgctcggcctcgtgaacgaggagacccgcgccgaccggccgggccgcgacgtggtcctggcgcgcctgctggaggtcgtgctgatcgaggcgctccgcgccaccgccgggccggcggcgccctcgggactgctgcgcggcctcgccgacgaccggctcgccgccgcgctgcggcggatgcacgaccggccgacggcgagctggacggtggccgcgctcgcgcgcgaggcgggcctctcccggtccacgttcttcgagcggttccgccgcgcggtcggggtcgccccgatggagtacctgctggcgtggcggatggcgctggcgaaggatctgctgagccgcgaggcggtcgggatggccgaggtggccgcgcgggtgggctacagctcggcgagcacgttcagcgtcgccttcgcccggcacgtcggccggccgccggtccggtacgcccgcgagcggccggtgccgtga

SEQ ID NO: 6410 - DNA, 1131 bp, Methylobacterium sp.
gtggagacagttcattccggtggccggccgctcacgcgcgccgcgctcgccggccggagacgtgcgctcgaagacgggcggacggtctcgcgcagggagctctcggccgcgggccgggacgcggccaaggccctgaacctgcgccctgccctgcgttcgatcctctcggcgctctgcgccgtgtggggtgagcaggattgggaacgcttggtggtgtggccctcgaacgagcacctgtgcgggatgaccgggctgtcggagcgcgcgctccgctacggcctgcgcgacctggtggccctggaggtcatcacacctcgggacagcgcgaacggcaagcgtttcgccatccgcgggccgggcggcgccgtcatcgacgcgtacggtttcgacctgactcccatcgtcgcccggaagggagaatgggcgaccgcgatcatggaagccaccgcgagggacgctcagcgaagccgcgcgttcgatctcctgaccgttcgtcgccgcgcggtgtcggaggcccttgccgccctgcgcgcccgcttcccggccacggatgccgccgatctgctcgcggcgcaggaggccctggagcgcagcacgccgaggagacgcgcttccggcgtggccactgacgtcgtcctcgacgcctggggagaactgcaagtcatggcggaggatcgtttctatcaagccgcctctgccggcaattccggccgtcacttagaacaagacaccggatctcctagcgatccttgtgcaaaggctcccgagaaggagcctgagccgacccgtaggcccgaaccgtcactcgtcgcggctgcttgccctgtcgctgccgaattcggcgtcaccctcagaacggaagcggatgtcatcgagatcggccggctgatgcggggcgggatcggcgcgcatccgtcggcctggagcgaggcttgcgaagccctcggtccgttccgggcctcggtgctcgtgctgatcgtcgcgcagctccacgacgacgacgtgcgccggggtgagatccgcatcaagaacccaggcggatacttcaggcagctcgtccgcctgtgttccgaaggtcgctacgggctcgaagccgagctcatggcgatgcgcaggaggaagatgacgtga

SEQ ID NO: 6411 - DNA, 1017 bp, Methylobacterium sp.
atgaagacgatcgggttcctgtccttcgggcactggtcgccgaccggcggatcggcgacgcgcagtgcggccgacacactcctccagtcgatcgacctcgcggtcgccgtggaggagctcggggcggacggcgcctatttccgggtccaccatttcgcgcgccagctcgcctcgcccttcccgctgctggcggcagtcggcgcccggacgaagcgcatcgagatcggcaccggcgtcatcgacatgcgctacgagaacccgttctccatggtcgagaatgccggcgcggcggacctcatcgcgggcggacgcctgcagctcgggctcagccgcggctcgcccgagcaggtcatcgacggctggcggcacttcggcttcgccccggccgagggcgagacggacgccgatatggggcgccggcacaccgaggtcttcctcgacctcctgaagggaacggggttcgccgagcccaacccgcggccgatgttcgccaacccgccgggactcctgcgcctggagccgcaatccgaggggttgcgggaccgcatctggtggggatcggcctccgacgcgaccgcgatctgggcggcgcagcagggcatgaacctgcagagctcgaccctgaaggcggacgagaccggcgagccgttccacgtccagcaggccaggcagatccgccgctaccggcaggcgtggcaggatgcggggcacgcccgcacgccgcgggtctcggtctcgcgctcgatcttcgcgctcgtgaacgacctcgaccgcgcctatttcgggcgcggcacgagcagcgaccaggtcggcatcatcgacaacatgcgcgcggtgttcggccgctcctacgccgcggagccggaccggctggttgacgagctgcgcgccgacgcggcgatcgcggaggccgacaccctgctgctgacggtcccgaaccagctgggcgtcgcctacaacgcccacctcatcgagagcctgctctcgcacgtggcccccgcgctcgggtggcgctga

SEQ ID NO: 6412 - DNA, 849 bp, Methylobacterium sp.
atggacgaccaggacaagcaatttatcacgcagcagatcctcgacgtcggccgccagctctatgccgccctcgacagcaagatcatgacggctcacgcgcagcagctggcgcagatgcaagatgtccggcgcctcgccgtggttcagctcgcaccgaagaacgatttctgcctcgtgacggatcatccgatcgcctacgagagcaacgatcacacggttccgcgcggcacaaaggatgacaatacgcgcaatcagcggttctgccacgcggtcgagagccatttcggccgaaaggtcagggccctggacctcggctgcgcggggggcggcctcgtcttcgatttcctgatccgaggcaacgcggccttcgggatcgaggggagcgattactcccttcgcgcgcagcgcgccgagtggtccatcatcccggactatctgaggacctgcgatattaccaagcccttcgctctgatggatcagaggtcagggacgaaggcgaaatttgacgtcatcacgatgtgggaggtcctcgagcacatcgaggaatcgctgcttcctcagctgttcgcgaacgtgaaatcccacttggcggacggcggtcttttcgtgggctccgccgcgacatacgacgatgtcgccaacggcgtgagctaccacccgacggtcaagccggagacgtggtggcgcgagcttgtccggcagcacgggctggaatttgtcccgatgaccatgttccagttcaaggatttctgccgaggctccgggaacgagaacgcgttctacgacgcggatttcagcaagaatcccgagctcggcttccacttcgtgatgaagcatcgccccgcttga

SEQ ID NO: 6413 - DNA, 648 bp, Methylobacterium sp.
atgaccctccgccgccgcgcgctgcctctggccgccctcgccctggccctaccgctggcgaccccgctggcgaccgtggcggcgcgggcgcaggaccggctgccgaccatcccgccccaggactacacgcccgagcagaagcaggcggccgaggccttcgcgcaggcgcgcggcaagccgcccttcgggccgttcgagccgctcatgtactccccggaggtgatgacgctcgcccggtcgatgggcgactacctccgcttcaagccgaagatcggcaccacgctctcggaactggtcatcctgatgaccgcccgccgctggacgcaggactacgagtggtacgtccacgcgccgatcgccgagaaggccggcatctccgccgacatcatcgcggcgatccgcgacggccgccggccggcgaagatgagcgacgacgagaccctcgtgtacgatttcaccgccgagctccaagacaccaagcgcgtctccgacgcgaccttcgcgcgtgccgaggcccggttcggcaagcccggcgtcgtcgatctggcggcgatctcgggctactacacgttcctggcgatggagctgaacgcggcccgctacccgattcccgctgacggcaagccgctgccgcgcatgcccgagtga

SEQ ID NO: 6414 - DNA, 915 bp, Methylobacterium sp.
atgagctatccggcccgggtgcaggtggtcgaggtcgggccgcgcgacgggctccagaacgagcccgcgccggtgccgatcgccgccagggtggcgctgatcgaggccctggccgaggccgggctgacccgcatcgaggccggcagcttcgtgtcgccccgatgggtgccgcagatggccgagaccgcggaggttctggcgcggctgcgcccccggcccgaggtcggctattccgttctggtcccgaacctgcagggtctggagcgggccctcgcctccggcgtccgggaggtcgcggtgttcgccgccgcctccgagagcttctcccggcgcaacgtcaacggctcgatcgccgagaccctcgaccgcttcgccccggtgctggaggcggcgcgcgcgaacgacctgcgggtgcggggctacgtctcctgcgtcctgggctgcccctacgagggcgacgtcgcgccggcggcggtcgcccgcgtcgccgcgtccctccacgcgatgggctgccacgagatcgccctcggcgacacgatcgggaccgggacgccgcgcgcggcccggcggctggtcgagcgggtggccgccgacgtgccgctgcaggcgatcgccctgcacctccacgacacctacgggcaggccctggccaacatcctcgcctgcctcgaactcggcgtgtcggccgtggacgccgcggtggcgggcctcgggggctgcccctacgcgccgggggccgccggcaacgtcgccaccgaggacgtcgtttacatgctgcgcggcatgggcatcgagaccgggatcgatctcgatgccctcgccgcggccgggcggtcgatcgcgtcccggctcggccgggagccggcctcgaaggtcgcccgcgcgctggccgccgcgccgccgccgacaccctga

SEQ ID NO: 6415 - DNA, 399 bp, Methylobacterium sp.
atgtccgacggcacggaggccgcgccggcggcagagcccgactacgaccggctgctgcgcgccaatctcgcgcggatcttcaacgcgcgggacgccggcgcgcgggcggccgccctggccgagctctacgtggccgagccgaccctgttcgagccggacaacgtcgtgcgcgggcgggccgcgatcgccgcggtcgccggggcgctcctggaccggttcgggccgaccttccgcttcgtgcccgtcggcacggccgccggacaccacggcgtgggatcgctgcgctgggaagccggtccggcgggcggcccggtcgcggtcaccgggacggacgttgccgagatcgtggacggcaggatcgcgcgactctgggtgctgctcgacccgccgcccccctga

SEQ ID NO: 6416 - DNA, 900 bp, Methylobacterium sp.; identical to SEQ ID NO: 5353

SEQ ID NO: 6417 - DNA, 531 bp, Methylobacterium sp.
atgcaggagacgggcgcacacctgtcccgccgcggcttcctgggcgccgcgggctcgacgctgctcgcggtcgcggttatgccggacggcagcgtgaccgggcgggcctgggcgcagatgccgaaggcgacgaagcccgagaccttcgcctcgctcgtgcagatgtcgcgcgactgctacccgcacgaccgcgtcgccgacaggtactacgccgccgcggtgcagatcctcgacgacgcggcgcggaccgctccaggagaactgacgctcctcgaggacgggatggccgcgctcaaccgggcggccgtcgagaggcaccgcctgccctacgccaaggttccgcaggatacggaccgggcagccctcctcgagaccatcgagccgaccccgttcttccagaaggtgcgggccaacctcatcgtcggtctctacaaccagaaggagctgtggccgatcttcggctacgagggcgcctccttcgacaagggcggctacctggagcgcggcttcgacgacatcgactggctctga

SEQ ID NO: 6418 - DNA, 483 bp, Methylobacterium sp.
gtgcgcctgcgcgccgtcgcgctctccaggtctgtctcaatgacactcgctcgtgaccccgatgcccacctctccggcacaactgacgcggccaaactctcgctgccgctgtcctggtggcgcgtcctcgcccctgaggcgctcgatatggcagcgcagtgccgcctgtccgctgccctgaatgccgtgcagcccctgccgtcccccgactggtccgctgcttgccggggcgattcggcggctgcgatccatatcgccctcaacgtcctcgccgaggccatcgcctttcctgggcgcctcgatccggcgatgtcggcgatctgcctctgcgccgtacgaggtgacggctcctgcatcgacctgctcgtgcacgtgctcgggcggcgcgctcgacgccgggctgatctcgaggtgctctgcctcgcccatgcttggtgctctgttccgcgccgcggttccgaccgcgtcggcgtcgcccgctga

SEQ ID NO: 6419 - DNA, 729 bp, Methylobacterium sp.
atggacgtcgtcgcacgccgccggggccggccccgcaaggcgccggtcgtcccggtcgcgcagctgccgcggaccgggctgcacgagcaggcggcgggccggctcagggacatgatcgtgcgcggcgtgctgccggccggcgcgtccctcgtggagacggacctctccgtcgccctcggggtcagccggacaccgttgcgggaagcgctcaagctcttggccgcggaggggctggtcgagctgcaccagaaccgcagcgcccgcgtcccggactggacgccggaggagatcctcgaactgttcgaggcgctcgccgggatcgagcggctgaccgcggaactcgcggcgccgcggatctccgaaaccctgatggacgcgctgcgcggcaagcaggcgcggctcgaccggatgcaccgggaccaagtgctcgacgcctatttcgccctgaaccaggagatccaccggacgatcgtcgaggccgcccggaaccgcccgctggcggaggcccacgccgcgctccaggcccgggcccaatgggcgcgcctgcgcgcgctctccagcggcagccgctgggaggaatccgcccgcgagcaccgggacctgttcgcggcgctcgccgcgcgggacgccgccgaggccgggaccgtcgcccaccgccacgtgctgcgaaccggcgtggtgatcgccgagacgctccaggcccggcgcgcggaccccgcggcgcggtaa

SEQ ID NO: 6420 - DNA, 984 bp, Methylobacterium sp.
atggaggacgccgtgatggaactcgtgaccaagcccctgcgggacgagggtcctctgccgctcctggtcacgccgccggagggcgccgcgggcgcggcgctcgcggacgcgctgccggcgatccgggccgcggccgaggcgcacctccacgccgcgggcggcctgctgctccgcggcttcagcctcgacgggcccgacgcgttccgcagcttcgcggcgggcttcggccacgacctcctgagctacgagttcggctcgacgccgcgcagcgccgtgacccagggggtctacacctcgaccgagtacccgccccaccagcacatcccgctgcacaacgagcaggcctacgcccgcgactggccgatgaagatctggttctactgccagcaggcggcgcccgaggggggcgagacgccgctggctgacagccgcgccatctaccgcgccgtgcccgagccgatccgcgcgcgcttcgccgagcggggcctgatgtacgtgcgcaactacggcaacgggctcgacgtggcctgggagcaggtgttcggcacgcaggaccgaggggcggtcgaggcgtactgcgccggccacgggatcacctgcgagtggaagccggacggcgacctccgcacccggcaggtctgccagggcaccgcccgccaccccgagaccggcgagccggtgtggttcaaccaggcccacctgttccacgtctcgaacctcgagccggaggtgcgcgcgaccctcctcgacctcgtcgacgagccggacctgccgcgcaacgtctactacggcgacggcagcccgatccccgacgcggatctcgacgcgatccgcgccgtgctcgccgcgcacaccgtcgtcttcccctggcagtccggcgacgtggtgatgctggacaacatgctgaccgcccacgcgcggacacccttcaagggcccgcgcaaggtcgtggtggcgatggcgcaagccggccgcgcgcagtga

SEQ ID NO: 6421 - DNA, 1926 bp, Methylobacterium sp.
atgcaagcggtcgcgcgatcggaatcccttgcggcgccctgcgccggccccgcggaccggaccggccgccgcggcggatggcgtgaccggtggcgcgcgccgcggctgcgcgtcgtgctggccctgggtttcggcacgctcggcttcctgacgaccctgacgctcgccgccctggtgagccgcgaggcgacccgacggctcgaggcggaggtcggcggccagctcgccgagatcgccggtcagatggcccggggcctcgatatcgggatgttcgagcgctggcgcgacatccagatcgccgccgcctcggacagtctgcgcgatcccgggaccggaacggccgccaagcgcgccgtgatggagcggctccaggcgacctacccggcctactcgatcatcgggctgatcgacgccgacgggcgcttctccgtcaccagcaccggcgccctggagggcgccgacgtctccggccgcgactatttccgcggcggccgcgcgggcccctacgtgggcgacgtgcacccggccaagctcctcgaggcgctgatgcccccggacgaggccgccgcgcgcgcggcggcgcgcgagcccctgcggctcctcgacgtcgcagcgccggtgcgggcgacggacggccgcgtcctcggggtgctggccgcccatctcgactggacctgggcgcgcgacatggcccgcatcctcgaggctggcctccggggccaccgccagggcgccgagatcctgatcctgtcccgcgacggcaccgtgctcctcgggccgcccgccctgcagggcgcccccctgccccgctcggtcctggcgggcggccggcccctcgatccggagggcacgagccgggtcggcccctggccggacggcgccgcgtatctcagcgcccgcgcgtccacggccggccaccgcgactatccgggcctcggctggcaggttgtggtgcggcagacggccgaccgggccctcatctcggtggcggccctgcgcgggggcatcctggcggcgggcagcgcggtggccctcgcggcggcgctgctcgcgtggctgctcgccggcctgatcgcccgccccctgctggatctggcggtcgcggccgagaccctgggccgcgaccagcccctgccgacgctgccccgctccctcgtgcgcgagggcgcgatgatcgccgacgccctcgcggcggcggcggacgagcgggcccggcgcgccgagacccaccggctgctgatcgacgaactcaatcaccgggtgaagaataccctcgccaccgtgcaggcgatggcggcgcagagcctgaagaatctgggcgccggcgcggcggccgggcgcgacgccttcgaggcgcggctcctcgccctgtcgcgcgcccacgacatcctgacccgcgagagctgggcgagcgcggatctgcgcggcatcgccgcccaggcggtgcggcccttcctgggtccggaccccgtgggcggcgatccgtcgaaccgggattcctccggtcgggagacttcggatcgtgaccctgcggaccgggacgctccgggtgcgaacaccccgcgcatcaccctggacggccccgacctgcggctgccgcccgagggcgccctcgcgctcacgatgatcctgcacgaattgtgcaccaacgcggtcaagcacggcgccctgtcggttccgggcgggcgggccgcgctggcctggacggtggaggcgggtcccgacaccgagaccctgcggctgacctggcgcgagtgcggcggcccgccggtcgtctcgccgtcgcggaaggggttcggcacccgcctgctcgagcggggcctcgccggaggcaggaccgccagcctcacctacgaggccggcggcctcgtctacgtggcggccaatcccctgcccgcggcgcgtctccacaccggacgggcctga

SEQ ID NO: 6422 - DNA, 819 bp, Methylobacterium sp.
atgcggacgagcctgcggcgcgatctcgactggttcagcttccacggcgcggtgctgctgctggccgggctctgcctcgtcctgctggcggcacccaccgtgatcgtcgtggtggtgtcgttcaccagcggcttctccctgcgcttcccgccgccgggttactccctgcgctggtacgcggcgctcgcggaggccgagcagctccgggccgccgcctggaacagcctcgtggtggcgggctggacgaccctgctgtcggtggtgctgggcaccgcggcggcgctcgccatcgcccggtcgccgcggctctccgcgcggctcctcgacagcctgttcctgtcgcccctcgtcctgccggccctggccttcgggctcgccgccctgatgctgttcagcctcgccggcatcccggtctcgccgctgaccctcgtcctcggccataccgtggtctgcgtgccctacgtggtccgcaccaccgtggcggccctgtcacagatggacccggtgctcctcgagagctcgacctcgctcggcgcctcgcgcctctacacgttccgccgggtgaccctgccgctgatccggcccgggatcctggccggcggcttcatcgccttcatggcgagcttcgacaacgtcccggtctcgctgttcctgcgcgacgccgccaccgacatgctgccgatccgcatgtggcaggacctggagggccgcctcgacgtcacggtggcggcggcctccagcctgctgatcctcgtgaccgtggtgctcgccgccgtgatggagcgggccgccggcctgtcccgccggatggcgggctga

SEQ ID NO: 6423 - DNA, 900 bp, Methylobacterium sp.
gtgagcgccggcccggccacggcgggcccggtcgcggcgcccctccgcccgggccgcgcctggacggcggcctacgacatccgcctcgcgctgccgctcggggcgttcttcctcgtcttcttcctggcgccgctggcgctgctggtgctcgtgagcttctacgccgatccggccatgacccgtttcggcctcgaccagtacgcccggttcctgctcgacccgttctccctgcgggtgctcggcgcgaccctgtggctcggcgtcgaggtcacggcgctgaccctcctgctcggcctgccgctggcgctgctcctgacctgggcgcccggccggctgcgcggcctgctgaccctgatcgtgctgctgccgctgctcacgagcgtggtggtgcggaccttcgcgtggatcgtgatcctggggcgccagggcatcgtcaacgccgcgctcctcggcctcggcctcaccgacgcgccgctgaagctgctctacaccgagggcggcctcgtcctggcgctggcgcaggtgcagctgccgctgatggtcctgcccctggtcaccgccctgtcgcggatcgacccgaacctcgccgacgcttcggcggcgctcggggcgggggcgtggcgcaccttcctccgggtgacgctgccgctctgcctgcccggcatcgtggcgggctgcctgctgaccttcgcggcggcgatcaccgccttcatcacccagtcgctgatcggcggcgggcagatgctgttcatgcccatgtacctgtaccagcaggcgtcctcgctcaacaactggccgttcgcggcggcgatcgcgatcgtcttcctcgtggcggtgctcgcctgcgtcacgctcctcaacctcgcgggccgcctgtcgggcggccgcgcgcgcgcctga

SEQ ID NO: 6424 - DNA, 1044 bp, Methylobacterium sp.
atgcccctgcaccgccgcagcctcctcgccggcgccctgaccctcggggccgcgcaggccttcccgggcctgtcccacgcgcaggcgcgcaagctcgtcttcgcgaccttcacgggcagctgggaggaggcgcaccgggccgtgctggtgccggccttccgcaagagctcgggcggcgacgtgatcctcgatccgatgctctcggtcgaccagatcgccaaggtccaggcggcccgcgccaacccgccgatcgacgtgatgctgcacgatccggggccagccctcacggccatcgcccaggacctcgtcgagccctacccggtggcccagtccgcccattacggcgacctgatcgcggacgcgcaggagccgatgggcccagcgccgttcttccagatcgtcggcctgacctacaatcccgagaaggtgaagacgccgccgacctcctgggccgacctgtggaagcccgagtacaggggccgggtcggcatcaccaacctgaactcgacgctgggcaccggcttcctcgtggagatcgcccggatgcacggcggttcggagaccgacgtcgagccgggcttcaaggcgctggaggcgctcaagccgaacctcgccgccgtcgcggccaacccgggcgccctggcggccctctaccagcaggagcaggtcgacatcgggccgggcaatttcaacgcgatccagatcctgaaggcccggggcgtgccggtggagttcgccgcaccgaaggagggcatcatcgccttcaagacgacgatccacatcgtcaagaacacgccgtcgaaggagctggccttcaagctgatcgaggccgcgctgtcgccggaggtgcaggccaagctgatgcagagcccctacctgatcgtgccgaccaaccggaaggtcgccatcgagggcgaggtcgcgaaagtcctggcgaaggacgcggacgagctgaagcgcaagtcggtgttccaggactgggccgcgatcaaccgcggccggccggcctggatcgagcgcttcaaccgcgagatccgggtgtga

SEQ ID NO: 6425 - DNA, 258 bp, Methylobacterium sp.
cgccacgggctgaacgccaaccagctgttcacgtggcgtcggctgatggagcgcggcgcgttcacggccgccggtgccggtgaagaggtggtaccagcctccgagctgcgggctgcccagcagcagatccgtgagctgcagcggctcctgggcaagaagacgctcgagaccgagatcctgcgcgaggcgatggagcgggtcgccgcccccaaaaagttgccctcgcgcgtgacctcgtggccggggaacggccggtga

SEQ ID NO: 6426 - DNA, 978 bp, Methylobacterium sp.
atgagcgaccaccgccccgtactcgtgatccacggcggtgccgggacgatcgcgtcgggccaggccgatcccggcgaggcgcgctaccacgcggccctcgccggaatcctggcggccggagcggcctgcctcgccgacggcgggagcgccctcgacgccgtgagtgtcgccgtcgaccttctggaggagtgcccgctcttcaatgccggccacggcgccgtcttcaccagcgccgagacccacgaactcgacgccgcgatcatggacggcgccaccctgcgggccggcgctgtcgcgggcgtctcgcgggtgcgccggcctggccgcgccgcccgcgcgctgatggaggccggcgagcacgtccttatggctggtgccggcgccgagaccttcgcgcgccggcacggcctcgagatggtcgagcccgattttttctcgacagaggcccgccgcgaccagcttcgccgagcgttggccgccgggcaagtcgccctcgaccacgacacggcgtcggggcccctcgacgagacccgcaagttcggcacggtgggcgccgtcgccctcgaccgggacggccacctcgccgccctgacctcgaccggcggcatgaccaacaagcgtcccggccggatcggcgactcgccgctgatcggcgcgggcacctacgcggacgacaggaccgccgcggtctcctgcaccggcacgggggaggccttcatccgcgtcgcggcggcgcacgatgtctgcgcgcgcatggcctacgggggccaggacctcgaggtggcagcccgggcggttgtcgaggagcacctgccgactgtcggcggccgcggcgggctgatcgccgtcgatgcgcgtggccgggtcgcaatgccgttcaacaccgagggcatgtatcgcggcctcgtccgctccggcgaggcgccggccaccgcgatcttcggcgagacccgccgcgtccccgcaccagcgcgctga

SEQ ID NO: 6427 - DNA, 885 bp, Methylobacterium sp.
atgccgagcgccacgacggacgacgggatacggctccactacgaggagagcggccaggggacgccgctgatcttcgtccacgagttcgccggcgatcaccgcagctacgaggcgcagctgcgccatttcggccggcgctaccgcgcggtcgcgttcaacgcccggggctacccgccctccgacgtgccggagtccgtcacggcctacgcgcaggcgcgcgcggccgacgacatcctggccatcctcgaccatctcggcgcgccgaaggcccacgtcgccggcatctccatgggtgccttcgcgaccctgcatttcggcctgcggcaccccgaccgggcgctgtcgctgtgcctcggcggctgcggctacggcgcggagccggagcggcaggcgctgttccgcgccgaggcggacgcgaccgccgcgatgctcctccgcgacggcatggcggccttcgcggagcgctacgccgtcgggccgacgcgggtgcagttcgagaccaaggacccgcgcgggcacgccgagttcaggcggatgctcgccgagcattcggccctcggctcggccaacacccaggccggcgtgcagaaggggcggccgtcgctctacgatctcacggacgagctggggcgcatgaccgtcccgaccctgatcgtcgccggcgacgaggactggccttgcctcgccccgagcctgatgctcaagcgggtcatcccctccgccgccctcgccatgctgcccaataccggccacgccctctcggtcgaggagcccgacgcctacaaccgcctgctggacgacttcctggcgcaggtggagagcggccgctggccgatgcgcgacccgcgggcgatctcggcgacgatcaccgggatcaggggctga

SEQ ID NO: 6428 - DNA, 552 bp, Methylobacterium sp.
atggcccgcgctctgccggacgttgcctccatcgaagagggtgttgggctcctccggacccagctcctgtcgatctccgacgcgatcgcgcgcacgcgccaggagatcgccgacctccggcaggagcaggagacgagccgcgcgcgggacgagctcctcgccgtggtgcagggcaccgaggacgccaccaacgcgatcctgacggcttcggagaaggtggatacgctcgcgcgcggcatcgtgagacggtcgggcgaggacgccaaccgggccgacgcccaggccatccagatcgagatgcagacgatcttcgaatcctgcaatttccaggacctcaccggccagcggatctcgaaggtcgtgcgcacgatcgtcctcgtcgaggagcggatcggcgagatgctgcgcgtctggtccggtcccggcgacccgccgtcgcggccgaatccgacggccgacacgcgcagcgaggaggcggccctgctcaacggccccgtcctgcccggcgacgcctcggtatcgcaggacacggtcgacgcgatgttcccgtaa

SEQ ID NO: 6429 - DNA, 282 bp, Methylobacterium sp.
atgacgcgcatgatcggaccgtggagggcgcccgccgcgtggcctgtccgcgcgctcgcggtctgcgccgcccttgccggatccgggccggcccgcgcgctggagaatccggcctcggccttctgcgcgacgatgggcgggcagacgatcctcgcgaagctgcccgatggcggcacgatcgggctctgcgcccttccggggcggaagatcgtcgaggaatggacgctgtaccggatgctccgcggcgtgaagccggcacccggcgccgacccgttccgctag

SEQ ID NO: 6430 - DNA, 1422 bp, Methylobacterium sp.; identical to SEQ ID NO: 5369

SEQ ID NO: 6431 - DNA, 1290 bp, Methylobacterium sp.
atgtccgacgaccgctaccaccggaaggcgctcggcgaccgcccgctccgtcccgagacgctgatgctcggctacggctacgacccggccctgtccgagggcgcggtgaagccgccggtcttcctgacatcgaccttcgtgttcacctcggccgagcacggcaaagccttcttcgactacgtctcgggacggcgcgaaccgccggtcggcgaggcggcggggttggtctactcgcgcttcaatcacccgaacagcgagatcgtcgaggaccggctggccgtcttcgaggaggccgaggccgcgctggtcttctcctccggcatgtcggcgatcgccaccacgatcctggccttcgcgcggcccggcgacgcgatcctgcactcgcaacccctgtacggcggcaccgagaccctgattgccaagaccctggccgggttcggcatcgcgccgttcgggttctccgacggcaccgatccggcgagcgtgcgcgccgcggccgaccgcgcggcgggcgcgggacgcgtcagcgtcgtcatggtcgagaccccctcgaacccgctcaacaccctcgtcgacctcggcctcgtccgggcggtcgccgaggagatcggcgcccggcagggcggcgaggcgccggtcgtcgtctgcgacaacaccctgctcgggcccctcttccagcacccgctgcgcgaaggcgccgacatctcggtctactccctgacgaagtatgtcggcggccactccgacctgatcgccggcgccgccctcggctcggcggcgcggatgaagccggtgcggcttctgcgctcggcgatcgggaccggtctcgacccgcattcctgctggatgctcgggcgctcgctcgagaccctgtcgctgcggatgagcgccgccaaccgcaacggcgagatcgtcggccggatgctggcggcgcacccgaaggtggcgcgcctccaccacctcgcgcatctcgagccgggatcgcggcaggcgcaggtctacgccaagcagtgcgcggcgccgggctcgacgttctcgttcgacatcgtcggcggcgaggccgaggcgttccgggttctcaacggcctccagctgttcaagctcgccgtcagcctgggcggaaccgagtcgctcgccagccacccggcctccacgacccattccggcgtgccgaaggcggtgcgcgaccggctcgggatcacggacgcgaccatccgggtgtcgatcgggatcgagcacccggacgatctggtcgccgacctcgcggccgctctgtccgtcctgggctag

SEQ ID NO: 6432 - DNA, 549 bp, Methylobacterium sp.
gtgatcctgcctcccctccgccggaccgcggccgacgcgcggacggtggccaccgtcgcccacgacggccaagtcgacaaggccggcaggccgtatatcgagcatcttgcgcgcgtggctgccggcgtgctcgggctgtcggaagggtgcccgttctggtccgacctggagcgggacgaggcgctgcaggccgcgtggctgcacgatgtggtcgaggacacccgctacgggttcggggacttggccaaggagggcttcagcgacaacgtgctgacctcggtcgccatgctcacgaagcccggaggtcgcgtcacctacgcggcctggatcaacaacatcgcgaaagtgggcaccctccgggcgaccctcgtcaagctcgccgacctcgaggacaattcggatcccgggcgtctggcgctcctgcccgcggagacccgcgagcggcttcatctcaagtacgagcctgccaaggcaatcctgcgcgcggcggcggcggcgaagggctggctcggttcaccgacgacggtcgaaggcagcgggccgcgttag

SEQ ID NO: 6433 - DNA, 276 bp, Methylobacterium sp.
atgagcagcacccgcaagacggcgcttcgtggcgccctcctcggcctcgccctcgcaggcccggcgctggccgacgacacgccgacgacggcgggcgcggtcgaccggctcaagggcctcgccaacgaggcggtcggcggcgccaagcgcggcgtcggcaacctgacggacgacgaggcgctgaaggccgagggacgcgaccagaagctccggggccaggcccagcaggagcgcggcaaggccaaggacgccgtcgagaacgccctcgacaagtag

SEQ ID NO: 6434 - DNA, 861 bp, Methylobacterium sp.
atggaatggagtgacgtcagggtctttctcgctgtcgcgcgatccggcacgctcggcggcgccgcgcgttcccttcagacaagccatccgaccgtcggcaggcgtctgcgcgcgcttgagcaggcgatcggtcacacgctctttcagcggactgcggacggtctggtcctgaccgaagaaggccacgggatcatcgcgctggcggagcagatggaggaaggcgcgctggccatggagcgccggctcgcggggcaggagcagaacctcaagggcagtctgcgcatctcatcggcggactggtttggggcgtatgtcctgcctcccatcctggcggatttctcaagggcctaccccaatgtcgacgttgaaatcctgaccggcacgcgcctgttcaacctcgcacagcgggaggcggacgtcgcttttcgtatcgtgccgttcaacactgccgatgtcgtacagcggcggctcttcaggctcgaatacggcgtctacatcgccgaggaggcgccagaccccggatacggcgatgggacgggtttccggctgatcacccatgagacatcgacgggtcacttcccggacatcgcgtggctcatcgagagttttcccaacgcaagaccggtcctgcgatcgaacaaccgcaacgtccaagggcgcatgtgcaagcaaggcgtcggcatcgcggtcttgccttgcgtcgtcggcactcagatccccggtatccgcaggctggaaacgccgacgcaaccgccagcccgagatatctggatgggataccaccgagatctgcggcgtcttcggcgtcttcgtgcgttcatttcgaccgtatcggaccatctcgtgaacgcgaccgtatga

SEQ ID NO: 6435 - DNA, 1383 bp, Methylobacterium sp.
atggacgaccactacgatgccctcgtgatcggcagcggcgagggcggcaagttcctggcgtggcacctcgccaaggccggccagagggtcgcggtgatcgagcgccgctggatcggcggctcctgccccaacaccaactgcctgccgagcaagaacgagatctggagcgccgagatcgcccaccgcgcccggcaggccgatcggtacggcatcgagaccggaccggtcgcggtggatatgggccgggtggtcgcgcgcaagcgggcgatggtccgcgacctcatcgacatgcacctcgaccgctaccgcgagagcggcgcggaactcgtcatgggaacggcccgcttcacgggccccagagcgctcacggtcgcgctgaacgcgggcggctcgcgcgcgctgacggccgagcagatcttcctgaatctcggcacccgcgcgaccatcccggacgtcccgggcctgcgcgaggccgggccgctcacccatatcgaggcgctcgaactcgacgccgtgcccgcccacctcgtcgtcctcggcggcggctacgtgggcctcgaactggcccaggcctaccgccggttcggcagcgcggtgacggtgatcgagcacgggccccggatcgcgggccgcgaggatccggacgtggcgtccgccctcgcgcagctcctcgaggccgaggggctggcgatccgcaccggcacggaggtggtgcgcgtgcgcggccgctcgggcgaggccgtggagatcacggtgcgcggcggcgccggtgaggcggtcatcgccgcgagccacatcctcgtcgcggcggggcgcgcgccgaacaccgacggcatcggtctcgaccgcgcgggcgtggcgctcaccgagcggggcgtcatcgaggtcgacgaccacctccggacgagcgcgccgggcgtctgggccatcggcgagtgcgcgggcagcccggccttcacccacgcctccgcggacgatttccgcgtgatccgcgacacgctggcggggatcacgcgctcgaccgcgggccggctgatgccgtcctgcctgttcaccgacccgccgctggcgcgggtcgggtcgaccgagacggaggcgcgcgccggcggtcacgccgtccgggtggcgcggctgccgatggcggccgtgctgcgcacgcggacgaccgggcagaccgacggcttcatgaaggccgtcatcggcccggacgaccgcatcctcggattcacgatgctcggcgcggaggccggcgaggtcatggccgcggtccaggtcgccatgctcgccggcctgccctacacggcgttgcgcgacgcgatcctcgcccatccgaccaccgcggaggggctgaacagcctgttcgcggccgtccccgcccgctga

SEQ ID NO: 6436 - DNA, 1227 bp, Methylobacterium sp.
atggagcaggacatcggcgagggggagcggccgcccgcttcgcgacggccatccgtctccaggtccctggacctcctcaacctcctgctcatcgacgtgaacggggcgatcaagccctacctcaacgtctacctctacgtgcaccgcggttggaatgatgcctcggtcgggctggtcagcacggtgtcgggcatcgtcggcatcgtggtgcagacgcccatcgggaccgccatcgacgcggtgcgcgacaagcgcgtgatcctgctcggcgccctggtcgcgctctcgctggccacgctcctcgtcgcgctcttcccgtacttctggcccgtgctcgcggcctcctgcgtgctggccgccgtcgggggcatgctgagcccggccatcgcgacgctcacgctcggcctgttcccatccgaccggatcgccgggcgcttcggccgcaacgccgccctggagcggaccgggaacgtcgccatcgccgtgctgatcgggctcgtcggctggctgttcccggaccgcgcggtgttcctcttggtcccggcctgcgccatcgtctcggccgcggcactctactccatcccgcgcgatgccatcgacgcgcgccgggctcgcggcggcggcgagggggagcaagccccggcccggtggcggaccctgctgacctgccggccgctcatggtcttcgcggcctgcgtagggcttttccatttcgccaacgcgccgctgctgaccctcgtcgcccaggagatcgggcaggcgcgcccggactggtcgtccgtcatcgtctccgtctgcatcgtcggcgcgcagggggtgatggtgccgatggggctcatcgtcggccgccgggccgagcgctggggccgcaagcccttgctcgtgatcggcttcgccgcgctgcccgtgcgcgccttgctctatctcgtctggcgcgacccgtactggctgatcgcggtccagtgcctcgacggcgtcggtgccggcctgctcagcgcggtgaagccgctggtcatagccgacatcacccgaggaaccggccgctacaacgccgcccacggcctgatcgggaccgtgcagggcgccggcgcttcgctgtcgttcgtgatcgccggaaccttggtccagcaggcggggttcgatgccgcctatctcgcgtgcgccgccgtcgcggcggtcgcgctcggggtgctcgtgacgctgctgcccgagacaatcccggagtag

SEQ ID NO: 6437 - DNA, 1608 bp, Methylobacterium sp.
gtgccggtgatcgaatccgctctggatccgcgcgcgcccgaggcccgtgccaatgccgaggccatgcgcgccctggtggcggacctgcgcgcgaccgccgaccgcgtccgcctcggcggcggggaggccgcgcgggagcgccatcgcgcccgcggcaagctcctgccccgggaccggatccgggcgctgatcgacccgttctcgcccttcctggaaatcggccagctcgccgggcacggcctctacggcggcgaggtcccctcggccgggatcgtcaccggcatcggccgcgtcgcggggcgcgagtgcgtgatcgtcgccaacgacgcgaccgtgaagggcggcacctacttcccgatgacggtgcagaagcacctccgggcgcaggagatcgcgcagcagaaccggctgccctgcctctacctcgtcgacagcggcggcgcgcatctgcccagccaggacgaggtcttcccgggccgggaccatttcggccgcatcttctacaaccaggcgacgatgtcggcgcagggcatcgcccagatcgccgtggtgatgggctcctgcaccgccggcggcgcctacgtgccggcgctgtgcgacgagtcgatcatcgtccgcggccagggcacgatcttcctcggcgggccgccgctggtgaaggccgcgaccggcgaggtggtcagcgccgaggaactcgggggcgccgacgtgcacgcccggatctcgggcgtgaccgaccacatggcggagaccgacgcccacgccctcggcatcgcccgccgcatcgtggccaacctgaacgcggtgaagcgccccgcgctcgcgccgcggcagcccgagccgccgcgctacgccgccgaggagatctacgcggcggtgccggccgaccgccggacgccctacgacgtgcgcgaggtcatcgcccggctggtggacggcagcgacttcgacgagttcaagcacctctacggccagaccctggtctgcggcttcgcccatatctggggctacccggtggggatcgtcgccaacaacggcatcctgttctcggagagtgccctgaagggcgcccacttcgtcgagctctgcgcccagcgcggcgtgcccctggtgttcctccagaacatcaccggtttcatggtcggccggcgctacgaggccggcggcatcgccaaggacggggccaagatggtcaccgccgtcgcgaccgcggcggtgccgaaattcaccgtcctgatcggcggcagcttcggggccggcaattacggcatgtgcgggcgggcctacgggccgcgcttcctctggatgtggccgaacgcgaggatcggcgtgatgggcggcgagcaggccgcctcggtcctggccacggtccggcgcgacggtgtcgagggccgcggcggcacgtggtcggcggaggacgaggcggcgttcaaggcgccgatccgggcgcagtacgaggagcagggccacccctactattccagcgcccggctctgggacgacggggtgatcgacccggccgacacgcgccgcgtcctggcgctcggtctctcggcgagcctcaacgcgccgattcccgagacccgcttcggcctgttccggatgtag

SEQ ID NO: 6438 - DNA, 603 bp, Methylobacterium sp.
gtgggtcgcaccgccggatcgaacgggccgcgcacggccgccgccatccgccgggccgggcttcggctcatctatcgccacggctacgaggcgatgaccctgcgcgccctggccgccgaggtcgggatccaggcggcctcgctctacaaccacatccgcagcaagcaggatctgctgttcgacatcgtccgcgaccacatggagacgctgctggcgcggaccgacgcggcgctggcgacggcgaccggcaccccgacggaccgtctccgcgccttcgtggcgcaccatgtcacgtaccatctcgagaagaagcaggaagtcttcatcgcgaatttcgagctgcgctcgctcgacccgccgcattacgcggcgatcgtcgccctgcgccgggcctacgaagaccgattggtcgcgctgctcgagcggggatcggaggcgggggagctggacgtccgggatgcgcgggtcgccggctacgcaatcctcgggatgctcaccagcgcctgcacgtggtaccggcccgacggccggatgaccaaggcggagatcgtcgccctgcacaccgacatggcgctgcggggttgcgtcaggcgtcagccatag

SEQ ID NO: 6439 - DNA, 219 bp, Methylobacterium sp.
atggcagagcgctactatttccgcctgaggagcgacggcgagacgatcgaggacgagaccggcgtcctcgccgcgtcggtcgcgcacgcggaggcggaggcgctggtgctgatcgaggagttccggaaggccggcgagctgccggacgctgcggcgggctggcggatggagatccacgacgcgaacggcacagtcctgcgcacgctgccgctctcctga

SEQ ID NO: 6440 - DNA, 405 bp, Methylobacterium sp.
atggcagacgccgtcgcgtcgcaacgcgctgtgctgattgtcgaggacaatcccgtgcagctcatggatgcggctgcagcccttcgcgacgcgggatacgaggtcgcggaggccgccactgtcgaagccgcccaggctcatctggcggcccgtcccgaacttgtggccatggtcgcggacgtggacttggcaggcgagcccttgagtggcttcaccctggccaaagccgtcgcggcgcgctggcccgaactggcgatcctgatcgtgtcgggtgtggcttggcccgccgaggagcagatgccgatgggcgctcgctacctgcgcaaaccgttcacaccggaggggctggccggcgcgctgggggctgtgctggcggcgcggggcgtagggtccgtgccgcattga

SEQ ID NO: 6441 - DNA, 225 bp, Methylobacterium sp.
atgaccgcagaggaacggctggctgagctgaaggcggcggacacgcgccgtcagacacgtcgcagggaggctctgaagcagaagggcatgacccagcagaacgtgtggctgaagccgtcggtcaaggccgtcatcgaccaggcgatccagaacggtcggttcaggagccgtaccgaggcgatcgagtgggcgctcgcgtctgccttcgaggagaagtcggcatga

SEQ ID NO: 6442 - DNA, 1167 bp, Methylobacterium sp.
atgcacgagttcacggagctgcgcggccgcgaggcggccttcccggaggcggagttcgccgcccggcaggcggcggcccgggccgccatcgcgggtgccggccacgacgccctcgtggtgaccggcccggagacgatctactggctgaccggccgccagacggcgggctacttcgccttccaggcactcctcgtgcccgtggacggcgacccggccctcctggtccggcagctcgaactgccgggcgcggccgccaacacgtggctcgacgacatccgggcctacccggacggcgccgacccggccgcggccctggcggccctcgtgcgcgggcgcggggtcgcccggccggccctggagcgggacggctggttcgtcgcgccggcgctcgcggcgcggatcgacgccgccctcggaagcggcccgctgcccgacggatccggcctcctcgcccccctgcgggcggtgaagtcggcggccgaactggcggcgatccgggccgccgcccggtacgcgcaggccggtctcgccgcggggctcgacgcctgcgcggccggcaccgacgagaacgccgtcgccgccgccatgctggcggccgcaacggccgccggatccgaggccatggcgatggagccgctggtcgcgtcgggaccgcgcagcggtctgccgcacatgacgtggcggcgccgccggctggagccgagcgacgcggtcttccttgagctcgccggcagccacgcccgctaccacgcggcgctaatgcgcagcgtctggatcggcccgccgccggccgaggcgcagcggatgatggactgcgccctgcgcgccctcgacgcggcgctcggcgcgatccgccccggccatccctgcgccgccccgcacgcggcggcgcaggccgtgatcgacgcggcgggctacggcccggccttccgcaagcggatcggctactcgatgggcgtcgccttcgcgccggactggggagagggtgccctgctctcgctgttcaccggacaggaccggccgatcgaacccggcatggtcttccacctgccggccaccctgcgccgctacggcgcctggacggtcggcgcctcggagaccgtcatcgtcaccgcagacggggtcgagcccctgtccgacctgccgcgcaccctgtcggtgcggtga

SEQ ID NO: 6443 - DNA, 339 bp, Methylobacterium sp.
atgggcgtcgatatcgcgcgcgtgaaggcgctcatcgcgacgttggaggcggtgacctccgccccccattttcacaggacggccttccggacgccgcgcaagaccttcgcgacgctggacgaggtgggccacgacatcaacctgatgttcgacccggacctgcgcgacttcttctgcgagcaggtgccggcggctttcagccccgttccgggcggctgggggcggatgggcgcgacgcggtgcgacctcgcgatcgtcgacgaggcgaccctgatgtcggccctgacggcggcccaccggctcgccgcgccgaagccgcgcacgccccgccgaccgtga

SEQ ID NO: 6444 - DNA, 333 bp, Methylobacterium sp.
gtgaccggcctgtcgctccacgccgtcgacgccgccacgggccggccggccgaggggatgcgcgtgcgcgtcctgcgcgccgagggaaggcggcgggtgatcgccgagggccgcctcggggcggacgggaccctcgaccatccggtcgtgcggacgcggctcgccgccggcctctacgaggtcgtgttcgtcatcggggaattcgtcggggccgcgggggaggggttcctggaggaggccgcgatccgcttccggatcgacgaccccgaccgccactgccacctgccgctgaaattcaccgccttcggggtggcgctgttccgcggctgctga

SEQ ID NO: 6445 - DNA, 1251 bp, Methylobacterium sp.
atgagcaacggtctgacgccgacggccgaccggatcgtcgtggccagcgaggccgactggaacgacgcgtggtacctcgtctgcatgaaggtctcgacgatcggcttcgtcgtcgtcgatgcccgcgagcgggtcgccaccctcgacgcgctgcgggcggccggaatcaccgacatcgccgcccacctcgacgcccatccggacgtggccgaccgcctgcggcacgggatggtcatcctcgacgtcaacgaggcggcggtgcggatgttcggcgcgggcggccgcgcggacatgatcgggcagcgcacgcagcgcttcttcgacccgctctgcaccgcccaggtcaattccgcccgggccttcgcggcgggcgcgacctcgttccagcagcaggcgcacagcgtccggctcgacggatcgcgcttcgagacgctgttctgcgtggtcccgcgggcggacggcgccacctccggcctgtggctcgcctccttcgtggacatcaccgagcacgtcgcgcggcagatgtcgctggaggtgctgcgcgacgagctcgcccacgtctcccggatctcgacgctgggcgagctctcggcgtcgatcgcgcatgaactcgggcagcccctatcgtcgatcggcatgaccgccggggcgatgctgcgcctgctcgatcgcgcggatctcgaccgcgacctgctccggcggcaatgccagcgcatcgtcgatcaggtcacgcgggccggggacatcatcgatcgcacacgccgcatggccgccaagcgggacagcgtccgcgcgcccgtctccgtggcggaggtcctggccgaggccgcgcggttcgtggcgcacgatctgaaccgcaccgagatcaggctcaccgtcgccccggcggacgcggccgcgcaggtcatcgcggaccggatccagctgcaacaggtcttcgtcaacctgctgatgaacgccatccagatccatcggcaggcgcggacccccgggcccgagatcgcggtcgagaccgtctgccgggacgggtcgatcacggtcgacgtcgtcgataacgggccgggcctcgatcccggcaccctcgaccggctgttcgacggcttcttcacgacgcgggccgaggggctcggcctcggtctccggatctgccggaccatcgtggcggcccatggcggctcgatcgacgcgagcccccgcgacagagcgccgggcgcccgcttctcggtgtgccttccgctcgcccagtcctga

SEQ ID NO: 6446 - DNA, 399 bp, Methylobacterium sp.; identical to SEQ ID NO: 5393

SEQ ID NO: 6447 - DNA, 570 bp, Methylobacterium sp.
gtgcggcaatggcgaaaggagacccgcgccgcgctcatcgcgcggcgggtcggcatctccgcccaggaccgcgccgcccggagcgagcggatcgagcagggtctccgagccgctctaccttcggcatcgggcctatcgatcggtctctactggcccttcaggggcgagttcgacgccagatccctcctgacggagctgcgcggaagcggggcgcgactggcgcttccggtcgtcgtcgagaaggcgcgcccgctccagttccgggtctggtcgccgggcgagcgcatgatccgcggcgtctggaacatacccgttcccgcagagggcgagattgtcgacccggacgtcctgatcgcgccgctcgtcggcttcgatcaggcagggtaccgcctgggatacggcggcggcttctatgaccggaccatcgcgtccaggtcgacgaagccgcgggtcatcggcgtcggcttcgagttcgcgcggctcgcgacgatccacccgcaggcgcacgacgtccccatggacatcatcgtgacggaaggcggcgtctggccccgcacggagcgaccctga

SEQ ID NO: 6448 - DNA, 1233 bp, Methylobacterium sp.
gtgctgagcgccggactggccgcgaacatcgcggccaatgtcctgacgcgggggactttgatcggccccttcctgtacagtctcgccaacctcgccgaggtgatgttggccgtccgtctcctgcgaaggacctacgagcaggacgccctgctgcaatccacgagatccgccctgcggttcctcgcgatcgcgggattgctggcaccggccgcgagcggcgtcctgggaggcttgacggcgcatctcgtcttcggccagcccctgttgcgctcgttcggcacctgggtcgcgagcgacggcctgggactcatcgtcttcacgcccttcctgctctcgctgttccgaggcgattacgcgcgtgcgctcgcggagcggagctggcgggaccggctcgaagcggccgccttgctcgtcctcgcaggttcggtcgcgtacgcgaccttcttctgcaccagccgccccttgctgttcctgatcttcccgcccctcatcctgatcgctttccggctgggccgcctgggtgtcaccgcggccgtgatggtcgtggccgtcatcggaggcgtcgccacgatgtacggtcgcgggccgatggtcctgatcgcggccgacgccgtcacgcaggcgcaggcgttccaggtgtttctggccttcatcctgctgacctgcctgcccgtcgcggcggaggtctccgcgcgggcgcggctcacggccgagctggccgcgcacgatcgggagatgacgaggagcgccttcaccgattccctgacaggactgctcaaccgggcaggtttcgagcatcagatcgagaccatcctgcccgtcagggcgctgccgcccgtcagcctgatcgcgatcgacgtggatcatttcaagcagatcaacgaccgctgggggcatccggcgggcgatcgcgcgctcgagactctcggatcgctgctcgcgtcgcagatccgcccgggggatctggtcgcgcgcctcggcggcgacgagttcgtgatccttctccgcgagagcgatctcgcgcgcgcccgggcggtgtgcgagcggatccgcgcgagcgcacgcgccgcggcattctcgaccagtgccgggtccgaggcgccggtcagcctgagcatgggcttggccgtcgcgcgcgtgggcgagggctacgaagcgctggctcagcgggccgacagcgctctgtacgaggcgaagcacgccggccgcgacgccctgcgatgggccgcctga

SEQ ID NO: 6449 - DNA, 891 bp, Methylobacterium sp.
atgaccatcgtcgtccctcaccccgccgctcagcgcggcggccgacagcggttatctacacgtgggcagcctggatccgcgaccaccagccggatcaccgtcccgctcgggagcgctgcggcactcggctgcggccacgtccagcccgcgatcccgcagatctgcgcacccgaactgattgccgcagcccaggccgcgctcgacggcgcgttccgggcgaccttcgtgcccgatcccctgctcggaccaggcttgtcgcagctcggatccgtgctggcctccatggtcaagaggcacgggtcgctcatcgaggcggccatcacggacgtcctggagcgaagcgggcgctacatcgtgctccgcaacgtcgcgatgccgatcaccgttccgacccaggaactcgtccgcgccagcagcgtcgcccagctcaaccagacctcgatcgaactcgcgggcgccgtcgcgcagtcggtattcctcgacctgatcgtcgtcgaccggaaagagagccgagccatcatcgccgaggtcaagagaggctccggaaaaaatgaggccaggaaaatacaccaagtcgaatgggtgctgcggtgcgcgcaggttcagggccgctcgtttctggcttcactcggctatgaggtcgcgcaaatccgcgccgtgctgatcgacgtctatggacgggccgggtacggtgatgaccttacggtgagcggaccggccatagatcagctgttcgcgaccccggtcttggcagcgctcgagactgtgacggcggcgcttcaagcccgattgcgcgcggctgtgccggaccttctgacgatggcgttggcgagcctcgccgttcctgagaacgtcaaacacccgcactcgcccgggccgctcgcgccctaa

SEQ ID NO: 6450 - DNA, 315 bp, Methylobacterium sp.
atggcgcgcgacggcaaccgaccccacccgagcgccctggcgcggtatccggttccgatcgagctgatctcggccctgttccgcgccgacgacgcggagcgcgaccggctgctcgcgccgatgccggcctacggccgcgcccggatcgccgcctactgcgccgagcacgcgcggctcgaggcgctcggcctgaaggtcgcgcgctcctgcgacgaggccacgctggtcagggctgcgggcgtgacggtcggcgccgacctcttcgcgcgctcgcgggcgcccgcaccggcgccgatccagctccaggccgcctga

SEQ ID NO: 6451 - DNA, 1161 bp, Methylobacterium sp.
atgccagcgtcaaccgtgatatccggtgcgtcctccaccgaaacgcaagccgcactcgtcagcggcgcgagcttcgccggcttggccacagcattctggctgaaccagcttggataccgcgtcacggtagttgaggtcgcaccgggtctgcggcgcggcgggacgcccgtcgacatcgagggcgagacaatcgcaatcctgacacgcatgggcttgatggacgctgttagcgctcgaacgcttccccctcgacgcttcgccttcaaggatgcggaaaacgcaacgctgggcgatatggcccaccacccagacgatgagggggggccgcgctacgagatccaccgcgacgacctgttggatgttctgtgcggcgcgatcgagggggatgtggaactgcggttcaaccgttcgatcgtggcgattgaagagcgtccggaggcggtgtcggcgacgttcagcgacggcagtcagcacgaattcgcactgatatgtggttgcgatggaaaccgctccaatacgcgcagactggtgttcggcgacggtgagcagttcgcccatttcatgggcggatatttctacctcaaagtcgtgccagacaccggactgctcgaaccgaacagctcggagctttttgccgttcctgggcggatggcgatgctgaccggctatgacgatcgcacggatattggcttcgggtttcgcacagccggcgagatcgaatacgactaccggaacaaggatcagcaacgtcgcctgatcaggaaaaatttttccggtctgaagtggaaagtaccggatatgctcgctcgtatgggcgaggacaacgacttctattttgatcgtatcagccagatcaggatgccgacgtggtctcacgggcgcatcgttcttgtcggcgacgcaggctattgcgtgtccccgttcgcaggcctcggtggctcgatggccatcatcggcgcgggaaggctggccgacgccctggcgcggcatccggacaaccatgccgccgcatttcaggattatgaggaagggctacggccgttcgttgagcaagtacaagaacgggccgcgatcgacagcatacagatgctatttcccggcgacgatggcgaaatggcagagcgagatcgtaagctggccatcggtgacatcggcgtttga

SEQ ID NO: 6452 - DNA, 444 bp, Methylobacterium sp.; identical to SEQ ID NO: 5399

SEQ ID NO: 6453 - DNA, 2268 bp, Methylobacterium sp.
atgcccgaacccgacggacagcccttcaggctgcaggtcgccaacgcgcggccccaggacggtggccgcggcatcgcccacctgccgcaggcggcgctggacgaactcggcctgcacgaaggcgacatcatcgagatcgtcgggaagcgccatacagccgcagtggcggtcgggccctacgaagaggaccagggcctcagcctgatccgcctcgatggcctgcagcgcgtcaatgccggtgcgtcgagcggcgatcatgtggaggtgcgccgcgccgagatccggccggccacccgcgtggtggtcgccccagcgcagaagaacgtccgcctccagggctcgggcgaggccctgcggcggaccttcttccgccggcccttgatcgccggcgacttcatcgctaccgcgacccagcgcggcggcggtcccgacccgcggctgccgccgcagctgcgctcctacctcgagctgcccgcctacggcctccaggagatccgcctcaccgtcgtggcgacgcagccgcgcggcatcgtctacgtggcggaagggaccgagatcgagctgcgcccgctctacgaggagccccgcgacggccaccgtgccgatgtgacctacgacgacatcggcggcctgggcgacacggtcgaccagatccgcgagatggtcgaattgcccttgcggcaccccgaactgttccagcgtctcgggatcgatccgcccaagggcgtcttgcttcacggtccgcccggcaccggcaagacccggctggcacgggcggtggccaacgagaccgaggcccggttttttcacatcgccgggcccgagatcatgggcagccggtacggcgaatccgagcagcgccttcgcgaggtcttccaggaagccgcacagaactcgcccgccatcatcttcatcgacgagatcgactcgatcgccccaaagcgcgagcaggtcaccggcgaggttgagcggcggatcgtggcacagctcctcaccctgatggacgggctggagccgcgccagaacgtcgtggtgatcggcgccaccaaccgacgcgacgccatcgacgaggccctgcgccgccccggccgattcgaccgggagatcatcatcggcgtcccggaccagccaggccggcgcgaaattctgggcatccacacccgcggtatgccgctcgcctccgatgtcgatctcgatgccatcgcccgcaacacctacggcttcgtgggcgccgatcttggcgccctggtccgcgaggcggccatggatgcggtccgccgcatcctgccggcggtgaacctgcgcgacggcatcccggccgaggtgctggagggattgagcgtcgagcgcgacgacttcctgtcggcgatgaagcggatccaaccctcggcgctgcgcgagatcatgatccaggtgcccgacgtcacttgggacgatgttggcggtctcgccgaggcgcagatgcgcctgcgcgaaggtgtcgagctgcccttgcgttcgccgcaggccttccggcgcctgggcatccgcccggccaagggcttcctgctgttcgggcctcccggtaccggcaagaccctgctggccaaggcggtcgcccgggaggcggaggcgaatttcatctccaccaaatcgtccgacctcctgtcgaagtggtacggtgaatccgagcagcaggtctcgcggctgttccagcgcgcccgacaggtcgccccgacggtggtgttcatcgacgaaatcgacagccttgccccggcgcgtggaggcggcctcggcgagccggccgtgaccgagcgggtggtcaatacgatcctcgccgagatggacgggctggaggaattgcagggcgtcgtggtcatggcggcgaccaaccgcccgaacctcctcgacccggcgctcttgcgccccgggcgcttcgacgagctggtctacgtgccggtgccggacgcggcaggtcgtcgccgcatcctggcgatccacaccaagggcatgccgatcgccgaggatgtcgacctcgacgccgtggccgagcgcaccgcccggttcaccggcgccgacttggaggacctcactcgccgcgccggcctgttggcgttgcgggaatccctcgaggccacccaggtgcggcgcgcccatttcgagcaggcggcgcgcgagacccggccctcggtgacgcccgagatggagcgggaatacgaggagatgctgcgcaccttgaagcaggaggggccgcagcggcagccgatcggatttatccagaggagctga

SEQ ID NO: 6454 - DNA, 150 bp, Methylobacterium sp.
gtggcgattacccccgagcagagtgcacttctcgaccgcgttccgtctccttcggcgctgcggcgtcttccggagtcggagctgcaggcggtggccgacgcggtgcgcgccgagatgatcgacgcggtctcgatcaccggcggccatctc

SEQ ID NO: 6455 - DNA, 225 bp, Methylobacterium sp.
atggcagagctgatcgaactcctgggagaattcccgggcggccgggacaggaagcgagccgaggccctatccgagcgattggacgggctactgtgtaaagcgcgcgagcagggggctccgcacacgacgttggcggccatccggggcgcgcagaccttgctgggcatggctgagatgcggccgctgccagcgctgtcgatccaagctaccggagcagggaggtag

SEQ ID NO: 6456 - DNA, 945 bp, Methylobacterium sp.
atgacgatcaagcaccgtgacctcgcgggcatcgacctgaacttggtcgtggcgctggacgcactcctgaccgagagcagcgtcacgcgcgctgccgcgaaggtcggcatcacgcaatccgccatgagcagcagccttgcccgcctgcgcaggctcctcggcgacgagctcctgacgcgcacgccggacggcatgcgcccgacaccgcggtcgctcgccctcctcgagccggtccgcgccgccctgcgccaattccagggcatcgtcctccgggaggacgactttgccccctcgcaggtcgagcggtccttcacgctcgccatccccggcagcgtcgaggtccgtctcatcccgcgcctgctcgcgttcctcgcctgcgaggcgcccggcatccgcctgcacctggtcggcctcgattacgggagcgtgctgggggacctcgacgccgacaggatcgacatggccgtcggcatgatctccgagggccaggtccaccacaaggtgcggcccctctatcgcttcggcttcctgagcctgttcaatccccggctgctcggcgtgagcggtccgctctcgctcgacgacttcgtccgcttcccgcacatcctgacgtacctgaccggcgtcggcccgggggtggtggacaaggcgctcgcgaaggtgggccggacgcggaggctggcggcgacgacgccgcgtttcgccaccgtgccgtttcacgtgcaggccgcgcccttgatcgccacgatggccgacgagctggccaccaccttcgcgacccaactcggcctggcgacgagccccgtcccggtgccgaccggggagatcgtcatctccatgctgtggcacgcctcctatgaccgcgatcccgcccatcgctggctgcgggaggtcatggttcgcctgggacgggaggccggtagcgcccgcgaagacgcggtgtag

SEQ ID NO: 6457 - DNA, 339 bp, Methylobacterium sp.
atggcgaccatgatgctcgtcgccatccccctgacccatcccccggcctccaaggctgccagaaaggcggctgaccgcgaacgcaagcgcgaggctcgcgaggccatgaggcaggccggggtgcccgaccctcgcatgttggacgcggccatcgtcgacgcgatgcgtgatgcgatagcctccgggggggtgccggacgggtcgacgatgatcccgcttcgggaggtcctccggctggccgcccggagcctgcagggccgtacccagcagggcatcgccctcgaccgggccgagatgcaccgcgccctggccaaccggctggcaccccgcaaggactag

SEQ ID NO: 6458 - DNA, 1008 bp, Methylobacterium sp.
atgacccagcactacgacgtcgccgccgttcgtcaggcgtttccggccgccgagcacgtggtctatctcgacagcggcttccagaccccgctctcccgccccgtgaaggaggcgtacgagcgcttcctgcgcgaagggttcgagaccgccggccccaagcaagtctggctcagccgcctcgaagagacccgcgccaaggtcgcgacgctgctcggcgcgcagccccacgagatcgcattcaccaagaacacctcggagagcatgaacatcgccgccaacgcgctgccgctgaaggccggcgacaaggtgctgatgatccacggcgaccatccgaacaacgcctacgccttcctcaacctgaagaagaagggcgtcgaggtcgtgttcatcccgatgacccaggtggtgagccggagcatgcctaggatactctgcgttgaggacgacgaggaaacggcgagcctggtcgcggaagccctggtcgacctcggctacacggtggaacgcgcctcggacggggaggcgggtttgtcggccatccaaatgtcacctccggacctggtcctgtgcgacgtgcgcatgccggggatgaacggcctggacttgctcgagcaactggctgcggctgccccgcacctcgcgcggatccctttcgtgttcctcacggcgctcgacgatcgcggcagcgagatcgccgcgcgccggaagggcgcggatgactacctcaccaagccggtcgacttcgagatgctggctgtcgtggtggagcatcgtctccgcgcgggtcgaggcgggcagggccaagacgcgttcggccatctgaccggccgggaacgggaagtgttgacctgggccagccgcgggaagacgtccgcggagatcgccctgatcctcgatctgcgggagcgaaccgtcaacttccatttcgaccaggccatgaagcgcctgaacgtcgtcaatagaacgcatgcggtggcccgtgcgctctcgttgcggttgatcgattga

SEQ ID NO: 6459 - DNA, 231 bp, Methylobacterium sp.
atgccgcgctacttcatcgacaccgccgaccacgtcgccgtccgggacgacgagggcacggtcctctcggaccgggtcgccctgcgggacctgctgcgccggaccctgacggcgctcctgcacgacgagggcgaggagaccggggtgaacgacttcaccgccagcgcctacgacgaggacggtcgcctcgtgatgcgggcccgggccagcttccacgtcgtggacccgtag

SEQ ID NO: 6460 - DNA, 1530 bp, Methylobacterium sp.
atgttcgagcgcttcctcctcgccgccggcctgctcgccgcggcaaccgcgcccgccgccgcggccggcgacccgatcctagcgatcagcggccagcccgagaccctcgacccgtacaatacgaacacgacgctcacgaccgccgtcaccaagtcgttctacgaaggcctcttcggcttcgacaaggatctgaaggtccgcaacgtcctggccgagagctacgagacatcgcccgacggcctcgtctacacgttcaagctgcgcgagggcgtgaaattccacgacggcacgacgttcgacgccgctgcggtgaaggccaacctcgaccgcgtcctcgacccggaaaaccacctcgcgcggtacaaccagttcaaccgcatcaagacgatcgaggtgctctcgcccacgagcctgcgcatcaccctgaaggagcccttcgggcccttcatcaactcgctggcccacgcctcggcggcgatcatctcgcccacggccctgaagaaatacgggaaggacatcgccttccacccggtcggcaccgggccgttcaccttcgtcgactggaagcagaccgattacgtcaagggcgcgaagttcgccgattactggcaggccggcttcccgaaggtcgacaccatcacgtggaagccggtgcccgagaacggcacccgcgccgccatgctgcagaccggcgaggccgatttcgccttcccgctgccctacgaacaggccaagatgctcgaagccagcaagaagctgaagatcgaggtccacgcctcgatcatcgagcggtatctcagcatgaacgtgctgcagaagccgttcgacgacctgcgcgtccgccaagcgatcaactacgcgatcaacaaggaggcgttggccaaggtcgccttctcgggctacgccttcccggcgcagggcatcgtcccgcagggcgtgcgctacgcccacaagatggatccctggccctacgacccggccaaggcgcgccagctcctcaaggaggccggctacgccaacggcttcgaggcgaccctctggagcgcctacaccaccaccaccgcccagaaggcgatccagttcctccaacagcagctcggccaagtcggcatcaaggtgcagaccctggcgctggagcccggccagcgcaccgagtgggtgcagaccgcccccgatccgaagaccgcccgcgtccgcctctactatgccggctggtcgtcctcgaccggtgaggcagactggggcctgcggccgctgctcgcgacggaggcgtggccgcccaagctcaacaacaccgcctactacagcaacgccgagttcgacgcccttctcgccaaggcgctggtctcgacgaacgacgcggagcgcgccgagctctacgccaaggcgcaggagatcgtgatgaaggacgccccctgggcgccgctcgtcaccgagcagaacctctacgcgacctccgcgcggctctccggcgtctacgtcatgcccgacggcaacatcgattccggcgagatcgccgtcgctccctag

SEQ ID NO: 6461 - DNA, 1257 bp, Methylobacterium sp.
gtgctggatcactccgccgagacccacctcgccgagacgaacacggccggcccgctcgcgggcgtgcgggtcgtcgacctgaccagcgtgatcatggggccctcggcgacccatatgctggccgatctcggcgccgacgtgatcaaggtcgagacgccggagggcgattccttccggcattaccggcctgcccgcggcgccgggatgggcggcaacttcctgcacctcaaccgcaacaagcgcagcgtccgcctcgacctgaagcggccggcggcgcgggccgccctcgaccggctgatcgccacggccgacgtcctcgtccactccatgcggcccgacgcgatcctgcgactgggctacggctacgagcgggtgcgcgcactcaggcccgacatcgtcttctgcggcgcctacgggttcggggccgacggcccctacgcccataaggcggcctacgacgacctgatccaggcgggctcgggcctcgcggcgctccagaccgccgcgtacggccagcccggctacctgcccacggtgctgtgcgacaagatcgccggacaggccatcgcctgcgcgatcctcgccgccctctacgagcgccgggccggcggcggcgggcaggcggtcgaggtgccgatgttcgagaccatggtggagttcaacttcgtcgagcacatggtcggctacgccttcgagccgccgctcggtccgccgggcttcaaccgggtcctgagcccgcggcgcaagccctaccggacccgggacggccacgcctgcatcctgccctactcggaccggaactggcgcgacttcttcatccacaccggccggctcgagttcgtggatgacccgcgcttcgcgccgctcgccgtgcgggtcgagaacatcgagatcctctacgcgctggtcgaggaggaggcgccgcgccggaccaccgccgagtgggtggcattttgcgattcggtgagcatcccttgcatgccggtcctcggcctggaggacctgccggaggacgcgcacctgaaggcggtgggcttcttcggcagcgccgagcatccgagcgaggggcgctaccgcaccatgcgccggccggtctcgttcagcggcagccgcttcgcgatccgccgccacgccccgcggctcggcgagcacaccgccgaggtcctggccgaggccgggctcgaaccggccgagatcgccgccctgatggacgcgccggacaagcccgacaccgcgcccctggaggccgcccgatga

SEQ ID NO: 6462 - DNA, 1191 bp, Methylobacterium sp.
atgggaccgcttcaggatatccgcattctcgacctcaccaccgtgttgatggggccctacgcgacctcgatcctcggcgacatgggggcggatgtcatcaagctcgagccgcccgaaggcgacctcatccgccaggtcggcccgagtcgaagcggctgcatgggcccgatcttcatgcacgcgaatcgaagcaagcggagcatcgcggtcgacctcaagacgtcggcaggacgcgacgtcgcgctgcgtctcgccgcgaccgccgacgtgctggtctacaacatcaggccgaaggcgatggagcggctcggcctcggctacgaggcggtggctgcggttcggccgtccatcatctatctcggggcattcggattcggccaggacggcccttatgccgaccgacctgcctatgacgacctgatccagaccgcgagtgccatcccggctctcatggcggagagcggcgaagaaggtccgcgcttcgtgccggtgaacatcgccgatcgggccgtgggcctgcacgccgccaacgcgatcctcgcggcactgctgcaccgcgagcgtacgggcgagggccagcgcatcgacgtgcccatgttcgagacgatggcgagcctcgtactcggcgatcatctgggcggcttgacctacgagccgccgctcgatggcggcggctacccccgcctgctatcacgccatcgcaagccttttcggacccgcgacggtcatctctgtgtcgtgctctacacggatcggcactggcaggcgttcttccggcttgccggtcaggattggcgcgccgcggatccgcgctacgccacccacgccagccgaatccgccacatcgacgagctcaacgggatgatcgccgagatcttgccgtcgcggacatcggcggaatgggaaagcactctgggtgagtgcgacatcccctgcatggcggtccagacgccggcgagcttgctcgagaatccgcacctggttgcgacgggcttcttcgagagcgtgccgcacgcatcggaagggcaggtcaagtccatgcgcgtgccgtcgcattggagtcggacacaaccggcgccgggacgcctcgcccctggcctcggtcagcacagccgcgagctgctgctcgagatcggcctatcggacaccgaagtagataagctcgtgaaccagagagccgtgtcagaatag

SEQ ID NO: 6463 - DNA, 288 bp, Methylobacterium sp.
atgaccagacgatgtctgctgatcttggtctcggtgctctcactgtcgctgcagaccggcgtggcgctgtccgagagcgagatgccggcaggaggcgccttcatgagcagttacacttcggatccttacttcgacccgcggtcacggtactcgcaggctcacgccaccggagacatccgcggacagccgatgctcgtcgaaccgggcgacgccccgccgccctgcaagctcttcgacacggcctgcgcggccgccttcgagcgctcacgcccccacgcgtatcgctag

SEQ ID NO: 6464 - DNA, 1077 bp, Methylobacterium sp.
gtgcgcgctcccgctgtcgtcggcctcgtcctgctgctgatggccggtccgggcccggcctcggcacaggtcgaaccatctccgacggccgaggggaccgggtccgccgcggcccgcggcgcgaccgtcgtggtcgtgcgggcgacgaccgacgaggccgaggtcgccgacctcctcgcgggcttccgcgaggcccatcccggcgtggcggtctcctacaccaagatgaattccgcgaccctgtacgacggcttcgtggaggaggccgcggccggcgcggtcgaggcggacatcgtgtggagttccgccatggatcgccagatcaagctggtgaacgacggctacgccgcccactacgcgtcccccgaggcggcctccctgccggcctgggccgtgtggcgcaacgaggcgttcggcgtcacggccgagccgatcgccatcgcctacaacaggacgctcctcccgccggagcaggttccccagacccgcgccgacctgatccgagccctgacggaccaccccgagacgtggcaggggaaggtcgccgcctacgatccggagcggagcggcgtcggctcgctcatcctcgcgcaggacgcggacgtgacgccccggacgtgggacctcgtctcagccctcgggcaggccggcgtgaagctctacacccggacggagaccatgctcgaccgcatcgccgcgggcgaggccgtcctcgcctacggcgtgttcggcgcctacgccctcgagcgggcccggcacgatccggcgatcggcctcgtgctgcccacggactacacgctcctcgtctcgcggatcgccttcatcgcgaaggacgcgccgcatcccgtcgcagcccgcatgttcctcgactacatgctctcccgcgaggggcaggcgcggctcgccgcccggtcgctcacgccggcccggacggatgcccgccgggccgacgacccggtcgcgtccgccacggccctgcggccggtcccggtcgggccggagctgctggccaatctcgaccagatccggcacgcccgcatgctgcggcgctggcggcgcgccatggaaggccgctga

SEQ ID NO: 6465 - DNA, 1401 bp, Methylobacterium sp.
gtgacccggccgcgcgcgccctcgatccggcggcgcctgctcgtccgcatgctgctcccggccctggcgctcgcgctgctgctgggcttcgtcggcgcgctcgtgatccggaacgtcgtggagacgacgcacgaccgcctgctcgacgggtccgtcctggcgatcgccgagcggctgaccgtggaggacggcgaggtgtcggtcgacctgccccgcgtcgccctcgggatgctggagagccaggcgcaggaccggatctactacagcgtcacctacggcggggcgctggtgaccggctatcgcgacctcccgggcctggacgtcgatacgctcccgctcggggtgacgaaccatcgcgacggcatcgtccgcggggcggccgtgcggatcgccgcccaggcccggcgggtctacgggaagccggacccggtcctcgtgcaggtcgccgagacgcgcgaggcccgccagggcctagagcgacgcctgctcgccgggctcgcactggccgagctggggctgatgggcctgatcggggccctgtcgtggtacagcatcgacagcagcctgaggccgctgacccggctgagcgacgcgatcgaccggcgggcggtcccgggcgcgatcaacctgcagccgctggacgtggccggggtgccccgcgaggcgctggccccggtgctcgccctcaacacgctgctcgagcgcctggagcaggcgatcgcgggggagcgcaccttcacgtcggacgcctcgcaccagctgcggacgccgctcgccgtgctcaggatgcacgtggaattgctccgcaggctcacgcccggggaaccggcccacgccgcggcgatcgacgatatcgacggagccgcgcggcgcctggaacgcctcctcgcgcaactgatcgcgctcgcccgcgccgatgcgggcgcggccgccacggacgccgccgcggcgatcaccgacctgaacgacatcgcggcccgcgtggtcacggagcaggtgccccacgccctcgcgcgcgggggcgagatcgtgctcgatcgccccgacggcgcggtaccggtcgtgggcgatgcgttcatcgtcggcgagatcctcaccaatctcgtggacaacgcgatccgctacaaccgtcccgaaggcaccaccgtcgtccgtgtccggcgcacggagacgggcgcctgcctggacgtcgaggacgagggcccgggcataccgccggaggtgcgcgagaaggtcttcgagcgattctaccgtgtcgcgacgcgagacggtcctgacggcagcggcctcgggctcgcgatcgtccgagccctcgcggaccggatcggcggggcggtcacgctcggttcccgcgcaggcggatcgggactgctcgcgcgggcgagcttccgcgcgccgtag

SEQ ID NO: 6466 - DNA, 639 bp, Methylobacterium sp.
atgctggacaggcgcacccggaagcggctggcgacgcgccaagccatctccgatgcagccacgcgtctgttcatggagcacggcttcgaccgggtgacggtcgacgagatcgcggaggccgccgatgtcggccgcatgactgtattcaatcacttccctcgcaaggaggacatgttcttcgatcgtgaggatgaggtacgcggaatggtggccgcggccatccacgggcgggatgagggagcaagcccggtcacggcactgcgcttgctcgctcatcgttgtatcgaggaccggaaccctctcctcccgcttttcggtgcgtcgctgagcttcgtggcgacggcactggccagcgaggcgctgaaggcgcgcgcccgccagatgtgcagcgagttcacgcgcgttttggcagagatgatggcagaggcggttgatcgacccgcggacgatcccgacgcgcatctggtggcgggcttgctcgtggcgacgtggagcgtcgccttcttcgaagggtacaaggtggctgaaacgcccggcgacgccgcggctgccggacgcgtctttcttcgtctgatcgatcgtggtttccaagccgccgcgggcgcggcagcgggaactccctatgccgaagcgggatga

SEQ ID NO: 6467 - DNA, 1008 bp, Methylobacterium sp.
atgcggcgatcgatcctgttcctggcggcctgtctgctggccggcatcacgccggcggcctccgccgggcccgcagcggacggcgtcgccgatctcggcagctacgccgcccgcatggaggttcacccgttcgagagcctgacgctgaccgaccggcagttcctcaccggcacgtccgagggagcgaagccggtcacggtcgcggggatcctgcgcatcgccaaggcggggaccgagcgcctgccgaccgtgatcctgatgcacggctccgggggtctgggcggcaacatcgagttctggcagcgggcgctggcggcgcgcgggatctcgaccttcgcgatcgacggcttcaccgggcgcggcctgaccagcgtcaacaccgaccagagcctcctggcgcgcacgaacctgatcctcgacatctaccgggcgctgggcgtgctggcgaagcatccgcgggtcgacccggcgcggatcgccgtaatgggcttctcgcgcggcgggcaggccgcgctctacgccagcctcaagcgcttcgacgccgcctggaaccgctccggggtgatccccgccctctacctgccggtctacccggactgctccatccgcttccgggacgacacggccgtggcggatcggccgatccggatcttcggtggcggcagcgacgactacaatcccgccgccacctgcgcggcctacgcggagcggctgagggcggccggcgccgatgtcgacctgaccgtctttcccggagcgcagcacgtcttcgacaacccggccgggccgacccagcccgtggtcgcccggggcgcgcagaccgtccgcgcctgcgcgataagcgaggcggcggacggcgccctcgtggcgggcccggacgccacgccgttcacctacgcggacccgtgcgtgcagcgcgacccgcatattggctccgacgccgccgcccgcgccgggatcctggcgcgtgtctcgcacgcgctggacgccgcgttccggggacggtga

SEQ ID NO: 6468 - DNA, 2538 bp, Methylobacterium sp.
ttggcgcgcgagctgtccggcggcggcctgagggtcgtgctgctggagagcggcggcctcgaccggatggagagcgcggacgcgctggacgccatcgtgaatgtcggccggccgcgcgcgacccagtgggccgtccggaaccggatcgtgggtggtagctcgcacacgtggggcggccggtgcgcccctttcgacacgatcgacttcgagcagcgtgcctgggtcccggagagtgggtggccgttccagcgcgacgcactcgatccttatctcgagcggacggccaagtatctcgggctcgcctacggcaaccatttcagcgacgcgcgcttctgggacctgttcggttcgcagccgggctggtccgagccggatcctcggatgctcctgcccttcttctggcagttcagccgcgacgacgcggaatcctatccgttcgagtacacgcgcttcgggcggaaactggacgagaagttgggcccgaacgtcacgttgatcagcggcgcgaccgtcgtcgcgatcgacgtgaacgggacgggcgacagggtacagggcgtccaagtcgcggcgcccgacggcgcgatcgtcaagctgccggcccgccatgtcgtcctgtgtgccggcgggatcgagaatgcgcggctcctcctcgcctccgatcatcaggtcccgggcggcctcggcaacaggttcgaccgcgtgggtcgctacctgatggatcacctgcgcgggccggtcgcgcatttcgaccctcaccgatcgcgcgcgctgcagcggcggttcggccgctacaccatcgaggatcggctgttccggggcgggctccgcctgagcccggacgtccagcgaagccgccagctcctgaacagcgcggtctggctcggggagacgctcgcccccgacgacccgggcgacgcgatccggaggatcctggtcggcaagccgcgggcgaaggacatcctgacgctgacgtcgaacctgccgctgctcctgcgcggctgctgggaccatttcatcgcgcgcaacggctttccgcggaagctctccgagctgagcctcgaatgcatggtcgagcagcggccggatcccgagagccgggtcatgctctccgatcagcgggatcacctgggcagccggctgcccctgatcgactggcgcagtcacgaagatgaaggccgcacgatgcgcgagacggcgcggctcgtcgcctccgagttcgcccgcctgggcctgcccgtgcccgagctggcagactgggtgcgcgaagaggcgccgatcccgctcagcttcgtcgatgtcgcccacccgaccggcaccacccgcatgtccgacgatgccgccaggggcgtcgtcgatgcgcgcggccaggttcacgggatcgacggcctgttcgtcacgggaagttcggtgttcccgacaggaggccactgcaatcccacgcagatgatcgtcgctctggcgatccgcctcgccgacctgctgaaggtccgggagcagcgcgacaccgtggtctccgacctccgaacgtctccgcccgtcccgggcgatctccgcgtcctcgtgacgggggcgacggggcggatcggccgcatcctggtggaggacctgcaggaacgcggctacgcggtcagggccgtcacgtcccagcccctgaccgaggcgcagccgcgcacgggtcgggtcgagtggcggaccttcgacttcacggcggatcaggattacgccggcctcgtccacggctgcgcggccgtcatgcatctcgccgccgagctcgggaagcaggaccggatgcaggccatcaatgtcgaggcgacgcggcgactggccgaagccgccgagcgggacggcgtccgggccttctgctacatgagcaccgtctccgtgtatggcagcggccgcgcgcgcaccgtgacggagacggcgccggttctcaccagcagcgtcgacgtcaaatccgaatactgggccctggactacgttcgcgcctacggtcgaacgaagctcgccggcgaagaggccatcaggcggatcgcctcgacccttccctacgtgatcctgcgcccgacggtggtcgtcgatctccataatctcatcggcttgcgcgactggagcctctcgaagcgcctcttcgcagcgcatcggccctcccatcacgtctacgtccgggacgtcacggacgcggcgatctggacgatgacgcggtccctgaccggggcttggccggcgggcgaggtccaggtcttcaatctctccgatcaagaggcgcgcgatgcgcggatcggcgacttcatgcggcgggcgttcacgataagccgcgatccccgcttccgggtcatcccgatgccggccctcgtcgactggctccacgatttcctgcgcaaccggacgctgcccttgcgcaatcctctctggaggatgcggttccccaacgatcgtctgcggcaggccgggtatcgacaccgctacggaatggccagggcccgcgccatggcgctggacatcctgcgagcggaaacacgggagcgaaaccggtcctga

SEQ ID NO: 6469 - DNA, 975 bp, Methylobacterium sp.
atgccgggcacgaaccgtcgcgatctggtgcgggccgcgctcgccggaggggccgtcctgggtctcggcggccgcgcccgcgccaccgcacccttcggcggagcgcaggcgccgggcttctaccggacgcgtgtcggcagctgcgaggtcacgatcctcaacgacggggcgcgcagcttcccgatgccggaccgcttcgtgcgcaacgttccccgggacgaggcgctcggcgccgcgcgggcggcctacatgccccccggccaggtgacggtgccgttcaacccgacgctgatcaacacgggcgcgcagctcgtcctgatcgataccggcaacggcccggtgccgggcgcgcccgtcggccgcctcgcggcgaacctcgcggcggccgggatcaggcccgaggacatcgacctcgtcctgctctcgcacctccatcccgaccacacgaacggcctcaagcgggcggacgggtccctcgccttcgcgaacgccgagatccgggccgccgcacccgactgggcgttctggatgagcgacgccaacatggcccgcgccgccgacccggtgacgcagggctacttcgccaacacccgccgggtgctcggcgacctgaaggaccggatcggcaccttcgcgtgggacgaggagatcgtgcccgggatcaccgccctcgccgcccccggccacacgccgggccacacggccttcgcggtcgcctcgggtgcggaccgtctgctgatccagtccgacgtgaccaacatcccggccctcttcctgcagcacccggactggcacgtgatgtacgatcacgacgccgatcaggcgcaggcgacgcgccaccgcttctacgacacggccgcgtccgagagggccctcgtggtcggctaccacttccccttcccgtcgctcggccacgtggaacgggacggacggggctaccggctcgtgcccatcgcctggaccggcgtgctctga

SEQ ID NO: 6470 - DNA, 285 bp, Methylobacterium sp.
atgaacatcacgatggtcgggtcgggctatgtcggtctggtctctggcgcgtgctttgcggatttcggccacacggtcgtgtgcgtcgacagcaatcgcggccggatcgacgcgctgaatgccggccggatgccgatctacgagccgggcctcgaggccctggtcgccgagaacgtccgccaggaccgcctgtccttcatcaccgacctggagacggcggtcggtcaggctgacgcggtcttcatcgcggtgggcacgccctcccgccgcggcgacggcttcgcc

SEQ ID NO: 6471 - DNA, 2973 bp, Methylobacterium sp.
ttgggcatcgtgtcaacgagctatgtcggacggtccgtagagcgcgttgaggacgccgccctgctctccgggctcggccgctacatcgacgatctcggcacgcggcccggcacgctgcacgcgtcgatcctgcgctcgccccacgcccatgcggacatcctcgccattgacgtccaggcggccaaggcgctgcccggcgtcaccgccgtgatcacgggccgcgaccttgatgccgtcaccaccggtctcgtccccgccctgcgggcggccgtcgatgcccgcgccatcgcggtggaccgggtgcgctatgtcggcgagccggtggctatcgtcgtcgcccgcgaccgctacctcgcggaggacggctgcgacctgatcgaggttcagtaccgggtccgcccggcggtggtcgacccgctggcggccctctcccccgacagcgagatcctgcacgagggtgtcggcgcgaatctcgtgagcgaccggcgtttccgctacggtgaccccgaggtcgccttcgcagatagcccgcacagcctgtccgtgaccgtgcgctacccgcgcaacaccggctcgccgatggagacctacggcgtcgtcgcttcctacgaccccaccgacgactcctacgacgtgctcgcgaacttccaggggccgttcagcattcacgcggtcgttgcccgggcgctcaaggtgccgggcaaccgcctgcgcctgcgcacgcccccggattccggcggcagctttggggtgaaacagggcgtcgccccctacgcggtcctgatcgccgccacggcccgcctcgtgggacggccggtgaagtggatcgaggaccggctggagcacctctcggcctccgtctccgccacgaaccgggtcacgaccctccgggccgccttcgaggcggacgggcgcgtcaccgctctcgattgggatcaggtcgaggattgcggcgcctacctgcgggcgcccgaacccgccacgctctaccggatgcacggcaacctcaccggcgcctacgccatccgcaacgtcgccgtacgcaaccgggtggtgctcaccaacaagaccccgaccggcctcgtgcgcggctttggcgggccgcaggtttactatccgctcgaacggctgatgcagcgcatcgccgtgacgctgggcctcgatcccttcgcggtgatccgggcaaacctaatcccggccgacgcctttccctaccgcaccgcgacaggcgctctctacgattccggcaattaccagcgcgccctcgacgaagccgcccgggatggcgggctcgtcgagttgaagcggcgacgggacgccgcccgcgccgagggccgcctctatgggatcggcctgacggcggcggtcgagcccagcgtctccaacatgggctacatcaccaccgtcctgacggcggaggagcgcaccaaggccgggccgaagaacggcgcgcaatcgaccgccaccatcaccctcgatccggtcggctcggtgacggtgcaggtcgcttcggtgccgcagggccaagggcaccggacagtgctggcccaggtggtggccgacgtcctcggcctcccgatggagcaggtccgggtcacggccgacctcgacaccgccaaggacgcatggtccattgcctccggcaactatgcgagccgcttcgccgccgccgtggcgggggtcgcgcacctcgccgccacccgcctgcgcgacaggctcgcgcggatcgcggcggcgcagctgaacctacgtcccgaggacctgctcttcgcggatgggcgcatcgcctcgcgattgaacccggatgcaggcctgcccttcgcgcgggtggccgccacgagccactggtcgccgggcctcgtgcccgaggatctcggcgcggtgatccgcgagacggtgttctggacgcccccggagctgaccgctccggacgcggaggaccatatcaattcctccctctgccacggcttcatcttcgacatctgcggcctggagatcgaccgggtcacagggaaaatcgccatcgaccgctacgtctcgatgcacgattgcgggcgcgtactgcacccgggcatggtcgagggccaggtgcgcggcggcttcgcgcaggcgctcggcgcggcagtctacgaggaactcgcctacggcgacgacggcgccttcctgtccggcaccttcgccgattacctcctgcccaccgcgaccgaggtgccggacctgcgcatcctgcacgtcgagagcccgtctcccttcacgccgctcggcgcgaagggggtcggtgagggaaactgcatgtcgacgccggtctgcctcgccaacgcggtggccgacgccctcgacctcgaggccatcgacctgcccctgacgcctgccaagctcgccgccctcgcggcagggggcgacgagccggcgccgccggccggtcgagccgcgaaggccgccgcgaaggcgggcgaccggaccctgcgcggcgacggcgcggccaccgtcactgccccgccggagacggtctgggcgatgctcctcgacccggacgtgctcgcctccgtcattcccggttcgcatggggtgcggaagctctccgacacaaggttccgggccgacgtcaccctcggcgtcggtccggtgaagggtcgctacaaggccgaggtgatcctctccgatctcgatgagccccgggcggtgacgctcaccggcacggtgacgggcggcctcggcagcggcggcggcaccggccgtttgaccctggagcccgacggctcggggggcacgcggatcgcctacgtctacgaggcggcggtgggcggcaaggtcgcggcggtgggcggacgcctcctcgacggggccgcgcgggtgatcatcggcgggttcttcacggccctcgcccggcgagccggcgggtccggcaagcgcgggctccgcctcccggccgccctgcgatggctcctcgcgcgtctgggggtgtccgcatga

SEQ ID NO: 6472 - DNA, 210 bp, Methylobacterium sp.; identical to SEQ ID NO: 5413

SEQ ID NO: 6473 - DNA, 972 bp, Methylobacterium sp.
atgaccatccggcacgacgacctgatcgtgatcgacgggctgatcgtctccgacttcgggcccgaggtcttcgccgacatgcgccgcggaggcatcacggcggccaactgcacctgctccgtctgggaggatttcgccacgaccatgcggacgatggcacgctggcgaggctggttccgcgagcacgccgacctgatcaccccggtccacggcgtcgccgacatccaccgcgcgaaggcggagcggcgcaccggcatcattcacggctggcagaacaccagcgcgatcgaggaccggatcgaatacctggaactgttccacacgctcggcctgcggatcgtccagctgacctacaacacacagaacctcgtcggctcaggctgctacgagtcgcgggacggcgggctgtccgatttcggccacgacgtgctggccgagatgaaccgactcggcatcctgtgcgacctctcgcatgtcggaccgaagaccagcgaggatgcgatccgcgcctcgcagcgacgcgtcgcctactcccactgcctgcccgccgccctgaaggaccatccgcgcaacaagacggacgcgcaattgcgcttcatcgccgagcacggcggcttcgtgggcgtgaccatgttcccgccgttcctggcccggggcgcggcctcgacgatcgaggactatctcgacgccatcgcgtacgtgatcgatctcgtcggcgaagagaacgccggcatcggcaccgacttcacgcagggctacgggcaggccttcttcgactacatcacccacgacaagggtgacggccgcaagctcacggatttcggtgaggttctgaaccccgaaggcattcgcgtcatcggcgactttccgaacctcaccgcggcgatggagcggcgcggctggccggcctcccgcatcgaacgcgtcatgggcggcaactggctcgccctgctcggcgacgtctgggcctga

SEQ ID NO: 6474 - DNA, 186 bp, Methylobacterium sp.
gtgccgccgcgggtgaccgaggagtatcgcgcgcggctgtgccgagccggcagccgggtcgcgttcgaccgcgtgcctggcgtgggacatctgtcgatggccaaggacgctgcgccggcggccctcgaccggatcggtgaccgctccgccggcgtgcgggcaccgagcgagtgcggcgagccttga

SEQ ID NO: 6475 - DNA, 894 bp, Methylobacterium sp.
gcgcaggcccccgcgcaggcccccgccccggcaccggcggggccggcgaccaagcccgagagcgatccggctcaggagacgatccgcaagctcaacgcctatgtcgggctcctcaaccggaccctgcgggcgcaggaatcgctcggccgctatcagagctgggtcaacatgaagaccggtccgaccggccgcgagcggatcatctacggcctctacgggctctacgacgtgcgcggcgagatcgcgaaggcggaggccgcgacggcgcagccgcccgcgatgccggacctcgacggcgccgtgaagacctacatcgccgcctatcaggcgctcgccccgacggtcaccgaggcggagggctactacgagcggcaggattaccgcgcggacaagatggagcagggcaaggcgctccacgccaagctcgccgtcgcggggccggccttcctggcggcgcgcgccaaggtcgacgccgcgctgcgggtcgagaaggagaagagcgacgcgctggaactcgccgccatcgaggcgcgggagggccgcaaggcgcgctggcacgtcgcgaacgtgatgaccgcctgccgcaaggtcatggacctgctgcccaccgacgccaagccggtcgtcgacatggcggccttcgacgccgcgctcgggcgctacgccgtcgccgtgaaggacatggacgggtacagcgccgccaacccgaactccttccacgtgttcgagagccggccgcgcgcgctcctgggcaagctgcgcgagttcgacgacaagctcgccaaggccaggggcgacgcccggcgcggcgccgggcgcgacgtgacctggatcgtgaacgactacaacatgatggtgtcgaccgcgcagacggccacgaccttctcgcggtga

SEQ ID NO: 6476 - DNA, 2019 bp, Methylobacterium sp.
atgttcggcaagatcctcatcgccaaccgcggggagatcgcctgccgggtgatcgccaccgcccggcgcctcggcatcggcacggtcgcggtctattcggaggcggatgccggcgcccgacacacccggatggccgacgaggcgtggccgatcgggcccgccccggcgcgcgagagctacctcgtggccgagcggatcctcgacgtcgcccggcgcgccggggcggaggcgatccatccgggctacggcttcctgtcggagaacgcggacttcgccggcgcctgcgccggggccggcctcgtgttcgtcggcccgcccccggcggcgatccgcgccatgggctccaaggccgaggccaaggcgctgatggagcgcgccggggtcccgctggtgccgggctatcacggcgccgcgcaggatgtccgggcgctgaaggaggcggccgcccggatcggctacccggtcttgatcaaggcctcggccggcggcggcggcaagggcatgcgcgtcgtcgaggccgccgcggcgttcgaggccgcgctcgccggcgcgcagcgcgaggcgcgggcgtccttcggcgacgaccgggtgctgatcgaggcgtacctgacccgcccccggcacatcgagatccaggtcttcgccgacagccacggcaacaccgtctcgctgttcgagcgcgactgctcgatccagcggcgccaccagaaggtgatcgaggaggcgcccgccccggggatggatccggtccggcgcgcgcggatgggcgaggccgcggtcgcggcggcgcgggcggtcggctatgtcggcgccggcacggtggagttcatcgccgagggcgagaccttctacttcatggagatgaacacccggctccaggtcgagcatccggtgaccgagatggtcttgggcctcgacctggtggagtggcagctgcgcgtggccgcgggcgagcggctgccgctcggcgccgcggatctggccctgcgcggccacgccatcgaggcgcgggtctacgccgaggatccggcgcgcgatttcctgccggcggtcggcaccctcgcccacctgcgccagccgccggaggtgccggggcgggtgcgggtcgagaccggcatcgtgcagggcgaccggatcaccccggattacgacccgatgatcgccaagctggtcgtctggggcgaggaccgggcggccgcgatccggcagctcgcggccgcgctcgccgcctacgaggtggtcggcgtgacgaccaatctcagtctcctgcgcgccgtcgccggccaccccgcctaccgcgcggccgacctcgacaccggcttcatcgcccgccacgccgacgacctgctggcgccgcgagcgaccggtgcggtcgatcccgcgctctgggccgccgccgccctgaccgtcctgcgcgaccggctcgcggccgtcgccgcgcaggcgcgggcgagcggcgacccgtggtcgccctgggccgatccggatgcgtggcggatgaacggggcgggctaccaggacctgcagttccgccacggcgacgcgccgcccttcaccgtgcgggcatgcccccgccccgacggcagcgcccgcctcgacctgccgggcggcaccgtcctggcggcgctcgccgaggacgccgagggcgagcggctgatgctggacggcgtctggcgccggctgcgcacggtccgccgcggcgcggagctgacggtgatcgtcggcggtcggaacgcgacgctggtccacgtcgatcccctcgccccgccccggaccgaggcgtccggcagcgaccgggtgacggcgcccgtgccgggccgcctgacccagctttgggtgcggcccggcgatgccgtggagaagggcgcgccgctcgcggtgatcgaggcgatgaagatggagatcaccctccgcgcgccgcaggccggcaccgtcgccgaggtccgccacgccgtcgacgacatggtcgaggagggcaccgagatcgtcaccttagcggcggaggagcggcccgcatga

SEQ ID NO: 6477 - DNA, 192 bp, Methylobacterium sp.
gtgccggtcgtcacgtgcctgcgcttgttctggttgcagaacttccgcctcaacgaacgtgacgattacgcaccgtacgcagacgatggggtccggtggcacgccgagaccgacggcaatccggccgcccacacgatggtcgcctcgccctacgacctggacgtccataacgcgaagaagtgcatgccctga

SEQ ID NO: 6478 - DNA, 1512 bp, Methylobacterium sp.
gtgagcgccgccgcgccggtcctgtcggaggcggccgccgccgaggaggagccggggctcgcctccggcgccgcggtgacgcggcgctcgttcgacgccgcgcgctgggtggcggtggcctcggtcggcaacgtggtcctcagcttcggggtgttcctcgtgctcgcccgcctcatcgggcccgccgagttcgggatggtggcgatcgccgcggtcttcatcgacatcctgcagatcgtcgcgcgctgcggcctgcccgacgcggtggtccagcgcgccgacctcgacgaggacttcgccgccaccgccttctgggtgatgctcgccacgggtgtcctgtgcgccgtgggcctcgtggccctggccggcccgatcgcctggatcttcgacctgccagcgctgcggccggtcctgtgcgcgctctccgcctgtttcgtcatcaccgcagcgggtgcgatccacgaagcgcggctccagcggagcttcgggttccgcaagctcgccctgcgggcgctcggcgccaacgtgctcggcggcgccgcggccctcgtgctggccctcgacggctacggcgtctggagcctggtggtgcagcggctcgtcgccgcgaccgcgaccacgctcctgacctgggcggcggcccgctggattccgccgctgcggctgcatctcgcctccgtgcgcgagcagatcgcgttcggctcgcggctgttctgcacctatctgctgctcgtcgcctcgatccggagccaggaagtcatcgcggcctacttcctgtccgccaccgatgtcggctacctgcgcctcgcgtggcgctgcatcgacctcgtgagccaggtcgcggtcatcccgctgaccacggtcgggctgaccacctacgcgcgcctccaggaccgtccgggcgagctggccgcggccttccacggattcaccgaggcctcggccttcctggccgtgcccgccttcttcggcatggcggccgtcgccccgaccctcatcccgttcctgttcggcgaccagtggcacgacgcggcgccggtgctgcggacgctcgcgctcctcgccccggaattcgtcgccacctcgatgctgtggatgatcttcacggccctgggccgcaacggcacggccctgcggctcgccggcgcgcagttcggcctcggcgccgcggcggccctcgtcaccgcgcccttcggcctcgccgcactggtcgccgggcacgtggtgcgggcctacctgttcacgcccgcgatcgtcgccagcgtcgggcgcgtcgtcccggtcacgaacgggcggctcgtgcggctcctcgcgccgatcacgctctgcgccggcgcgatggccgggctggtgctgctcgtccaggggccgatccacgccgccctcggggaccgggtcggcctgttcgcggcggtcggaatcgggatcgcggcctatctgggcctcgcctggatcttcatgcgcggcacgctccgcacggccgtcggcctggtcctgagacgccccgcctga

SEQ ID NO: 6479 - DNA, 1227 bp, Methylobacterium sp.
atgaccgaagtgctccccgccgacgcgctcgcgaagcgcggcctccgggaccgggcgcaggccgcgcggtccgtcgtcgccgcgcggccgcgggtcctgttcgtgagccataccggaacgatgtccggtgccgagctggtgctccgcgacgcagtccggccttgggcgggctccagcgccttcctgttcgaggacggcgcgctgaccgcggccctccgcgacgcgggtctggagatccgtctcgcgcgtcgccagtccgccctggcgggcctccggcgggacgtgtcaccgctgagcgcgctcccggtcctgggccagctcggcgccctggcgctggagatcgcccgatcggcccggtcctgcgacgtggtctacgccaactcgcagaaggccttcctgctctcgtctctggccgcgcgcgccgccgggcgccccctgatctggcacctccacgacatcctcgacggggcgcatttcggccgggcgcagcgcatcctgcagatccggctcgccaatctctgcgccgcccgggtgatcgttccctccgaggccgccgcgcgggccttcgtccaggccggcgggcgccggtcgctgatccgcgtcgtgccgaacggcctcgacgtcgatccggcaccctgctccgccgccgttctgcgcgcggaactcggcctgccggacggccccctcgtcggcgtcttcagccgcctcgcgccctggaaggggcaggacgttctgatcgaggcgctggcgaccctgtccggcctccgctgcgtcgtggtcggggcgccgctattcggcgaggatgcctacgcggcgcacctgcgcgacctcgcggcgcggcgcggcctctcggaccgggtgctgttcctcggacagcgcgacgacgtcccccggctgatgcaggcggtcgacgcggtcgtgcacccctcggtcgatcccgaaccgttcggccgcaccctggtcgaggcgatgctggtcggcgtgccggtgatcgccaccgacgccggcgcgtccactgagatcctcgacggcggcgcggccgggacgctggtgccgccgcgtcggtcggatcgcctcgcggcggccctgtcggcgctgttcgccgatcccgacgccttcagggcgcgcgccgcgctcgcgcgcgagcgggcgctgtcccgctacggcgcggagagcatgcagcgcgatctcgccgacatcatcctccaggtcgccggccgggcctga

SEQ ID NO: 6480 - DNA, 1170 bp, Methylobacterium sp.
atgcgtgtcgcgatcgttcacgactggttgtacatcgtcggtggcgccgagcgtgtcctcgagcagctgctgcggatctatccggacgcggatgtcttcgcgctcttcgacttcctgcctgaagcagaccgggcgcggctgggctacacccaggcgcatacgagcttcatccagcgcatgcccttcgcgcggacgcggcaccgcaactacctgccgctgatgccgctcgcgatcgagcagttcgacctgtcggcctacgatctcgtcatctcgagcagctacgcggtggcgaagggcgtcctcaccgggcccgaccagctccacgtctcctacatccactcgcccatgcgctacgcctgggacatgcagcacacctacctgcgggagagcggctgcgacgcgggcatgaagagcgtgctcgcccggctgatcctgcaccggatgcgcgtctgggattttcgcacggcggccggtcccaacgcgatcgtggccaactccgctttcgtcgcccgccgcatccacaaggtctacggccgcaccgccgaggtcatccacccgccgatcacgctgccgatccagcagtatgacgggccgcgcggcaaccacttcctcgtggccagccggctcgtgccgtacaagaacgtcgaggcggtgatccgcgcgttcgcgctgctccccgacctcgaactcgtggtggcgggcaccgggcccgatgccgcgcggctgcgcgagatcgcggggccgaacgtgtcgttctccggcttcgtgcccgacgcggagctgcgccacctcatggccacggcccgcgccttcatcttcgcggccgaggaggatttcgggatcatcgtggtcgaggccacgtcggagggcacgccggtcctcgcgttgggccgcgggggcgcccgcgagacggtccagacccgcggcccgcagcgcaccgggatgttcttcgacacgcccgagcccgtggcgatcgccgagtgcgtccagcgcttcctgctgcaggagagccacttcacccgcgaggcctgctgggcgcaggccgagctgttctcggccgagctgttccgcagccggttctcgaccttcgtcgacgaccagatggcgatgcaccgggccgcctgcgagacgcgcccgcggatcctgccgcgcctcgaagccgtcggctga

SEQ ID NO: 6481 - DNA, 2313 bp, Methylobacterium sp.
ttgtcccaccgcaccgcatcgcagggtcctgtcgcgcccgccgcccgccgcggggcgggcgcggcgcgctggatcccgcccgcgatcctggccgccggcctcctcgcgaccgggctgagcacggccctcacctggcaggcggcggcgctgcgcgaccgcatgaccttcgagcacgccaccgagatcgagctgcgcacggtcgaggaccagttccgcacctacaccgccctcctgcgcggcgccgccggcctgttcgccgccgaaggcgccaccgtcacgctggcccagttccgggcctacgtgcagcggatcgaactgcagcgcctctatcccgggttcctcggcatcggcttcacgccgaccctgcccgcctccgcgcgggagacgttcgccgcgcgcgccgcggccctgggcgtcgagaatgcccgggtccggccgccgaccgacaacccgatgatcagcccggtcctgttcgccgagccgccgaacccgcgcaacctcgccgccatcggctacgacgtgatgtcggacccggtgcggcgcgacatggtcgagcgggcccgcgacaccggccagccggccgcctcggcgcggatccagctcgtgcaggagatcgacgcgaacaagcaggcgggcttcctcgtcgccatgccggtctatgccggcggcgccgtgccgccggacctcgaggaccggcggcggcgcttcctgggcttcgtgttcggcgccttccgggccgacgacctgttcaacagcatcgtggcggcggaggccgaggaggacgcggccttcgccatctacgacggcgcgccgagcgaggcgaacctgctgcaccggtccgcgcgggcctccgccgccggggcggggcgcctcacccgcgaggcgcatctcgagctcggcggccgcacctggaccgtcgcgttcgcgcagcgcgtctcgccccggcgcggctcggcgctgccggagatctggctcgtctgcggcggcggcctgttcgccaccgccctgctggccttcgcggcctaccggcagcgccgcacgcaggacgagatccgccagctcaacgcgtcgctggaggcccgcgtcgaggagcggacgcgcgatctccgggcggcggccgaccgtctgcggcaggccggggaggagcgggcgcgcatggaggaggcgctgcgccagtcgcagaagatggaggcggtgggccagctcaccggcggcctggcgcacgacttcaacaaccttctggcgggcatctcgggctcgctggagctcatcgaggcccgcatcgcccaggggcggtcgaaggatgtcggcaagtacatcgccgccgcccagggcgccgcccggcgggccgcggcgctgacccaccgcctgctcgccttctcgcgctgccagacgctggcgcccagggcgatcgacgccgatcggctggtccgcgggatgctcgacctgatccagcgcacggtcgggccgagcgtcgaggtgcggcacgtcggggcagacgggctctgggccgcgctcgcggacccgtcccagctggagaacgcgctcctgaacctctgcatcaacgcgcgggacgcgatgcccgggggcggccggatcaccatcgagaccgacaaccgctggatcgaccggcagcaggccgacgcccaggacatgccggaagggccgtacctgtcgctgtgcgtgtccgataccggcaccggcatgcccccggaggtcgtcgcccgggccttcgacccgttcttcaccaccaagccgatgggcgagggcaccggcctcggcctgtcgatgatctacggcttcgccaagcagtcgggcggtcaggtccggatcacctcgacggtcggccagggcacgaacgtgtgcatctacctgccgcggcacttcggcgaggcggacgcggacggccccgacccggccaggggcctgatggcgcaggccgaggcgggcgagaccgtgctgatcgtggacgacgagccgacggtgcgcatgctggtgacggacgtgctgagcgacctcggctacacggcgatcgaggccgcggacggcgcgggcggcctcagcgtgctgcaatcgggtgcgcggatcgacctgctcgtcacggatgtcggcctgcccggcggcatgaacgggcgccagatggcggatgccgcccgggtcggtcgaccggagctgaaggtgctgttcatcaccggcttctccgagaccgcgctgccgggcgacgggcgtctcgagcccggcatggcggtgctgactaagcccttcgccgtggaggccctggccgcccgcatccgcgagctgatcgcgcgctga

SEQ ID NO: 6482 - DNA, 1092 bp, Methylobacterium sp.
gtggcggagacgacgggcggccgggatccgcgggcgaacaatttcgggtccctgcgcctcctgttcgcgggcctggtgatcctcgcgcacgcccccgagctcgtggacgggaaccggtcccgggagttgctgacgcaggtcttcggaaccctgtccctgggggagatcgccgtcgacggcttcttcctcgtgagcggctacctgatcaccgcgagctaccgcgccaagcgctccttcggcgactatctcgcgcggcgggcgctgcggatctacccggccttcgtggtcgcgtccctgctctgcatcgccgtcgtcgcgcccctcggcggcggcaacctcgcggccgcctcgccactcgagacgctgctgcggctgtcgctgctgctgatgccggtggtcccgggcgccttcgccgagctgccctacccgctgctcaacggctcgatgtggaccattccgtgcgagttcggctgctacctgctgctcggcctcgtgggcaccgcccgcgccctgcgccgccgcgggcgctatctcggcctgctcggggggctcggcagcctcctcgccctgcgctggctcttcctgcccgtcgggcatccgggcgacaccctcggatccctgtcggagatgatccgcctcaccttcgtgttctgctgcggcggcgccttccggctgttcgccgaccggatcgcctacacgcggcgcggcgcgacccgcgccgccctgctgctcctgccgctgatgttcagccgaccgctggccgagccggccttcgcgatcctcggcggctacctgatcttctggttcgccttcgcggtgcgccccaccgccctcagccgcgccaccgcccaggtcgacccgtcctacgggctctacctctacgcgtggccggtgcagaacctgctggtcgcgcggatccccggcatctcgccctggacggtcgccgccctcgccctcgcggccgccatcccgctcggcctgctgagctggtacctgatcgagcggccgatgctccggttccggccgggaccgggcggcgcgcggccggagcccggcgcgatcccggcggccgcgcccgccctcggggcctag

SEQ ID NO: 6483 - DNA, 588 bp, Methylobacterium sp.; identical to SEQ ID NO: 5428

SEQ ID NO: 6484 - DNA, 2823 bp, Methylobacterium sp.
atgagcgccagtgtcgcggacatccaggcggatgcctctccccaccatctgcccgccctgacgacgggccgggacgcgtggttcctcgacaccgagcaggcgctcgcggaggagatggatcatttctgcgggccgccggagcccggcgatcgcgcgccctggcaggcgcgggccgaccaggcccggctcgccgccctgtgcctgtccggcggcgggatccgcagcgccaccttctgcctcggcgcactgcaggccctggccagccggcggatgctcggcgagttccactacctgtcgacggtatcggggggcggtttcgccggcggctggttgcagacgttcatccgtcagtgcggcagcatcgccgaggccgagcgccagctcggcggctcgggcaacgagatcttcgccaagctgcggcgctacacgaactacctgaccccggaggtcgggatcctgtcgcgcgacacctgggccggcatcgttctctacatccggaacacgatcctcaactggttgatcatcttcccgctgctgctgttcgtccccctcgcgctgctcgcctaccggacggcgctcgaggctgcgagcggcagcacgctgtggctgcccctggtgctcggcagcgcggcgctgttcgtcgcgacgttcagcgcctgcaccctcctgccgagccatcggccgcggacgggcggcgtcacggcgtacgcgtccccggcgcggatcgcggcctgcatcatcgcgccgacctgcgtctgggccctcgcgctgccgttcacgctccgcgcgctgttcgagcagccgctgccggtctcgggcctctccctgtgccgcctgggcctcgcctacttcgccgtgcaggtcgcggcctatctcagcggcctgatctggcagacctcgaagggccatccgggcctctggctgtacgagcggaatctcggtccctggctcgccagcagcctcgtctcggccgggctgatctgcgtctgcgccgacgcgtccatcggctggctggtcggtggctccgctgccggcttcgacgccgcgaaggccgaggtctctcagatcctgacggtcgcggccccgccggcgctgatcgtcatccaccttctccagagcgtcatcttcatcgggttccggaagagcgccgagtgcgccgacctcgaccgcgagtgggtcgcgcgggtcgacggccagttcctgctggccgcgatgggctggacaggcctgtgcctgtgctgcctcgtcctgtccgccgacgccctcggccgccaggacgcgcagatccccgccctgttcggcgcgctcggcgccctcgccaccggcccggccgccgccttcctgggcaagcaggtcttcgtccgcgcgcagtccctggccgccaagggacgcatggacgacctcgtgatgatcggcctcagcgcgatggcggcggtcttcgggatcagcctgttcgccctgatgggctggtgcctcggccgcttcctcggccaggcgcacgattggtggggcaactgcctgctgccgcgccgggcgctcggcggcgcggacaccggcgcggatgccggctccgtctgcggcatcaacccctacggcatgatcgtgatcctggacgtcgcggtggcggcaatcctggccggggccgtctggctgttcggccgcgtcaacgtcaaccgcttctccatgcacggcgtctaccgcaaccgcctgacccggggcttcctcggctcggcgcggacgcggcgcgacgccgatccgttcacggacttcgacgaggaggacagcccgcgcatcgccgatctcgggaccgagaagcggctcctgcccgtcgtcaacatgacgctcaatctgacggatctcctccacaccgagtgggcggagcggaaggccgcctcgttcaccgcgacacccttcgcctgcggctcggcgatcctcgaccgcgccgacagggcgcgcgaccggcccggcaccgtcggcccgcgcggggcctacatccgcacgtcgcaatatgccgggatggagactccgggcgaccgtgtcagcgcgggccgagggccgctgctgggcggtctgctgacgatctccggggcggcggtcagcccgaactggggctatcactcgtcgcgcctgatcgcgttcctgatgaccctgttcaacgtccggctcggcgcctggctgcccaaccccgcggtggcgcgccgggacgacctcaagctcgcgaagccgaggaactccgtgctcgcgctcctgagcgagctcggcggccgcagcaccgatgtccggcaggcgatctacctctcggatggcggccatttcgacaatctcggcgtctacgagatgctgcggcggcgctgcgcgcggatcgtggtgatcgacgcgggccaggacgaacgctgcacgttcttcgacctcggcaacgtgatccggaaggccgaggtggacgggctggcgaaggtccagatgggcgagatgcgcattctcccccgcgcgacgatcgagcgcgagggcaagcgtgccggtgcgctgggctacgcgcggggtacgatcgcgtatccggggggccgcgacgcggcctcgctgatctacatcaagccgagcttcctcgacgacatccccgccgaagtccgcgcctacggcgccaccagcccggccttcccgcacgagagcacggccaaccagtggttctcggagagccagttcgagagctatcgcgccctgggctactaccaggtcagcaagatgttcggctcgcagctcacgaccttgtcggactggtccgtgtatctcgacagcgagatcgggcgccggaccgcggattcctag

SEQ ID NO: 6485 - DNA, 711 bp, Methylobacterium sp.
ttgaaactcgcgcgcggcgaccgtggccggaacgtcctgctgctcggcatcagcctcctcttcgtcgccgccggcctcgggatgatcgccaccggcgcggatggcggcgtcacgacgacggtgttcttcggcgtgtgcgcggccgtcgccgtgtggcagctgcggccggacctgctcgaatccgagagccggtcggcggggtcgctggcggcgcagttccccggccccgtgatcctgcgcgcctcggtgcggaaactcctgttcttggccctgatggccgccggcttcggcggcgtcacgctctggatggtgctgcacgaggcgccctccacggcgatgcaactgctgctctggccgggcgtcgcgctcttcctcggcggcgtccccttcctcatcctgacggcgatccgcggctcggcgctgcacctcgacgagacgggcttcaccgtcgtgcagctgggccgcgcgcggcacgtccggtggcgtgacgtgagcgtgttcgagccggtctccatgccgggttcgggacaacgcctcgtgaccttcgatgacgcgaacgccggcgcgacgcgcctcggggcgatgaaccggcaccagatcgggcgcaacgcgggtctgccggacagctacgggctggatcccgacgcgctcgccagcctgctcacggcctggcgcaagcgggccctgcagcgggaggacgatggcttctga

SEQ ID NO: 6486 - DNA, 792 bp, Methylobacterium sp.
atgatcgagatccgcaacctgagcgtccgctacgggcagggcgccgacgcggtcgccgcgctgtcggggatcgacctgaccatcggtcccggggagttcgtggtggcgctcggcgcctcgggctgcggcaagaccaccctgctctcggcgatcgcgggattcctggcgcccaccgagggccgcatcctcctcgacggcgcgccggtccggggtccgggagccgagcggggcgtggtgttccagcgccacgccctgatgccctggctggacgtcgccgagaacgtggccttcggaccgaagatgcggggcgtgccccgggcggagcggcggcggatcgccctggcgacgctcgacctcgtcggcctgcccgactgcgccgaccggaaggtctacgcgctctcgggcggtatgcagcagcgggtcggcctcgcccgggcgctcgccggagacccgcgcgccctgctgatggacgagccgctcggcgcgctggacgccttcacccgcgagcagatccaggagctgatcctccggatctggcaccggaccggcaagatggccttcttcatcacccacgacgtcgaggaagcggtgttcctcgccacccggctggtgatcatgagcccgcggcccggccgcatcgtcgagacgctggacctgcccttctcccgggcgttcgtcgagggccgcgacgcccgggccgtgaagtcggaccccgccttcatcgccgtgcgcgagcgcgtgctcgcgcgcatccggagcggcgccgccgcggcaccggaggccgtccgatga

SEQ ID NO: 6487 - DNA, 150 bp, Methylobacterium sp.
atgcagaagatcggtctcgatctgtacgtcagcgcggccaataaggccggcgtcctgatatgggagaagcccggtgacgggtacggcttccctatcccgaagaacggccgcgatcttctggtcggcgccgacacgactttcgagggctga

SEQ ID NO: 6488 - DNA, 1926 bp, Methylobacterium sp.
atggcagcgcccgacggcatccgcgcggtgaccttgtcgagcggcggcctggccgaagtgaccctggtccatgccgtcgacggcgacgggacgatcgggctcagcgtccggcccgagcaggtcgacgacattctcaagagcctcgtcgtgcgcgatcccgtcggaaccgtcggcgccctgcgcctggacggggtggatcaggccgacgagaccctgcggacgatgccgttcaccgcggacgacctgtccgcgccgacccgcctcgtgggcaagctgcagggcgtcccgatccgggtccagagcggcgggcgcacgctcgaagggcgggtgctcggcgtctccgagcggaatgccgggaccgggaccggcgacgtctcgatcctgaccgtcctgaccgcgaccggcacgctcgaatccgtgccgatcgaggacggcgcctccgtgacgatcctcgacccggccatggcggccaagatcgccgaggctatcgcggcggccgggaagaccaaggtcggcgacgcccaccgggtcgagatcgccgtctccgggcagggccagcgcgaggtccggttgacctacgtcgtcgccgcgcccgtctggaagacgagctaccgcatcgtcgatggcggcggcgggcgcgcgaacctgcaggcctgggccatcatcgagaacgccctcggcgccgactggacgggcgtcgacgtcaccctctcgtccgggtcgccggtggcgctcctccagcgcctgcacaagcgctactggcgcaagagaccggaggcgccggtaatggtcgaggatgtcggcatgccggacctcgacccgggcacggtcgcgtcgaagtcggtcgcgcgcctgcgcgccccggcccccgccgccgcgcctcttccggccccgatggcgcggatggacacccgcgacagccgcatggaggccgcggaaccgagctacgacgccgcggccgccaccgcgggcgccgccgccagcgagggggatgtcgcggcgaacttcacgctgccgcatccggtcgatctgcgcgccggcggcacgctgtcggtgccgttcctcgataccgagatcgaggccgagcgggtcgccctctggaagccaggccagggggttcacccgatcgcggccctccggatccgcaacagcgccggcgcgaccctgccggcgggcctcatcaccctctacgaccgcaaggccggctacctgggggacgcccgtctgcccgcgacgcccgtcggcgagcagcggctcgccagcttcgccctcgaccgcaaggtcgccgtccaggcggagaccgcgccgagcgacgccctgaccaagatcaccgtggtcgacggcgtggcgcgcgcgacggtgatcgcccgggaggtcacgacctacacgatcaagggtgcgccggacgccgcccgctccgtgatcatcgagcatccccgacgggatggctggaccctcaccgcgtccgctcgcgacggcgagacccccacggcctatcgcctcaaggtcgcggttcccgccggcgggacggccgagacccgggccgtgctcgagcgcgtccggatcgacgcctacgacctcgtcgacgccgacgaggcgctgctcgtccggtgggcctccctggcgaccgacccggagctgggcggcaagctcaagaccctctcccaggcccgcgccgaggtcgccgcggcgacccggaccgtcgaggagatcggcgagcgcgcggcgaaggtgcaggcggagcaggagcgcatccgcagcaatctcggcgccgttccgaaggacagcgagctggcgcgccgctatctcagccgcatgggtgcccaggaggacgagctggcgaagctcgatgccgcccggacccaggccgaggacgggctcagggcgtcgcaggcgcggatccggtcgctgatcgcggcgctctga

SEQ ID NO: 6489 - DNA, 537 bp, Methylobacterium sp.
atgtacaggatctcggcgatgctcgtcttggcgaccagtcccgcgctcgccgcgccggccgcggctggcgatccgggtacgcgcgcgccgttcatccgcgagcaccgctgcgccgtcgtggagcgtctcgacgccatccacaggcgcgggccggtcgacgtctcgcgcgaccgcttcatcgtcgtcgcgccgcacggacaggcgcagcgctacgtccagtgcatcttccaggatcgggatacgcggatgttctgcgaggccgcgtcgggcgcctacgggccacccggccgaaggcgcctgcggctggatgcgacggcacggcaggctctggcggcgctcggatacgtccaggcggacccggcggagaacttcgcgcgcctcgtggagctgggatcgccgcccgacacgggcatcgccgcggatctgatgctcgcggcgctgcacgatgcctacggcgcccgcccaggcgacattctcgatatcgaggccccgcacggcggaacgccggggcggggctgcggcgcgcccgaatcctga

SEQ ID NO: 6490 - DNA, 966 bp, Methylobacterium sp.
atgacggcgcgcggaccggcccgcgcgacgcggcggcgtgtgctcgccggcggcgtgctggcgacgggcgcggcggcgtcgggcaccgtgcgggcggaggtccaccccgcgcgggccggagaggtccgccacggcacggtccgggccgacggcgtagacgtcttctaccgggaggccggtcgccccgacgccccggtcatcctgctgctgcacggcttcgccaactcgtccttctacttccggcacctcatgccgaggctggccgatcgcttccgcctgatcgcgccagacctgccctccttcgggttcacgcatgtcccggaggatcgcgcctacgtctacgacttcgcgtcgctgtcgcgcacgacggaggcgttcgtcggcgcgctcggcctcgaccgctacatcctctacacgttcgattacggggcgccggtcggatgggatctggcgctcgcccatcccgaccgcgtcgccggcatcgtgtcccagaacggcaacgcctatctcgacgggctcggcgacgcggcctgggcgccgctgcgggcctactgggccgcgccgaacgcggccgccgtcgcggcgatccgcgcccgcatgaccctcgacggcgtcagggccgcctacgtccagggtgtgcccgacccgtcccgcatcgagcccgaggcctacacgctcgacgcggccatcctggcgcggccgggcaatgccgaccggcaagtcacgctcaagctcgactacaagcgcaatctcgagcgttacccgctgatccaggccttcttccgcgcccgccgcccgaagctcctcgccgtctgggggcgcaacgacgcgttcttcatcccgcccggagccgaggcgttccggcgcgacatcccggaggcccgcgtcaccttcctcgacaccgggcacttcgccctggagacggacggcgacgcgatcgcggaggagatccggcgcttcttctga

SEQ ID NO: 6491 - DNA, 273 bp, Methylobacterium sp.
gtgatcttcccccgcggcgaggccgccctcgacgtgctctcgaccgtcccggaggggccgccccggcgcttccgctggcgcgcccgggtccaccgcgtcgcccatgccgaggggccggagcggatcgccgccgaatggtggcgcgcgcccggcgcggatcgcgattactaccgcatcgagtgcgaggccgggcaccggctctggctctaccgcgacggcccgcacgcccctgatcgcccggccgcgtggtacgtccacgggctcttcgcgtga

SEQ ID NO: 6492 - DNA, 930 bp, Methylobacterium sp.
ttgcgcatcctcgtcgccacagacttttcgacccgctcacagcgggccgtgcgacgcgccggcatcctggcgcaacagaccggagccgacgtcatgctgatgcacgtcgtgaacggagcgggttcccggcaggtcgcacgggacgttcgcgaggcgcagcgcatgaccgttgagcaggccgcggtcgtgccggaactcttccgcgtggactgccgctcgctcgtcgtccccggacgcctgcccgacccggtgctcaacgcggcggcggcgcggcaggtcgacctgatcgtggtcggctcagatcatggaaaggacgcgcaaggccttggccagacggtccgcgacctgatccgcgccgccccgtgcccgatcctcgtggtcaatcggtccgtcgtgggtccctacgccgaagtcacggtcccggtcgacctctcggccgcgtcggcgcgggcattgcacagcgtcgcgtcgctgggcctcgcagaccgcgcccgcgtcaccgtcgtccacgccttcgacgtgctgggcaagccgagattgtcggggttcggcattccgcgcgagcagatcgaaggctacgtcgagagttggcgctccgtgtacgcggaggagaccgaagccattctcgaagccgaggggctcgcaagacggaactgggtgaggcggacggaggaggggcgcccggacgaggtaatcgccagcctagcggcgcgaacctgctccgagctcctcgtcatgggcacgcgtggccggaccgggttcaggagggccctgctgggaagcgtcaccgaagccgtcctcgccgccggccaggcggacgtgctggtggtcccgccgccccggcccggctcatccagcaggtcggaacgatcaggatggcccttgtccgccaaggccgagcgcacggccctacaggtcgtcacggcgtga

SEQ ID NO: 6493 - DNA, 633 bp, Methylobacterium sp.
atgcatccctatgtctcggacggcctgcacgccgatcccttcgacgccttccgcgtccgcgcccatcgcgggccgatgggcggcgacccccgcggacggcacgggccccacggccacccgggtcgcggtcccggcgaccgccggatgttcggccgcggcggccgcggcgacctcgcgcgcttcttcgcccacggcgacctgcgcctcgtcatcctccacctgatcgccgagaagccgcgccacggctacgagatcatcaaggcgatcgaggagcgggtcggcggcgcctacagcccgagccccgggaccgtctacccgacgctgaccctcctggaggaactcggccacgtcacggtgacccccggggagggcaccaagcggctgcacgcgatcacgcccgaggggcaggccttcctggacggcaaccgcccgaccctcgaggcgatcctcgcccggatggccgaggccgaggccgcccggggcgacggtcccccgccctcggtcgtgcgcgccaaggaggggctgaagctcgccctgcagatgcggctcgcccgcggcccgctcagcgccgagcaggccgccgccatcacggcggccctggaggcggcgaccgccgcggtggagcgggcgtga

SEQ ID NO: 6494 - DNA, 573 bp, Methylobacterium sp.
gtggaaatcgatcttgagacatattatcaggcggccagaaccggcagcctggcctgtattcgctcgctcgacccgatctacggcgagcgcttcttcttcctgcgcgtccgcgaggtgcggaacggccgcatcgccaccgcgcgcgggatcttctggacggtcaacggcgagaaatgcgatccgggctggggcggggacgcgcacgcgctggtcgtcccgaccctggcgctcctcgagatgatcgagccgaacctggagcggatggcgcagttcggcgtcgaccggcggttcgagatcgccgtggcgcgggccgtgctggagggccgcctcaccgagatgccggagatgccgcagccgccggttccgaccctcaaggaggcgcaggccgagctgcaggccgcgatggcctactgggaggccgtggacgtccgcgaggcgaagcccggcacctcggtgcggatccgccgggaggccagcgagcggctggtcaccgcccgcaccaatctcgagcgggccaagcagcaggccgggcggctcgcgggctgcggcgaccgcgcgggctgccccggctag

SEQ ID NO: 6495 - DNA, 654 bp, Methylobacterium sp.
atgaagacgtatctcatcatcggggccggccccggcatcggcctcgccaccgccgagcggttcgcccgcgaaggttttcgcgttgtcctggcgtcgcgcgacgccgacaggacccgtacgctcgccgcgggactgcgggacaaggggcacgtcgccgaggagcgcacggtcgacgcgagcgatgatgccagcgtcgctgggctcgtggccgaggtcacggcctccttcggagccatcgatgtgctccactacaacgccgcggcgctgcgcaaccagaccgtcatcgatcagcccggcgacacgttcaacgccgacctggccgtcaacatcggcggcgcgctgtcggccgtgagggcggtggcgccggcgatggctgcgcggacctcgggaacgatcctcctgaccggcggcggcttcgggcttgagccgaaccccgacttcctgtcgctcagcatcggcaaggccgggatccgggcgctcgcgctcggccagttcgagccgttcagggcgcagggtgtccatatcgcgagcgtgaccgtcgtggcgcagatcaagcccggttcggccgaggcgaccgcggtcggcgagcacttctggcggctccacgcccaggcgccagacgcctggacccccgaagccaccttcgccggctga

SEQ ID NO: 6496 - DNA, 657 bp, Methylobacterium sp.
atgagcaccttcctcagcatcggttccggcccaggcatgggtctcgcgaccgcggagcgcttcgcccgcgagggcttccaggtcgtcctgagcgcccgcgacgagggcaaggtgagggacctcgccgagcagctcaaggccaagggccacaaggttgacgtccgcaccgtggatgccgctgaccccgccagcgtcgcgaagctcgtcgagggcgtcgagcgcgacttcggcggcatcgacgtgctgcacttcaacgccgcctcgatgcgcaaccagacgctggccgaccagccgcgcgacagcttcaacaccgacctcgccgtcaacatcggcggtgccgccgtcgccgcccaggccgcggcgccgaagatgctccagcgcggatcgggctccgtcctgttcacgggcggcggcttcgggctgcagccgcatcccgagtacctctcgctcagcatcggcaaggccggcatccgcgccctggcgctgggcatcttcgagccgttcaaggagaagggcgtacacgtcgccaccgtgacggtcgcgggcttcgtcaccaccgccgaagacgccaacgcggtcgccgagcacttctggcagctccacagccagccgaagggcgcctgggaagtcgaggccatgtacaccccgaagggctga

SEQ ID NO: 6497 - DNA, 3375 bp, Methylobacterium sp.
ttgcagcagggcgccgcgcttggcttgagccccagtcccctcttcgacgggccgagctatctcgccgacaacccggacgtcgccgcggcgggccaaaacccgctgctgcactatctcgaaagcgggcgcgcggaggggcgaccgatttcctcctgcgccgacgcggacgcggtgaagcggatcgcgacgtcacccctgttcgacgccgagtggtatcgggcaacccaggcgcccggcgtgcctgcggatcaggctgcgcggcattatctgcgcgagggtgccgcgcttagcttgagccccggtcccctcttcgacgggccgtggtaccttgcgatcaaccgcgacgttgccgctgccggtcagaacccgctcctgcattacctgaacgacgggtgctcggagggacggtcgatcgctcccttcgccgagccggcagcactggcgtcactcgaagggtcggacctgttcgacgcggactggtatcgcgcgacacacgtccctgacctgccgccggaccaagctgcgcgacactacctctgcgagggcgccgcgcgcgggctgcagcccggccccctgttcgacggcgcctggtatctcggcaacaatcccgatgtggctgaggccggcgccaacccgctgcttcactaccttaggagcgggcgtgcggagggccgacccatccgcctcgcctgcacccgcgatgcccaggcgcgcttgatcgagctccgccccgtcgtcctgcgagagagcacgtccgcgcgcgtcgtcgtcgtggtccacgccttctatgtcgatgttttcgaggagctgttgccccacctcgtgcgggcgatcccgcacttccacctgctggtctcgaccgacgagcccgcgaagcagtgcgcgctcgaggcggcagtagatcgcgccgggctcgctgaccagtgtcgggtcgtgctggcggaaaatcgcggccgcaacttcgggccgctcgtcaccgtgttcgcgcgcgacatcctgcgctacgacctcgtgctccacgtccacaccaagaaatcgctgttcagcggcgccgagcagacgcgctggcgcgatgagatctaccgggcgctgttcgcgaacgccgcctgtgccgccatcgccctgtccttattcgaggaggacagccggatcggcctgttcttcccggagaccagcgcgcacatcgtctactgggcgcacgcgtggctctccaacatcggcaccggctacggtctgctcgaccgcctcggcctgccctatgacgggttcgacgagtacatcgactatccggttggcggcatgttctgggcgcgggtcgatgccctgcgcccgctgctgaccgccggattgacgccccaggattttcccgaggagcacggccagacggacgggacgctcgcccacgcgatcgagcgggttatccccatcgtgtgccggtcgcagggctaccgcgccgtatgcctcgactacgaccgtgggcttgcccgctgtggcggcagcgcccgcaactggcaccagtacagcgcccgcacacaggaccaggcgctgctcgcgctgcaggatgtcgatctcgtttcgttcgacctgttcgatacccttgtcagccgccctgcccggcgcccggacggggtactcaagctcgtcgagcaccgcatcgcgatagaggaaggccgccccatcccgctcttcgcggagcgccgggccgcggagaaccggatccgcgcccgcaagcaccatcagggcgacgtcaacctgtcggagatctacgcagaacttgccgcctcaggaacgatccctggcgacgtcgtcgcgcgggcgcaggccatggagaagcggatcgacctcggagccctgcgcccgcgcccggaggtcatcgccgtcctgagggcggcgcaccaacgcggcaagcgcatcgtcctgatgaccgacacctactacgaggacaccgacatccgcggcatcctccaggcgatcggcatcgccgacctgttcgcggcgctctacgtgtcgaacgcggtcggcgcccgcaaggaccggggcgacctctggcgccacgtcgaggaagcggaagcggtgccgcgcgcccgctggctgcatgtcggcgacaatgagcattccgacattcaggcggcctgcgaccggcggatcccctacctgcacgtcgcccacccggctaagatcctcgcgcagagtgggttcgtgagggacgaaggcgatctcgcgcggacgtggtcgtccgatctggtcatcggccacgccatgttgatgctgtgccggaacccgttcctcgaccggcccggcccgccctacctgtcgctcggctcggcccgcgacgtcggctacgtcgtgttcgggccgctcatgctgctgttcatgtcctggctgatccggcacgaggccctgggccgggtcgagcggctgtactttctcgcgcgggagggcgacttcctggtcaaggtctaccggctgatccgggagcgctacggcctgcgccatctgcccgagggtcggtatttccacgtttcccggcaggtggcgatcggtgcggccctcggcacgggtttccgtccggatctggtgaccggggcaggccgctatgtggggagtatccagtccctgctctggaaccgggcgagcttcaccgccccggcacatctcggactggacagccgcgacgtgcggcttccggccgatgccccggtcgtcgagcgcgtcatgaccgacctcgagccggagatcatggcccatggggcggacctgaacgcgcggttccgcgcatatgcccggcaggagggcctcgacgccggcggcctccacgccgtggtcgatgtcggatactcggccacgatccagaagatgatgcagctggctctcggccagccgctgatcggcctctacatgacaaccttcgacgcggcgcagatggtggagagggacggcggtgccgcctttagctgcttccgcgcgggcgccgagaatcccgagacgtcatcgctccccgtcctggcctacggcctcgcggtcgaggcgttcctgaccgctccccacgggcaggtcgtcggctacgagagtgcgggcgaacggatcgggcccctgttcaaggccgatccgcggaccccggccgagcacggtatcctcgccgagctgcacgccggcgccgagcagtacatcatcgacacgctcgatctctacggaccgagccttctccaagccgacatcccatccagagggccacaggaattcctgcgcctgctgatgcaggggctgatcgccaccccgtccgaaccgatgcggacgctcggtgtggaggacgatttctgcggtctgccgattcacaaggtgtatgcgggagcgggaagtccggcgtccggctga

SEQ ID NO: 6498 - DNA, 921 bp, Methylobacterium sp.
atgctgaccttcctgctcaagcggctcctcgggctgctgccgacgatgctgatcgtctcggtcctcgtcttcctgttcgtccacctgcttcccggcgatccggcgcggctggcggccgggcaggatgccgacgcccagacggtggccctggtacgcacagagctcggcctcgaccggcccctgccggaacagttcgtgcgctacttcgccaacctcgcccgcggcgatctcggcgtctcgatccgcacccgccgcccggtctcgaccgagatcggcgagcgcttcctgccgaccctcctgctcaccctcaccagcatggcctgggcggtcgccttcgggctgatcatcggcatcgtctcggcggtctaccgcaacgaatggcccgaccggttcgggatgacgctcgccgtgtccggcatctcgttccccgccttcgcactcggcatcctcctgatgcagatcttctcggtcgagctcggctggctgccgaccgtcggcgccgacacgtggcggcactacgtgctgccgtcgctgacgctcggcgcggccgtggccgccgtgatggcccgcttcacccgcgcggccttcgtggaggtcatcggcgaggatttcgtgcgcaccgcccgcgccaaggggctcaaggagcgcgtcgtgatcgccaagcactgcctgcgcaacgccctgatcccggtcgtgaccatgatgggcctgcagttcggcttcctgctcggcggctcgatcgtcgtcgaggcggtgttcaactggcccggcatgggccgcctgctcgtcgatgccgtgaaccagcgcgactacccggtgatccaggccctggtcctgctgttctcgctggagttcatcctgatcaacctgatcgtggacgtgctctacggcctcatcaacccgaccatccgctacaggtga

SEQ ID NO: 6499 - DNA, 996 bp, Methylobacterium sp.
ttgatcggaatttcggtcgtcagcttccaacaaggcgacctgccgaaggcggtcaactacatctcggcaatagtcctagagaatccattcgacagcgacctcctcggcacgtgctcggcccttctgcggagcttttccgtcgaggaattcgccgatcgtgtcgaagcgataagtgatgacgccaagaaggatgcgcggacaataacggcgtgcctcgacggttttctcaacatggcggatttcggatcctcgggcgaggcgatcgtgcgcgtcccatccgagatcgctagcgcgatccacttcatatcgctcgacgctctgtctgtaggctccaacagatcgaagttcggtcggtactcgcctatcaactgcgtcatcgctcctaccgcgggagactatgaattccgcgagaagcacttcatctacgcgtcctcactgctggaggacaagcaggagatccttgaggcgttcggcctccgggatctggcacgggtcaaagcggttcacaaggtcaaagcgaagcgcatgtcggatgccctcgatgaaatcggggtctcaggtctcgactatttcaagagcgatctggagggcatagacggcttggtcctgcgcgacgcccggcagcacatcgccggggccgccgtcgtacaggccgagctccgtttcatgccggcctacgagggggagccgcacttcgacgagaccgtcgcctacatgcgcggacaggatttcgaggtgctgcatctgaccaatgagaattggcggtacgcgacccggcacagggagcacatggccagaggtcggacggtgtttgcggataccgtgttcgtgaagaacatcgacacgtatctatcgcttcacggacgctcgaccgaggccgtggttcgatattgcctcgcctgcggcgtgtccggcaacgcaaactatgctgaattcatactcgagaagcacaaggcactcgtcccttgcgatctcggcgccgctctcgtcaactaa

SEQ ID NO: 6500 - DNA, 789 bp, Methylobacterium sp.
atgttcgatatctgggaccgcatcgccgccgaggcggtagagcgggccaaggcgcagagccaggcagttgcccttgagcggaagatccgagccccgcgcaacaggcgctcaaattggacgggcgaccgacagacgctccacgagatcggatccgtgatccacggccggcatctcggcccgtgcgataccgacgatggcgaaacctacctccgggccgccctcccctggatcgtcacaaaggccggtggcttcctcgcggacgaccttgagcgtcacgtgaccgactggtgccgggctgccgtcccccgcctcgatctgggagctatccgcggctgccttgccgaagcccaggagcgcgacgggcggcaacggctatggtggtccgcgcaggatctgggcgaccttctgcggctcaagacggacgaacgggagcggctgcgggtcacgcgcattcggccggccggcatgacggctcggaagttcgcgacctatcagcgggctcggaaggccgaacaggcgaaggcccgccggatcgccaaaggggcaacgccccgggagcaatcgaaggctcaactagagccgtgggtcgcgctcaacatgagccgggcgacctatttccggaagcagcaggccggcaccctccccgcccagatccgggaccgtgagactgtttcgtcgtcaccagatacgaagtatctagagcccgtgacgggccagtctcacgtcgcagaacagactgatcggcccccacgaggtggtccaaggtcaaagttagtgcagggttggtcg

SEQ ID NO: 6501 - DNA, 2484 bp, Methylobacterium sp.
atgtcgggcggtcagggcgggagcggcgcagatccggtcaacggcaccggcggtcagcccggggcggacgaggtggcgaacggcaccggcgcggccggtggaaacggcggcgcttctgcccaggggagcggcggaggtgcgggcggttccgcaggctcggtcggaggcgccggcggcaacgggggcgcggcggctggtggaactgtcaccaacacgtcgggaacgggtggcgcctactcgaccaacacgggctccagctttttcgggggggctggcggggctggccttgccggtccgaatcccggcgacggcggcggcggcggcggcggcggcagccacggccagtacctctccaacacggggaatggcgtaggcttcaccttttcccggaccggcggcaccggtggaacgggcggtgccggcaacgggacgggcggaggtggcggcggcggcagcggtggttacggcttcgttgagcccggccccggatccttcatcgccagcgctcagatcaccggcgggaacggcggtgccggcggtgccgccggcggtcccggcgctttcggcggttccggcggtgagggcggcatcggacttttcctctacgggagcacgggcaccaacaccggccagatcacgggcggaaacggtggtctgggcggggccgcgaatggtggcacggcgggcatcgcgggccaggggggagccggtctgtccggcgcgaacatcgccatcaccaacaccggcacgatctcgggcggcttcaccggcggcagcacaaccgtccgggccgtcgctatcaacgtcacgggcggcaccaacagcctgacccccagcacgggaacgctgaacggcggcctcgggatcgccggcggcgccacgacattgcgcgtcctcggcaacgctcccaacaatctcggacccgtagccaacgccggcacgttcgacatctcggggacgacggccggtgcctcgatcaccacgctctcgggcaccggcgggacgacgctcggtgcgcaggccctgaccatcaccaacggttcgaccagctacagcggcgcgatctccggtactggcggcgtggcggtcaccggtggcacgcagacgctgacaggggtcagcacctactccggcggcaccgcgatcggttcgaacggcggcgctgtgtcgagcacccttcagctcggcggtccgacctcggccggcacggggacgatcaccttcggcacgatgtcggggacggcgacagcgcgcctcgggctcaacgtggccgctcagccgaccaatggtggcaccttcgccaacaccatctccaatttcggttcgggcaacgagatcgcgctcgccgggctgaccaactccagcgtcagctacaacagtgcgaacagctcgatcaccatcaccggcacccgctccggtggcggccaggtgagcgagaacttcgtgctgtcggccccccgcacgaccagcttcgcggcggtgtcggacggccagggcggcacgatcgtgcgcgccgctacggccccgaaccccacgaatcccacgaacccatctcagccggccaaccctgcaccctgctacgtgaccgggacgcggatccgtgtcctgcgcgatcgggtcatctcggacgtgccggtggagcagctcgcggtgggcgatctcgccatcacgattgccggtacgccgcgcccgatccgttggatcggcacccgcgcgtaccggggatcgatggttcccccggccgagcgccccgtccgcatccgggccgacgctctgagcgagggcgtgcccgcccgcgacctgcttgtctctccagatcactgcctgtggctggacgggctgctcgcggccgcgggacatctggtcaacggctcgagcatcacgcgtggcgaggcggtggcggatctcacatactggcacgtcgagttggacacccacgacctgctgctcgcggagaatgctccggcggagagcttcctggcggcgcccggcgtgcgcggcggcttcgatggcgtgcaggccctcgacgtcggcaccgggcgcatgccctacgctccgcgcgccgaactcggccccgacttggccgcgctgcgcgggcgcttagccctccgcgctgtctcgttggacggtgcggcagagccgggctcggtgcgagcgtggctggaccgatgcgtcgtgacgggcgatggcctgctgcacgtcgggggctgggcgcgcgacgaggcgcatcccgacaccccgctgtgcctggacgtgttggtagacggtgccgtcgtcgcgttcgcggtggcggccgagttccggtcggaccttgctgcggccggcttcggcgacgggcgatgcggcttcgacctcggtgtgcatgtacgcctcgctccacacgtgcatcatcgtgtcgaagtgcgtcggtcggccgatggcctcctgatgtgcgccaagcggatggatgcggcagggtcttggatcgcgctgttggcagcgtag

SEQ ID NO: 6502 - DNA, 471 bp, Methylobacterium sp.
ttgaagaagctgctccgcaaggcgcaggtcaaaccgctcaagcaggtggcggccctgccgttccgcgtcggcgccgacggccggatcgaggtcctgctgatcacctcgcgcgataccgggcgctggatcatcccgaagggctggccgatgaccggccgcaaggcccatcaggccgccgcgcgggaggcctacgaggaggcggggctcgaggggcagatcgccgcgaacccggtcggacggtaccattaccagaagcgcttcgaccacggccgcgccttcccctgcatggtccgcgtctacccgctgcgggtcgaggcccagcacgagcgctggccggaacaggcccagcgcaccctgcaatggttcgcgcccgaggaggcggcgcgcctcgtccacgaggacgagctccaggaactcctgacggatttcgcggcgcggccgatcgagatccgcggcgacgggcgcggctga

SEQ ID NO: 6503 - DNA, 1437 bp, Methylobacterium sp.
atgggattctgccagggcgggttgttcctggcacagttcggcacctcgctggccctcgcgcggctgctgacgccccacgagaccggcatcttcagcctcgccgccgcgatcgcgggcctgctgtccacgctgcgctcctgcggcctgtcgagctacatcgtccgggcggaccgggtggacggggccctgctggcgagcgtgttcacggtgaacctgatcctgtcgggcgcggcggcgatcctgatcctggccttcagcgtattcggcagcgtcctcctgggcgagccggaggtccagcgcgccctggccatcctcgcagtcgtgccgctggtcggcgcgctggagttccgcccggccgccatgatcgagcggcacggcaatttccgcggcgtggccctcgtcaacatgctgcgcggtctcgtcgccagcggcgcgatgctggcgctggcgctcctcggcttcagctacatgagccaggcctacgggcaggccgcgggcgccgtcgcggcggcgctggctgcgaacggcctcggcctgcgctacgtgtcgctgcgcatgggcctcgcgggctggcgcgagatcctgacctacggcggccggctcttcgccatcgcgggcgtcgcgggaatcgccggccggatgggcgacctcgtcctcgggcggatgctcgggctcagcgccctcggcctgtactcccgcgcggcgagcctcaacaccctgatgtgggaccacctgcacgtggtgatcacgcgcatcaccttcgtggacctcgcgaaccagcagcggaacgggcagtccctgcgcacctgctacctccacacgctgcggatgatcaccgtgctgctctggccggccttcgcgggcgcggccgtcctggccgggccgatcatgcgcgtcctgctcgggccgggctgggagggcgcggcgctgcccttctgcctgctgtccctggcggcgatcgtcctgacctcgctcagcatgacctgggaggtgttcctgatccgggaccagaccgccctgcaggcgcggttcgagttcctgcgccacggcgccggcctcgtgatgttcagcatcggctgcctgttcggcctcggcggcgcgggcgcggcgcggatcggcgaggcgttcctggccgtcggcctctaccggccgcatctcgagcggatgaccgacacgttccggcgcgactacgcccccatctacctccacgccgccgtcctgaccggcatcgccgtcgcgcccgccgtcctggtgatgtcggcctggggatggtcggccgagacgccgctcccgagcctcgcggccgcgatcgccgccgggatcgccggctgggcctgcggcctctggtacctggaccatcccctcgtcgcggaagcgcgcctgctgctcgcgcacatgcgcccggcccgtccggccacgagcgtgtcgaacctctag

SEQ ID NO: 6504 - DNA, 915 bp, Methylobacterium sp.
atggccgggcccgtctccgaatgctgggggagcatgcttcgcgagctgaagacctttgtcgccgtggcacggctcggaagcttcgcggcggccgggcaggctgttggcctcacggcctcggcggtgagcgcgcagatccgaaacctcgaaagcgagctcggggtccgtctgttcgaccgcacgggtcgcacggccatcctcaacatgaacggcaagaaggcgctcgtgcatgcgcatgagatgctcgccaccttcgcacggatgatggaggtcggcgacggggcgacccttcgcggcgagctgaaggtcggcgcgatctcgaccgcgcagaccggcatccttcccgaggcgctggtgctgctccagaaggaggctccgtctctgaagatccacctggtgccgggagtatcactgccgctcctcgggcaggtcgatgcgggtgagatcgatctcgccctggtggtgaaaccacccttcgagctccagaaggacctccatgccgaggacctcctgcgcgaggagttcgtgctcgtcacgcccacctatgtgaccgaatccgaccccatggagatcctggcgagctatcccttcatccagtacaaccgaacgtcgttcgcggggcggcaggtcgcgagcttcctcaaccagcaaaacctggccctcgaccagatcttggaactcgacgagatcgcggccatcgttcgcatggtccagagcggcctcggggtctcaatcgtaccgtggaccggagactgcggcgcgagcccggaacggtttcgcatcctgaggctcgggcccctggccttccaccggaccctccagctcgtggtgcgctactcgcagcgcaccaacccggccgtcgacctgttcctgacctgcctgaagagggcgacggccggcaggcagggtcagtag

SEQ ID NO: 6505 - DNA, 783 bp, Methylobacterium sp.
atggtgacgatcagtcgacgccgcgcgctcggggcggtcgccgccggcgccaccgcgggcctcggccccgccgcggccgccgaggcgcagccggccccgctgttcccgctgccgcaggccatcatcccgatcctgggcgaggcgcaggtcttcccggtccgccggatctactgcatcggccggaactacgcggcccacgcccgcgagatgggctccgacccgtcgcgcgagccgcccttcttcttccagaagccggcggatgccgtgcaggtcgtcgcgggcggcgtcgccgaccatccctacccgtcgctcacccagaactaccaccacgagatcgagctcgtggccgtgctgaagtcgggcgggcgcgacatcccggccgcgcaggcgctcgaccacgtctacggctacgccaccggcctcgacatgacccgccgggacctccagcgcggcatgggcaaccagaagaagccctgggagatcggcaagagcttcgaccagtccgcgccgatcacgccgatcctgccggtcgcccgggtcggccatccggcgcgcggccgcatccggctcgccgtgaacggcaccgtgcggcaggacgccgacctgtcggacatgatctggtcggtcgccgagcagatcgccgagctgtcgcgggccttcgagctgaaggcaggcgacatcgtcttctcgggaacgcccgagaatgtcgggccggtcgtccgtggggacgtgctcgccggctcgatcgagggcctgccggacctgtcgatccgcatcgtgtga

SEQ ID NO: 6506 - DNA, 354 bp, Methylobacterium sp.
gtgcggcgattctggatctcgaccatcctgggactcgaactgctcctcggcgggaccctggcggcctccgcccggacggcgggggttccggacttcaacatccgggcgatctgcgcgccggagcaccgggcgggatcgaccgccgtcgaccgggcgagctaccgcggctgcctgtccgacgaggccgccgcccggcgcaccctgatcaagcgctgggcgacgttcgacgtggcggagcgccggacctgcgcgacggagagccagatcggcggagcgccgtcctacgtggcgatgctgacctgcgtgcagctcggaagcgacgccctgccgatcaacccgtcgggccagccctga

SEQ ID NO: 6507 - DNA, 285 bp, Methylobacterium sp.
atgctctacatggtccacatgcaggtcaacattccggcgtccctcccgaaggaggaggcggctcgcctgaaggccgaggagaaggcctacgcccagaagctccagcaagatggccgatggcggcatctctggcgcatcgccgggcagtacgccaattacagtgtcttcgacgtggcgggaaacgatgaacttcacgaagtcctgagttcgctgccgctctacccgtatatggcgatcagcgtgacgccgctggcgcagcatccctccgcgatcgcggccaactga

SEQ ID NO: 6508 - DNA, 810 bp, Methylobacterium sp.
atgagcagcgcggtcaccgcggccgggatcaccgggcggacccgggtctacgggatcctggcggacccgatctaccacgtgaaggcgcccgaggtgatgggggcgctcttcgcccgccacggcgtggacggcgtcctcgtcccgctgcacgtgacggcggacggcctcgccgccgtgatggacgggctgcggcacctgcgcaatttcggcggcttcatcgccacggtcccgcacaagaccgcgatgaccggcctgtgcgacgccctcacccgggaggccgagcagatcggggcggtcaactgcgtccggcgggaggcggacgggcgcatggtcggcacgatgctcgacgggatcggcttcgtcgaggcgctgcgcgcctcgggcctggagccgcgcggccggagcgcggcgctggcgggggccggcggcgcggcgagcgccatcgccttcgcgctcgccgaggccggtgtcgcccgcctgacgatcctgaaccgcaccgccgaccgcgcccaagcgctggcggagcgcctgcgcgccgcctatcccgggctggcggtcgcggccgaaggcgtccaggcggagcacgatctcctcgtcaacggcacgtcgctcgggatgcgcccgcaggacgccgcccccttcgacctgggcgccctccacgccggccagttcgtcgccgaggcgatcatggatccggagattacgccgctgctcgccgccgcgctgagggcgggctgccgcgtccagaagggcctgccgatgctggagtgtcagatcgccctgatggcccgccacatgggcgccctctga

SEQ ID NO: 6509 - DNA, 1050 bp, Methylobacterium sp.
ttgcgcaaggcgaccgccgccttcggggcggacctcgtccacgtcgatgcgcccgctgccccgggcacgggacgcgtcaccgtcgcggtcgccgcggccggcatctgcggcagcgacatccacgccttcgagtggaccccgggctacgggttcatgaccgcgttcatgccggtcactctcggtcacgagttctccgggacggtccgggcggtgggggacggcgtgaccgcgctcgcggtcggcgaccgggtcacctgctggccgacggtgccgtgcggcgcctgcgcggcctgcgccgccgcgcggccgcaggattgccagggccgccgcatcgtcggcctgcacgccgacggggccttcgccgatcaggtcgtcgtcccggccgacaattgccgccgcctgccggacgggttgccgctgaccgtcgcggccctggccgagccgctggcggtcgcggtcaacgcggtggacgtcgcggaggtcggtcccggcgaccgcgtggcggtgctcgggccgggcccgatcggcctctgcatcgccttcgtggcacagcagcggggcgcggacgtgctgctcgccgggctcgacgacgccgcgcgcctcgacctcgcccggcggatcggcatccgccacacggtcgatctcgccgacatcggcctggacgacgccgtccggcgcgccttcgacggggaggccgaccgggtgatcgaggcgaccggttccgcccggtcggtcagtgacgggttggccgtcctgcgctcgggcggcgtgatggtggtggccggcatccattccggctccctcgacctcgacctgacgggtttcgtgcgcagcaagaagcagctgcgcgcggcccacgacacgacggcgcgcgccttcgacgccgcgctcgcgctcctcgcggcgcatgccgggacgctggaggcgctgatcacccaccgacgccccctcgcggaagccggggcggcgttcgagctggcgcgcagccggcaggccatgaaggtgctgcttctcccggaagcggcggcgagccgggaaacggagcgatga

SEQ ID NO: 6510 - DNA, 594 bp, Methylobacterium sp.
ttgctcgacctccgggaacgggccgcgcgcttcgcgcgggcacgcggaggcgcgacggccgtggagttcgccctggtggccctgccgttcttcgcgctggtcggggcctgcctcgagaacgggatcgtgttctgggagcaggagatcctccagcaggcggtgtccgacgccagtcggcagatctacacgggcacgttccagacgacgaacgccggcacaaccgaccccgcgacgttgatgagccgcttccggacggcgatctgcacgcagccgaacggcacgccccgggtcacgatcttcacctgcgccaacgtccgggtcagcgtgatgaaggtggccgattacgggtccgccaccccggtctcgccggtcgcgaccaacgccagcggtgcgagcgactggaacccgaacttcgccagctacgcctgcgccgggaactcagccatcgtgatcgtgcaggccgcggtcgacatcccggtcttcttcccgctgctcggtgccgccgtgcccaacctgccgaacaagcggcgggtgctgcaggccgcgacggtgttcaaggtggaaccctacaccgcaccgtcggggtgctcgtga

SEQ ID NO: 6511 - DNA, 204 bp, Methylobacterium sp.
atgaaaacagtcgtcgccaccgccgtggtcgtcttgttctgcgccggcgcccgcgccgacgagctgaacgacatgccggacatcgcgtgtgcccaagcgtcgtccgccgtggagcgcgatcacatcgggtgcccgggcaccgacagggcggccgcggggtcccgggcggccgcctcgcccctcgaccgcgcggaagacgactga

SEQ ID NO: 6512 - DNA, 903 bp, Methylobacterium sp.
gtgaccgatatcctcgtccccgccgctcccaccgtcgcgcccgtccccaccggcatccggacgccgtggtcggaattctggcgcaagttccggcgccagcgcgtcgccgtcctcgccctgggcttcatcggcctgctggtcgtggtcgccgtgctggcgccgtggatcgtgccctacgacccggtcaacgacttcgactacgaccggatcaacgagggcccgtcgctcgcgcactggctcggcgtcgatcccctcgggcgcgacatcctgagccgcatcgtcgagggcgcgcggatctccctggcgaccggcttcctctcggtcgccgtcggcgggctcgtcgggaccgtgctcggtctcctggcgggctactacggcggctggtgggaccggatcgtcatgcgcatgtccgacgtgctgttcgccttcccgggcatcctgctggcgctcggcgtcgtcgccatcctgggctcggggctcgtcaacgtcgtggtggcggtgtcggtcttcagcgtcccggccttcgcgcgcctcgttcgcggcacgaccctggtcctgaagaacagcacctacatcgaggccgcgcggagcatcggcgctccggaccggacgatcatcctgcgccacatcctgccgggcacgatctcgggcatcgtggtctacttcaccatgcggctgggcacctcgatcatcacggccgcgagcctgtccttcctcggcatgggcgcgcagccgccgacgcccgaatggggcgccatgctgaacgaggcccgcgccgacatggtctcggcgccgcacgtcgcgctgttcccgagcctcgcgatcttcttcacggtgctggccttcaatctcctcggggacggcctccgggacgccctcgacccgaagatcgaccgcctgtga

SEQ ID NO: 6513 - DNA, 417 bp, Methylobacterium sp.
atgccggcggccggcggctcgccggtgggtctgcgcctcacccgcagcgacgcggccggtctcttggcgcggatcgccccgcggatcggccgctacgccaccctgcgcctggcgctggcgggcggcgaggccgtcctgttcgcccccgacacaggctcgggccggccggcgctgccctggtgcgcgacgccgctcgggtggctggcggccgacgggccgctgctcctgcccttcgggtgccgcctcgccgtgccggcgccctggcgcgccgaggtcgcgcgccgcctgctcgaccggcacggtctgggcggtccggccctgctcgtccccgagggcgaaaccctgcgcctgctcgacctcgccggttcgcgcgccgtgccggacatcgataccggccgcctgggagaggcggcgtga

SEQ ID NO: 6514 - DNA, 516 bp, Methylobacterium sp.
atgctcgccgtccgcctctcgaaggccgccctcgtcggcgccctggccctgacttgcacgctggtcgtgtacggcaacgtcacggagccggcagtgaacctcgccttcgtgcagcacgtgctgtcgatggacacgatcctgccggattcgggcatcgccgaccgcgcgatcaccgatccggcactgcagcgcggcgccttcgcgatgatcgtcgccgcggaggctgtcacggcgctcctgctctggatcggcgtcgcgctgatgctcgcgcggctgcgggccccgcgcggcgacttcgaccgggccaagacctgggcgatcgccggcctgagcgtcggcttcctggtctggcaggcgggcttcctgggcatcggcgccgagtggttcggcatgtggatgtcgaaggtctggaacggccaacaatccgccttccgcttcgccatgacggtcctcggcgtgatgatctacgtcgccctgcccgaggccgaggatccggaggcgggccgcataggctga

SEQ ID NO: 6515 - DNA, 1218 bp, Methylobacterium sp.
atgtcccgcacgtccccctcggccatcgaccgcgcgcccgtcgccgaccggtcgggcaccggcaatgtggtcaggctagccgtcgcgcaggccctcgccggcgcgaactcgaccgtcgtgttcgcgacgggcgcggtcgtcggcaacatgctcgcgcccagcaaggtcctggccacattgccgatctcgatcttcgtggtcgggatggccgcctgcgcccttccgaccggcagcatcgccaggcgccacgggcgccgcaccgccttcatggtcggcaccgggtgcggcgtgctcgtcggcctgctctcggcctgggcgatcgtcgcggccagtttctggctgttctgcgcggcgatgttcctcgggggcgcctacgcggccgtggtcttctcgttccgcttcgccgccgcggactgcgttccggccgatcgccgcccgcgggcgctgtcggccgtcatggccggcggcgtcttcggcggggtgatagggccgcagctcgtcacccacaccatggacctgtggcctccctacctgttcgccgccaccttcctggcccaggccgccgtcgccgccgcggccgccctgatcctggcgggcgttcgcctgccgcggccggccgccgggtccgtctcgggcggacgaccgctggccgtcatcctcgcgcagccgcgcttcgtgatcgcggtgatctgcggggccgtgtcctacctccttatgaacttcgtcatgacggccgccccgctggccatgcgcctgtgcggccacgcgcaggaggatgccaatctgggcctgcagtggcacgtcatcgccatgtacggcccgagcttcttcaccgggcgcctgatcacgcgcttcggcgcgtcccgcgtggtggcggccggcctcaccttgacgggggcggcagcgctcgtcggactcgcgggcttggacgtcgggcatttctggttgtccctcatcctcctcggcgtcggctggaacttcggcttcgtcggcgcctccgcgatggtgctggactgtcatcgcccggaggagcggacgcgggtgcagtcgatcaacgacttcatcgtgttcggcatggtggcggtcggttcgttctcgtccgggggcctgctgacgagctacggctgggacacggtgctctgggtgtccttcgcgcccttggcgctggccgcgacggcgctcgcgctcacgacagggcgcggcgcgaaggcgtggtag

SEQ ID NO: 6516 - DNA, 678 bp, Methylobacterium sp.
atgaagaaccggaccatcgcgagctcgatcgggaccgagatccggcggcgcatcctcgacggccgctatccggccggctcgcagctccgccaggatggcctcgcggcggagttcggcgccagccggatcccggtgcgggaggccctgtttcagctggaggccgagggcctcgtgcggatcctgccgcatcgcggggccatggtggcgccactctcggctgccgacgccgccgaggccctcgagctccggggcgccctcgagccgcgcctcctggccctctcggcgccccgcctgaccgccgacgactacgcccgggccgacaccctcttggaggagtacgccgcggccctgcgggcgggcgcgacggcgcgctggggcgccctcaacacggagctgcacctcctcctctacggccgggcggatcgtccccgcgccctcggactggtcggctccctgctggccgagtgcgaccgctacacccgcctccagctctccaccgacagcgccgagctggagcgggccgaccgcgagcaccgcgagatcgtccggctctgccggaacggccacgtctcggccgcctgcgccctcctgaccgaccatatcgaccacgtcgccgccgcgctgatggccttcctcggcgccgcgccggtcccggcccgcgcgacagagattgtataa

SEQ ID NO: 6517 - DNA, 2862 bp, Methylobacterium sp.
gtgacgggcaccgtcttctcgcgttccctgcgcgcgcgcctcgtcggcgccacgctctcgacggccgcgatcgcgctggcggccctggttttcctggtggttctgcgctccgggcagacgctccgcgagcaggcgcaggaggtgtcgacctggtccgaggcccagctctccgaccgactgctcagcgacgccaagctcgccgccgcccggctccagatgcagcgcgaggacgtcgagcggcgcttcgccaccatggccaagcgctgggacgtcgccaaggcggtgttctccggcaacacggtggcggcctcggagctgctccggcctgctctggccctcgccgacctcgacggagccatcgccttcgacctcaatctccgcgcgctgaccgccgaccgcgtcgaggcggacctcctcgccgccaacgcggcgttccggacgtcgcccgtcgcggcgtccctgcgggccgtgctcgcccgcaacgatcgggagcacgcggagggattcgcgctgtcgctgcgctgggacgacgcgctcgcgcgggcgctcgccgccaccgagagcggcacggtcgccgacatcttcggcgagccgctgttcgacgatttcggcgaggtgatcggcggcctcgtcgggtaccgggtcctgcgcgcgcacgagccgaccctgacggccttcgcgtccctgagcaaccgcgacgtcctgatcctcgccgaccagaacctcctctcctcggcgggctcggaggtctccaacgcccagctcggacccgcgtcgggcgctgagctgcacgccgtgctcggcgccgagaaggtcgcgcgctgcatcccgcagccgcccgacatacgcctctgcgttgcggcgccgctgcgggagttgcagcaactcaccggcaaggtcgtgggcatcggcgaggagagctcgcgcgcgctgctgcggacgctcagcgtcgtcgccggtctcacgctgtgcctcgtcgccgtcgtcatgctcttcctgtcgagtcggatcacccgtcccctggtgcgcatcacccagaccgtctccgaggtcgcgcgcggcaactggcacgtcagcgtgcccgatatcgaccgtgccgacgaggtcggcgatatcgcgcgggccgtcgtcgtgctcgagcattccctctcggagcgcgatcagctgcgcgacgacgtgttccggcagaacacggtcctgacggagcgcgagcggcagctgcaggagcagaacgagcgcttcgacgccgccctgaacaacatgtcccagggcctgtgcatgttcggcgtccacggccggctcaaggtctacaattcccagttctgccggatctacgggatcgctccgggcgtgctggatctcgacccgacacaggatgaggttcaccggctcgctggtctcacggactggtcggccgcggagagcgggccgatccgccggaccctcacccggacgctggccgacggccgctgcatcgagatcacggtcgagccgatggccgatggcggctgggtggagacccacgaggacgtcaccgcgagcgtcaccgcgcaggcgcggatcgcgcatctcgcgacccacgacgcgctgaccggcctctcgaatcgagcgctcctggccgaccgtctggccgccgccttcgcggaccatgcggtcggcggccgggcggtgaccgtcatctgtctcgacctcgacgacttcaagggcatcaacgacaccctcggacatccggccggcgacgagctcctccgacaggtcggccgccgcctcaccggactgtgcccgtccggcggcacggtggcgcgcctcggcggcgacgagttcgcgatggtcctcttcgaggcagacctgccggacggcgtcctcgccctggcggagcagatcctgatccagctcaggcggccattcttcctcgccggccagttcgtgtccgtcgacgggagtctcggtatcgccatctccggcacggaggatgccgacggcgacgatctcctgcgccgcgccgacgtcgccctctacgccgcgaaggccgacggcggtcggcgcgtccgcgtcttcgagcaggagatggaggagcgtcagaaccagcggcgctggctggaacgcgagctgcggctggcgatcggcaccgcgcagatcgagctgcactatcagccgctgttcgacctggcgacgaacgcggtgacgagcttcgaggccctcgcgcggtggcaccacccggaaagcgggatgatctcgcccggcgagttcatcccggtcgccgaggcgacggggctgatcgacgccctcggcgcctacgtgctcgaacgggcctgcgccgatgccatgacgtggcccggctccctgcgggtcgccgtcaacatctcgccgatccagttccgcgaaggcaatctcgaccgtttcgtcgaggaggtcctgctgaagaccgagctgccgagccaccgtctcgagctggagatcaccgagtcggtgatcctgagccaggatcaggcgagcttcgagatgctgagccgcctgcgctccttaggcgtgcggttctcgatggacgatttcgggaccggttactcgtctctctcctccctgaacaccttccgattcgacaagatcaagctggaccagtccttcgtccggaacctcctggagaaggacgaggcggcagcgatcgtccacgtcgtcgctgaactcggccgcagcctgaagatcacgacgacggccgagggcgtcgagaccccggagcagctggcccggctgcgggcgagcgggttctcggaggtccagggctacctgctgagcaggccgatcccggccgctggcgtagcggccttcatcaacgcgcaggagcatatccacgtcgcggcctga

SEQ ID NO: 6518 - DNA, 810 bp, Methylobacterium sp.
atggcactgttattcacgtctcttcggcgcatcatcgcgggtggaatcatcctcctggccctgccggccgccgcgcgcgcggacgacctcgcggtcgtcggcacgggcgacgggatcgagatgctccaggccgtggcggccgcctacaatgccgagcgcggcgacgcgcgcgtgtcggtgccgccaagcatcggttccggcggcgccgtcgcggccgtgggcggcgagcgccagaggctcggacgggtcgcgcgcccgctgaccgaggccgagaaggcccagggactcgtggaggtgccgctcgcccgcatcccctcggcgatctttgtccatcagggcgttggcgtcaccaacctgaccagcgcgcagaccgccgcgatcttcgccggcacggtcgacaattggagcgccctcggcggccccgatctgaagatccgcgtcgtccggcgcgaggacacggacagcacgctcacgttcctgcgggccaccatgccgggctggcgcgacctcgtcctgaccagccgctcgaagacggcgaccacgacccaggacgcgatcgccacggtgcgggagacgcccggcgcgatcggcttcggaccgtactcgccggcgctcgcaggcgatctcgcggtcctgacgatcgacggccgggccccgcgcgatccggcctatccgagcgccgtgaccctcgcgctgatctacaaggccgccacgcgcgacgccgcggcgtcggcgttcctcgccttcgcgacctccgaccgcgcgggacaggtcatggcggagcggggcggcgccccgctcaggccgtga

SEQ ID NO: 6519 - DNA, 1038 bp, Methylobacterium sp.
gtggccgaacgcgtcaccctcgtcatcaacggaaggcgggtcagcgccagcgccggccagaccctgctcgacgcgggtctggcggccggccaggcgatcccgcacgactgcgccactgggcagtgcgacacctgccgcgtccggatccatgcgggcgcggtcgacgatgcggggacgcgcatcggcgagaccgtgcaggcctgccgggctcgcctgaccaccgacgcggtcatcgaattcgacgaggttccggaaaccgtccggcgggccggcaccgtggaccgcgtcgtcgatctcaccgccgagatcgtcgaggtgacggtcgcgctgcgcaagcggctgacctacctgcccggccagtatgtccgggtctccttcgccgggctgcccgcgcgggactacagcccgaccctgcgcgcggacggatcgggcgaactgaacgagttgatcttccagatccgccgccagcccgacggcgcggtctcgccgttgctcggcggcaggatcggaccgggaaccgccgtgaaggtcgagggcccgttcgggaccgccttccaccggctcgggcgcggccgtctcgtgatcgtctcatcgggcgtcggctgggcgcccgcctgggcggtcgcccgcgcgagccggatgcgtgagccggagcgcgacctgctcgtcgtggccggcgcgcggcacccgcagaatctctacatgcgcccggcgctcgactggctgcgcgcgcggggggcgacgacggtcctgacctgcagcggcggcaacccgcctccggatgcccggcccgggcggccgacgctccacatgccgatgctcacgcgcgacgacaccgtcctcgcggcgggcgcccccgagatggtcgcggctgtccagttcctcgccgcggcgaccggggcgacctgctacgccgatcccttctacgcggccgcgcgcggcgcggacgggaggccgccgtccgacacgaacttccttcagcgcttcctccagcgcgtcgcgggtcatcggaccgcaaaaacggagcctgtcgcctag

SEQ ID NO: 6520 - DNA, 1773 bp, Methylobacterium sp.
atgtcggaaccgctgaccctcgcgccgcatcagcccggcggagccgagaccgcccccgggtggcgcagtacagccgccgcgcaggtcgaccggcatccgcgctccgatgtcgggacgatcgtgatccactgggtggtcgccatcgccatggtggcgagcctgctcacgggcctgcgcatctcggccgacgcgcccgtggcgcggaccgcgaagttcctggcgcccctgcttccgcaaggtgaagtctggactgtccacttcgtggccggcctgaccctgttcttcgggatcaccgcctatctggtctacctcgtgcgcgggcgtctcacggatcgcaacggcctgtcgcggctccgcgccctccgtgtcagcgggcgaagcaaggccgcccggaaggcacggtggggcggcatcaacgtcgcgctgcactggctgatctacgccgtcacgctcgtcctgacgggtaccggggtcgcgctctacctcggctatggcggctgggtggtctggctgcacgccacctgcgcgctggtcgccctggcctacatcgcggtccataccctcgcgcacttcatgtacggcggcctgtggcagctccttcggttgttccgcccggcggccctggcggacggtgcggcgcggcggcgacgcccacttctggccgccgccatcatcggcctccccgtcgtcggcggcctcgccttcgcggatgtgagaggccgctccacgctggtgatcgacaaggtgtcggccgggcccgacctgtcgaagctcctcgacgacccggtctggcgcaccgcgcgcccggtctcggtccggacgatgcagggggccaatttcggcgggaccggtgagaccaccgtcgagatccgcgccgtgcgcgacgcgacgaacgtgtatttcgccttccgctggtgggacccgtcgcgctcgctcaagcgcgtcccgatgatcaagaaggcggacggctggcacctcctcgacgcggacgcggcgcgcgcggacgtgaccgcctactacgaggacaagctggcggtgatcttctcgcgatccgacgcgttcggcagcggcgggtcgacccatctcggcgcccggccgctgcccgacgcccccgccccgctcaacggccgcggctaccactacaccaccgacggcagctacatcgacatgtggcagtggaaggcggcccgtggcggcatgctcggcgtcgtcgaggacatgcatatcggtccgcccaccgaccccaccgccgccgagcgggccgtgaagggccgctaccaggccggctactggggcgatcccggcaccagcgcgtaccgctacaacttcaagttcgagggtccgggcggctacgcgggggcggtcgagccgctgcggcttcccaaggactggcaggcgacggtggccaagctcggtaccgtggatttggacttcgatgccagcacgtcgccgggctcggcgtggtggatggtcgagaagaccgagacggtgccgtactcggcggccgccgacgcggagatcccggtcggcaccgtgatgccgggcgtgctcatgaccgacggctatacgggggatcgcgccgggatctcggcggccgccgactgggccgacgaccactggaccctcgtcgccgcgcgcaagatcgcgaccggcagcaagtacgacgtcgatttcctgccgggaaacaccttctacctgtatgtctcggccttcgatcacacgcagacgcggcacacgcggcacatgcggccggtcgaagtccttctgcgctga

SEQ ID NO: 6521 - DNA, 2253 bp, Methylobacterium sp.; identical to SEQ ID NO: 5465

SEQ ID NO: 6522 - DNA, 807 bp, Methylobacterium sp.
gtggcgggggtgtcgtccatgaacttcgtgaccgggaagacgacgtccgtccgcgccgccgagccgggccgcaagcgggcgcggaaggccgtgaaaggggcgtcccaggaggccccacaggaggcctcccagggggcctcttatgccgcgggcggcaacgacgatctgcccgacctgacgctgaccgaccgggcctaccagcagctggaagagatgatcacgaccctggtgctcccgcccggcctcgtgctcggcgagcagaacctggtccaacggctcgggatcgggcggaccccgatccgggaagcccttcagcgcctcgcgcgcgacgggctcgtcgtggtcatgccgcggcgcggcatcctggtgtcggacatcaacgtgcgctcgcagctgcggctccttgagacgcggcgcgtcttggagcgcctgatcgcccgcctcgccgcggagcgatccacccgcgaggagcgcgaggtcttcgcggggctcgcgcaggacatgcgcgacgcggccgcggcgtcggacgatctggcgttcatgcgcctcgaccggcagttcaacgagctgatcgcgacggcctcgcgcaacgagttcgccgtgcgctcgctggagagcatggcgggcctgtcgcggcggttctggtaccagcactacaagcaggcggccgatctgccgctgaccgccaacctccacgcggacgtctgcgaggcggtcgcgcgtcgcgacgtcgaggctgccggcgccgcgtcggacaggctcgtcgactacatcgagagcttcgcccgcaagacgttggatctctga

SEQ ID NO: 6523 - DNA, 585 bp, Methylobacterium sp.
atgatcgcggcgccgacggcgacgcgcgccgagccggtggcggcgcttctccgggactggaccacggccaacggcctctgccgcggcggctccggcgacgatccgcgcacgcaggttgcctgcgaacggcgcgacggcctcgatcgccggctcgccgccgcgggctggtgccacggacgcccggccgacaccggcgcccagagaacctggcagccctgcggcgacggcacgcgacagcctgcacaggccgggacggagaccccgcagggcgcagcgcggcgcgtcctgctcgatgtcgcccggggccctgcggaggccgggcggggacagccggtgcagttcgtcgtgcacgccctgaaccaagtcggcccctgggccttcctcttcgcgcggatgcagcggcccgacggccgccccctccctcgcgccgcggacgatctagactcgaacgactacgccgcgctgctgcgccaggacggaaacggctggcgggtcgtcgacttcgccgtgggaccgaccgacgtcgcgtgggaaggctgggaccggcgctacggggcaccggcctccgtcttcgcggtcaggtga

SEQ ID NO: 6524 - DNA, 1221 bp, Methylobacterium sp.
atgaagcgactggacgtggccgtcatcggcggctcgatcgccggactgaccacggcgtgcctgctcgcgcggagcggccacgccgtcacggtgttcgagcggtcggcggccgcgctcacgggccgcggggcggggatcgtcacgcatcccggcctccgggcggtgctggcgcgctgcggtgctccggccggggcgggcgatctcggcgtcaccgtcgagggccgccgggtcctcgaccgggacgggaccgtgatcgcggaacggagcctgccgcaggtgctggcgagttggggacggctctacggcctgctcctggacgccgcgcccccggacagcgtccgctacggcgcggcgctcgccgcggtcgagcccgacggcgcgcgcgtcgtcgccttcttcgaggacggtcgccggatctccgcggatctcctcgtcggcgccgacgggcagttctcgacggtgcggtcccggttcctgagcggtgtcgcgccgcgctacgccggctacgtggcgtggcgcgccgtcgtcgacgcggcagccctcgcgccggcgacccgggaggcgatcggcggccatttcgcgttctgcctgcctccgggcgagcagatcctcggctatcccgtgcccgggcgcgcggacgaggccgccgggctgtgcttcaacgcggtctggtacaggccgaccgaggaggccgcgctcgccgcgctgctgaccgataccggcggcgtccgccacgccctctccatcccgccgggccgcatcaaggccgcggtgctggagtcgatgcgcgccgacgcggcgcggatcctcgcgccgcccttcgccgaggtcatgctgcgcgccgagcagccgttcctgcaggcgatcctggacatcgagacgccgaccatgatcccggcgcgcggcgtcgcgctgatcggcgacgccgccttcgtggcccggccgcatgtcgggatgggcgcgaccaaggccatggaggacgccgccgccctcgcggacgccctggacgcggccggcgccgacgtggacgccgcgctcacggccttcgaggcgcgccgacgcgcctacggcgcggccgtcgtggcgcggggacgcgatctcggcgcgtacctgcaggcgcagcagcgcggcgcggccgagcgggcggcggcggagcggttccgcagccccgaggcggtgatggccgggacggcggtcccgcccgatgtcccccgcgcttag

SEQ ID NO: 6525 - DNA, 1209 bp, Methylobacterium sp.
gtgatcatcggcggttccatggcagggctgttcactgctctgctgctgaggcgagccggctgggacgtcgacgtcttcgagcgtgcgggtgcggagctgtcctctcgcggcgccggtatcgtgacccatgccgaattgtatgaagtgctgcaaagcgcgggaatcgaccggcaagcggccgaggtcggcgtgtcggtgatcgggcgacgggtgctgggcgcgaacggttcgatcgtcggcgaactgccattgccccaggtgttgacctcctggggccacctctatggcctgctccgcgaagcgctgcccaccgagtgctatcatcacggtcgctcgctgacgcggatcgaggaggatgccgatagggtcacggcccatttcgaggacggctcctcggcatcggcggatctgctgattggggcggacggtattttctccgcagtgcgcacccagctcgcccccgaagtccttccgagctacgtcggctacatcgcttggcggggcctcgtgaacgaggacgacctgtcggccggcacgcgcgaggcgctcctggagcatttcgccttcgccctgccggacggcgagcagatgctcggctacccggttgcgggatccgataactccatggcgcgcggccgccgccgcttcaacttcgtctggtatcgtccagccgccgcggacacggccttgcgcgacctgttgaccgacgtggacggggtcgagcaccagctgtcgataccgccaagccggatccggcccgaggtcgtcgcggccatgcgctcggacgggcgccggctgctggcacctcaattcgccgaggtcgtcgagaagaccggtcagccgttcatccaggccatccaagacctggaaaccccacggatgcgcctcggccgccgcgtggtcatactcggagacgccgccttcgtcgcccgcccgcacgtcggaatgggcgtcacgaaggccgcggcggatgcgcggggcctggttgacgcgctggtggccaatccggacagcctggacgacgccctcgccgcattcgaggcggcccgccttcgctacggcgccgccgtgatccggcgcgcccgggaactcggcgcctacatgcaggcacagatcctcacgccggaggagcgcgccatggccgagcgccaccgccggccggaagcggtaatggcggagaccgctgtcgccaccggcatcgcggcttga

SEQ ID NO: 6526 - DNA, 321 bp, Methylobacterium sp.
atgccgaagcgcctgacaatcaccgtcccgcacgacctcgggacggccgaggttcgccggcgcatcgacctgcacatggactgggctttccgccgcctggaggcggagaagatccgcgtcgaggccgaggactggctgggtaatcgccgctccttctcgggtagcggctacgggcagtcggcgcacgtcgccatccaggtggcggatgacgcgctggaggtcgaggcgctggtgccctggatggccagcctgttcgcgcccgtcatcgagtcggtcgggcgccactacgtcgggcgcctcctgtccgacgaggccgcctga

SEQ ID NO: 6527 - DNA, 1398 bp, Methylobacterium sp.
ttgatcgacgccggaagccagaccgcgagtgcctccgatgccgccgcatcggtcgccgggtcgatcgcggccgtctcgcggcggctcgattcccttccgatgacgcggcttcacgcggcggcgctcgccgtctgcacgctgggcctgttcaccgacatcgccgaggtcgccctgagcaacgccctggcggccatcttcctcgcgccgccccacaacatgtcgcggggcagcctctcgctgctcctcgcctccgtgttcgccggcggcgccgtgggcgcgcccgtcttcgggatgctgggggatcgcctcggccgcaggcgcgcgctccaggcctccctcgcgctgatggccgccggatcgctggcggccgccgcgagccaggggctcacggcgctgacgatcgcccggacggtctcggggttcgcgatcggcgggttcccgcccctggtcgccacctacctcgccgaggtgacgcccgcgcgccgacgcggcgcgacgctgctggtctgcgccggactcgggctcctcggaggcctggccgcgatcggcttggtccagatgatggcaccggccgcgccgctcgggatcgagccgtggcgctgggcgctgatcctcgggggcgccctggcggcgctcggcggcgtcctattcgcgcggctgccggaatcaccgcggtggctcgcctcggtcgggcgctctgccgaggccgacgccgcctgccgccggttcgagcgcgcggccggccggagccgggtcgccgcccccgccgacccggacacggacccgcccgcgaccgggcccgcggggttccggggcctgttcgccgagacgcgccagctgcgccggacggccctgttcgtcggcctctacaccctcgcccccctggcgacgatcgccttcccgctgctcagcgccgtcgtgatggtggagaagggcttcaaggtcgatcaatccctcgtcttcgccgcgctgtcgatgctcggcccgcccctgggtaccctgctgaccgcgctggcgatcgaccggctcgagcggcgcgccgtcctgacggccctggcggcggcgatggcggccctcggcacggccttcgccgcgagcggcacgttcctgaccctggtcttggtcggcatcgccttcaacaccgcggcggcgacctacggcagcatcctcgccgtctacgcgacggagctgctcccgacgccgctgcgggcctcggccatgacctgcgcctgggccggcggccgggtcgcggccgcgctggcgccgatcatcctcctgccgatcctctcggcctacgggccgcacgcgatgttcgcggtgatcacgctcgtcctcgcggcgagcgcggccctgctcctcgccggaccgcgcggcctgtccgggcaggcccttgcttag

SEQ ID NO: 6528 - DNA, 408 bp, Methylobacterium sp.
atggtggctgcccccggaccgatcctggccggcgccctcgtggtcgccggtctcgggttcgcgtccgccgccgaggcgcaggtgccgacgcgggtcggcacctgcgcggcgaccaccatcgcgcggatcgggacccggttcagcgacacgctcgtgaagccgaagggcgacgggatcggcgacgggacgagcgtcgatctcaagaacggcgtctacggcgtctcctacgcgtatgtcgaagcggtcgcgcggtcgcgggtcggcgaccgggtcatgacctgcctcgtactcgtgccgacgggctgccccaagggcgacgatcgcggcaagatgtacacgacgaccaacctgcgcacgctggattcctggactttgcccgactcccagcacatgtgcggcggggcctga

SEQ ID NO: 6529 - DNA, 1281 bp, Methylobacterium sp.
atgcaggacctctccgatcccgtcaccctctcggccggcgccgtcctgttcgacgaggggtcgatcgggcactgcgcctacctgatcctgagcggccgcatcgcgatcttccggcggcgcgacggcggagaggccgtgctcgcccggcgcggggccggcgagatcttcggcgagatggcgatcctcgacgccctcccgcgctccgcgggcgcgcgtgccgaggcggattgcgtgctcgtccccgtgagcgcggcgcagatccaacagcggctcgccggcgccgacccgatcctgcgcctctgcctcgaggggctcatcgcccggttccgcgagaccctgccgcgcctcgggccggccgtggcggaggggcctccggcgccgctgtcgccctccgcccgcgccgatttcgacgcgacggtcgcgtccctcgcgcaggagcgcgccctgcggcgggccctggcccgggacgagttcgcgctgttcctgcagccgatcgtgcggctcgccaccgggcggctcgccggcttcgaggccctgatccgctggcacgatcccgagcgcgggctcgtggcgcccgcgtccttcatcccggccgccgaggcgaacggcctgatcctcgcgatcaccgcctgggtgatcgacgcgatcggccggatcgtgccccggatcctgcaggccggcctccaagcccccgccgccgtcgagccgtccctgttcgtgagcttcaacgtcacggcccaggacctcgcccggtcggacatccccaccctgatcgacgcgatgctgcgccggaccggcatcgcgcccgacgccctcaagctcgagatcaccgagagcgcgctgatgcaggatccggccggggcagcggccgccctcgcgcgctgccgcgccgccggcctcggcatcgcggtggacgatttcggcaccggctactcctcgctcagccatctcagcaccctgccgatcaccacgctgaaggtggaccgggccttcgtccgggcgatgctggcggagccgcgcgatcgccggatcgtccagaccatcctgcggctcgccgaggagatcggcgtggtggcggtcgcggagggcatcgagggccgcgccgaggcggaggccctcgccgccctgggctgcgacctgggccagggctaccatttcggccgcccgatgccggaggccgacgccctcgcggcggcggcggcctggaacgccgaggcgtggcgcgtcgggctgccccgagggaccggccagggccggccgagggtccgcgcccagggctga

SEQ ID NO: 6530 - DNA, 192 bp, Methylobacterium sp.
atgtccgacgacgacggttttgaccgcatggtggaggcgacgatcctggcccatcaactcgtggtcgcgcacggcacggcgacgatgcaactcctgtcccgattgctgctcatggagatcggtacggagatcgcggcgcggcgcgatcccgatccggccgccaacgacaatccggacgccctggcggattag

SEQ ID NO: 6531 - DNA, 1284 bp, Methylobacterium sp.
atgagcgtacgcgagaccctcgaggcccggctggcccggatcgccgcgggggacccggcggtcttcacccgcctctacccggagcaggcccgcgcggcggcggacgccgccgatgcgcgccgccgggacgggatctccctcggccccctcgacggcgcgatggtctcgatcaaggacctgttcgacgtggcgggcgagacgacgcgcgccggctcggtcctcttggccgacgcggcgccggcgcggtccgacgccccggtggtcgcccgcctgcgccgcgccggcgcggtgatcctgggcaagaccaacatgtccgagttcgccttctcggggctcggcctcaacccgcattacggcacccccggcaacgccgccgatccggcgcgcatcccggggggctcgtcctccggcgccggggtctcggtggggcaggggacgagcgacatcgcgatcgggtccgacacgggcggctccgtccggatcccggcctcgctgaacggcgtcgtcggcttcaagccgaccgcgagccgcgtgccgctggagggggcgttcccgctgtcctacgccctcgattccctggggccgctcgcccggacggtcgcggattgcgcggccgccgacgccgtgatggcgggcgaggagcccgcgccgctggaggcgctcgccgtcgccggcctgcgcatcggcgtgccgcggggcctgctgttcaccgagacggaggcgccggtcgccgaggccttcgagcgggtgctgtcccgcctgtcccgggccggcgcccggatcgccgatcacccgatcgacgaccacctcgccgccatggacgcggcgctcccggacggctccctcgcggcgatcgaggccgcggcgatccacgccgactggctggacagcgcggccggccgctacgacccgcgggtgcatcgccgcatcgtggccggccggaatgcgacggccgcgggctacatccggacgatgcgccggcgggccgcgctgatcgccgccttcgaccggcacctcgccccgctcgacgtgctggcgctcccggcgaccgccgcgacggcgccgctcaccgccccgctggcggcggacgacgcggccttcctggcggccaatcgcctgatgctgcgcaacaccgccttcggcaacttcttcgatctcaccggcctgtccctgccgatgccgggcctgccccggccggcgggcctgatgctgctggcccggcacggacaggaccgccggctcctggcgatcggggccgggatcgaggccgcgctggcggggtga

SEQ ID NO: 6532 - DNA, 291 bp, Methylobacterium sp.; identical to SEQ ID NO: 5477

SEQ ID NO: 6533 - DNA, 450 bp, Methylobacterium sp.
ttgtccaagtggtatctctacggcatcgccctcgtggccggcgtcgcgaacgccatcgagccgggccagaacgccacgctggcgaaggtcacggggcagccgatgctggccggcctgttctgcttcggcctcgcgatcgcctgcttcctcgccgcgatggccgtcgcccggctgcgcggccgctcccaggccgaagcggccacgcccgtgccctggtgggcttggccgggcggcgtgctcggggcggcggtcgtcctggcgcagctctacatctccgagaaagtcggcgcggcgccattcctgggctgcgtgatcaccgcgggcgtggtcggctcgatcatcctcgaccatcacggcctcgtgggcttcgcgcgccaccgcgccgggcgctggcgcatcctcggcggcgcgctgatggtcgcgggcgtcgccctcgtggcggcgttctga

SEQ ID NO: 6534 - DNA, 1299 bp, Methylobacterium sp.
atgcgcgtaggggacctgtccatccggacgaccatgagcctcgtcctcgtcgtcatggccacgatcatgctcggcttcgcgacgggcaccgtgcgggaggcgcgacagcacgccgccgaggccgagcgggtcatcgcgctggtgcgggcgagccgcgccctcctccagacgctgaacgtgacccggttcgagcggggcgcgactctgcagttcctcgccgccgcagagcccgtcgaggccgagacccgcgcggcgctctacgccgaccgggagcgggcgatcgcggggctcgccgcggcccggccgctgctcgacggcctggaactccccgccgtggcggcgaccctcggccggctgaacgaggcgagcggccgcctcgatcgcctccggccgcgggtcgacgccgccctggacgtgccgggcgcgcgtcgcgacggcgcggtgacggcggaggccagggccgccctccaggccatgctcgatgccctgatcgccacgagcgacgccgtggacgccgcgatcccgctgtccgacgggctcctccggcgcgacctcgcccttaagcgggcggcgtgggcgacgcgcatggccaacggcgccgtcgcgctgcgcgtgcagacatccctggcggccggggcgtcctggtcgctggacgagaccgtcgcggccgccgaggagcggggacggctcgacgcggcctggaacgcggcgatcgaggccgcggccgaggcgtccgggacggtccaggccgcgttccagcgagcccgggagaacaatttcgagggcgcccccctcgcccgccggcgcgccgtggcgcaggccctggctcgcggcgcgccgccgggcctgacgctcgcccaggcgcgcaagctcgacacgcccgagcaggttaccctcgtcgacctcgccttcgtctgcctcgacgagatggtcgcgcgggccgaggccctgtcgggggcggcgcggagcaccctgtggcgcgacggggcggccctggtcgcgaccctgctgctcgtcgccctcgggctgctcgccctgttccgcggcgtgctccggccgatccggcggatcaccgcggccatggaggccctcgcggccggggattccgccgttgccgtcccgggcctccggcggcgcaacgagatcggcgccatggcccgcgccgtgcaggtgttcaaggacaacctgatccgcacccggcagctggaggcggaggccgaggcggcccggcaggacgcggagcgtcagcgcggcctcgcgatgcggcaggtcgccgaccgcttcgccgacgccgtcggc

SEQ ID NO: 6535 - DNA, 231 bp, Methylobacterium sp.
atgacccgcactctgaccttcgcggcgctggccgcgctcctcgccgttccggcggtccaagcggaggcccgcccgcggcacacccccgccaaggcgcagcccagcgccgcgatcaaggcgcgccagaccgtcctgaacgatttcaacgcgcggatgagccgcctggacgcgctcatgggcaccccgagcaggtcgtcggtccgcgcgcgctcggccgaggccggccgctag

SEQ ID NO: 6536 - DNA, 117 bp, Methylobacterium sp.
atggagacgacgatgacctggaccaaccgcatcgccttggtggcaaccctgatcgccggcgcggtcgccctcgtgacctacgcgcaggccctcagcctgccggcccatttcgcgtga

SEQ ID NO: 6537 - DNA, 117 bp, Methylobacterium sp.
atggagacgacgatgacctggaccaaccgcatcgccctggcggcgaccctgatcgccggcgaggtcgccctcgtgacctacgcgcaggccctcagcctgccggcccatttcgcgtga

SEQ ID NO: 6538 - DNA, 777 bp, Methylobacterium sp.
atgttcgcggatggccaggtcgcggtgaccctgtccggcgagggcccgcccctcgtcctgctgcactcgctgctcgccgaccggacgagcttcgaccgggtcaccccggcgctcggccgcgacttccggctcctcgtccccgacctgcctgggttcggcgcctccgcgcccgcgccgggcggcctcgaggccgtcgccgaccgggtcggcgcggcattgcgcgcggcgaccgggggccggccagcggccgggctgggcaacggctacggcggcttcgtgctgctgctctgcgccctgcgccaccccgacctcttcgaccggctcgtcttcgccgattgcggcgcctgcttcccggagcccggccgggccgcgttccgcggcatggccggcgcggcggccgagaaggggctcgcggcgctcgccgacacggccatgcgccggctgttcgcgcccgcgttccaggccgcgcacccggacctgatggccgagcgccgggccgccttcctgcgcacggacgtcgacgtgttccgggcggcctgcgcggccctggccggcctcgacctgcgcgcgcgcctctcagagatccgcgcgccggcgctggtgctcgtcggggaggaggacgaggcgaccccgccggccatggcgcgcgagctcgcggccgggctgccggacgcgcggttcgtgacgctgccggactgcgcccacgtcccgcagctccaggcccccgagctgttcgcccgcgaggtcctggcgtttctccggccgggttccgcctga

SEQ ID NO: 6539 - DNA, 318 bp, Methylobacterium sp.
gtgaggctccgcgcgcgcctcgccgcggccctgcggccgcccgcgcgcgccggcgtgcagcacctcccccggcgtgtctggcccggcgaggaggcggcttggcgcgacgagaacggcgtccgccacccgcgagcggtgcgccgtgccctcgcggcgctggccgccctcgaaccccgcggtcgctacggcgcccggatcgagggacggggcaaggtcgtgaccggtccggccagtgcgctcgtcctgcgcgacgcggaggcggagatcgggttcgtcctcggcctcacgcccgacgggtacggcgcggagctgttctga

SEQ ID NO: 6540 - DNA, 864 bp, Methylobacterium sp.; identical to SEQ ID NO: 5483

SEQ ID NO: 6541 - DNA, 669 bp, Methylobacterium sp.
gtgcagcatttcggcgtcacggtccagaacatggaccgagctttcgccttctacaccgaggtactcggcggcaccgaggtcatgcgtgatggcgatttcaagggggagccggtccatttcacgctgatggccgatcaagagatcgttgcccgcgagcgccgcgtcgatcctcgcaccatcggcgtcccggacctgaagggtggctcccagcggctcgatgtccgcttcgtccaattcgagaacgtcgtcatcgaactcctgcagtatcgcgacgccacgcagccgatgggcggcggcgacagctgggctgagccgcgcgaccacatgagcccggcctacccgcgctcgatgcacatttgcttctacgtccgcgatgacgtgaacttcgacaagttcatcgccgatctcgaggccgagtgcgcccgccgtggcatgacgcaggtcagggcgaaccgcaccgtacccgtgcactccgaggagcagcgccgcgcggcgccgagggataccaatacgatcaagatccacgagggtccgtcgaacggctggtcgatcatttactgcaaggggcccgagggcgagcagctcgaattcgtccaagtgctcggtcccgtaaaaaagacgttcgatgacgctgccgaggcgcgccgggcggcgacgaaccggggctga

SEQ ID NO: 6542 - DNA, 516 bp, Methylobacterium sp.
atggcctatcatcccgttcccgtgacgcatgtcggcctgaccgtcaccgacatccgcgcagcgaccgagtggtacaccaaggccttcagctgccggcacatcatcgggcccctgcacgtcaggcacgacggctcgcatatcggcgaggtgttcaaggggatcttcggtgatcggttcgaggagggatacgtgtcccacctcgccaccgcgaacggggtggggatcgaactcttcgagttcgtcacaccgaagtcggaagccgtcgacgacaacttccgctactggaagaccggcgtgttccacttctgcttggtcgaccccgacgtcgagggcctcgcgcggcggatcgccgagatgggcggcaagcagcgctcgaaggtctggacactgttcgagggagagccgttcaaggcggtctactgcgaggatccctggggcaacctgatcgagatctactcgcactcgacggagctcatgtacgccaaccggagcgcgacggccgcccgggcggagtga

SEQ ID NO: 6543 - DNA, 354 bp, Methylobacterium sp.
gtggttcgcgccgatccgacacgccgctcaggcccgcgacgccgttcccgatggcgcggcacgcggtcttcggcgggcgccccgaaggccccgctggccgatcctcgaaggggatgtcacctgccccgcttcttcctcaacgtccggcggcacggcacgctgatcgccgatcgggagggcgacgatctgcccgatcggacggcggccgagcacctcgctcgcgacatcctgcgcgagatgcgccggctgccgcacgtctacggcgcgccgcgcggctggcgcgccgacaccttcgtcatcaccgacgaggccggcgcggtggtggccgaagtcccctacgccagcgtgctctga

SEQ ID NO: 6544 - DNA, 789 bp, Methylobacterium sp.
atgagcggcaccttgctggagacggtcgacgaacgcggggtcgccaccctgacgctcaaccgtccggagcagcacaacgccttcgacgacggcctgatcgccgccctcaccgcgtccctgcaccggctgggcgccgctcccgggatccgggcggtcgtcctggcgggcgccggccagagcttctcggcgggcgccgacctcgcctggatgcgccggatcgccggccagtccttcgacagcaacctcgccgacgccgccgggctcgcggggctgatgcacagtctcgaccggctgccgaagccgacgctcgccctcgtgcacggggcggcctacggcggcggcgtcgggctcgccgcctgctgcgatatcgccatcgcggccgagagcgcgcggttctgcctgagcgaggtgcggctcggcctgatcccggcgacgatcggcccctacgtggtcaacgcgatcggcccgcgctgggcccggcgcctgttccagaccgcggaggtcttctccgccgagcgcgcccgggcgatcggcctcgtgcacgaggtggtgcccgacgaccggctggaggcggccggcgcggaggtgctgcgcgacatcctccggggcgccccgggcgcgcaggccgaggccaaggacctcgtcttcctgtgcgaggggcggccggtggacgccgacctggggcgcgagacgggccggcgcatcgcccggcgccgagcctcggacgaggggcaggccggcatcgccgccttcctcgacaagcgcttagccccgtggcggcgggactga

SEQ ID NO: 6545 - DNA, 273 bp, Methylobacterium sp.
atgattggggccggatatgtcggcctggtctccggcgcctgcctggccgatttcggccacacggtcgtgtgcatcgaccgggaccccgacaagatcgccagcctgaacgccggccgcatgccgatctacgagccgggcctcgacgtcctggtcgccgagaacgtccgccagggccggctcgccttccgcgcgaccatgcgggacgccgtggccgaggcggacgcggtcttcatcgcggtgggcacgccctcccgccgcggcgacggcttcgcc

SEQ ID NO: 6546 - DNA, 261 bp, Methylobacterium sp.
atgacacgcttgccgattatcgtcctcgccaccctcgcactcgggggcagcgccgtcgccgccgagcagggggcctcgtccaagactccgggccacgagatgcaggatcgcgggagccgggccgggagcccgggcgcgtccggttacgcgccgggccacgagatgaagtccggcgggacggactcgaccggttcgacgtcgcgaagcggcggaagcacgacgggcaccaccggcaccagctcgaccggcacccgtcgctga

SEQ ID NO: 6547 - DNA, 954 bp, Methylobacterium sp.
atgctcgacaccgacgatctccgcttcttcgtcgcggtcgcggccagcccgtccctggccgccgcggcgcgcagtctgaacgtgtcgccccccgccgtgacgcagcggctgcgcagcctggagaagcggctgcgggtccatctggtggaccggtccggccgcggcctcacgctgaccgacgagggggagcttctggccgagcgcggtcgcgacctcctcggcgccttcgacgatctcgccgacgccctggccgagcgcgtcggcgcggtgaccggacatctgcgcgtcgtcgccccgctcggcttcgggcgccgctacgtggccccggtcgtgacggcgttccggctgcggcatccgggcgtgcggatcgacctgctgctctcggatcgcctgggccgcatcccgtccgagacctgggacctcgcgatccacgtcggtgagatcagggaggcgaccccgagcctgaccgtgcgcgccctcgcgccgaacgaccggatcctctgcgcggcgcccgcctacctggcccggcatccggccccgcgcgtgccggccgacctgcgggatcacacctgcatcgcgctgcgcgagaacgacgaggacgtgacgctctggcgcttccgcgcggcggagggcgccgaggtccgcgtcagggtggatgcggccttggtcagcaacgacggcgacgtggtgcggggctgggccctcgcgggcctcggcgtgatcgtgcgctcggaatgggatgtcgccgacgacctgcgcgcggggcggctggcgcgcctgctcgaaggctacgccctgccgtcggcgccggtcgtcgccctgctcggctcggaacggcggtcgcgcgcggcccggacggagcggttcctcgaggcgctccggcgctcgttcgatccgctcccgtggcgcccgcccgcgggtcctggcgcggccgccggggatgcggggccttga

SEQ ID NO: 6548 - DNA, 621 bp, Methylobacterium sp.
atgatcgatctctacgcctggaacacccccaacggccggaagatcagcgtggcgctggaggagatggcgctgccctaccgggtcatcccggtcgacatcacgcaaggggcgcagcacgcgccggacttcctggcgatcagcccgaacaaccgcatccccgccatcgtcgatccggacgggccggacgggtccccgatcccggtgttcgagtccggcgcgatcctgctctacctcgccgagaagaccggccgcttcctgcccgaggaccggcggcagcgcgtcgccgccctggaatggctgatgtggcagatgggcggcttcgggccgatgcccggccaggtccaccacttcctgtccgtcgcggaggccgaccgcgcctacgggctcgcccgctacagcaaggagacgcaccggctctacggcgtgctggaccggcgcctcgcgcaggtcgcgtacgtcgcggggccgctctcggtggcggatttcgcgatcctcggctgggcgtggcgccacgagcgccaccaggtcgacctcgccgactacccgcaggtccggcgctggtacgaccggatgatggagcgccccgccgtgcagcggggcttcaccgtcccgctgagctga

SEQ ID NO: 6549 - DNA, 552 bp, Methylobacterium sp.
atggacgacctgcttcgcgagtttctgaccgagagcggggagcatctcgacacggtcgatgcagaattggttcgattcgaacaggatccgaacaacgagactattctgcggaacattttccgactcgtgcacacgatcaagggaacctgcgggttcctcggactcccgcggctggaagctctggcgcacgccgccgagaccttgatgggtcgcttccgtgacgggctgcccgccacgtcggattccgtcaccctgatcctgctgacgctggaccggctgaaggcgatcctggccgatctggaggccaccggcacggagcccgcgggctcggacgacgacctcatctccgccctggagcgcatggccgagggctcgccggagccggaggccgccgccccgccgccgccgcccgagccggtcctgcccgatccggtggtccgcgagctgaagcccggcgaggtctccctggacgacctagaggccgccttcctggccgctcctggtccggacgaatcggacttcctcccgccgccggcccccgtggccgcgatg

SEQ ID NO: 6550 - DNA, 1494 bp, Methylobacterium sp.
ttgcgtcaggcgttcccgttcctgacggcgccgcagatcgcccagaccatgttcacaaccgccacccatctcggtgacgggcccgccaacgccccgaacgccatctacggctggggcctgctcaacctcggcaaggccatcgacggcccgggtcagttcacctccacttggacggtcaacaccacctacaatggccaagcctattacggccgcttcgccaacgacatctcgggcgtcggcggtctgatcaaggttggtctcggcacactcgaactcgccggtaccaacacctatgccggcggcaccgccgtcctcggcggtaccctggccgtctcccgcgacgccaatctcggcgccgccggcaccggcctgaccctcggcggcggcaccctcgaggtcctggccgacggcttcgccaccgcccgcccgatcacgctggccggccccggcaccctgcagatcgacctcggcaccgccaccttcgcggggccgatcgacgacggcagccagccgggcgtgctcgtcaagaccggccccggcaccgccgtgctctcggccgccaacacgttcacgggcggcgccctggtcggcaccggcaccctggccctgaccgccaccggcagcctcaccgcgcccgttctcgtcggctcggcggcgagcttcctcaatgccggcctcgtctccggcaacgtcggcaacttcggcgtcctcgccaacagcggcaccatcacgggcggcctcgccaatgccggtctggccctcaacaccggcaccgtcgcgggcgggctggccaatgccggtctggccctcaacaccggcaccgtcggcggcggcgcgaccaacagcggcagcctgatcaacgccggcaccctcgcgggcgggctgaccaacaccggcaccgccctcaacaccggcgcgatcgccggcggcgtcatcagcagcggcatcctgagcaacagcggcgccatcggcggcggcgtcgccaacaccggcctcctcgccaccagcggcacgatcagcggcggcctgaccaatgccggcaccgtgctcgccagcgccggccgcatcgacggcgccatcgccaacaatgccggcctgctcgccgtcgccggatccgtggccagcagcggccccttcgccaacgccgccggcgcgacgctcgccgtcaccacgggcggcagctacagcctcgccggccccctcgccaatgccggcctcgtcgccgtcgcccagagcgccagcctcaccgcctccggcggcctcagcaacgccggcctcgtcgccagcgacggcaccctcaccgccgacctgaccaacactggcgtcgcccgcctgtccggccagttcaacggcacgctcaccaacaccggcctcgtgcagatcaccggcccgctcgccgggctcaccggcctgaccaacaccggcgctctcgacctcggcggcaccgccctcacgctcaccgacctcgccggcccggcctccgccgtcctgggc

SEQ ID NO: 6551 - DNA, 1302 bp, Methylobacterium sp.
atgaaggtcctcctctgctcgacgcccgccacgggccatctcaatcccctcctcgccatcgcccacatgctgatcgcggacggccacgaggtcatggtcctctcgggctcggccttccgcgaccgcatcgtggcggccggcgcccgcttcatggcgctgccgggcgcggcggatttcgacggccgcgacctccgcgcggtcgtgcccgaacttgccgagatcgcgccgggaccggactggctgcgcgtcgccatggagcgcgtgttcgtcgaccgcatccccgaccaggcgcgcggcctgcgcgcggcgctccgggccttcccggcctcgctggtgatcggcgacgacatgttcttcggcgccctgccgctgctgctggggccgcgcgcggagcgccccgccatcgtcctgtgcggcacgtcgatcctgcactgcgcgcggcccgaccgggctccggccttcctgggcctcccgccggccgagacgcccgagcaggaggccgcctacggccgcatcgcagaggcctacgaggcggcggtcgaccggccggtcgggctgagcctcgccgccaagctggcggaactcggccgggccgccccgccctggccgctgttcgacgcggtggtccggctcgccgacacctacctgcagctgaccgtccctagtttcgagtacccgttcccgctgccgccgacggtgcgcttcatcggggcgctgccgatcgtcccggggcaggcggcgctcccgccctgggcgggcgacctcgacggcgcgcgcaaggtcgtgctggtcacgcagggcacggtcgcgaaccacgatttcggcctgctcgtcggccccgccctccgggcgctggccgatgagaccgacatcctgaccgtggtgacgggcggcggccgggggctcgacgcgatccccggcccgatcccggccaacgcgcggctctcgccctacctgcccttcgagtggctgctgccccgggtcgacgccatggtgaccaacggcggctacgggagcgtgaaccaggccctgagccacgggatccccctcgtcgccgccggcctcaccgaggacaaggccgacgtgaacgcccgcatcgcgtggtcgggggccgggatcgacctcgccgcgaatgacccgacgccggaggcgatccggaaggcggtgcggaccgtgctcgacgcgcccggccatcgccgggaggcgcggcgcctcgccgccgagttcgccgcctacgacgccaaggccgagatcctgcggctcctgtccagccacggcgaccgcgcgcgcagcgccgcctga

SEQ ID NO: 6552 - DNA, 1140 bp, Methylobacterium sp.
atgcaggatctcgaggcgtattcggttctggtggggtcgatctacgaccgcgtcggccagccggaggagtggtcggcgctcctggaggatctgaccgatttcgtcggcggccgggtcggccagctcgccgtgttcagcctcgacgggaaccgcaagccgctctgggcggtgtccggcttcgagcggtcgcggtaccgcgagttcctctaccggcacgccaccgaggatccgcgcctcccctacatcctgtcgaaccagggcaaggtcatccgcgccgaggagggggtcgacgcggtgcagttccgcgagtcggccctgttcaaggaggtcgtccagcccttcgagatcgagcacagcctcgtcacctacttcgccaaggaagccgacgtcatggcgacgctcgcggcgatgcggggcgaggagggcggccccttccggtccgacgaggtccggcgcctggcgatgctcgtcccgcacctgcgccgggccttcgagctgtacgcattgatgcggcaggcctccgagcgcacgtccgatctcgcctccgccctggacctgctcgacgccgccgtgatcctcacggattccgacctgcgcgtcgcgcacgccaaccgcgccgccgaggcgctggcgcggtcccggaccggcctgtccttcgtgaagggcagcctcgtcctcaaggacagccagaccgggcggcggatcgcccgcgcggccggcgaggcgctcgcggccgcgagcggcgacgtcgcgatcacgcaggccgaccacatcaccgtgacctgcggcgagagcggcatgccctaccgggtgtcgctgcacccgctgtcgaagcggccggccggcaccgggtcgaaggtgcgggccgagctggcgatcgtgatccggaccgggaccccgaaggtccaggggagcaacgccgcgcggctgcagaagctgttcgggctgaccgtcgccgagtcgatcctcgccaacgcggtcgcttcgggacggtccctcgacgaccacgcccaggaccgcggcatcgcgatctcgaccgcccgcacccagctgcgcgccctgttcgccaagaccgagacgcaccggcagggcgagctcgtggcgcgcctgcgcgaggggctggacgtctcgctcaactga

SEQ ID NO: 6553 - DNA, 1428 bp, Methylobacterium sp.
atgctgccggttctcgttgcgcggaagggcgctctcgtcgggatgctcctggcagtgctcgccgtcccggtcgcgggcgaggccggctggaaggggccggaggcgcaaccgctgttcgtcaacgagtccaatccagccggctacaactacgcgccgagcgtcatcaccgagaacgggaccaccgacatctggtggtgcggtcagggcaagacggacgtcatcttccatcgctcctacacgccgcagaccggcttctcgccggcgcggatcgtgttccagccgacgcccaactcctggaaccggcagtacgtctgtgatcccagcgtgatccggggccgcttcgtcaacccggcggacgggcagacctacgcctacgcgatgtactattcgggcgccgacaacctgcccggaaacaacaaccagaccggcctcgccttctcgaacgacaaggtgacgtgggtcgactacccggaaccggtcatcaagccgatcaacccggtcatcgcgcagggcaattacggcacgggccagccggcgaccttctcggacggccggtccggcctgttcgtcttcaccacggatctcaccgggccgcagggcgtgccgggcttcggggacctctacgtccggcacacggccgacggcgtgcatttcggggcgccggcgcgagtccccaacgccacgaccgacggctcgaccatcaacccgaactcggatttcgcctacgatcccaagaccggcgaggtctacgtcatcaccgggttgccgggccgcgtgtgccagcaggtggcctgcaaggatccggggcgcaatcccgaccgggaaacctaccagatggggctgttcaggatgcccctgaaggcggtgctgagcggggcgccggcggcgtggacacccctgggctacctgaactccgacgtcacgggcttctacctgaaccacagtcccggcttccagcgcgacggggcggggttcctgacgccgttcctgccggacatcacggtcttcttctcagggggtgacccctatcccggcacgtggcgggtcgccgaggcgcggcggccgaagggcgccgaccgccttcccctgcggcgcgccttcgggcccggcggccactgggtgacgaccggctatatcgggccgggctacacgatcgagcgcagcctcggtaccgtgttgacgctcccggcgcccgggaccgcgatgctgatgagctgcgcggcaggacaggaccacttcctcagccgcgacccgagatgcgagggccagacaccgctcgggcagaccggctacgtctacgaggcgcagaggccggggagccatccgatctaccgttgcatcgccggaggccgcgatcatttcgtgtcgaccgtcccggactgtgagggtcacatgtccgaagggatgctcggctacgcgctggactga

SEQ ID NO: 6554 - DNA, 297 bp, Methylobacterium sp.
atgaagttcggcgtcctgatcctggccggcgcctgcggcgtcctcgtcgggatcgtcatcggatacgtcgcgggaacgcgactcagccaagccttcgcgcaattgccggtgacggaccgctcccccgccgcgcaggcgctccggatcgtggaccgcatcgcgaccgagcacggcctcgcgcgggacgcgctgctccgggcgatgctcgaccagcagggcggccggacggggaccgcgcgtcccagcgaggagccgggcagggagccgggcagggccccgggcgaaccggcccggtag

SEQ ID NO: 6555 - DNA, 216 bp, Methylobacterium sp.
atgaccgcggcgctcgccgcgccggccacgcaggtctgcgccttcatgctcggctgcgcgctgatccacgtcgcccgcgcccacgccgatctgatcacgcggctcctcgccgtcacggcggtcggcgcggccgtgctggtgcttctcgtcgcgtccctcgactacgcgccggaaggcggaatcttcgacgaggtcaccgtctacgcggcctcctga

SEQ ID NO: 6556 - DNA, 471 bp, Methylobacterium sp.
ggcccgcccaccccggacgacctcgacgagctgctgaccctggtctggaagaagcccgccttcttcgtggcccatccccgcgccatcgcggccttcggccgggaggcgacccgccgcggcgtgccgccggtcgtcgtccacctgttcggcgcgccgttcatcacgtggcgcggcgtgccgctggtgccgagcgacaagctgccgatcgacctcgacccggtgaccggggccgagaccacctcgatcctgctgctgcgcgtcggcgagggcgagcagggcgtggtcggcctgcagaaatcgggcgtgaccggcgagatcgagcccggcctgtcggtgcgctacatgggcaccaacgaccactcgatcgcctcgcacctcgtgacccgctacttctcggccgccgtgctggtcgaggacgcgatcgcccgcctcgataacgtgctgctgggcaactaccatgactacgcctga

SEQ ID NO: 6557 - DNA, 510 bp, Methylobacterium sp.
atgcccgggtacgtcgaagccgatctcatccaagcccgcaagccgatcacggatcaggccggccgggggctggcctactgcgtcctgggccacttggaggtggagcagcgcgaggcccccacctccgaccgggctgaaaccatccgcgcgctgcaggtgaacatcgccacgttcgacggcgtcgagccggaggccgaggacgtcccgccggatcccgcgcccacgcagcagccggcggccagcatcagcagcctgacacccgtaccgtcgccggcgccccccgtgtccgccccagtcgccaccgatacccgtgcggtcggcgcggccagcatgcgcaggacgttggcccgtgcaggcatcacgcccgtgggcgggcagcaagggacggcgagctcctcgcaggcactcggttctgtctatgccggccagggctcccagaaacccgtcgatctggtcgccgacatgaggcgccgctacggcatcaccacgaacacgggcggcaggtcatga

SEQ ID NO: 6558 - DNA, 123 bp, Methylobacterium sp.
ttcgtgcagcgcacaccccgcggacgcgtcctcacccgacacgcctaccggcacatgcagatgccggaaccgaagcgcgagacgcccgggcagttcggcttcttcggtgacggagagccctga

SEQ ID NO: 6559 - DNA, 297 bp, Methylobacterium sp.
atggccgaggcaggggaaccgggatcgggacgcctctggatccgcgacccgcgcgccgtcctggccgaggccgccggcggcgggatcgtggtggcgggcacccggatcgtcgagtgcgtggcggcgggcgcgcgccccgccgcgcccgtggacgcgaccttcgacgcgtcgcgccacgtggtcatcccggggctgatcaacacgcaccaccacgccttccagacgctgacccgcgcccatccgctggcgctcaacaagccgctcttcccctggctggaggcgctctacacggtctga

SEQ ID NO: 6560 - DNA, 747 bp, Methylobacterium sp.
gtgggctacgagggctacgcaaagttccgcgcggccctcgtcctcggctatgagaaggcgctcgcaccggtcgagaagctgcgcggcagccgagatcagcccgcgaccgcgtccggcatcctcgacggagccttggccgacatcgtccgcaacatcgaggcgacgcggcgtgggctcgacggccagacctgtgcgcaggccgtcgaggcgatccgccgggcccgacgggtctacgtcgtgggcctgggcagcagcagctggccggccggcatcctggcgcgcaacctcgacgtcaaccgcgaggacgtccatctgctggcgacactggaggggcccggcttcgccgcccggagcctgcgccggctgacgaccgacgacctcgtcatcgcgctcgcaaccccgcggtacttcgccgacacggtgcggctggccgagatcgcacggaagcacggcgccgcggtcctggcgctgactgacggaccgcactcacccctcgtcgccaccgcaacggtcgcgctctacgcgcagaccgactgccactacttcgccgcctcggatgccagcctgacggccctcgtggaggccctggcgagcgccttcgcccacgccaccgaggatctcgtcccggccgcgacgcgcgtgacggaagcggtgctgccctggctcgaccgcgactacgccgcctggccgccgcagggcggagccgacgacctgcccgacaccccgcctccgggagccgttccatga

SEQ ID NO: 6561 - DNA, 1077 bp, Methylobacterium sp.
gtgacgccggccgcccccccgcgccccgcgccccgcgtcggccgcctgccgcggggtccgcgcgacgccatcaccgacgtcccgggcgtgacggtcggccattgcacgctggccgagggcgacgttcagactggcgttacagtcgtgcggccgcatggcggcgatacataccgggaccgcgttccggcggccggcgtcgtgctgaacggcttcggcaagtccgtcggcctgatgcaggtcgaggaactcggtgtgctggagacgccgatcgccctgaccaacaccttcgcggtgccggcggtggtcgccgcccagatccgcgccgcgatcgccgacaatccggaaatcgggcgcgcgctgccgacgctcaacccgctcgtcttcgagtgcaacgacggctacctcaacgaccttcagcggatggcggttgaggcgtcccattatcgcgacgccctggacgcggcgggcgccgccgtcgcggaagggtcggtcggggccgggcgcgggatgtcgagcttcgggctcaagggcggcatcggcaccgcctcccggcgggtccgcgcgcgcgcgcggggccggttcacgctgggctcgctcgtcctgtcgaatttcggcaagccgtcccagattcgggtccgcggcgtgccgctcgccgctcagctccgggcggccgccggggagccggaatccggcaccgaaccgccggagaagggctcgatcatcatgatcgtcgccaccgacgcgcccctcgacgcgcgtcagctccgccgcctcgccctgcgggccggggcaggcctcgcccggaccggctcggtgttcggccacggcagcggcgatatcgcgctcgccttctcgaccgcctacacggtgccgcaggatcccggccgcccgatgccggcgcccgccctgctgcacgacgcggagctcgacccgctgttcgaggccgccgcggacgggatcgagcaagcgatcgtccacgccctttggcgggccgaggcggtcacgggccgcgacggccaccggcgggacgccctgaccgatctcctgcccggctgggccgatatcctcggagtctga

SEQ ID NO: 6562 - DNA, 441 bp, Methylobacterium sp.
atgacccatcgtaccatcaccctcaccgccgccctgacgatgaccgtggcgtccctcctgccggccgccgcgtcggaggtgaccctcgacaccgccgcgcacggcgccttctccgtccccgccgtcatcggcgcggcccaccatacgccgggtctcgcgctgagcgccgccgacgtccgtgcgcagggtggtcacctcgtaccggccctcacgcgctggcaggaggctcggccggccatcgcctccgtcgagcccttcaaggcgcccgccaccatcaccgtggcctatcggagccgagacgtcgcgacgcatgccgcgcaggtcctcaagcaggggggcttcgcgaccgcgggcgtcgtccggtggctgcccgacgcgcctgttgcggtcgaggccaacacgaacacggtcaagctcgggtcgcttgaggccatgaactga

SEQ ID NO: 6563 - DNA, 318 bp, Methylobacterium sp.
atgaggcgcctactcctcgccggcctcttcgcagccgtcaccggagcgagcggtgcatatgcgcaggcgacgctgcgcgttatcgacaccgcgccgaacgacgtgctgaacgtccgcgagtttccaacctcggacgcgcggatcgtaggcatgattccacccgacgggcgcggcatcgtcccgactggcgagcgcaatggcaactgggtgttcgtccgttaccggaggggcgagggctgggtttcgcggcggttcgtgtatctcggggcgccgccggtccggcgaggcgggagcctggatccggacgtcagcgaatag

SEQ ID NO: 6564 - DNA, 126 bp, Methylobacterium sp.
atgtcccgttttgcctttcaaatccacccgatgatcctgtgcggagggacggggacgcggctgtggccggcgtcgcgggagagcatgcccaagcagttcgcccggctggtcgacgccgagcgctcg

SEQ ID NO: 6565 - DNA, 144 bp, Methylobacterium sp.
atgctgaacaccatcctggcgcttctcgctgtgctcgccgttatggccgcgcacgctctctacaagctggtgcggctgcccttccggctcttgcgtggcctattccagcacagctccaagcctgctcgggtgacggctcactga

SEQ ID NO: 6566 - DNA, 264 bp, Methylobacterium sp.
atgaaagcaatcgtctgtctgtccgccgtcgtcgtcgcatcgacgcccttcgtcggcacgcccgccagggccgacgatgccgaggcggcgcgcctgtgccgaggagacgcattcaagctctgcctgagcgagatcccggaccgtgaccggatcacggcctgcatggtccggaacagggcgcgcctgagtccgggctgccagacggtgttcaacaagccgtcccggccagccaccgtcgaggccgccagccacacgatccgctga

SEQ ID NO: 6567 - DNA, 1500 bp, Methylobacterium sp.
atgcgccttgccgtcctccagttcacgcacgagaccgtcacgttcctgccgaacgacacgacccgggacgacttcatctatcccggctcaccggccgccggggccgcgctgctcgccaccgatcccaagggctacatgggcggcttcgtgcaggtggcgcgggagtacgacggcgtcgagctcgtggggatcacctcgccgctctggccgcgcaccggcaccgcctcgggctggatcaccgccgacgcctacgcgcatttcctcgggcagatggtggcggagctgcgggcgcagggcccgttcgacggggtctatctcgccctgcacggcgcgatggcggtgcgcggcgtccccaggccggaggccgacatcgcccgccaggtgcgcgccgcggtgggcgaggggtcgatcctggtcgggaccttcgacctgcacggcaacgaggacgccgccttcctcgaccacgccgacatggctttcgcggtgaagtacttcccgcattacgacggccacctgcaggggcagcgggccgcccggatgctggtgcgcgccgtgcgcggcgacttccggccggcgcaccggaccctcaaggtgccgatcctctcgccgaccgtcgtgcagtggaccggcgccgcaccgtggtccgacctcgtgcagcgggccctcgtctgggaggcgcgcgagccggacgtgtacgtgaacgtcttcttcggcttcccgtggggcgacgccccggacggcgggatgaccgtgcaggcgatcaccgacgacgacccggccctcgccgagcgggtggcgcgggatgtcgcggatttcgcgtggcggcagcggcgcgcgctgctcgaggcgacgcggatccacacgatcgccgacggcgtgcgcctcgcccgggcggcggtggcggagggcgccgccccggtggtcctcgctgaccacagcgaccggtcgggccgggcgacctggctgctgcgcgagatcctccggcagtgcctcgcccgcaccctggtcgccacggtggcgtcccccgacatcgcggcggggtccctcgcggccggcgacccgttcgacgcgccggtcggcggtggcggcgacccgtccgcgggcgacccggtgcgcatcaccgggaccgtgctgcgcgtcgtcgccgcgccggagcccggcgtcgccggcagcggcggcggaggcacctggatctgcgtcgcgttcggggccggcaacgtcctcgtgctgagcccgcagctcgcgcagatcgtcgagcccgacgagctgtggcggctcggcctggacccggcggatttcgacgtcgtggcgatcaagtcgcgggtgcatttccggcgcggcttcgacgacagcggctacgcccgcacgatcctgctggtggagccgccggagccgttcctcggcacggtgcgcctcgatcacctcgcctacgcgcagatgcgggccgccgacttcttcccctacggcgacccgcccgggcccgtcccgtccgacccgtga

SEQ ID NO: 6568 - DNA, 156 bp, Methylobacterium sp.
atggaatgggtttatcgcggcttcgagacctcgatgctcggtctcgctctctgtctcggactcggcgcctgcctcacgctcggcaccgcgcgcgtgccggccggaacgctctccgtcaccctgccgatgctcacggtgaccgcccccgcgccctga

SEQ ID NO: 6569 - DNA, 318 bp, Methylobacterium sp.
atgccgtttgacagccagagcgccgaggctgcgacgacggcctttgccgcgtccgtcgcggggcgctgcatgacggacgccgagcggatccaagaggacgccatcgagcgggatcgacgggccacccgcgcggcggtctgggccacagtgccgaccactgccgagggccgtgccgcgcttgtccggtatgcggccttccaggcggaactggccttcggcgccgactggcgagccaaggcccggcaggagttctgcggcgacttcctcgtggctgcgctagctgcagttgaggctgagacggagcgcggagaggcctga

SEQ ID NO: 6570 - DNA, 189 bp, Methylobacterium sp.
atgatcaagacgctgagcccgcagacaggtagcgttcagggcctcgtgcgccgggtcgaggaggtcggcatcatcgtggcccaggagcatctgaaagccggcatgctgcccgctgaagtccgggcttggcacatcggtttccaagcggggatgagcctcgagctcggagatttcatgcgccgcttttga

SEQ ID NO: 6571 - DNA, 540 bp, Methylobacterium sp.
acctggaccggcgcctacttcggtatcaacgccggctacgccttcgacgccagcgaccgcaacaccggcaacaccttcgccgtccccttcccctacgccgcccccggcaccgtcgcctccttccgcaaccgcagccaggacggcttctccggcggtggccagatcggctacaactaccagtttaccccgggctccggtgtcgtgatcggcttcgaggccgacgcccagtacctcgacttcggccgcagccggaacaacgccttcatctccggcgcgctggcccccggctactacgtcaccgacccgcgcggcctctccagcctcgacttcttcggcaccgtccgcggtcgcctcggctacgccttcgaccgcaccctcgtgtacggcaccggcggcttcgcctacggctcgggcagcgccgaccgctccttcggtggcttcgccggcaacgacagcttccgcaccggctgggccgccggcggcggcatcgagtacgccctgcccaccgactcgttcctgaacttcttccgctcctcggcc

SEQ ID NO: 6572 - DNA, 543 bp, Methylobacterium sp.
atgggtgacgaaattcgcttccagatccgctcgaagccggctcgcatggaggagcagacgcgcgtcgcgctggcgctcctgcgcagcaggggtgggtggccccaggattgggctgcacttcaatccggcgctgcgtcgtgccctggcgcgtggcgattgggcgccggtgtggccaaggacgcgacggcgctcgagccgaagctggtcaaaggcctggacggcaaggaaggcctcgatctcggcgacggcacgatgaagatgccggacgggtcgatccggtcaatcgtcccggcggcgccagctggtgggatcggtggcggtggcggccgcggaatgtccgaactccgtgagcacgtggccgagttgggccggcacatcgagcgctttggccagtccggcttccacgctcagatcgaggtgacggggctgcggcaggcgggcctgcgagccacttccatgaggatcaaggcccgtggcggcctgagtgccgacttgggggtgactgagcccggcgccaaggaagacatgagcgactggacctga

SEQ ID NO: 6573 - DNA, 1728 bp, Methylobacterium sp.
atgtccgagatgtccgagcgcgccaacatgaccggcgcccacgccctcgcggccgcgctccaccggcacggcgtccgcgacgtgttcggccagagcatcccctcggcgctgttcctggccgcgccgcaccacggcatccgccagatcggctaccgcaccgagaacgcgggcgccgccatggccgacgcctacgcgcggatctccggccgggtcgcggtggtcgcggcccagaacggtcccgccgcgaccctgttggtgccgggcctcgcggaagccctgaaggcctcgatcccggtcgtggcgatcgtccaggacgtccaccgccgcttcaccgaccggaacgccttccaggaactggaccacctcgccctgttcgcgggtgtcgccaagtgggtccgccgggtcgcggtcgccgagcgcatcgacgactacgtcgacatggccttcgcggccgcggcctcggggcggcccgggccggcggtgctgctggtgcccctggacctcctcgacgagcggccggacttcgaggccgccgcgccgcgccggtcggcgagcctgggcacctaccccctcgaccgcacggtcgccgacccggcccggatcgccgaggccgcggacctgatcgccgccgcgcggcgtcccctcgtgatcgcgggcggcggcgtccattcctccggggcctacccggaactcgccgccctgcagggcctcggactgccggtcgccacaacggtgatgggcaagggcgccgtcgccgagaccgacccgctctccgtcggcgtcgtcgggtacttcatggcgccgcgggcgcgctcgtcccacctgcgcagcctcgtcacggaggccgacgtcgtcctcctcgtcggcaaccgcaccaaccagaacggcaccgacagctggtcgctctacccggcggacgcccgcttcatccatctcgacgtcgacggcggcgaggtcggccgcaactacgaggccctgcgcctcgtcggcgacgccaagctgaccctcgccgccctcgccgaggcgctccggcagcgcgacctggcgggattggagggccgccgcgcgccgctcgccgacacgatcgcccgcgctcgcgaggcccaggccggcgacatggcccgcctcgtcgacatggaggccgcgccgatccgcccggagcggatcatggcggagatcgacgcggtgacgaccgccgagaccgtcgtcgtcgccgacgcgagctacgcctcgatctggatcgccaacttcctgacggcgcggaaggccggccagcgcttcctgacgccgcgcggcatcgcgggcctcggctggggcctgcccttcgccctcggcgccaaggccgcccgcccggacgcgcccgtgatctgcgtgaccggcgacggcggcttcggccacgtctggtcggagctggagacggcgcggcgcatgcggctgccggttatcgtcgtcgtcctgaacaaccagatcctcggctaccagaagcacgcggagctgagcctgttcggcgacttcaccgacgtctgcgacttcgaggcggtcgaccacgccgccatcgcgcgggcctgcggctgtgccgggacgcgggtcgagcgccccgaggatctcgcaccggcgctgcgcgacgcgctcgccggcggcgccgtcacggtgatcgacgtgatcaccgaccagcgcgcctacccgccgatcaccagcttcgagggcaaggacgccctcgcctactga

SEQ ID NO: 6574 - DNA, 669 bp, Methylobacterium sp.
gtgccggactgggtccgtccgatcgtcaaggagagcctgagcgagcgggcctaccgcgagctgcgcgtcgcgctgatgcgcgggcagttgcgacccgacacgcgcctgcggctccggccgatgtcggcccggttcggcatcagcgcgacccccatgcgcgaggcccttctcaggctcgtcgccgagaaggccctcgccctcgacgcgcgcggcagcgtcgtcgtgccccgcctgaccctggatcagctcttggagatccgggcgatccgcaccgatctcgaggggcgtgccgccgccgctggggcagctagccgcgcggccgaggtcgacgacctcgaggcgatccacgcgcagatctcgcactgtcacgcgagccgcgacttcgcgcgggcggtgaacctcaacaccgagtttcatctgacgctgtgcaggctcgggcagatgccgatcctgtacgagatcgtggagttgctgtgggtgcgctgcggcccgatcctgtcgcacctctacgatgacggcgtccccgactgggagccgcacccccatcgccgcatcatcgacgccctgcgccgcggtgacccggaggcggcccgggatgccgtgcgcgaggacatcgagcgcggtgggagcggcctgttcgcgcatgtccgcgcgaccgccacagggtga

SEQ ID NO: 6575 - DNA, 648 bp, Methylobacterium sp.
gtgctcgtgatgggcggcctgccgatcggcctgagccgcttccgccgcgatgagcgcgggatcgccgccgtcgagttcgcgctcgtcctgcccctgctgatcgtcctgtatttcgggaccgccgagctgacgcgcgtcgtcgacgcgacccggaagctgaccctgttcgcgcgcacgctgggcgatctgtccggacgggtggacaacgctctggcgacccagaacgggatggctctggcgacgcaggacgggatgacgaagatcaccagcgcagcgaccgcgatcctgcgcccgctggacgcgtccggcctgcagatcgtggtcaacgcgatgggcgtggaaacggtcaacgggtcgctcaagggcttcgtctgctccagctggccgcagaacgccacgaagcgcccggccaaccaggccaacgggagcaacggactccccgccacgccggccgcctatcagttcgacggggcccgctacatcctggcggaagtcacgatgccctacaccccgatcatcgggagtgccctgtaccgctggatcttcggcggccgcggattgaccttcacgcggcagatcccgtggtccgagcgcacccccagcgagatcgtcatgccgggcggcaccgcctgcccggtctacaactaa

SEQ ID NO: 6576 - DNA, 2976 bp, Methylobacterium sp.
gtgcctgggcgcctgaggccgccgccggtccccgatgcccgggagccgctcgcggccctgcgcccgcgcggctggatgcatgccggcacgatccccctcgacgggatcctgatggcgcgcggctccgcggggccggactggcgcgcccggctccttccctggctcgagcacgccgcggaggtgcgatcacgcggcgatcgcgtgctcgtgctgttcgccgcgcccgtcacgcgggactgcgcggccctcggaccggtcctgccggtcgtgcgcagtgccgggatcctgaccgccgtacccctcgccgagccggagccgcccgtcgccgcggccctgcgggaccatgtcgtccacatgacggggggacgcctcgccgccgagccgctggcggccttcgctagtctcgacatcgccggttggtgggatctcgacgcgatcgcggtacatccggccgaacgcctgccggtcctgcgaccggcggcgccggcgcgccgcctcgtcagcgcccccgccctcgtcgccgacgcggaccccctcgcgccggtccgcgacgccgtgacccggcggccgcggcgccggacgaagcacgtcctcggcgatctcgtcacccgcttccggcgcctgatcggcggcgcgttggggctcctctggaccgcctacgtcgtcctgctggcctccatcatggtcggcgccatggtgcttggcttcgccgagaacgtccggacgacggcggagcacggggccgccgcggcccactggggcagcctcgcgctgccggtgctggtccttctcgtcatcgcgtggttcgcgttccggcgccgcggagcgcgggccgggcgtgagggcgccgcgccctcggccagccagcccgccggaaccggcagcggacgcacgcccatctggtgccgggcggcggcgtggctcgcgtggcgctcgccctacgcggtccatcttcgccgcctctatgcccggcggctcaccgaggtcgagcggctgttcgcggcggggcgcgtcgacgaggccctgtaccgggcgatcggtctcggcggcgcggcgcggcgcgggagcgccttcgccgacctgccgctgaccgggcccgggctgcgcaggagcctcgacctcgatctcgggccgcagcgggcgagcggactgagcctcgcgcccgcggacgagatccggctcgcggcgctctaccgcgcgcaggccgtggcgatggccggacgcggcgacacggatcgcgcggccttcgtgctcgacagcctggtcgggaacccgcacgaggcggtgcgcctcctcgcggaatccgggcgcctggagaccgccgcccgtctggccgaggcgcgccgcctcccgcccgcgacgaccgtcccgctctggttccgggcggggcagaccgagcgggccctggcactcgccgcccgccacgaggcccacgcggagctctggaaggaactcggggccgacgatccgttccgaccggtcctggccgaggcctgggccgcgcgcctcgtcgggatcggcgccctggatcgcgccgccgcggtcaccttcggcctgccggctctggccgagcggcgactggactggatccggcaagccctcgacgccgagacgccggtgccggccgcgccgctcgcccgggccctgcgcgccctgccctgggagggacgggacggcgaccggctgcacgccgccttcgcggacctggtgagcgcgaccggggccgaggcggcggcgcgccggagcgcggtggccgcgctcctgctcgacgcgcagttcgagggcggtccggagcggccgccgacgcccgccttcgcgctcctctgccgcggcctcgcgcgccgcctcgccgcggatgacggcatcctcggccacgatgcggagcgcgcccggctcgccgggcgcttcgcggaagccggtggacaggtcgccctgcgccagcatctccggcagctcaggacgcgcaccgcaccgtccgcctcccgcctggcgggcccgctcgtcgtccctgacggcccggcgctctccgagatcgccgatgccgcgctcctgtcgggcgggcggctgctcctgggctaccgctccgggctcgtgcgcctcctcggccgcgccggccgcgagcgctggcggggacaggtggatggcctgacgggcttcgcgcgtctcggcgcgggcgaccgggccctcgttctgcgcgagacgctcgacggccccgacgtccagctcttcgacgccggcaccggacggctcctgccgctcggtccgctgccgatcacgcactggcatggtcaggcggacgagaccggctggctcgtcttcgacggggaggcgctcgtccggctggacaccgcctcgctcctcggtcgcgcgggcggcgcgcccggctccgacggcgccctggcgcaccattggcgcctgcccatgaccgaaccgggccggccgctgctgctcgccgccttcgcggacgcgagcgccctgatctacgcccggcacgacggcctgatcgagtggtggagcctgtcctcccgcacccttgcggtgacgtgccggttctggacgccgcccgatcgcggcgtcggcgtgctcggcctgaccgaggccgtcgcttggtccctcgaggggaccggcgcgcatccgcacctgcgggcgcatccccacgctttcacgacggcctcccgggagcaggagcgcgcgttgatcgaggccgccgcgcgcgcggagcccgcggacccgccgcgcctagtcgcggcggagaacggccgcctctgggccgcgaccgccaccgaggaggggacgctctgggccagcgtgcccggcgcgaaccggatccgcggaccggccgtcctgtggcagggcagcgggagcctgcgcgcgcgcttcgctcccgagggcgacgccgcggccgtcttcgacgggcggggtcgcctgatcgtgttcgagaccgtcaccggacaggtgatcctgcgcctgatctga

SEQ ID NO: 6577 - DNA, 1104 bp, Methylobacterium sp.
gtgagcgccgcatcgaccggtccgcggacgacccttccgccggcgctggcatcctggacgacgctcttctccgacatggcggaaccggatctgcggatcctcgcggcgctggtcgaggcgctgcggcccctcgtcgagcgggccgacggcgcgggcgggcaaccgcagggcgagatcgacgggctggggggcctcggaacacgcggcgggatcgagcgcctcgtcgcctcggagtggctctggcgcgacctcgattcggacgccttcctgcagcgcgcggccgagcgcgacctgctgaccctggagccggtctaccgtcaggcggcggatgcgggcgccgtgctggtcgtggtcgatgccgggccggaacttctcggcgccccccgcctcgtggccttcgcggcgctgctctgcctggccggtctcgcccggcggcgcggcgcgcgcctgctctgggcctcgaccgccacgccggagcggcgctggctcggcgcgttgaagcggtccgacgccgcggtccttctccgcgagagcgccgccacatccctcgacgcggtcgaactcgaacgggtcgtggccgagccggtcgcgacccgcgcggccgggcggcccggcgccagcctctggctcatcggcgggtccgacctgcccgaagcggcgcgaccgtgccggcggatcaccatcgaggagcggccgcgtctcgggccggacggcctcgccgtggccgccgacgtcaccgtgctggacgccaccggccctgtcgccgccgcgcgcctcgacctcccgccggagcgcgaggcggtggcgctgttgcgcgacccgttccggccccgtccggctcccggacgcccgccgccccggcggtccgcgcccgaccggagcgcggcgcctccggactgggcgccccgcgggctggccttcgcgccctgcggcgagcacctcctggtggcgcggcccgacggcattctcatcgtccccgtcaccggcacctccggcgcgctgcgcctgccggtcgcaccccacgagcgcctcgtgggctcgccgtcggccggtcgcggatccgggccgcgtgcctcaacgtctacgccgacgacgcgcgcctga

SEQ ID NO: 6578 - DNA, 1074 bp, Methylobacterium sp.
gtgcacctcgcgctggtggcgcgcgagcatctccttctgatcggaccgcccggcaccggcaagtcggccgcggtgcgggcctgcgccgccgggaccggggcgcgctgcttcgagtacctgatcgggcgcttcacggaaccggccgaactgttcggcccgctggacctcgaagccctgcgcgcgggcaagctgcggccggacatctccggcatgctgccggaggccgagttcgccttcctcgatgaggtcttcctcggctcgaccgcgatcctgaacgcgcttctcggcgtgctgaacgagcgccgctaccgccgggggcatttcgacaccgccgtcccgctgcgctgctgcgtcggcgccagcaacgccctgccggaggatcccggtctcgcggccttcgccgaccgcttcctcgtcacggccttcgtcgatcccctggccgacaccgacctggaggccctgctcgccggcgatccggtcgcgtccgtcgaacccggcgacggggaggcgccgctgacgctcgcggagatcgacgccctcgccgaggccgccgcgcggatcgacctctcgccggtccggcccgcctacgcgcaggtggtgcgcaagctgcgcgcccgcggcgtgcggctgagcgaccggcgcgtagtgcggggccagtcgctcgtcgcggcggcggcgctcatcgcgggccggacggctgcggaggaggccgacttgtggccaatgatccacctcgtccaggaccggatcgcgcaggacgaggcccgcgacctgctgcgcgtcgagctcggcgccgcggcgagccccgtcctgcccgccgccgccaaggcggcgggctacggtccggccgcacgggccgcggacctcgccaaggagggggaggctctggccgcctccgccccggacgaccgcaccgcccccgccttcgaggcctggctggtccgcgccgaatccttcctcgtgcagatcgacgccgccttcggggcggaggagcgcccgcgggccctcgccgcggcgcgggacgcgctgctgacgcgctgccgggcaccggtcgcgggcgtgaccccggcgtga

SEQ ID NO: 6579 - DNA, 2334 bp, Methylobacterium sp.
ttggggaggtccgggatcgcgcgccgcgtcctcgtggtcggcgcgatcccgattctcgtcgcggccgccatcgcgctgggcgcctggatcctgctctacgaggccgagcgggcccggaccggcgccgtggtggcgacggagaccgcacagacgctgacgtcgatgaaccgggcgcgggcggatgccgtcagcggcggcaccgcgcggcgggacgaggccgagcgtcgcttcgacgagcgggccgccacggcggccgggcagctcgaacgcctggagggtctcgcgcgcacgcgcggccagtcggctctcgtggcgaccgtcacgggcgatctgaactcgcaggtgacgcgcatgcgctcgctcctgctctccgagcggaccgcgaacgcgacgatcgccgatatggcccggcgggcggacgccctggtggccctgaccgacgttgcgcgccggcgccagcagcaggacaacgctcagctgatcgccgtcctggccgtcaaggatgccgagctggagcggaaccagggcgtcgtcacggctctccgggagctccgggaggcgatcagcaccgcggagctgaaccgggcgcgcatcggtcgcccggtcttcccgatcgagttcgatgagctcgccgccgaccttcggcagctcgatgcggtgggcgaccggctacgccgcgtcctgcgggtcgacggcgaggcgggggcggcggaccgggcgacaaagctcctgaaggcgtaccgcgaccggagccggaccgaggacggcctcaacagggtgctctccgagggcttcgagctgacccgcgcgacccaggccggccgcgtcctggtcgagtggtgcgaccagctcgtccaagtgaacgtcacccggcagaaccggctgtacgaggaggtcgcgctcctgatccgtcactcggtcctctcgaacgaggccgagctctccgcccaggacatcgccctcacggccctgcgcctggcccggcggacggatgcggccctggcgcgccgggatactgcggaagcgtcgcgggtgctggaggcgggcgcggagctgtcgggcacgtcccggacgctgctcatcccggtgagcatccgggacgagatggcggaggcgatcgacgggtggcgcacgcagctcgccgcgacgatcgggaagatcggcgagcagaacgagaccatcgccgacatggacagccgcgccgccacgatgagcgccaacgcgcagaccttgagccgggccttcatcgacgatgccgaccagttcggcagcgtgatccggcagttgctggtcgtgggggcggtcggcgccctgtgcctggggatcggcgccgccgccgcggtggcgcgctcgatcacccggccgctgcacgcgctccagcacagcatcgtcaccgccgccgccgcgcccgcccccgaggatatcggccgcgacagtcacctgctcacccgacgcgacgaactcggcgacatcgccagggcgaccaacgcgttcctggagcagatccgccgccgcgaagcggaccggcgcaacgcctcccagcgcgccgacgacgcgctcacgaccctgcggcaggcccaggaggacctgatccgcgccgaacggctcgcctcgctcgggcagctcgtggcgggcgtctcgcacgagatcagcaccccgctcggcatcgccctgaccacggcgacgcaggtccagtccgactcggcggcgttcgcgcgcatggtcggggacaaccagctctcccggtcgcggctgacccagtatgccgggcggatgcgggagggcgcgcagctcctgaccagcaacctgatgcgcgcggccgatctcctctacagcttcaagcaggtggcggccgatcaggccatcgaggaccgccgcccgctgaacctcgcggactggatcgacgagctcctgaagagcctgcgcgccctggcgcggccgggccgccacgtcttcgaggtcgactgcccgcccgatctcgtcgtcgacaccctgccggggatcctggcgcaggtcgtctcgaacgccgtcaagaacgcgatcgagcacggcttccaggatcgggagggcggccgcatcaccatcacggggatccggtccggggacggcatcggcctctccatcgccgatgacgggcgcggcatcgacggggccgacctcggccgcgtgttcgacccgttcttcacgacggcccgcgcccgcggcggcacgggcctgggcctgcacatcgtccacaacctcgtggtgaaccgcctccaggggcgggtcgaactgcagagcagcgcgggtgccggcacggtgctgcggctgtggctaccggagcggctggcatga

SEQ ID NO: 6580 - DNA, 888 bp, Methylobacterium sp.
atgcccgcgtctccaagcctcgcccgggaccgatcccgcatcgcggccctcgctctggcgacgctgatcggcgtcggcgatccccgcccgggctggtccctcgacatgccggacagcccgcgtcccgcccggccgtcccggccggtgccgccggagctggccgcggccctcgcggcctacaggacctacgtcgtggcccaggccgacgccttcgtgcgcgagaccgcgcgcttcgtcgcggcgatccaggccgggcagctcgcggaggcgcgccggctctacgccccggcgcgcgcgccctacgagcgtatcgagccggtggcggccctgtttcccgagctgatcaagcgtctcgacgtgcgcagcgacgagttcgagctgcgcgagcgcgatcccgccttcgtcggcttccatcggctggagatggcgctgttcaccctcggcaccacggaggggctcggcgaggtcgcggagcggctcaccgccgagaccgtgaccctgcgcgaccgactcgcggcgctcgccatcccgcccgcccgggcggtcggggctgcctcggccctgatcgaggggatcgccgccaccaagatcagcggcgaggaggagcgctacagccgcaccgacctgtgggacttccaggccaatatcgagggctcgaaggtggtgttcacgctcctgcggccgctgctgacggaccgggacttcgtggcccgggtcgagcgcagctacaagcgggtcgaggacctgctcgcgcgctaccgcagtccggacggcggcttccagagctacgacaaccttaccgcccgggaccgcaacgccctgaaggggcccatcacccttctggctgaagatctgtcgacgctgcgtggccggctcggtctagactga

SEQ ID NO: 6581 - DNA, 1242 bp, Methylobacterium sp.
atgcgcttcctttcaccggttcccacccgccgccggtttctcggcggcctcggcgccgccgcgctcctcgggcccgcccgggccgaggacgcgacgccgaccatcgccacggaagggacgctcgtcgcccagcccttctacggcccccaccaggccgggatcgtcaccccgcagccggccgccgccctgtacgtcgccttcgacgtgctggccgagcggcgcggcgagctgccccgcctgttccggacgctcaccgagcgcctcgctttcctgacgcgcggcggtgccgtgcccgatcttcacccgcagctcccgccgcgcaattccggcatcctcgggccgaccatcctcccggacaatctcaccgccaccgtctcggtcggcgcgagcctgttcgactaccggttcggcctgggtcgcgcccgcccgcgccatctcgggccgatggagcgcttccccaacgacgccctcgacccggcgcagtgccacggcgacctgctgatccagttctgctcgaacaccgccgagaccaacatccacgccctgcgcgacgtcatcaaggcgacgcccggcctcctcacgccgcgctggaagatggagggcttcctcccgccccacgtggtgaagaccatgggggccgacaccgtgcgcaacatgctcggcttcaaggacggcaccgccaacctcgacgtgcgggacctccggatgatggaccgttacgtctgggtcggagcggggcaggacgagccggcctggacgacgggcggaagctaccaggtcgtgcggatcatccgcaccctcgtcgagcgctgggaccgcacgccgctcggcgagcaggaggccatcatcgggcggcacaagggcagcggcgcgccgctccggcagggacacgagcgcgacgtccccgactacgccgccgacccggacggcgaggcgatctcgctggcggcccatatccgtctcgccaatccgcgcctgccgggcaccgagggcagtttgatcctgcgccgcagctacaactattcccgcgggctgaccgccgccggccagctcgacatgggcctgctgttcgtctgctaccaggccgacctcgccgccggattcgtcaccgtgcagaaccgtctgtccggcgaggggctcgaagagtacatccgcccgatcggcggcggctatttcttcgctctgcccggcgtgccggggcccggctccttcctcggggaaggaatgctggccacgacctag

SEQ ID NO: 6582 - DNA, 1341 bp, Methylobacterium sp.
atgatcggctttctcgctcccgcggcccacaggccacccattcagacggatcgcgtcgatccgacctaccgcaagctgcgctggcagatcttcgcgggcatctttctcggctatgcgggctattaccttctgcgcaagaacttctcgctggcgatgccctacctcgtcgagcagggctacagccgcggtgagctcggcaccgcgctctccgccgtcgccatcgcgtacggcctgtccaagttcctgatgggcatggtctcggaccgctccaacccgcgctacttcctgccgattggcctcgtgctctcggcgctggtgatgttcctgttcggcttcgtgccctgggcgacctccagcgtcggcatcatgttcgtgctgctgttcctcaacggctggttccagggcatgggttggccgccgagcggccgcacgatggtgcactggtggtcccagaaggagcgcggcggcgtcgtctcggtctggaacgtggcgcacaatgtcggcggtggcctgatcggcccgctcttcctgctcggcttggcctggttcaacgactggcacgcggcgttctacgtgcccgccgccgtggcgctcggcgtcgcggtcttcgccttcatcaccatgcgcgacacgccgcaatcctgcgggctgccctccgtggaagcctggaaggacgattatccggacggctacgacgcgaaccacgagcgcgagttctccacgcgcgagatcttcgtcgagcacgtgctgaagaaccggatgctctggtacatcgccttcgccaacgtcttcgtctacctgctccgctacggcgtgctggactgggcgccgacctacctgaaggaggccaagcacttctcggtcgacaagacctcctgggcctacttcctctacgagtgggccggcattcccggtacccttctctgcggctggctgtccgacaagctgttccgtggcaaccggggcgcgacgggcgtggtgttcatgttcggcgtcatggcggcgacgctggtctactggctcaatcccgagggtaatccgggcgtcgacctcgcggccctgatctgcatcggcttcctgatctacgggccggtgatgctgatcggcctccaggccctcgagctcgtgccgaagaaggcggccgggacggcggcgggcttcacgggcctgttcgggtatctcggcggctccgtcgcggcgagcgcgctggtcggctacacgaccgaccattacggctggaacggctgcttcattctcctgctggcggcctgcgtcctcgccatcgtctgcctgtcgctgaccctgcggcacagcagcaccgcggtcgcgcagcctgcctga

SEQ ID NO: 6583 - DNA, 1134 bp, Methylobacterium sp.
atggaccacgcggcggaggccggcgacccggtcgacgggatcgtcctcgatcaggtcgagcggctgctcgcccagcacctcacgccggcgctgctggcggcctgcgacggggccgcgggcgcgaccgcaagggcggcggatctctggccggcggatctctggacggcgctcgccgagagcggcctgccgctggcgctggtgcccgaggcggagggcgggatcggtctcgccgccacgaccgcggcccggctgatccggcgttgcggccgggccgccctccccctgcccctgccggagaccgtcgcgggcgcggcgctctgggctgccacggggggacaggtggccgaagacgccctgtcgctggtcccgggcggtggccccgtgcggatcgcgccgcacgcggaggggttcgtcctggacggccgggtcgcgcaggtgccctggggcggttcggtcgcggccctgctccttgacgccgtcgacgcggccggcatcccgcacctcgtgcggatcgccgcgcccgggacgctccgcgacacgcaccacaacctcgccggcgagccgcgtgacaccctcgatctgaccggctgcatcgtcccggccgccgacgtccgggccgcgccgggctgggctgccggagcgggggcgccgtccgtcgaatccgtcggcgcctgggtccgggcgcagcagatggtgggcgccctggagacctgcctcggctcggccctcgctcacgcccaggagcggcagcaattcggccggccgctcgccaagttccaggcgatccagcacatgctggccgaggccgcgggccatgtcgccgccgcaaccgcagccgccgaccttgccgccgcctgctggggcgacccgcgcttcgtcctcgccaccgccatcgccaaggcgcgctgcggcgaggcggcgggccacgtcgcggcgatcggccaccagattcacggggccatgggcttcacccaggagcacccgctccaccgcgcgacgcggcggctgtggtcctggcgcgacgagttcggatccgacgccctctggcaggagcggatcgggcgcgcggtctgcgcgggcggcggcgcggccctctggccgatgctggtccggctccggggcggcgccggctga

SEQ ID NO: 6584 - DNA, 1152 bp, Methylobacterium sp.
atgcacagtttccgcttcagcgccgagccgctcccgcccgaggccgaggccgcccgcgcgtccgtccgcgccttcctcgacgcggaacgggcggccgggcatttcgtcccgcaccggacctcgtggacgaccttcgacgccgccttcagccggcgcgcgggggccgcgggcctcatcggcctgaccctgccggaggcctatggcggccacggccgctccggcctcgtccgcttcgtcgtcaccgaggagatgctggcggccggcgcgccctgcggcgcgcactggatcgccgaccgccagtcggggccgcagatccaccggcacggcaccgaggcggccaagcgggcgatcctgccgcgaatctgccggggcgaatgcgccttcggcatcggcatgagcgagccgaattccggctcggacctcgccgccgtccggacccgcgcggtgcgcgacggcgacggctgggtgatcaacggctccaagatctggacgacgaacgcccatcaggtcgattacctgctggccctcgtccggaccggcgagcccgggccggaccggcacggcgggctgacccagttcatcgtcgacatggcggcccccggggtgacggtccggccgatcctcgacctgtcgggccatcacgagttcaacgaggtgttcttcaccgattaccgcgtcgccgacgcgatgcgggtcggcgccgagggcgcgggctggggcctcgtcacggaggaactcgccttcgagcgctccgggcccgaccggttcctgtcggattaccggctgctcgtcgaactcgtcgaccggatcgggccggagccggaccggttccaggcggtcgagaccggacggatggtggcccagctcaccgcgctgctgggcatgtcggcctcggtggcccgcctcctcgatcagggcgtcgtgccgggcgtcgaggcggcgctggtcaaggatgtcggcaacggcttcgagcgcgccgtgccggagatcgcccggcggctcgtgccggtcgagccgagtctcaccgcgcagggcgacgccttccgcgaggctttgggcggcgtgaccctgcgggcgccctccttcaccctgcgcggcgggacccgcgaggtcctgcgcggcgtcatcgcccgggggctggggctgcgatga

SEQ ID NO: 6585 - DNA, 762 bp, Methylobacterium sp.
gtggccctggtgaagtccgccggacgggtgctccagatcctggagctgttcgacgagatccagcgggaagccagggtctccgagatcgccgagcggctgagcgtcccgcaatcctcgacttcggtgctcctgaagagcctcgtccggctcggctatctcgactacgacccggcgagccgcagcttcctgccgtcgccccgggtggcgctcctcggcgcgtggctcgacaagggaccggtgcgcgacggcagcctcgtgcgcatgctcgagcacctgtcggagcgcacgggcgggacggtgatcctcgccgcgcgcaacgcgatcttctcgcagtacgtccacgtcctgcaggcgcgcaccgccatgcgcttccacgttccgcccgggacgcgccgcctcgtcgtctggtcggcgactggcaccgcgctcctcgccgacagcccggaggccgagatcggtccgctggtccgccgcacgaacgcggaggcgccggccgagcagccgccgatcgcggtcgcggccgtcctgaccaacctggcgcggctgcggcgggacgggcacttcctctcccgcgggctcgtcacgccgggcgccggctcgatcgcggtcccgctgccccggcgcatcgacagcaagggccgcccgctggcggtcgccgtgtccggcctgctcgacgagttcgagcgtcgggaagcggagatcgccgcgacgatccacgacgcggtggcgcggttcctgccggaggatccgtcgcggccctga

SEQ ID NO: 6586 - DNA, 1437 bp, Methylobacterium sp.
atggcgcttacggacctgagccgcttctacatcgacggcgcctgggtcgagccggtttcggctcagccgttcccgctgatcgatcccgccacagagacggcgttcggcaccctcgcgctcggcgatgccgcggatgtcgaccgggccgtgcgcgcggcccgcgccgccttcccggccttctcggagacggcgcccgccgaacgcgtcgcgctcctccgccggatcctcgcgctcttcgaggagcggttcgagatcttcgcggagacgatccggcaggagatgggctcgcccatcggcttcgcgcgcaaggggcaggcggcgcggggcccggcgcacctcaacgcgctcatcgcggtgatggagcgcttcgcgttcgaggaggatcgcggcaccacccggatccggcgcgagccgatcggcgtctgcggcctgatcaccccctggaactggccgatcaaccagatcgtcgtgaagatcgccccggcgctcgcggccggctgcacgatggtgctcaagcccagcgagtactcggcggtcagcgcgatgctgttcgcgcaggtcctgcacgacgcgggcgtgccgccgggcgtgttcaacctcgtgaacggggacggccccggcgtcggcgccgcgatcgccgcgcatccggggatcgacatggtctcgttcaccgggtcgacccgcgccgggatcgagatcgcccgagcggcggccccgaccatcaagcgcgtcgcgcaggaactcggcggcaagtccgccaacatcctgctggaggacgtcgacttcgatcaggcggtccggcgcggcgtcgcggcctgctgcacgaattcgggccagtcctgctcgatcccgacgcggatgctcgtgccccgggcccggatggacgaggcggccgccatcgcggccgaggcggcggcggtcttccggctcggcccgaccgcggaccccgagacggatctcggcccggtggtcaaccgcacccagtacgagcgcgtcgtcgggctgatccgcaccggcatcgcggagggcgcgcggctcgtcgccggcggcccggagcggccggaccacctcgaccgcggcttctacgtccgcccgacaatcttcgccgacgtgacccccgacatgaccatcgcgcgggaggagatcttcggcccggtcctgtcgatcctcgcctacgacagcgaggacgacgcgatcgcgatcgccaacggctcgcgctacgggctcgccgcctacgtgcagggacgggaccgcgaccgggcgcgcgccgtggcgcggcggctcatcggcgggcaggtccacatcaactacccgcccccggacgtccacgcgcccttcggcggctaccgccagtccggcaacggccgggaatggggcgaggccggtctccaggaatacctcgagaccaaggcgatgatcggcttcggcctcgactga

SEQ ID NO: 6587 - DNA, 954 bp, Methylobacterium sp.
atggccttcgatcgacacatcttctccggcacgatcccggccctgatgacgccctgccggccggaccggacgcccgacctcgacgccctggcgcgcaaggggcgggagctcgtcggtgccggcatgtcggcggtcgtctactgcggctcgatgggcgactggccgctactcaccgacgaggagcggatggcgggcgtcgagcggctgctcgccgccggcgtcccggtgatcgtcgggaccggcgcgcagaacccgaagcgggcggcggcgctcgcggcgcacgccaaggcggccggcgcccacggcctgatgatcatcccgcgggtcctgtcgcgcggcagttcggccgcggcccaggaggcgcatttcggcgacatcctggaggcggccgtcgacctgccgtcggtgatctacaacagcccctattacgggttcgagacccgggcggacctgttcttccgcctgcgcgcccgccacccgcacctcgtcggcttcaaggaattcggcggcgcggcctcgctcacctacgcggccgagcacatcaccggccagtcccccgacatcaccctgatggtcggggtggatacccaggtggtgcacggctacgtcaattgcggcgcccggggcgccatcacgggcatcggcaacgtcctgccgcgggaggtgctccacctcgtcgccctgtgcgagaaggccgccgcgggcgacgtccgggcccggcgccgggccgaggaactcgacgccgcgctggcgatcctgtcgagcttcgacgaggggaccgacctcgtcctctactacaagcacctgatggtgctggaggggaacccggaatacgcgctgcacttcaacgccaccgacgcgctcagcgacggtcagcgccactacgcggagacgcagctgcgcctgttcaaggcgtggtacgcgcagtggtcggaagccggcgccggggcctga

SEQ ID NO: 6588 - DNA, 942 bp, Methylobacterium sp.
atgttggacgatcatttccgggcgcggatcactctgcttcgatccgagcgcgatttccgcccggcggtcgccggttactgccagggcatgatcgaaccggcgcagattgtttggccgagccacaagctgctcaatcagatcgggcgctacgtggtctcgttcatgctgatccacaacgactacgcgtggcgccatcacgggggcccgcgtcccaccctgacggtcctccaggcgatggtgggatcgagcccgaggcagacggccggcttcgtgtcggccctgaaggccgggcgcttcgtcaccgcggtggcggatcggggcgacgggcgcgtgaaatgcctgcaggcggcgccggccctggtgaccgagatcgcgcggagcgggcgcctgttcgtcgccgccatggacgcggtgacccgtcgcgacccgggccacgccgggatgctcgacggccccgaccggctcggggagttggtgcgcctttcggccgcccacgtgctgcggcacggcacgctcatcgcgccgttcccgcgggtgctccatttcgcaggacgggactgcggctatccgctgctcacggccctggtcggggcccactatgccgccacggtgcccggcgcgccggcggcggtgtcgctcagcctgcgcagcctcgccgagcggctggacgtgtcgcgggcccatgtcggcaacctgctcggcgaggccgaggccgcgggatggatccggatcgccggcggccacctgaccgccttcgacccgacgctgctggcggagttcgaggtctgggccgcggggcagatgctgttctacgacgatctcgcggcggcgatcctcgcggacctgccggccgcgacagccccggtccgcgcctccggacgcgccggtctcgcttgtgttccggtcgatccggggatacctacgggccgcaccgcgccgtga

SEQ ID NO: 6589 - DNA, 954 bp, Methylobacterium sp.
atgcccgtcaggctcgacgcgcgcctggccggcgacctgttcttcttccgcgtcctggtcgaggcgggcggcttcgcccgtgcgggcgaccgcctcgccgtcacgcagagcgcggtcacgcagcggatccagcggctggagcggcgcctcggttacccgctgctcgagcggggcacccgcgagatccggctgactgccgcgggtcaccacctgttcgccgcggcgcggagcggcttcgacgggatgggcgaggccctgctccggggggaacggcgcgagggccgggcgacgctgcggatcagttgcgtcccctccctggcctcggaatggctcgcgccaaggctgaaagccttcagcgacacgcatcccgacatcgacgtcgccgtcttcggggagacccacgacctggatccgggacgcatggcgcagtccggtatcgacgtcgcgatccgctacggcccggcgccgcctcccagtgcgacggtcgtcttcgaccatcccgagccggtctacccggtctgcgccccggcctaccgggatgcggcggatcccggcggggccgtcgtgctgctccacgacgcgacgccgtgggaggcggccgcgagcgtctcggaggagtgggatcgctggataggcgtccatggggcgccctggggcggccgcgtccagaatctctacttcaacctcgcgcaactggcgctgcgcgcctcgctcggcggctcgggcatcgccctggggcgatcgctgatcgtcgcgccctatcgcgccgacgggcgcctcgtgcccgcctgcgacgcggccctcatgaacgggctccggtacttcgttctcgtgcgtgccctgccacccgcagggccggcggcggccttcgtggactggctcggccggacgatggcgggtccgccgggctcgcccgaggcgccgcgtcggggcggtgcggcagaatgcggatag

SEQ ID NO: 6590 - DNA, 444 bp, Methylobacterium sp.; identical to SEQ ID NO: 5536

SEQ ID NO: 6591 - DNA, 1794 bp, Methylobacterium sp.; identical to SEQ ID NO: 5537

SEQ ID NO: 6592 - DNA, 786 bp, Methylobacterium sp.; identical to SEQ ID NO: 5538

SEQ ID NO: 6593 - DNA, 621 bp, Methylobacterium sp.; identical to SEQ ID NO: 5539

SEQ ID NO: 6594 - DNA, 264 bp, Methylobacterium sp.
atggacgacgggtccgacctgatcttggaagcggttgatgcgctccggggcgccggcgtcgcagtggcgccgatcggcgacgagcttgagagctggcagatcggcgatttcgtctattccgacgccgacctgtggcgcctggccgcgagtcgccggcggtcgaggatggcgacgcgcggtagcccagcgccatgccgaaggccccatcgcctagaggcgcccggccgcgccaggacctccggccgcgcgtgctggcggcgctga

SEQ ID NO: 6595 - DNA, 519 bp, Methylobacterium sp.
gtgcagacctcggttcaggcggccgtgcgcgcgctcctgaccacgacggaccgttcggagatcacggtgcccctggtggccgccgcggccggcgtgacgccgtcgacgatctaccgccggtggggcacgctcgccgagctcttggccgatgtcgcggtcgagcggctccgtcccgacggcgagccggccgataccgggagcggccggaccgatctcgaggcgtgggcggagcagtacgcggacgagatgtcgtccgcgccggggcgggagatgatccgggacgtcctggcggcggcggacgcgaactgtgcccagcgatgctgcagcttcacccgcgatcagatcgcgatcatcgcggatcgggccgtggcccgcggcgaggccttcccggaccccgaggcggtgctggacggggtcgtctcgccgatcctctaccggattctgttcgggaccgcgctggaccgggaacggatcctcgagctggtcgaccgcaccctgacggcgcgcgaagcgacctga

SEQ ID NO: 6596 - DNA, 429 bp, Methylobacterium sp.
atgacccagggaacggaaccggcggcgctgccgccccacttggcacaggaatacgcggcggcgcgggacaacggctgcgtcggcacccggctgctctcggaggatgaccgctcccgggtctggaccatcgtcctggcgcccggcgcgcggatcggcttccacacgcacgtgctcgactatttctggaccgcggtgacggcggggcgggcccgctcgcattacggcgacgggcgggtcgcggaggtcgattaccgcgcgggcgacatccagcacctgtcgttcgggccgggcgagtcgatgacccacgacctcgccaatatcggcgacacggagctgatcttcaccaccgtcgagttcctggacagcgcgaacccgcccctcgcgctcccggccgccgtgcgcgcggaggcgacccgccgcgcggcctaa

SEQ ID NO: 6597 - DNA, 417 bp, Methylobacterium sp.
atgacacgtcagaagatctcgcagtggccggtccccccggccgactggccgccggagctgcgccaggatttcgccgccggtgccggcagagggcaggtcggcagtcgcctcgtctccgagaccgatcgcgtccgggtatggtcgctcagcctgaaacctggcgagcggatcggcttccacacgcacgtgctggactacttctggacggcggtcaccggcggtcgggcacgctcgcactatgccgacggccgggtcggcgaggtggtctacgagcccggggacacacagcaccacaccttcccggccggtgcgttcatgatccacgatctcgagaatatcggcgagaccgaacttaccttcacgaccgtcgagttcctcgacagcgcgaacgcaccgctggccttggccggccgctga

SEQ ID NO: 6598 - DNA, 417 bp, Methylobacterium sp.
atgaaacgtctcgcgatcgccctcacggcgctgtcgagcctcgtcctgttcgccccgtcgagcgaggcgcgaccccacggccgcggcttccataatgggccccaccatctgggccacggcgtctggagggggcggcgccacggcctccaccggtaccgccatcaccgtctgcaccggcactaccggcggcaccggggctaccgcggatatcgcggcgtccacttccgccccgccggctacggcttccggccccacgcgtatcgctcgggtggctggggcggctatcgcggggtcggcttcgcgaccggcgcaggccttggcctcgcggccgctgcacggcccggtctctacggcgcggcctacgggcggccctacgggtacggctatgcaccggtcggctacggctgcgcctactag

SEQ ID NO: 6599 - DNA, 300 bp, Methylobacterium sp.
gtgatcctgtcgcggtggcgcggctatagcgccgccatggcgaagcgccccatgactctcgacctgttcacgaccctggatatcgtcgatgacgacgtctcggccgtcgtcgacgcctatctggccgatcccacgcccggttcggtggcgttcggggacggcttccgcatcgatcccgcggccgcggtggcctcgcatcccttcgcccggacgctgatcgatcagccctgggccgatgccgggctgcgccgggccgccatccgcgccgccatcctgctggcggagccggagcgggtctga

SEQ ID NO: 6600 - DNA, 1134 bp, Methylobacterium sp.
atgacggaatggctggaccgcgccgaagccctcgacgccctcgggatccgggcccagacgctctacgcctacgtcagccgcgggctgatcgaggcgcggcgggcgccggggcggcggcacagccagtaccgggccgccgacgtcgcgacgctcgccgaccggcgcggccggagccgcgccagcgcggcgatcgccgcgggggccatggcctggggcgagccgtcggtcgtcaccgcgatcagcaccgtccaccggggcagcctgatctaccgcggccgcgacgccgtggcgttcgcccgcgacgcgagcctggaggcgaccgccgacctcctgtgggacagcccggaggcgacgctgttcgaggttccggccgacgcggccgcgacgccgttcctggcgctggccgggcttctgcaggaggccgaagccgcgctgggccgcgggcaccaccgcctgtgccgcgacgcgcgccgcgccgtcgcgcatctcgccgcgtcctgcggcatccccgaaggccgggcgcccctgcatcagggcttggcgcggctctggtccctcgacgccgcgaccgccgaccgggtccgtcaggcgctggtgctgctggccgaccacgaactgaacgcctcgaccttcgcgacccgggtcgccgcctccaccggcgcgccgatcgcggcctgcctcatggccgggttgagcgccctgtcgggaccgcgccacggcggcgccgcggcggcggtgctgcggctcgtcgacgaggctgacgcgacgaacccccgggaggccgtgcgcgcctgcctggatcggagcggcgcgctgccgggcttcggccacccgctctacccggacggcgacgcccgcgccgcggccctgggcgcggtcctgcccgccgaccccctgctggacgccgtccgggactgcgccgaggcggcgacgggggcgcggccgaacatcgacttcgcgctgacggcgctcgtccggacggcgggcctgccgcggagcgcgccgttcacgatcttcctgctcggccggagcctgggctgggcggcgcacgccatggagcagggccgccaggggacgctgatccggccgcgggcccggtacgaggggcggcgcagcccggcggaccgcccatag

SEQ ID NO: 6601 - DNA, 840 bp, Methylobacterium sp.
atgcttcggactgcgatcgccgtgacgcttctgctggccggagccccggcctgggccggaccgcgctggcaggacctgccgccgacccccgcgccggtcgccggcacggtctccggtcgcgccgctgtcaacggcatccggctgtattacgccacgatcggcaacggtccgccggtcgtcctgctgcacggcggcctgtcgaactccgattactggggccaccaggtcgcggcgctcgccgcccgccgcacggtcatcctcgtggacagccgcgggcacggccgcagcacccgggacgatcggccattcggctacgacctgatgaccgacgacgtggtcgggctgctcgacgtgctgaagatcccgcgcgccgacatcgtcgggtggagcgacggcgcgatcctcggtctcgacatggcgatgcgccaccccgaccgcgtcggcaaggtgttcgcgttcggggccaacgccgacccgtcgggcctgatcgagggcgtggagacgaacccgaccttcgccgccttcatcgaccgagccggcaaggagtacgaggccctctcgccgaccccgaaggactacgccgccttcgtcgacgcggttggccggatgtggggcgggcagccgcgctggaccgaagccgatctgaagcggatccgcgcgccggtcctcatcgcggacggcgaccacgacgagggtatcaagcgcgcgcacaccgagtacctcgctgccacgattcccggggctgggctgctgatcctgcccaatgccagccacttcgcgttcctccaggatccggcgctcttcaacgcggcgctcctcggcttcctggacgggccttga

SEQ ID NO: 6602 - DNA, 360 bp, Methylobacterium sp.
gtgcatttcatgcggatgatggggctcgtggcccttgtgttgagcggcctgggcctggcgggcccggcgtcggcggccccgctctcaccggcgccgctggccggcgacgcgagcgggctgacccgggtcggctactggtgcgggcccggattccacctcaacccgtggggccggtgcgtcccgaacgcccgccggttctacggcccaggcccggccttctacggagcccgctactacggaggccggcgcttctaccggacctacaactatcgctggcaccgcaattaccgctggcatcgcaactatcgctggcaccgcaactatcattggcatcgcagctaccactggcgtcgccgctga

SEQ ID NO: 6603 - DNA, 198 bp, Methylobacterium sp.
atgcccccgcggtcgcgccgcggggctcatcggcgggcggcgcaggtccacgaagacctggccgcgccgcgcacccatcccccagaccgcgccgcctccgaggccaccatgacgctcgccctcatcatcaccggcttcctgatcgtgaacttcgtgatggccggcctcttctccctcgtggccctctgggccgactga

SEQ ID NO: 6604 - DNA, 1212 bp, Methylobacterium sp.
atggctgaggatgggattgccgattcgggccgcgcttggcgtcggctcgccgcggcgacggcgctcggcacggtcggaggcgtcggcatgtggtcggtcgtcgtcgtgctgcccgccgttcaggccgagttcggggtcgatcgggcggcggccgccctgccctataccctcacgatggtcggcttcgcggtcggcggcctcctgatgggccggctcgcggaccgcatcggcatcgtgcccccgctgctcctcggcaccgtctgcctggccctcggctacgggctcagcgccctcgcgacgaacctctggcagttcgccctcgtgcacggcgtgctcgtcggggcgctcggcagctcggtcgccttcggaccgctgatggccgacgtgtcgcgctggttctcgcgccggcgagggctcgccgtcgcgctgtgcgcgtccggcaattacctcgcgggcacgctctggccgccggtggtggagcgcgcggtccacgcgtacggctggcgcgcgacgcaggccggaatcggcctgttctgcctcgtcgccatgctgcccctcgcgctggcgatgcggggccggccgccgcgggcttcggcgacgtgcgcggccggtccgcaggccgtgacgacgctgtcgcccgcggcgctgcagggcctcctcgtcgtggccggcaccgcgtgctgcgtggcgatggcgatgccgcaggtccacatcgtggcgtactgcagcgatctcgggtacggcgtcgcccgcggcgcgcagatgctgtcgctgatgctcggcttcggcatcgtcagccgggtcgcgtcgggcttcgtcgccgaccggatcggcggtctcgcgacgctgctggccggtgcgctgctgcaggcggcggcgctcgcgctctacctcgcgttcgacgacctgacctcgctctacgtgatctcggctctgttcggcctgttccagggcggcatcgtgccggcctacgcgatcatcgtgcgcgagtacctcccggccgaggaggccggggcgcggatcggtgcggtgctgatggcgacgctggccggcatggcgctcggcggctggctcacgggggcgatcttcgacgccaccggctcctaccgtgcggcgttcgtcaacgggctggcctggaacgccgtcaacgtggcgatcgtgctgtggctgattcactgccgtcgggcgcgcacgagtccggccgcgctctga

SEQ ID NO: 6605 - DNA, 705 bp, Methylobacterium sp.
gtggccgcgatggcgaaatttcatttcgtcgaggattacgaggcgtacgtccgccaactgatgcgcgacttgcccctggatgaggcgatgagcgtggcggtgggcggcgactacgaccgcatcggcgcgatcgagtgcgagatcctccagcatttcgggctccgggacggccagtcggtggtcgatttcgggtgcggctccgggcgcctggcggtgcatctcgcccgcaccgcgagcgtcgcgtatctgggcctcgacgtcgttcaggacctgctggactacgcgaagcgccgctgtcccagggactaccgcttcgcccggaacacggcgctgtcgctgccggtcgccgacggcagcgtcgacctcgtctcggccttcagcgtgttcacgcatctcctgcacacggagtgctacatctacctggaggagatgcaccgcgccctcaggcccgggggccgcgtcgtggcctcgttcctcgagttcggcatggcctcgcactggggtgtcttcaccaagacggtcggcgagcagcgcaccagcacggtgccgcacctcaacacgttcatcgagcgcagcgtctggcagacctgggccgaccatatcggcttcgacagcgtgacgttcctcgacggcacggcggcgccgtggccgtcgggcgtgtatctgggtcagtccctcgcggtgctcggcaaggcgccggcctga

SEQ ID NO: 6606 - DNA, 1407 bp, Methylobacterium sp.
atgtccgaagccgtgagcccggcggtcaacgccggaggccgcctcgaccgcctgccgatcggcccgttccaccgccgcatcatgtggctgatcgggatcggcatgttcttcgacgggttcgacatctacatcgccgccaccgtgctcggcgcgaccctgaagagcggcttctcgaccctgccgcagaacgcgtggttcgtctcggccaccttcgtggggatgatggcgggctcgttcctcacgggcttcttcggcgaccgctacgggcggcgcttcacctaccaggcgaacctcctggtcttcgggctggccgccatcggggcggccttcgcgcccaacatgacggtgctgatcgtgctgcgcttcatcatgggcgtggggctcggggccgagaacgtcgtgggctactcgaccatgaccgagttcgtgccggcgcgctcgcgcgggcgcttcctcggcctcatggcggtgttcgtcgtcacgggcctgccggccgcctccctgatcggctacctgatcatcccgaccttcggctggcgggcgatgttcgcgctgggcggcctcggggcgctcgccgtctggtacgcccgcaagagcctgccggaatcgccgcgctggctcgaggccgtggggcgccacgccgaggccgaggcgctgatgcgcgcgatcgaggccgaggcggcccgcggcgcgccgctgccgcccgccgccgccgcggcgcccgtcacgcagctcgggctcgccgccctgttccggccgccgctgctgtcgcgcctgctgctgggctgcctgtgcctcgtggtgatcaacaccctgctgtacggcttcgtgacctggctgccgaccttcttcattcggcagggcctctcggtggcgacctccttcggctacgcgctgctgatggggctcggcgcgccggtgggcagcgccatcggcgccctgaccgccgaccgctggggccgcaagccgacgatcatcggcgcctcggcgacggccatcctgttcgggatcctctacccgatgaccctggacccggtcctgctgccgctggtcgggttcgggctgacggtgccgatctacgtgctggtggccctgctgttcgggatctacatccccgagctgttcccgaccgaagtgcgcctgcgggcctcgggcctgtgcaacacggtcgggcgcggggcgaccatcgtgacgcccttcctggtcgttaccctgttcgagacctacggcatcgcgggcgtgaccggcctgatgatcgggctgctcgccctgcagatcgtggcggtcgcggcgttcggcgtcgagccgcgcagccagagcctggagagcctggaggccggcgtggcgccggccgagggcggcccggccgcccgggcgcggggcacggttccgcgcccgatccactga

SEQ ID NO: 6607 - DNA, 1524 bp, Methylobacterium sp.
atgaccctgcacgcgccggaaccgaccgtcgagacacggggcaacttcatcgacgggcgcgaggtcgaggccggcgacggcgcgctgatcgacgtgcgcaaccccgccaccggcgcggtgatcgcccggatccccaattcggggccggccgacgtcgaccgggcgatgcgcgcggcccgggcggccttcgagggccgggaatggggcgggatggacatccgggcgcgcgcccggctggtgaacaggctcgccgacgcgttcgaggccaacctcgacacgctctaccggctggagaccaccaacaacggccggccggtcaacgagacccgggcgcagctctcgcggctgccggacttcttccgctacttcgcgggcgtggcgctggcgcggcgcgacgacgtcatcccggtcgagggcaactacctcaactacacccgccgcaccccgatcggcgtggtggcgaactgtacgccgttcaaccacccgctgatgatcctgtgcaagtcgctggcggtggtgctcgccaccggctgcaccacggtggtcaagccctccgagtacacgccgctcacgaccctgaagctcgcgcagatcttcaccgaggccggcctgccgccgggcgtgttcaacatcgtgctggggcttggcgcctcgaccggcaaggcgctggccgagcacggcgacatcaacaagctcgtgctcaccggcggcaccgaggccggccggatcgccggctcggccgccgcgaaggtcttcgcccaccagaccatggagctcggcggcaagacccccgtgatggtgttcgacgacttcgacgtcgagcgggcggtgaactacgcggccttcggcgccttcatcggcgccggccagacctgcgtgtgcggcagccgccacctcgtccaggcctcgatctacgacgagttcgtcgagcggctcgccgccaagaccgccgcgatccgcctcggcgatcccttcgacccggcgacccagctcgggccagtcatctccgagcgccagcgcgagcgggtgctggcctatgccggctacggccgcgaccagggcgcccgcgcggtggcgggcgggcgggcggcccgggtgccgggcttcgagggcggctacttcgtggagcccaccgtgttcgcggacgtcaccgccgacatgcgcatcttccaggaggaggtgttcgggcccttcaccagcgtcacccgcttcgaggacgaggccgacgcgctccggctggccaacgactcgcccttcggcctcgccgcggccgtgcgcacccgcgacgtcgcccgggcccaccgggtggcgcacgcggtcaaggccggcatcgtctggatcaacgaccaccaccgcctcgacccggcctcgccctggggcggggtcggcgacagcgggctcggccgcgagtgcgggatcgagagcttcaacgaccatttcgacgtgaagagcgtgatggtcgccaccggcgacgggcccttcgactggtaccgcgacacggccggccagcgccgcctgaactga

SEQ ID NO: 6608 - DNA, 633 bp, Methylobacterium sp.
gtgctgctccgagacaacatctacgcggcgatccgcgccgacatcctggcctgcgtcctgcgccccggcgcggaggtgcgcgagcaggaactggcccagcgctacgccgtgagccggcagccggtccgggaggcgctgctgcgcctggagcgcgagcggctcgtcacggttcacgcgcgtcagggatatcagatcaacgcgatttcggtggcggacgcgcgcgatctgctgcgcatgcgcctcgctctggagccggcctgcgcggccgaggccgcggccggcgcgcccgcttccgtcctggcgtccctcgacgcgttccgcgccgtcgcggacggcgccgacttcatcgcggagaaccgcgccttccacatcgccctcgccgaggcgtcggggaaccgccgcatggccgcgaccgtgcgcgacctcgtcgagcaggcggaccggctggtccgggtcagcctcgacggtatccgcgggcgcgacccggcgcagctggtggacgagcacgccgccatcatcgacgccgtgcagcgccgcgacgggcgcggggcgcgccgcctcgtgcgcgcgcacgtcgcccaggccgagcgccgcatcctgaccgccctggaacgcagcgcgatcgtcctctga

SEQ ID NO: 6609 - DNA, 414 bp, Methylobacterium sp.
atgcaggacatcccgttgggggcgaaggggagcttcgccatgctggtcgggccgtcacatctggccagccagttcaaggacaacatcctgccgccggtcttcgccacgccgatgatggtcctgatcatggagaacgcggcgctgaacgccgtccgccagtacctcgatcccggcgagagcgccgtcgggaccaaggtggacgtgacccacatggcggcgaccccggtcgggcaccgcgtccgggcggaagccgaggtggtcggcgtcgccggacgccagatccagttccgcgtcgcggcctgggacgagtcggagcagatcgggtccgggacgcacgagcggatgatcgtcgacatcgagcggctcggcaaacgtctcgccgccaaacagcccgccccgtcgaagcgcgcgtag

SEQ ID NO: 6610 - DNA, 465 bp, Methylobacterium sp.
atgtcgttcatgagggtcacgatctgcgccgtcgcgctctgccttgtcgcgggcctgggccacgctcaggaggccggacagacggtcgccggcgagggcgattgggtgctcaggaaatcggcggccccgtcgagcggcgacgtcgcctgcgttctggcgccgaaggcgcggtcgcgcatccagatcgtcggcgaccgcatcgagatcaccggcctgccaaagaattccatcttcaattatcagtatcggatcgacgagggacctgtttcaaacgcgatgtttcccacaacgcagatgcaggacgccggagtgatcacgctgaatggggacgtattgaaagatattctggccggtcgacgcttcagcatccgcctgctggaccgatggcacgaggccatcacggaggagatcagcctctccgggctgcgcggcctgatcgacaagcgggccgaggcctgcaggtag

SEQ ID NO: 6611 - DNA, 243 bp, Methylobacterium sp.
atggctttccccgatgcgaacgaacccagcgccccgtcgatcagcgccctcgagctggtcaataccctgatcgagcgcaaggagagcggcgagccggtcgacgccgacatcctgtccttcctgaccgacatggaacggctcgggctcaccgacaccgatgcctacgcgacgctcgacgcgtatcggcctgggcccgcacggggtgcgaccggcggggatgacgcgagcgaggcggacgcctag

SEQ ID NO: 6612 - DNA, 708 bp, Methylobacterium sp.
gtggcgacctggaactgcgacgccggtccctccggccacgggatcgccgcggtcccgccgggccggcccggccgccctccgcccggcggatcatggaacctcgcggcgttcgagcgccatcgcgcggcctatctggcgcgggcgcgccgcatcctgggctgcccggcccaggcggaggacgtcgtccaggacgtgctgctccggctgatcgccgatccgcccccggccgagaccgcgatccaggccgcctatgtcgggcggatggtgcgcaacctcgccctagaccgggcgcggcggcagggcctcgagcggcgcctgttcaccggcctcgacgccgcgccggacccggccgatcccggcaccggcactcccgaggcggccgcggcgtcgcgggaatccctacggcaggtggaggccgcggtggccgagctgccggagccggtgcgcacggccttccagctccaccgggtcgagggcgtgccgcagatcgagatcgcggcccggctcggggtctcgcgcgccctggtatgcggcctcgtgcgccgcggccacctgcactgcctcgcggccctcgaccggcgctgcgccgcctgcccggcgcgcgccgaggccccaggccggcagcggcgccggaccgcgcccgtcggccaggacctcggccgcggcccggcgcaggcgatcatcagcccgccggcgacgggcccgtag

SEQ ID NO: 6613 - DNA, 801 bp, Methylobacterium sp.
atggctcgtctgcaatcctccggcttcttcgatctcggcgatggtcgactggaatatcatttcgtcggtcgacagccggaggtggcccccacgcttgtgttgctccacgaaggcctcggttcggcgatgcaatggggcgccctgcccgagaccctcgcccaaacgacagagtgcggtgtcctggccgtctcccgccagggatatggcgcgtcgagcccggtgcccttgcctcgcccggccgattatctcgagcacgaggcccgcacagtcctcccgcggttactcgacgccgcagatttcaggagcggcgtgatgatcggccactccgacggcgcctcgatcgccgctctcgccttggcggaaggcgatgcccgcctgcggggcggtgtgctgatggcaccgcatttcttcgtggaggaggtcacgctgtccgcgatccggcgaacccgagccgcctacgagcgggggctcttgaggacccgcctcggccgctggcacaccgatgtcgaaggggccttccgtggctggaacgacgcatggctggatccggcccggcgcggatggacgatcgaggctgcgctgacacgcctgaccgtccccgtgacacttatacagggaaccgaggacgcctacgggacgcaagcccagatcgctgcagcccgcagatcatgtccacccagcctgctcacagtccgtgagatgccgggtgtcggtcatgaaccacatcgcgaagctttcgcggacacggtcgctctcatctcggctttcgtcgagtatgtcctgaaagacgaaccaggctaa

SEQ ID NO: 6614 - DNA, 1350 bp, Methylobacterium sp.; identical to SEQ ID NO: 5561

SEQ ID NO: 6615 - DNA, 807 bp, Methylobacterium sp.; identical to SEQ ID NO: 5562

SEQ ID NO: 6616 - DNA, 1560 bp, Methylobacterium sp.; identical to SEQ ID NO: 5563

SEQ ID NO: 6617 - DNA, 534 bp, Methylobacterium sp.; identical to SEQ ID NO: 5564

SEQ ID NO: 6618 - DNA, 858 bp, Methylobacterium sp.
atgtctgaggctctcgagattgctcatggcacctttggtcgcgtggcgctcctcgacatggaccggagccttgttcggcacgcgcatccgcactgccacgttcttctgaaggtcgaaggggacgacaccgagttcctcgtcggggaccgtgtcgttgcgctgaccgacgaacaggccgtgctcgtcaatgcctgggaaacgcacgcttatctccatgatccgcgccgcgccaaggcgatgatcctggccctctatatcgagccggactggctgggggccttccggcgcaattgggcggcgagcggggcgcctggcttctttggaaagcccttgggcggcgtgaccccgacgatccgccgcttcgcgcacgacctcgctgcggagatggtctacgcgccgcactcctcgcacattcaggatcagttgctgtcgggcctgatgatcgcggtaatcgagcggttcaccgcgtggcgtgaggaggccgagtcgctccgcgccgccgccaggcgcaacgccagcgattggcgcatccggcggactatcgcgcgagtgcgcgccgagcccggtgccacgttggggatcgaggccctggcccgtgaggcgggcctttcccgagcgcaattctatcgcctgttcgagcaatccaccggagctccgccccacgtcttcctcaacgcgatccgcatcgagcaggccgtcgagtcgatcgtgggcagcgaggaatccttggcggcgatcggcacgcgcctcggcttcgccgcgcctgcccatttctcgcgcttcttccgggatcatgtcagcgtgcccccaagcgtattccgcagcattgtccggcgaagcggccaacccgccgtgtga

SEQ ID NO: 6619 - DNA, 705 bp, Methylobacterium sp.
atggccttcaacaccgaactcgacagcgccctcgaagccgccttcgccgaggcgcgcgcgctgtacaaggagcgcggttttcagcgtcgggtcgggttcggccggcgtcccgccctgatcaatgtcgacctcgccaacgcctggacgcggccaggcaatcccttcacctgcgagaacatcgacgagcagatcatccccggagtccaggcgcttctggctgcctgccgccgcaacaatcacccggtagtgcacgtcaccacctgctaccaggtcaccgacgtcgacagtcccaagaccgacatgggcctgtggcaccgtaagatcccggtcgaggtcgtggatcagaacaagcccgagctctgggcgatcgacagccgcattgagccggtgccgggcgagcaggtcctggtgaagaagcgggcgagcgcctttcacgggacctacctcgccgggttcctgcgcgccaacaacgtcgacacgattctggtcacgggcgtgaccgcctcggcctgcgtgcgcacgacgctctgcgatggtctcgccgagggcttccggaccatcgcggtgcaggagtgcatcggcgaccgtgtgccgggcgccgtcgcctggaacctcttcgacatcgacgcgaagttcgccgacgtcgagccgctggagcgctgcgtcgcctacctcgacgaggtcggcctgcgcaacgccgcctga

SEQ ID NO: 6620 - DNA, 1065 bp, Methylobacterium sp.
atgcgtgctgtccggtccctcgatcgattctcgccgacgcgccggcaggcgcttctcggcagtgcggcggccatcctcacggcgggggcgggacgcgaggcgcacgcggctgccggaacggtcgtcgtctccaactggggcggcgactggaaccagcggacggtgcgcttcgtcgaggctcccctggtggaggcgcagggcctgaccgtcgtgcgcgatctcggcatggagccggagcgcaaggccaagcttctcgccgagcgccgcctgcgccggggcagcatcgacgtgattcatctgaacgactcggatgggttcgagatgatgaaccaggacgtgctggcagatctcgatcgggcgcgcatcccgaactacggcgacgtcattccggccctgcgcaaggattatttcgtcccgtggctctacagcggcgtagtaatcatctacaacaaggataagatcaaagatcctccgaaatcctacgcggagctctgggacaaaaagtgggccggccgcctcggtctgaccaatcagctctacttcaattacatgatgatgtccggcctgatccagggcggcaacatgacgagcgtcgagaccggccgcgagcggctcgtcgcgctgaaggagttggtccagccccgactttacgccgcacatcagcagctcggcgcggcgctggccaccggcgaggtcgacatcgccctgaactataaggcccgcggcctgcaatggatcaacgagggctcgccactggccatccagtatccgaaggagggcgcgatcgcgatcaccttcggcgccgggatgccgaagcgcgcgccgaacccggacggagcctacgtctacctgaacgcgatgctcgaccggaaggcgatggccgaactcgccgcggcgagcttctacgcgccggccaacggcgcggccgagctgagccccgagctgcgcgctcggatcgacttctcccccgaggagcgcgagcacctcaacttcccggattatgcctacgtctcgaagaacaccgccgagtggctcgagtggtggaacaagacgatggcgcgctga

SEQ ID NO: 6621 - DNA, 1158 bp, Methylobacterium sp.
atgtcagcgaacacctacgacgtcatcgtcctcggcgtcggcggcatgggctcggccgcctgctggcacctcgcccgccgcggtatccgggtgctggggctcgaacgcttcgacatcccgcacgccatgggatcctcacacggcttcaacaggatcatccgcctcgcctacttcgaggatccctcctacgtgccgctgctgcggcgcgcctatgagaactggcgggaactggagggacggttcggcgagcagctcctcttcatcaccggctcgatcgatgcgggacctgagggcagcgccatggtcgagggctcggtcgcggcctgccggacgcacgacctcccgcaccgtctgctcgacggcgccgaactgcggcgtgtggcgcccggctacaacctgcccgacacgcatcgggccgtccttcagccggatggcggcttcgtctcggccgagcgcgcgatcgtcgcgcacgtcatgcaggcgcaggcggccggcgccgagatccgggcgcgggagccggcgctgagctgggagccgacggcctcgggtgtacgcgtccggacggagcggggcacctacgaggcggggcgcctgatcctgtcggcgggctcgtggatgggcgaattcgtaccgcagctcaaaaccgtcgctgtgcccgagcggcaggtgctcggctggttccagccacgggagccggccctgttcgcgccggaccgcttcccggtgttcaacatggaggtcgaagagggcaagttctacggcttcccggtctggcacgtgccgggcttcaagatcggccgttggcaccatctcggcgagacgggcggtgccgataccttgtcgcgggagtgcgaagccgaggacgaggcggtgctacgcccctgcgtcagccgctacttcccccaagcaaacggtccgaccatggcgatgcgggcctgcttcttcaccaatacgccggacgagcacttcgtgatcgatacgctgccggacctgccgcaggtcgtcgtcgcttccccctgctcaggtcacggttacaagttctgcagcgtcgtgggtgaagttctcgccgacctcgccttgggcagaaagccgggatttgacctcagcctgcatgcgctcaaccgcttcgcaccacgttcgtatgcgagcactgattaa

SEQ ID NO: 6622 - DNA, 951 bp, Methylobacterium sp.
atgcgacccttcagctacgagcgcgtcgcgagcgccgaagcggccgtggcggccgtcgccgcccggccgggcgctcggttcatcgcgggcggtacgaacctgctcgacctgatgaagttccagatcgaggcgccggcccatctcgtcgacatccggcatttgcccctgaaggccatcgaggatctgccggacggcggtctgcgcatcggtgcgctcgccaccaacaccgaggttgccgcccacccgcgcgtgaagcgcgattacggcgtcctcgcgcgggcgatcgtggccggcgccacggggcagctgcgcaacaaggcgacgaccgccggcaacctgctgcagcgcaatcgctgcccgtacttctacgagacgtccctgccgtgcaacaagcgccagccgggctcgggctgctcggccctcgggggcgtcacccgctcgctcgccgtcgtgggcacgagcccgcattgcatcgctcagaacccgggcgacatggccgtggcgctgcgtgtcctcgacgcaaccgtcgagaccgtcaggcccgacgggtcgcagcgccggatcgcgatcggcgattttcatctgctgccgggcgaccggccggagatcgagcacccgctcgaaccgggcgagctcgtcaccgccgtgacgctcccgcgaccgccgggcgggacgcaccactatcacaaggtccgcgaccgggcctcctacgccttcgcgatcgtgtcagtcgcagtcgtcctgcacaaggacgggacggggcgggtcgcattcggcggcgtcgcaccgcgaccgtggcgggtggaggatgcggaggcgctcctgccgggtggaccggcagccgtcgtcacggcggccttccagggcgcgacgcccacggccgggaacgccttcaagatcccgctcgccgagcgcgcgctcgcactggtgctgagcgaagggagggtgtga

SEQ ID NO: 6623 - DNA, 2646 bp, Methylobacterium sp.
ttgaaggtcaacatcgcggcgatccggcgcgcactcgaaggagcggaaccggagaagcgcttcatcgcgacggtgagcggacaagggtaccgcttcgtcgcgcccgtcgacgtcatgtcctggccgatttcggcagcagcgcggcgccataaccttccgaaaccgacggacctgctcggccgatccgaggatctcgcggtgatcgcgacgaaggtgctgcagcgaccgctggtcacgatcacgggtctcggcggcgtcggcaaaaccagcctggccgtgacggtggggcacgctctcgtcgggcagttcccggacggggtctggatggtcgatctgtgcgtcatcgacagcgaccgctatctcgcgagcgcgttcgctcaggaaatgcgcatcgcaatccatgcagacgatccacaggctgcactggcgactgccctggcggatcggcagtgcctgctcgtcctcgattgttgtgagaacgccctcgatcaggcggcccggctggccaccatgctcgcgaccgccgcgcccggaactcacgtattggccacgagccgggagccgctccggatggcgcacgagaccgtgcatcgcctccaacccctgccggctccgacagcgttcgggacgctcaacgcgaaggatgttctgactttcccggccgtggcgctgttcgtcgcgcgcgcctcggccgctgctccagacttcagcctcgaggacgacgatgcgtgggccgtcgtcgagatctgtcgccgcctcgacgggttgccgctggcgctggaacttgccgcgacgcgggtcggggcgtttggacttcgcggcctcctccgtctgctgaacgagcgcctggaccttctggacgacggccgacgggcaggtcatccccggcaccgtggcctgaccgcgaccttggactggagctacggactgctgtcgcagggagagcagaccctgtttcgacggctgtccgtctttcacggcgtcttcccgctcgacgccgcgctcgcgatcggccgttctgctggggaggccgagcatgcgtgcatcggccacttggccgatctcgtcgccaagtcgctgattgtcgctattcctgggtggtcggcccggtaccagcttctcgacacgacgcgggcctacggattgcagcgcctcgccgagagtggcgaggatgatgcggtccgtcggcggcacgcggagttttgtgtcgcgcaatgtcgcgacgtctcggcgcgcaggagcgcgaaggcggcatccgacccgcgcgaggagttggtcgcgctcgtccaaaacgtccgcgccgcactcgactggtgcctaaccgaccggcgcgatcccgtcctcggtcgaacgctggcagccgaggcgctcgtggtgtgggacacgctcgcgctgctccaggaacggatcgaggcgagcgagtgggcgctcgcgtcggccgcccccgccgacggtccggaagaccggtacgagatcacgctgcgggcgtcgctcgctgcggccctgctgcaggtcgagggtccgacggcgcggattgcggagttgtggagcggggcgctcgcccgcgccgaacggctgtccgaccgcgatggccagttgcgggcgctctggggcttgtgcgacttccagacctgggttggggaccacggcgcctcgttcgccctgacggagcgcatcaggacgctggcggccgccagcggcgatcgcgcggccggcgcggccgtcgacaggcccgccgccaccgcgctccgctatctcggccgtctcgacgaggctcgcgaggcagcggagcgcctgctggcccgtgcggcccgccgtgacagtcccggccggcggctggaggatcacggcttgatcgcggcacgcggcaccctcgcgaacgtcctgtggctccagggacggccggatcacgccgtcgcggcggcgcggcgcgcgctcgtcgaggccgaagccaacggccaggccttcgcccttacgaatgccttggcgcacacggtgatcccgattgcgctccatggcggcgatctcgacgaagccgagcgcggcctcgcccgcctcggggaccacgtcgcgcgtcacgccatgcgcatctggcaggtcatcgccgattgcctcgaagcgatcgtgagcctcagccggggcgatgcgggcgggctgcaccgcctcgaggatgccctcgtcgagatgggggagatcggcttccggatgcggcgtccggcctatctcggctcgctggcgtccggcctcgcggcgcatggccaccttccggacgcgctcgctcgcatcgacgacgcgctcgccgcctccgagcacggcggcgaactctggtgccagccggaactgctgcgcatcaagggcgagatcctcctcgcctccaccggcgtcgccggcgaggcggacgcggcgcggcacttcctgcaagcgatcgatctggccggcagccagggagcggcgatatggcgcctacgggccgcgacgagcctcgccgcgctggatgaccggtatggtggcccggcagccctcgccgccgtcctcggcggcttcgacgaagggctcaacacgcccgatctcagggctgcgcgggcgcgccgtgctggtcgggggggacttggcagcgatgcgggccggccggtctccctggcctga

SEQ ID NO: 6624 - DNA, 1083 bp, Methylobacterium sp.
atggcacagaccgtctcgtggggcgtcctcggcaccggggtcatcgcccagcgcttcgtcagcgaccttctcgggcggccggacgcgcgcctcacagccgtcggggcgcggagcacggggagcgcccaggccttcgccgcggccttctctcaggcgtccggcgcgccggccgccgtcgccggcgtcgaggccctggccgcgcggccggatatcgacgtcgtctacatcgccacgcccaacagcgaccacatggacagcgcgctggcctgcatcgaggccggcaagtcggtcctgatcgagaagccgatcgcgctctcgggcgggcaggcgcggcgcatcgcggaggcggcgcggcggaagggcgtcttctgcatggaagcgatgtggatgcgcttcacgcccggcgtcgtgcgggctaaggcgatgctggaggcgggagagatcggcgatcccctgcatctcgacgcccgcctgttcttcccccgcgcgttgaacccgcccggacggacggacgatccggccgaaggcggggtgatcctcgatctcggggtctaccccgtgtcgctggcgctccacctgttcggcgcacccacggaggtctcgggcgtcggcctcgatcggggcggtgcggcggcgcagcaggccgcgctcgcgctcggctggaacgccaggaccgcgaccctgagctgcggctcgaccggagaggccgacaacgccgccgtgatcgtcggcacgcgcggccgcatccacctgcaccggcagttcctgtgcccgcccttcctcacgcgcgtgcgcaccgccgccgcgccggcgcccgccgaccgtgccccgccgcgccgccaggccgtcgaccgactggccttcgcgaaacgcctcctgcagccgctggacttccgccgcgtcgcgctgatcccgacgccgtacctcgggttcgggctgcggcatcagatcgacgaggtgcatcgctgcctgctcgccggcgcccgcgagagcccgatcatgccgctcgcggacagcatccgcaccctcgacatcctcgatcgcgtccgcgcccggccgcagccgctggaggccgtcgcctag

SEQ ID NO: 6625 - DNA, 1245 bp, Methylobacterium sp.
atggcgggacaggcgttgccgatcgagacgcgtgcgccggccgcgtccctcctcgcggaccgcgtcgccgtgttcctgctcggcgccgccctgaacttcaacgtcctgacctcgaccttcgggctgccgttccagcgcctgtccgacctgctgccgttcctgctcatcccctggctcgggttgcgccgcgccgtcgtcgcggaggcactgcggcaggccgcgcccctcgccggcatcctggcgctgatcgcggcctcgttggtgctgaaggcccacaagcaggcgggcgacgtctacctgaccctcgtcctgctgctctacgtggtccaggcgttcatcctgctggtgatgttccgcgaccggcgcgtcgaggacgcattctgcgtcggcctgctcgccggaatgctcgcctccctcgcggtcctgctgctcgccgcctccggcatgccgctcgaccggttcggactcgccgttcccacggacgggctcgacgaggagctaaagctgttcgtgcaggacaagcagggcggcctctgggcctccggcaacgagaccggccacgtcttcgccctggccggggccgcggccctgctgctcagcctgcgctatcgcctgaagatcgtctatctcgcctacttcgcggccctcctggcgagcttcccgttcaccaacaaccgcgccggcctgttcatgccgatcctgttcctcggcctgctgatgcggcggaacctcaaggcgcccgcggtgctggccgcgctcggcgtcctgggcgtcctgctcgtggcctgggcggtgacgggggagatcccgctgccggggacgctgtcccaggcgatcgagcggcgcttcgccgaggaccacaacgtcacgggcaatttcgacgagcggttcctgtccggcgtgaccgcgctccagctggtcctcgagtacccgttcggcgtcggcgaggtcgcccgccgggaggagctgcaggccctgaccgggctcgtgacaccacacaacggcttcgtgtcgctggcactccagagcggcatcgccgcggcgctgctgctcgtcgccggcctcgggcggatcctgctggcgcccgccgccttcgggtcgttcctgacctacagcgcggtgttcctgatcccgtcgctcatgttcgaggaactgtcggtcaaccagtacttcctcttcttcatgggcttcgtcctggcatccctcgcgctgccaccggaccgcgcccaatcgaccccggattag

SEQ ID NO: 6626 - DNA, 1338 bp, Methylobacterium sp.
atgatgacccccaccctgtcgtcgagctacgcccgggtcctctcggaggaaccccgcgcccaggaccgggaccgcccgagggatcaggcggccgcgcgcgcggtgaccggccccctgcggatcctgcatctcagcgccctctacccgccctacatcgtgggcggcgccgagcgctcggtggagcacctcgccgaggaactcgtcgcggcaggccacacggtggcggcggcctgcatcgcccgggagcccgagcccaagagcgtgcggggcggcgtcaccgtctaccgcatggcccaccacaacgatttctggctcgaggactggccccaggcgagccgcttcggccgcgcctgggcgaagctcaagcagcagtggaatttcgccgtcgcggccgagttcggccgcgtcctcgacgatttccggcccgacatcgtgaacacgcactcgctgctcgacgtctcgactctcgtctggcgcgaggcggccaagcgcgggatcccgatcgtccacacggtctgcgagtacgacctgatctgcggcaacgccgcgatgttcagggacggcaagccgtgcgaccgctggcacctgggctgcaaggtggtcaacgccgccaagcagatcacgaaccggtcggtggacgcggtcgtcagcgtcgggaccgagatcctcaagacccatgtcggccacgggttgttcgcgcatctcgcgcccgagcggcgccgggtgatcttctattcctgcaccgtcccagagggcgacccggaggccaggcgccggatcgaccggaccggccagccgatgaccttcggctatctcggccggatcaacaacgagaagggggtcggcacgatgatcgacgccttccggcggatcggtcccggcgattggcgctgcctcgtcgccggccacgcgatggacgactcgatcgagcggttcaaggcgcaggccgagggcctgcccatcgacttcgtcggctgggcgaaacccgccgagttcctcagcgcgatcgacgtgctcatcgtcccgtcgttctgggccgagccgtcgccgcggacgatctacgaggcctacacgatgggcgttccggtgatcggggcgggctcgggcggcatccccgagctgatcggcgaggacaatgccgactggctgttcacgccgggcgacgacgccgacctcgccgcacggctgcggaccgtgatcgcccgcggccgcggtgacctgccggacgagcgcgccttccagcacgtcatccgcgaatcgacctcggagcgcgtcgccgagaagtacctcgatctctacgccgaactcgttgccgagcgtcgggcgagccgcccgtga

SEQ ID NO: 6627 - DNA, 1257 bp, Methylobacterium sp.
atgcgcatcctgcaccttagctccctctacgcacccgagcaggtcggcggcgccgaactgatggtcgagacgctcgcccggacccaggcggatctcggccacagcgtcgccgttgcctgcgcggcgcggaccgagggcggaccggtcctgcaggacggcgtcacggtttaccggatcggctacgggacgccgttccacatcctcgattggccgcagcgcgggcgggtcgagcgcctccgctacaaggtcgcggcgcagtggaaccgccacgccgtcgaccggatggagcgggcggtccgggactacgcccccgacctcgtgaacacgcattccatctccgagctaccgccggcgctctggccgatgctccggcggctccgggtgccggtcgtgcacacgctgcacgacttcaccagcctctgcaccaacggcgcgatggtgcgccacgggcgtccctgcgcccggcagcatctcaagtgccgcctctacgccgcgccgcaccggcgctgccagcgcgccgtgacggcagtcgccgccgtgggctcggacatcctcgaccgccacctcgccgccggcctcttcgctcatgtgccgccgtcgctgcgccgggtgatctggaaccccatcccgcccggctcgccggtgacgcgggcgaagcgggcgcccggcgcgccggtccggttcggctatctgggccggatcgagggcgcaaagggcctcgacgtcctcctcgaggcctgccggcgcctgccggaaaccggctggcacctcgccgtcgcgggccgtgccgtggacgggctggaccgctaccgtgccctggccgagggcctgcccgtcaccttcccgggctacgcggagcgcgacgccttcctcgacgatctcgactgcctcgtggtcccgccgatctggcccgagcccttcggccggacggtggcagaggcctacgggcgcggcgtcccggtgatcggcaccgcgaccggcggcatcggcgagcaggtcgggtccggcccctggctggtcccgcccggcgacgcgccggcgctcgccgccgcgatggcccggatcatcgcggagccggcccgtctcgccgaggggctcgcccgcgccgcacgcatccgcgccggcaccgatccggtcgctgtggcgaccgcctatctcgatctctacgccgcgacccgcgacgcggcctccatcgaaccgcttcccgagccttccgcccgcgcggagcgcccgcacctcagcgagtgccgttcatga

SEQ ID NO: 6628 - DNA, 2196 bp, Methylobacterium sp.
atgtccttcctgactgtcgatctggccgaccggacgccggttcgcgccctcgcccaggagccggcgcgcggcggtccgctggccgcggccctcgcccggatctggcatcgccgctacctgttcgcggcggtgttcgccaccgtcctcggcctcgccgtgaccgccctgctgatgatccagcggcaatacgtggcgagcggctcggtcatcgtggccgaggcggaaccgggcgccaataacgcctcgatggcctggatccagaagatcggcgacccggccgacatcgagagccagatcctggtgatccgctcgccgcggctcctgcgcctcgcgatcgacgacaacctggtcgccgcggtgctggccgagtgccgctacgcggccacaggggggcatcccgaccggatcagcgagaagaaggacgccgcctgcacgaagctcacgaccgaccgcaacgcgctcgtcgactacctgcagaagcgctacacggtcctgagctccggtcgctcgcgcatcatcaccatcggctacaagtcgccgctgcccgagacggcgcagacgatggccaacggcctgatcaacgccttcttggatgaccagcgcgaggcgcaggcctcgagccgcaaggcggcggccgactggctgcacaccgagatcagccagctggacgcctcgatccgggccgacgagacccgcatccagaccttccggcgccgcaagggcctgctgaagggctcgctcgccccgatcagcgcggagcggctcaccagcatcagccagcagctcgccgcggccgagaccgccaaggcggacgcggccgcgcggctctccgagatcgaggccaagggtgcccgcggcgccgacagcgccccggccgtcctggcaagcccgaccatcgtctcgctgaagcagcagctcagcggcgtcagcgcgcagctcgccaaccagagcaccctgctgggcgcgaaccacccggtgatccgggcgctcgagaccgagcaggcgagcctgcgcgctcggatcgagcaggagatcggcaacgtcgccaagggcctgcgcaagtcctacgaggcttcgaacgccctggccaagtcgctgcgcgcccagctcgagacggcgaagaccgacgccgccgccgccatggacgacgaggcgtcgatcgagggcatggtgcgcaacgccgagatcaagcgcacccgctacgccgatctggtcaagcgggcgggcgagctggagaccgagcggcgcatactcaccggcagcacgcggctcgtcagcctcgccgagctgccgcaggagccgttctcgcccaaggccgtgccgttcctggcgggcggcatcgtgctggcgggcgtgctcgcggccgccgccgcgctgctgcgcgactacaccgaccggcgcgtgcgcacctcggcgcagctcatggccggcaccggcgccccggtcttcgcgcagctgccgagcctggagcccgccggcctcgtcggccgcttctccgagcggcagcgcgagctcgacctcgcggaggccctggcgcgggcgcgggtcgacccggtgatgcagaacgtcctgcgcaacctgcacgcccatctcgtgctggcgggcgcctgcaagtcccgcgtcatcctggtgacttcggcgaagccgcgggagggcaagtcgttcacggccttcgcgctggccggcatcggcgccgcgagcggccgccgggtgctggtggtcgagtgcgacctgcggcggccgaacttcgaggcctccctaggactcggccgcggccccggcctcggcggcgtgctccgcggcgagatcgacccggccgacgtggtggtccaggccggacgcttcgacgtcatccccgcgggaacgccgacggccgactcgaccgagctcctgatgggcgaccggatggccgacttcctcaagtggagccgccgctacgacctcgtcctcttggacaccccgccgaccagcctcctgatggatgcggcgatgctggcccgccacgtcgacggcgtgctctgctgcgcccgctacgggcgctcgcagctctccgatacggtcgagaccgtggcgaacctgcgccgcgccggcggacacgtcctcgggatcgccatgacgatggtccgcccgggcatccagtcgacctacgacgtgatgccgctgcccgatccccgcacggccgcgagcgcgcgatga

SEQ ID NO: 6629 - DNA, 1284 bp, Methylobacterium sp.
gtgacccgtctcacgcgccggtcggccctcgccctggcggcgggcgtcttcgcggccgggcgggccgccgcggccgagccgctgcaccgctgcgaggcgctgatcgactcgatcggcgtcaacgtgcatctcggccatcgcggcaccccctacgtcgaccgcttcgccgcctgcgcccaggcgctcgacgaactcgggatccggcacctgcgcgacgacatcgtgctcgtcggcgacgagccggccgggcagttcgagcgcatcgccgatctggccgaccggggctaccgtttcagcctgatcttctacgacgggctcacgccggggccgcgggtgccgccggagcgcttcgccgagatcgccggctgggccggcgacgggctcatcgtggcggagggcggcaacgagccgccggtcgcggcgcggccgggcctcgcgcggctctcggccgatcatcaggcggccctgttccgcgcggtgcgggcggacacgcgggccgaggccgtgcgtgtggccggaccgagctacatccagggtaacgtcgcggcggcgcagaacctcgcggcggtcgtcgacctcgccaacatccacgcctatcccggggccgagcacccggaaaccgacggcggcggcagcctcgcgcgcttcgtcgcggccgcgcgcccggtcttcggcgacgcgcccgtgatcgcgaccgagaacggctaccacacggcgctcgccaccggcagcccccccctgccgatctcgccgggactgcgcgcccgctacctcccgcggatgctgctctggagctacctccagagcgtgcggcggacctacctgtacgagctgatctccagcttcgaccgcggcgacgccgatcccgagagccgcttcggccttctcgcccacgacggtcgccccacacccgccttcgcggcggtgcgcaacctcgtccggctgttcggcgcccccgccggggagatcgccgccgttccggccgatcgcgacgtcacgctcggcagccccgttcccgatctcatcaccgcacggttcgcgcggcgggacggggcgacgctcgtcccgatctggctcggcctcgacggctgggaccggcgtagccgggcaccccggccggacttgccggcgcagaccgccgagctccggctgtcacggcagccccggcgggtgcgcctccatcgcttcgacgacgacggcgccgtgagcgtggtggagcttcccgcggacaggcgggtgccggtcccggtcacggaccgcctcggcgtcgtcgagctcacctag

SEQ ID NO: 6630 - DNA, 231 bp, Methylobacterium sp.
ttggacttctcacggcccggcaagccgaccgacaacgcgctggtcgagtcgttcaacggccggctgcgcgacgagtgcctaaacgcgaactggttcttgtcgttggccgacgcgaagagcaagatcgggacgtggcggcggcactacaacgagggccgtcctcacaccgccctggggtggctgacgtcccaggaattcgccctggcggcggcccggcaggccgccgaatga

SEQ ID NO: 6631 - DNA, 1593 bp, Methylobacterium sp.
atggcggatgtactgatcgtgggagccggtccggtcggtctgacgctcgcctgcgaactcgcccggcacggggcgcgctgccgggtcgtcgatgctgcggcgcggccgtcgccctattgccgcgcgatcggggttaccccgcgcacgctggaagtctgggaggacatgggcctcgcccgcgagatgatcgacgcgggtctctggctcacgggcctgcgcacgatcctgcacggccagccgccggtcgacgcggtcagtccaccgctcgatctgccctacgcgtcgctcggtctgccccaattcgaaaccgagcgcgtcctgaaccgtcagttggagcgcttcggagcccgggtcgagcgcggcctgcgcctgacggccctggagcaggacggcgccggaatccgcgcgcgcctgcaggaggcggatggtgcggtcgcggaggcgcactttcgctacgtcgtcggctgcgacggtgcccacagcacggtccggcgccagctcggcatcgcgttcgagggcgaggcctatccctggccgttcatgctcggtgacgtgcacatcgcctgggatgtaccctacggactcgcggtccgggcgctgcgactgaacgaggacgccccgcccgacatgttcatcgccatcccgctccccgagccgggccgctaccgcgtctcgatgctcgcgccgcagcatctggtgccggcgggcgggtcggaccacgggatccaggccgagcttcaaggcccgtcgctggccgacctgcaggccgtggccgacgatctcctgccggacggctcgcgcctgtcggacctgcgctggtcgtcggtgtaccgcatcagcatgcgcctcgccgccgcctatcggcgcggccgctgcttcctggcgggcgatgccgcccacatccacccgccgaccggcgggcaggggatgaacaccgggatccaggacgcctacaatctggcctggaagctcgccctggttcttcggggcgccagccccgaggctctcctcgacagctacgagggggagcggcgcccggtgggcgcggacgtgatcgcgcggacccggacagcgagcgagggatacggtcgggagcgcggcggcgcgccggaccgcctcgccgacacgcaggtcctcgtcagctaccggaacacggcctggatcgccggcgacgcgacggagccgacggaggccggcccgagggccggcgaccgggcgcccgacgtcaacgggctggtccgcgacgggctcggctttccgacgcggctcttcgacgccctccgcggcaccgagcacgtcctcctcatccatgctgccgggatgtcggacgccgtggccggccccgatctgccgatctgggcccgcgagcaccgttcccgcgtccgggtcgtcgtcatcggcagcgaggtgcccatcccgggcgtgacgacgctcgcggatccgacgggggccttcggtaaggcttacggcgcggggaccatggcctgcctgatccggccggacgggcacctcgcttggcgcggccggacgtggcgcgagcccggcttgcacgcgcatctccggcgcctgttcccgtcggccttcccgcaatga

SEQ ID NO: 6632 - DNA, 1695 bp, Methylobacterium sp.
atgagcgaccgggcggtgagctatgtccacggggcgatcggcgagcccctgctcggcctgaccatcggccaggccctggatcgcgccgccgcggcgtggccggatcacctggcgctggtcgcgcacgcccagggcgtccgatggacctggcgcgagctgagggaccaagccgacgccttcgcggccggcctgctcgccctcggccttcggcccggcgaccgtatcgggatctggtcgctcaaccgcgccgagtgggtgctgacccagttcgccgccgcccgtgcggggctgatcctggtgacgatcaacccggcctaccggctgtcggagctggaattcgcgctcaacaatgtcggctgcaccgctctggtgacggcgacggcgttcaagaccagcgattatctcgggatgctcgacaccctggcccccgaactcgccgcctccgggccgggccggctgtccgccgcccgcctgccgcacctgcgcacggtgatccagatcggcggaccgccggccccggggacggtcccgttcgacgcggtcgcggcccggggcgacgcggccggcaccggcgccctgcgcgacctcgccgacgcgatgcagttcgacgacgcggccaacatccagttcaccagcggcacgacgggcgccccgaagggcgtgacgctgacccaccacaacatcctcaacaacggccacttcgtcggccgcgcgatgcggctgaccgccgaggatcggatctgcatcccggtgccgctctaccattgcttcggcatggtgatgggcaatctcgcggccctgacccacggttgcgccatggtgtttccgggcgagggcttcgacccgcgcgcgacgctggagaccgtgcaggccgagcgctgcaccgcgctctacggcgtgccgaccatgttcatcgccgagctcgaccatcccgagttcgcgcaattcgatctccgctccctgcggaccgggatcatggcgggcgcgccgtgcccgatcgcggtgatgcgccgggtcgtggagcagatgaacatgcgcgacgtcaccatcgcgtacggcatgaccgagaccagcccggtgagcttccagagctcgagcgacgacccgctggagcggcgcgtcacgaccgtcggccggatccacccgcatctcgaggtcaagatcgtggatcccgaggggcgcgtgacccctcgggggacgcgcggcgagctgtgcacgcgcggctactcggtcatgctcggctactggggcgacgccgcgcggaccgcggaggtcctcgacgacgccggatggatgcacacaggcgacctcgcgacgctggatgcggagggctactgcaacatcgtcgggcggatcaaagacatggtcatacgcggcggcgagaacatctatccgcgcgagatcgaggagttcctcttccggcacccgcagatccaggatgtccaggtcttcggggtctccgacccgaaatacggggaggagctgtgcgcctggatcaggctgcgcgacggcgagaccctgtcggagccggcggtgcgcgcgttctgcgcggggcagatcgcgcatcagaagatcccgaaatacatccagttcgtcgacgccttcccgatgacggtctccggaaagatccagaaattcgtgatgcgtcggtgcgtggaggagcagctgggcctcgcgcgatccgagacggcctga

SEQ ID NO: 6633 - DNA, 1239 bp, Methylobacterium sp.
atgccgctccagccccacgagaccgccttcacgcaggcacccgcgccgccgcgcccggtgccggtccttccggacgccgccgcggcgctcgccgtcgccgaccggctggcggaggccttcgccgaggccgccgccgagcgcgacctggagcgccgcctgccggtcgccgagatcgcgcgcttcaccgaatccggcctctgggcgatcacggtgccgagggaatacggcggccccggcctcgacagcgccacggtcgcccaggtgatcgcccggatcgccgcggcggacggctccctcggccagatcccgcagaaccatttctacgccctggaggtgctccgcaacggcggcaccgaggcccagaagcgcgccctctacggccgcgtcctggcgggcgagcgcttcggcaacgcgctcgccgagaccggcgcgcgcgaccacacccgccgcacccgcctcgtgcgcgacccggccggctggactgtcgagggccgcaaagactactgcaccggctcgctctacgcccaccgcatccccaccctggccaatgccgaggaggacggccgggcggtcgcctacctcgtcttcgtcccccgggacgcgccgggcgtgaccctggtcgacgactgggacgggttcgggcagcggctcaccggctcgggctcggtcctgttcgaccgcgtcgccgtggagcccgactgggtggtgccgttccaggcctcgctggagcggcccaccgccctcggccccttcgcgcagatcctgcacgccgggatcgatctcggcatcggcgcgggcgccttcgcggcgaccttgcccttcgtgcgcgaccgcgcccggccgtggatcgattccggggtcgcgcgggcgagcgaggatcccctgaccctccacgcgctgggcgacgtccaggtgcgcctcgcggcggccgacgccctgctggcgcgggccggccgctacgtggacgccgcgcaggaagcccccgacgccgacagcgtcgcggcggcctccgtggcggtggccgaggcccgggcggcgagccaccgggccggcctgctcgcggccaacaagctcgtcgagctcggcggcacctcggccaccgaccgggccgaggcgctcgaccgctactggcgcgacgtccgcacccacaccctgcacgatccggtgcgctggaagtaccactggatcggcgcctaccacctcgacggccggcagccgccccggcacggagcgctctga

SEQ ID NO: 6634 - DNA, 552 bp, Methylobacterium sp.
ttgcaggacgcgtcggccccccccgagatccaggccgcagccgccccgatcgcggcggatgaacccgatcaagcgcccgctccggcgcctgaccaatcgcctgaccacttcgccgaggccgtccggaccggcgccgagaccgcgcccgacggcgcggtggacgtcccgtccgacccggtggccacagccgccgcgacgacgtccgaagccgagttcgaagcccggtccgaagccgagtccggaaccggggcggtgatcgacatcgccccccggccggtgccgggcgcgggtccgggactcgtcgcggccgcgaaccgaatcagcttcacccccgaccgcctcgacgtcgtcgagatcggctcgatcatcgcccgctacgtgcgcggcgagggcgaggcggccgtcgcgcatctgcgggcgctctcgggtgcccgctcgccggccgacgtcatccgcctgcaggtcggcgaggtccagcgggccgccgacgcgtccctgacctgctgggtcacggtggtcgggcaggcgagccgggtcgtcgcgtaccgctga

SEQ ID NO: 6635 - DNA, 1986 bp, Methylobacterium sp.
atggcccgccccgacctccgcgccctcacggatgacggcctgatccagctcgccaatgccgggctggtgaagcgggcgctgcgcgaggtggccgccggccaggggccggacctcgcggaggccggggacggcaccgtcgaggcgcgcttcgccgacggcacggtcacgcggctcggccccggccggcctcccggcgaggccagctgcacctgcccggcgagcgggatgtgccggcaccgggtcgccctcgtcgtcgcctaccgggccgccccggtcgcggacgggccggccgatgggtcttccgcgggggccgccgatggggccgccgagggtgcggcggtgccggccgcggcgccggtcgcctgggatcccggcaccctcgacggcgcggccctcgaggcggggctcggcggcgcggcggcggcggagttgcggcgccttctggcgggtgggatcacggtcgggctggagcggggcgccgtcccggcggcgcggctcccgaccgcgaccgtgcgcttcctcgtgcccgacgccgtcggctacgcccgctgcgactgcgcggccgggggcggctgcgcccacgtcgccctggcgatccgcgccttccgggattccgcgggcgcccccgagatccgcctcggcggcgcggccccggccggagcggaggcgaagccggcggagacggacctcgcggaggccgccgaccgggtggtcgccggcctgctggaggccggggtcgtgtccggaccggaggcgcacggcgcggccctcgtccggctccggcgggcggccgagaggcggggcgccacgcagctcctgctggcggaggcggacctcgacgggcaggtcgcggcctatgccgcgcgccacgccgcctacgacgcggccgtcgtcctggcgctcgccaccgaactcctcggccgcgtccggggcggtgaggccgccctcggcctcggccagccctacgagaccgccatgggcaagacccgcctcgtctccctgggtgcccggctcctcgcccgcgggcgcggcgccaccgcccgggtggcgctggccgacaccgataccggcgcgctcctggcgctggagcgcgcgttcgcgccgggcgaggccgaggcggatatcgcggccagcctgcccgggcgtctcctgagcccgggcctgtccgtctcgggcaccggccagggccagatcctgaccagcgtcgcgcggcgccgggccgacgggctcctcgccctcggccagggcgcgcggggccgcacggcgctgctgccgcgggacgccctggtggccctgccggcccccctggcggcgccggacgtcccgtcgatcctgcgccgcctcgccgaccggccgcccgtcttcctgcgcccgcgcgaccggctggaggccttccacgtcttccccgtcgaggcggtcctgggacaggcctgggcgcccggcgcccagacgtggcaggccgccgtcgcgctgccgggtgcgggcggcacgctgcatctcgcccgcgcctacgaccccgccgcgccgcacgccctggacgccctcgcgggcgcctgcgcggggcgctggggacccgtgcggcaggtcgccggcccggtgcggatcgcggacggcaccctggtctgcgatccctggtcggtgtcggtcgaccggctcgtcgtgcccgacctcgccgtccccgacggcgccggccacccgatcccgccggcgccggacctggggccggccacgctcctcgacgaggcggccgcgctcctggcgaacgccctccatgcggggcggcgggccttcgcggccagcgcccgcgccggcggcgccgacctggtcgcacgcctcgccgcgaccggctatccggccaccgccgcgcggctctccgccttcctctccgccaccctggcggctccgggcgcgcagtccgagcccttcgcccgagccgccctctgggtcgccgccatgcgcgacgatcccgggccggaagaggcctga

SEQ ID NO: 6636 - DNA, 357 bp, Methylobacterium sp.
atggccgtgaagcggatcgtcaccaacatccggaccacgcaggtcgaggcggcgcggtccttctacgcggaggtgctcggcctggaagtggtcatggatcacggctggatcctgaccttcgcggcccccgggatgtcggcgacgccgcagatcagcgtggccagcgcgggcggctcgggcacgccggttcccgacatctcggtcgaggtcgacgacctggcggaggtcctcgcccgcgtgaggcgggcgggcctgcccgtgctgtacggcccggcccgtgagccctggggcgtggagcggttctacgtccgcgacccgttcgaccggctggtcaacatcgtcgcccatctggcgtga

SEQ ID NO: 6637 - DNA, 1326 bp, Methylobacterium sp.
atgctggccctgctcggcctgtgcacgatcgcgctgctgctcgccgccatcctgaccaagcggatgtcgcccctcgtggcgctgatcgtcatcccggtcgcggccgccctgatcggcgggttcggattcgacaccggcaagttcgtcctcgccggcctgcagagcctcgcgggcgtcgtcggcatgttcgtgttcgcgatcctgttcttcggcatcgtcagcgatgccgggatgctcgacccgatcatcgaccggatcctcgcccgggtcggcacccgccccacccggatcgtgcccggcaccaccctgctggcgctgctgatccacctcgacgggtcgggcgcggtgacgttcctgatcaccatcccggcgatgctgccgctctacgaccgcgtcggcatcgaccggcgcgtcctggcctgcgccgcctcgatggcggcgggggtgaatttcctgccctggaccgggccgatgatccgcgcctccgcggccctcaagctgccgatccccgagatcttctcgcccctcgtgccggtacaggcggtcgggctcgtcttcatcttcgccgcctcgtactggctcggcctgcgggaggagcgccgtctggccctcgtccccggggcgacggggtccgcgggggccgcgcccggcccggccacgaccgcccggaccctcagcgacgcggagcgggccctgcgccggcccgaccgcttctggatcaacatcgtcctcacggccgcggtcctcgggacgatggtgttcctggccgagaaggtgccgccggcgctgatgttcatgctcggcacggcgctcgcgctggtcatcaactacccgcaggtcgacgcccagcggcagcgcgtcgacgcgcacgccagggccgcgatcctgatggcctcgatcctcctcgccgccggcgtgttcaccgggatcatgcagggcaccggcatgctcagggccatggcccagacggccgtcaccttcgtgcctcccgagatggggcgccacatcccgttcgggctcggcctcgtgtcgatgcccctgtcgatgctgttcgacccggactcgttctacttcggcgtcctgccggtggtggcggaggtggcccaccagctcggcgtcccgccggtccaggtcgcccagggggcgctgctcggccagatgacgacgggcttccccgtcagcccgctgacgcccgcgaccttcctggtctgcggcctgaccgggatcgacctcgccgaccaccagagattcaccttcccgttcctgctggcggcctcggtggtgatgaccctcgcctgcgtcgtcttcggcgtcttccccatctga

SEQ ID NO: 6638 - DNA, 1338 bp, Methylobacterium sp.
atgagaaccgtccgcctcggcgccggcgccggctatgccggagaccgcatcgagcccgccgtcgaactcgccgagcgcggcgacctcgactacctcgtgttcgagtgcctcgccgagcgcaccatcgcgctggcgcagcaggcgaagctgcgcgaccccgagggcggctacgatccgctgctggaggcgcgcctgcgggccgtgctcgggccgtgccgggcccgcggcatccgcatcgtcaccaacatgggcgccgccaacccggtcgccgccgcccggaaggccggggcgctcgcgcgggagatgggcctcgccggcctgcggatcgccgcggtgaccggcgacgacctgctcgacgcggtgcgggcgggcgacttcgtcctggaggagagcggcgagccggtcgccggcctcggcaaccgcgtcgtctcggcgaacgcctatctcggcgcggcgccgatcgtggccgccctcgcggacggcgccgacgtggtcatcaccggccgcgtcggcgacccggccctgttcctggcccccctggtgcacgccttcggctgggcgatgaacgactgggagcgcctgggccgcggcaccctcgcgggccacctcctcgaatgcgccggccagatcaccggcggctacttcgccgatccgggctgcaaggacgtaccggacctcgcgcgcctcggcttccccatcgggatcgtggccgaggacggcacggtcgagatcacgaaggtcgcgggctcgggcggccggatcagcctcgccacctgcaaggagcagctgctctacgaggtgcacgacccggcgcgctacatccagccggatgtggtcggcgacttctccgagatcgagatggagcaggtcggccccgaccgcgtccgggtgcgcggcgcgacgggcgcgccggcgacgggcctcctgaaggtctcggtcgggtacgtggattcctatatcggcgaggggcagatctcctacgccgggcccggcgccctggcccgcggccggctcgccctgtcggtggtgcgcgagcgcctcgccctcaccggcgtggcgacgaccgagctgcgctgcgacctgatcggcgtcgacgcgctccacggcgcggcgctgtcgggcgggcgggagccctacgaggtccgcctgcgggtcgccgggcggaccgatacccacgccgaggccgtgcggatcggcaacgaggtcgagacgctctacaccaacggcccggccggcggcggcggcgcctggaaatcggcccgcgaggtggtggcggtgcagtcggtcctcgtcccggccgccctcgcccggccgcgcgtgcacgtcgttgaagcctga

SEQ ID NO: 6639 - DNA, 345 bp, Methylobacterium sp.
atgaagctgcgcgcgctcgcccatgcccgcacgggcgacaagggcaacacgtcgaacatcgcgctgatcgcctacgacgcggcggattacgagcacctcgcggcgcacgtcacggccgagcgggtgtgggcgcatttccgcgggatcgtgaccggcgacgtgacccgctacgcgctgccgaagctcggggcgctgaacttcgtgctcacgggggcgctcggcggcggcgtcacccgctcgctcgccctcgacgcgcacggcaagggcctcggcgccgcgctcctcgatctggatatcccggacctcggcgccggccgagccgcacgcggaagcccgagaccgtga

SEQ ID NO: 6640 - DNA, 519 bp, Methylobacterium sp.
gtgaccctacggtcgcggacctggatcacggagatcgggcgggtcgcgcccgtcgcaagggagatcgcggtgccgcaaccccagtccgcctcgtcggccatgctgttccacatggtctccggagggccgcagccggtcgcccccttcagccacgcggtcgaggtcgacggcttcgtcttcgtcacgggtcagatgcccgacacgccggacgggcccggcgtcctgcccgacgggatcgaggcgcagacccggaacgtgatggccaatctcgcgacggtcctggccggcctcggcctgggcctcgagaacgtcgtcgtcgcgcgcgcgttcctgaccgagttcaagcgcgactacgccgccttcaacgccacctacaaatccttcttcccgcccgaccggctgccggcccgcacctgcgtgggcacgacggggctcgcctacgacgccctggtcgagatcgacctgatcgcccaccgcggcggcgcgacgtcgccgtcgtcggacgcgcgatcgggctga

SEQ ID NO: 6641 - DNA, 417 bp, Methylobacterium sp.
atgaccaacaagcttcttctgtcgctggcgacggccggcctcctcgccctcccggcggccgcccaggcgcagggcaccctgcggggcgcggccgagggtgcggcggtcggcgccgacgcggccggtccggtcggcggcatcgtcggcggcgcggtcggcgcggcgaccggcacggtcggcggcatcctgggcgtcgacgaccgcccgcggttccgcagctacgtccgcgagcgcggcgcgcgctcctacagctggggcggcccggtccgggtcggcaccgtgctgccggaggacagcgtcacctactacgacgtgcccaccgagtaccgggtgcgtccgggctaccgctacaccatcgtgaacgaccagcccgtcctggtcgatcgcggccaccgcatcgtcgaagtcatcgactga

SEQ ID NO: 6642 - DNA, 159 bp, Methylobacterium sp.; identical to SEQ ID NO: 5594

SEQ ID NO: 6643 - DNA, 930 bp, Methylobacterium sp.
atgctcagcgcgggaccggccgtgacgcgcctcccggcggccaccctcgcggcagccatcgccgcctccctcgccgcaaccctcctggcgccgtcgtcggcccgcgcgatcgactgccgcaaggcggccagcccgctcgagcgcatgatctgcgccgacccggcgctccggaaggcggacgccgccctgggtgcggcctattccggcctcctgcacagcacggacgacgccgagatccgcgcgatgctggtcgccagccagaagcgctgggtggcggcccgggacacgtggctcggcgacccggacgcggccgacgcgcgcgccgtcgtgctggaggcgatccgggcacggaccgaggacctgtccggccgctcgaagagcgatccggcccgaccgcactggatcgcggcggcgctgcggcagcgggccttcgcggcgcggttcaccggcggccccttcgcggggttcgacgcggcgtgcgacttcctgcccgtcgggcaggaccgggtctacgggtgcttcggcagccggcgctaccagaacggcgaccgggtctgcacgctgtccgacgactgggcgagcggccacacctccgagacgcgcacggtcgcgcgggtcgtcgacggcgccgcgcgcacggtcgcgacctgcacgatcggcgggggcgacgacgcggaatgcccgggtcccgacaacgccgacggccgctgggcacggcctgccgccccggccgccgccggcgcggcagcggcacccgcgggccctcggcccgtcctcgacgtcgagctggccccggacgccgatgccgagacctggctctcgacctgcctgaccgaccccgcctatccgccgcccgacccggttccggcggcccggacggccccgggatcgagcccgcccgcgccggcgggcgccccgagcagccggtga

SEQ ID NO: 6644 - DNA, 1293 bp, Methylobacterium sp.
atgcgcgccgccgctcccgagacgccctgcctcgccttcctggaggccctgccggtggcggagcgctggcagcgcgcccgggactggatcgcccgcgcgccccagcccttcttcgcgcagctgcgcgcgcgacggaccgccctggattgcggcgcggccatcctcgtcgccggccgcgccgaggtcgaggagatcctgtccctgccgcaggtcttctccgtcgcgctctacaagcccaagatgggcgagttcatgctggcgctcgacggcacggaggtgaattaccgcgacaaggcggtcatgcgcgccgtgctgtcctggcgcgacctcccggcgatccgcgatctggcgggcgccgagaccgacgcggccctcgacgcgggtctcgaccagggcggcggatccatcgacgtcgtggcgtcggtctcgcgccgcgtcccgctgcggatcgtgcagcgcttcttcgggttcgcggcgcccgatgccgacctgctgcgctggtcgtacgcgaaccagttcgaccagttcaacaacctccccttcgacgagcgcccggacgccgacgcgatccacgcggcggcggatctggcgcgccaggagatgcgggcggccttcgccaggatcatcccggcgcgcgtcgcggcgatcgaggccggcgccgacctgcccgacgacgtcctcacccggctgctccggctgcacctgccggcggcgaccggcttcggcatggaccgcgtcgtcatcaacgtcggcggcctgctgatcggggccatcgagaccacgtcggaggccgtggtgcacgccctcgcggagctcctcggccggccgcagatcctcgcggcggcccgcgcggccgcccggaccggacccgccgccttcgacggctacgtgtgggaggcgctgcgcttcgcgccgatcgtcgccttcatgttccgccaggcggagaccgaccacgtgctcggccggggcagcccggccgagagcgggatcgccaagggccgggtcgtcctgcccctcagcctgtcggcgatgttcgacgcgaccggcgtgcccgacccggaccgcttcgacccggcccgcccggagcagacctatctccatttcggccggggccatcacgagtgcctcggccgctacgtggcgggcgcgatggtcccggagatcgttcgccgcatcctcctgcgcgacgccgtgcgggccgagggcgcggtcgaggacgggggcacgccgttcccgaccgcgttccggatctcctgcgccggccggccggcgggggccgccgggcccggttag

SEQ ID NO: 6645 - DNA, 267 bp, Methylobacterium sp.
cccgagacggcgaccccgcatccggccccggcgcccgccccgggcgcggcgcccgcgcaggccgccccgcgcaccgccaacagtgcccgcgcggagcgccggcggcgctcctacgcggcctgcaaccgcgcctcgcatcagcgcgggttgcgcggcggcaagcgccggcgcttcctgatccggtgccggctcggctacgagcggacccggatccccggcggccagcccgccgcggccgcgccggcccagccgggccggaagccgtga

SEQ ID NO: 6646 - DNA, 285 bp, Methylobacterium sp.
atgcgcattctcgttctcgccgcgctcgcaggtgtcggcctcggcgtcctggctgtccccgcctcggccgttcccgcgggccccgcgaccggcctctcgtcgccgtccgacatgctcaccgacgtccggatgaggcgccatcacgtgcggcgacattcgatgtcgcgggtccagcggcgctatccgggtgcgagcttcgtccggaacaagacccccggctctgcgggcggcagcagccggggtaacggcgttaccggcagctacgccgcgcccagcggacggtag

SEQ ID NO: 6647 - DNA, 258 bp, Methylobacterium sp.
atggcgaacaacctgaccgtctccgagctgcgcaaggccgccgagatcagcgatcaggagatcgacgctgcggtcgacgccgtgctcgcggatctcgccaccgaatcatatccgctggcgaagggctggacgctcgacctcgtcgagacgcgccgcacgaacacacgcgcgactgaggcgctcaccaccgacaagccggcctggaagcgcaacatggtccggaccgcgatcctgctggcgcacccggtgaagggatga

SEQ ID NO: 6648 - DNA, 231 bp, Methylobacterium sp.
gtggctgagaccttcaccgccgctgacctcgctgcctgcgccgagcgtgagcttgcccagcgccgacgcgcctatccgcgctgggtcgaggccaagcgcatgacgcaggctctggccgaccgtcagaccgcgctcatggaggcgatcgcacgcaagctccgcgctgaggccgatgccgagggcgcgaagggggatctgttcggcgcagcggcggagatgtgccgtgaatga

SEQ ID NO: 6649 - DNA, 294 bp, Methylobacterium sp.
atggcccaggaggtcaagctcaccgtgaccctggaggcggcgctcgccgaccgattgaaggttgccgcgaccgagcgcggctggtcccccgaaagcctcgcggccgattgcgtcgctcaggccctggaggtggcgatccgccatcgggtcctgatcgagcggatggagcagatcgacggcgccatcctcgacatggcccaggccgtcggtgacctcggtgcgccatcgggcggtatcgacctgtccaaggtctgccgcctccgagcgggcgccgccgccgatccggcgcgatga

SEQ ID NO: 6650 - DNA, 279 bp, Methylobacterium sp.
atgcgtggcggccgcaggccagcccggctggaccacagcctccgtctctgggcgcctcaaggcgtttcagctcttccgacgacggacacgcggcgcggccccgtcatcggcgtcgtcgacccgcaggcggcgatcaaacgcgacatcgccggccacaaccgacacgccgagcccgtcatctggacccggccggccaccgatatcctcgcagccgtcagcctggcctactggtaccctttcgggaacggatcgggcttgatcagctcggggctggtgtag

SEQ ID NO: 6651 - DNA, 1188 bp, Methylobacterium sp.
atggcgatcgggctgctgctcctgagcgaggtggcggctatggcgacgtggttcgccaccaccgcctcgatcggcgcgatccgcacgcagtggacgctgagcccgttccaggaggccctgctcaccaacagcgtgcaggccgggttcgtcgccggcaccctggtcagcgcgctgctggggctggccgaccggttcgacctgcgccggctgttctgcggctgcgccgtcgcggccggtctcgccaacctcctgatgctggccttcgcgccgacctcgccgatggtgccgctgctgcgcttcgtgacgggggcctgcatggccggcgtctacccggtcggcatgaagatcgccgcgacctgggcggtgggtgacctggggctgctgatcggccttctggtgggcgcgctcaccctcggctcggcgctgccccacctcgtcgcggccctcggccagctcgactggcatctgccggtgctcggtgcggcgttgggcgccctcctctcggcggccctgatccgcttcgtgcaactcgggccgatccggtcggaggccccgcccctgcgcttggagaacgccctggaggcgtggcgcaatcgcggcgtgcgcttggccaatctcggctatctcggccacatgtgggagctctacgcgatgtgggcctggatcggtgccttcatggcggcgagcttccgtgagcgttacggcaacgcgccgccgttcccgccggaactggccgccttcgcggtggtggcggccggggcgttcggcgcgatgctgggcggctgggcggccgatcgactcgggcgcactctggtcaccggcgcctcgatgctggccagcggctgctgtgccatcgcggtgggtttcctgttcggcggccctgcctgggcggtgctggcggtgggcgtgctctggggcgtcgcggtgatcgccgattcggcgcagttctcggcggcggtgagcgagctgagcgaccgcaggctgatcggcacgatgctcaccgtgcagacctgcctcggctttctcctgacgctcgtcagtatccagctcatcgccttcgccgggacattcctcggctggcgcttcgccttcgcgctgctggccgtggggccgttcctgggtctcgcttcgatgctgcggctgcggcgcctacccgaggccaagcggctggcgggaggacgcaagtga

SEQ ID NO: 6652 - DNA, 348 bp, Methylobacterium sp.
atggtcgagatcctcgccctcccggtccggcctcacggcacgcaccagttcgaccgactgcacgcggacttagccgccgcgcacgaacgtggcgcggatctcggcccccgagcccctcacatccaagcaggtggcgacaggctgctcgaactgacttgcgccttggaacgcgcgatcgaggatctggatctcacgttgatcaagctcggtctccgggatccggacatgcgtgaagccctgcgagacttcgtcatcaagaccgagagcctcgccaacacggcgcagagcttcgctcacaccgtgcacggcctcgccggcctagcgcagcggtacccagcgaccctctga

SEQ ID NO: 6653 - DNA, 213 bp, Methylobacterium sp.
atgacaatcaccaccactataaatgccatcggactggtgaaggcgacggagatgatccagtcggcaagggcggaagctgcgatcgagcacaaagcggggctgcataccgtctcaatgccggcgcccccgccgaacgacgcaggcatccaaaggcaaaagaatgacccgaaacttctcgcatcgcaggagcgtgtggtggacatcaccgtctga

SEQ ID NO: 6654 - DNA, 306 bp, Methylobacterium sp.
gtggccgtgcctcgccgcgacgagacccgcgatgaatcggcatcggctgcgtggccggtctcgctgcgcgctggatcgaacagcggccgggtgacgttcctcatcgcctacatcgcccagacaggaggaacgctcatgcgaattcgctatctgctgccgctcgtcggcttgctcgcgctcacggcctgcaaggacgagaagaaggccgagccccccccgccgcctccgcctcccgccggcacggcgccggcgaaccctgcgcctccggccacgacgacgaatccggctcccgccaacaagccgtag

SEQ ID NO: 6655 - DNA, 1356 bp, Methylobacterium sp.
atggcatccttccaggattttcaggacggctacgagcggacctgggcgtcgctccagatccggccggagaagctcgcgaccgtgcgcaagctcgcgcagcagctcgccgccggcaagccgcgctaccaggagatcgaggcgcgcaccggcgtgccctggtggttcatcgggctctgccactaccgggaatcagccttcgatttcgacacgtatctcggcaacggacagaagctcggacggcgcaccacgatcgtcccgaaggggcgcgggccgttcacggggccgcaggccttcgtcgaaggggcggtcgacgcgctgcgcctccagggcctggtcgggctcggcgactggagcgtcgcgcgggccctctaccggctcgagggcttcaacggctacggctaccacggccggggcgtgaactcgccgtatctctggggcggatcgacggcctacgggccgccgggcgcgcgcggcggcaagttcgtgcgcgaccacgtgttcgacccgaacgtggtcgacacgcagatcggcaccgcggtgatcctgcggagcctcatcgacctcgacgcgacggtcgcgctcgcggcgccgcgcgccgtcgaggcggccgtgtcccgcgagcccgacgacgaactcgccgacagcacgctctgggtccagcaatcgctcaatcgcctcggcgcgacgccgcccctcgtcgaggacggccggaacgggccgcggaccatgacggccgtcgcgacgttccaggcgcggtgcggtctggacgataccggcctcgcggacgcgcgcacgatcgccgccatccaggaggcgctgcggccggcggcgccggaccacgcggtgctgacgcggatccaggacctggagcgacagctcgccgcgcgggcggtcaccccgatgcagcccgccccgatgcaacctgcctcgatgcccccggtggtgatcgcgccggccgcgccgcccgccgacgtcgcggcgcggctcgacgagttcctccaggccctgcgccgacagatcgacggtgcgcgcctcccgaccgccccgatcttgcccggcccgcccgcggcgcgtcccgacggcgcggtcctcgggccggtcaacggcgcgctcgggcagacgatcgggcagctgctctccggcaagaagtcggcgatcggcatcatcggcgccgtcgccacgcagatcctgtcccaggtgccgctcaacaccggtctcgggcaggtgctcgcacagctcacgcccgccttcgggctgagcccctacacgatgccgatcttcatcgggctgacggcgtggggcgcgctcgggaagttcgagaagtggaacgcacgcgcggggcaggcgaccccgtag

SEQ ID NO: 6656 - DNA, 120 bp, Methylobacterium sp.
ggggtgagcctgacgggggcggtcgccgagggcgtgcggctgtcggtgggctacaccggcgacgtccgcccgggcgccaccgcccaggtgttcaccgtaggccttcaggccgcgtggtag

SEQ ID NO: 6657 - DNA, 120 bp, Methylobacterium sp.
ggggtgagcctgacgggggcggtcgccgagggcgtgcggctgtcggtgggctataccggcgacgtccgcccgggcgccaccgcccaggtgttcaccgccggcctccaagccgcgtggtga

SEQ ID NO: 6658 - DNA, 120 bp, Methylobacterium sp.
ggggtgagcctgacgggggcggtcgccgagggcgtgcggctgtcggtgggctataccggcgacgtccgcccgggcgccaccgcccaggtgttcaccgccggcctccaggccgcgtggtga

SEQ ID NO: 6659 - DNA, 429 bp, Methylobacterium sp.
atggtcgagcatatggtcgagccgccgcggaccgttcggcggcttgaggtcatcaccaccgcgagcggccggcgacgctggtcgcagtccgagcgcagacggatcctcgctgaggccatggcaccgggtgccgtcgtgtcggttgtcgcgcgccggaacgggatgagcccgcagcacctgtttacctggctgcgcgaggcgcggaaggcgccgacagtcggtggaatggcagcggccttagtaccggttctcctcgatgagcctgcctctgcgtcatccgcatcgtcgccccgggccggcatccgtcctctgggcagccctgttaccgggatcgaggtggagatggccggcgccgtggtgcgcatcggtgcggacgcgagccaggctcagatcaccgcggtgatccgggcgctgaaggcttgtccatga

SEQ ID NO: 6660 - DNA, 180 bp, Methylobacterium sp.
atgacagaccagaccggacgacccgcgcgggagggggccgaggccccggtggccgcgaagactgagacgccgcgcgagaagctcggccagatggaggacaaggcgcggtccgacacggatctcggcgaggcgatcgaccgcgccaccgccgccgtcggccaggacgacgggaagcgctga

SEQ ID NO: 6661 - DNA, 753 bp, Methylobacterium sp.
atgacgttcacggcacacaacatccgcctcgcggacgggtccgagaccttgcccgaggcgggctggctgatcggcgacagcccctggacccaggcggccctgcgctcgctccggctgttctacgggcacaggctggccggccggtcgatcgtcgatctgggctgcctcgagggcggctacacgctcgaattcgcccgcgccgggatgcgcgccaccggtgtcgaggtgcgccgctccaacttcgagaactgcctgcgggtcaaggaggggacgggcgtccccgacctcgccttcgtcaacgacgacgtgtggaatctggcggcccacggccccttcgatgccgccttctgctgcggactgctctaccacctcgacaggccggccgccttcatccgcctcatggccgaatgcgtccgcgacgtggtcatcctgcacacgcatttcgcgaccgagaccaacgaggccctgttccagctctctccgcccgccgagaacgaaggtctgccgggtcgctggatgcacgagcacgatctcgacgacacgagccagctcgaggcgcacaaatggacctcgtggagcaacaagcgctccttctggcccaccaagccggccctgatccagcttctcaaggagtgcggcttcgacatggtctacgagcagtacgacatgctgggacacgacatccgcggctcgatggagagcggctactaccaccagcagggccggagcatgttcgtggccatgcggacctga

SEQ ID NO: 6662 - DNA, 711 bp, Methylobacterium sp.
atgttcgcgacgagcctcgccctgtgggtgatagccatcctgcttctgctctcttggttgcatctgcaggagcggctcaccgagcggtgtcgccgcgcgatccgaccgcagatcgagcgcctgatcatcgagaaccggtggatggagcaccacgcgcgcggagcggcagcgttcgaggcgctctgggaccgggaactcgtcaggctgcaccgcgcccatctctcgcgcccgctccgcgccgtcgtccggttccgcggcttcaggcgcctggtcagcgcggaattcgcgtcgatcctgccggccgaggtcgcgtcctggaccttcctcgaccgcgtgagcgcctcgcaggcgcattacgaggcgctgatgctgcggtgcctgaaggcggccggctggcgcctggattaccaggatcaggaccacttcgtgctcctccgggcccgaacgcgcgtcgtcgtttgcctgcattgggcggaccgcgacgtcgcgtgtctcccgatctccgacgtcgcggcggcggcggagcgcgccgggtcgaccacggcgtgcgtgatgacgaatggtcggttcagcggcgcggcgcgcgccatggcggaggagcagaacgtcctggcgctgcactgctcgcagatcgacctgctgctgccccgggacaagtcgacggtcgcgccccgcacggcccgcggaatcggtttccggctcgccgcctga

SEQ ID NO: 6663 - DNA, 1200 bp, Methylobacterium sp.
gtggcggccgccgcgttcggcgccgctgccctcaccgccctgcccgcctccgcgcagtacgcggatggcggcatcaagatcggcatcctgaccgacatgtccggcggatactcggatctggccggccgcggctcggtgacggccgcgcagctcgcggtcgaggatttcggacgtccgatcaacggtcggaaggtcgagctcgtcttcgccgatcaccagaacaaggcggacatcgcctcgtcgatcgcgcgccggtggttcgataccgagggcgtcgacgccatcttcgacaccaattcctcggtcgccgggctggcggtgcgcgaggtcgcgcgcagcaagggcaagatcgacatcaactccggcgccggctccatggcactgaccaacgccgcgtgctcgccgaccggcgcccactggtcgtgggatacccactcgctcgcggccggcaccgccgcggcgctggcggacgatccgaagaacacgtggttcttcattacggccgactacaccttcgggcacgatctggaggcgcaggtcacccgggtcgtgaaggccaagggcggcacggtgctcgggtcggtcaagcacccgttccccaatccggatttctcatcctacctgctgcaggcacaagcgtcgggcgcgaagatcatcggcatggccaacgccggtgccgacacgatcaacaccatcaagcaggcaagcgagttcggcatcctgcagggtggccagaggctgggcgggctcaacatcttcctgaccgacatctactccgtcggattgccggcggcgcagggcatgatcctgacgacgggcttctactgggacatggacgaccagacgcgcgccttcgcgcggcgcttcggcgagcggatgggcggccggatgccgaccatggtccaggccggcgactactcggcggttctccacttcctgaaggcggccgaagccgccggcacggatgacggcctgaaggtgatggccaagatgcgcgagctgccgatccaggacttcttcgcccgcaacgccacgctgcgcccggacggccgcatggtccacgacatgtacctcgcccaggtgaagtccccggcggaatcgacggggccctgggacttctacaagatcctgaagacgatcccgggcgaccaggcgttccagccgctctccgagagcacgtgcaagctggtgaagggctga

SEQ ID NO: 6664 - DNA, 288 bp, Methylobacterium sp.
atgatcgagaccttcgacaaggccgggagcctggacgtccgcagggcgaaccgcgcggagcatctcgtctacctcgaccggatcaaggaccggctcctggcctgcggcgcgaagctgaacgacgacgggagcgacgccggcggcggcctctacgtcgtcgacgtcgagacccgcgcggaggccgaggcgctcatccacgcggacccgttctacaaggtcgggctcttcgagcgcgtcgagatccggcgctggcgcaaggcctacctggacggccgcagctatctctga

SEQ ID NO: 6665 - DNA, 807 bp, Methylobacterium sp.
atgaccgagcggcagacgaaccccgaggcgatcgtccggcgcgcgagccacgccggacggcgcgtcctcgtcacgggggccggccgcgggatcggccgggcgatcgcggaggggttcggcgcgcggggcgccctggtgggcgtggccgacgtgaacccggacgacgtcgcggcgaccgtcgcggcgatcgagggcggagacggtcgcgccctgccgctgcgcctcgacgtcgccgactacgcggccgtcgaggcggccctgtcggaggccgccgccgcgatgggcggcgcgttcgacacggtggtcaacaacgccggcatctcgcccaagcacgacggggcggcccaccgggtctgggagatggacccggcggagtggagccgcgtcgtcgcggtcaacctgacgggggcgttcaacaccgtccgcgcgctggcgcccgcgatgtgcccggccgggcgcggctggatcgtcaacatgtcgtcggtggcggccaagacccactccccgatcgtcgcctgccactacgcggcctcgaaggccggcctgatcgggctcaccaagcacctcgcggccgagctcggcccgttcggcatccgcgtcaacgcgatcgcgccggggcggatcgagaccccgatggtccgggcggtgggccgcgccgtcaacgacgagcaggtgcgcctgaccccgatgggccggctcggcgcccccgaggaagtcgcggatctcgccctctacctgacctccgccgaggccagcttcgtcaccggccagaccgtcgacgtcgccggcggcctctacatgacgtga

SEQ ID NO: 6666 - DNA, 1710 bp, Methylobacterium sp.
gtggcggtgccggtcgcggtcggcaacccgttcatctaccacgtcttcatcacgatctgcgtcttcgccgcgctctcgaccgcctggaacatcgtcggcggctacgccggccagctctccctcggccacggcatcttctacggcctcggcgcctattgcgggatgctgctcgtcggcgccgggatcagcccgtggatcggcatggtcgccggcgccgccctcgccgtgctggtggcgctggcgatcagctacccgtgcttccggctccacgggccgttcttctcgttggcgaccatcgccttcctcgaagtcttccgcgtcctggcactgcatttccgggacctgaccggcggcgccaccggtctgatgatcccgctgaagttcggctggacgtggatggtgttccgggatcgctggccgccgctggccatcgccttcgggctcctcctgctgaccctggcggtcgcgtggtggatgcgcagccaccggatcggcttctacctcgtcgccacccgcgagcgggaatcggccgcgcgcgccgccggcgtgcgcaccgtgcgggtgcggctcgtcgccgtggcggtgtcgggggcgctcaccgcgatggtcggcaccttccacgccatgtacctgaccttcatcgagccggcggcgatgttctcgctgaccctgtcgatccagatcgcgatgttcgcgctgatcggcggactcggcacggtgttcgggccgctcctcggcgcgctgctcctcgtgccgatcaccgagctggcccgcggctggctcggcgccaaggctctggggctccacggcctcgtctacggcctcgttctggtgctcgtcgtcctgttcctgcccaacgggctgatgggcctcgtgtcccgcttcgcgcgggcccgcgcgggcggccgcggcgcgcaggcggcgtcggttccggccgttccgcgggccccggagcggccgcccgtcggcgcggacctgatccgggtcgagggcctgcagaagcgcttcggcggcctgcacgtcaccaacgatgtcggcttcacgctccgggagggcgagatcctcggcctgatcggccccaacggggcgggcaagaccaccgtcttcaacatgatctcgggcttcctcaagcccgatgccggaacggtgagcgtccgcgcgccggacgggacgtggcaccggccgggccggccgtcggatttcgcgacgctcggcgtcggccgcaccttccagatcgtgcagcccttcgcggccatgacggtggaggagaacatcatggtcggcgcgttccaccgccacagcgacgtccgcgaggcccgggcggtcgcgcgcgagaccgccgagcggatggggctcgcgccctggctcgggagcgaggcgcgcggcctcaccatcggcggcctcaagcggctcgaggtcgcccgcgtgatggcgatgcgcccgcgcgtgcttctgctcgacgaggtcatggccggcatcaaccagaccgacgtgcgccgcgccatcgacctgatgctgtcgatccgcgacaccggcgtcagcatcatcgcgatcgagcacgtcatgcaggcggtgatggcgctctccgaccgggtgatcgtcctgagttccgggcagatcatcgcccagggtagcccgcaggacgtggtgcgcgacgcagccgtgatcgaggcgtatctcggcaaggagttcgcccatgctcacgcttga

SEQ ID NO: 6667 - DNA, 1011 bp, Methylobacterium sp.
atgggcatgcgagccgtgatcgccgacggacagggcggtcccgacgtcctccggatcgtcgagcgtccgcgcccggagccgggccagggccaggtgctcgtgcgcgtcgaggccgcgggcatcaaccgtccggacgtgatgcagcgcgagggccgctacccgccgccctccggcgcctcggacgtgctcgggctcgaactcgccgggatcgtcgaggcgctcgggcccggcgcgggccgcttccggatcggggaccgggtgatggcgctggtccatagcggcgcctacgccgagtgggccgtcgtcgacgaggcggtcgctctgcccgtgccggagggcctcccggcggtcgaggcgggggcgatccccgagacctacttcaccgtctggagcaacgtgttcgagcgcgcccggctgcaggcgggcgagagcctcctgatccacggcggctcctcgggtatcggcaccacggcgatcctgctggcgaaggcccggggcgcccgggtgatcgtcaccgcgggctcgcccgagaaatgcgcggcctgcctgacgctcggcgcggacgcggccatcgattatcggcgggaggatttcgtcgccgcggccagggccgccaccggcgggagcgggcccgacgtgatcctcgacatggtcggcggcccctacatcgcccgcaacctcgatgccgtggcggtcgacgggcgcatcgcgcagatcgccttccagcagggctcgcgggtggcggagatcgacttccagccgctgctgatgaagcgggtgacgctcacgggctcgacgctgcgcgcccggccggtcgccctgaaggcgcgcctcgccgaggccctcgccgagcacgtcctgccgctgctcgcggcgggccgggcgcggccgccgatcgattccgtgttcccgttcgagcgggtcgcggacgcccatgcccgcatggatgcgggccagcatatcgggaagatcgtcctgtcgatggacgacgccgcgcaggggagccgctga

SEQ ID NO: 6668 - DNA, 363 bp, Methylobacterium sp.
atgacttacgtgagcgggttcgtcacgccggttcccgacgcgaaccgggaggcctatgtcgcgtcggccagggcggcctgggcgctgttccgggagtacggcgcgctccaccagatggaggcctggggcgacaacgttccggaggtcgagcggaccgatttccggcggtccgtcgcccttcgcgacggcgagagcgtcgtcctcgggtggatcctctggcccgaccgggaaacggcagaccggtgcgaggccgcgatgcggaccgatccgcgcttccgcgatctgacaatgccgttcgacggggcgcggatgatcttcggaggtttcaccgcggtcttcgaagcgtcgcgcggggcggcgtag

SEQ ID NO: 6669 - DNA, 315 bp, Methylobacterium sp.
atgccagatctcgccgaggtggagctctactgcgcggaagcccgggatatcctcgctcacgcggagaacatcgttgccgacctggaccggagaggtgcctgcgaggggcactgcctgatggcgaaccagggcctcgcggcgctgcggaacctcgaccgcatcatcgagcggcaccgcaggcggctggcgttcctggccctgcccaacgcggtcggcccgtccccacctccgtcccctccgcggaagcggaactggctgctcttcctccggcggcgcggcgggtacgcgggccatggcatcgaggcgcattcctaa

SEQ ID NO: 6670 - DNA, 1155 bp, Methylobacterium sp.
atgggcctcagccatcaccgcatcggaatcctgttctccgcggacggaccctacggtctcgtcgggcgggcgatgctgaacggcgcgctcctggcggtcgacgaggtgaacgcgcggggcgactgcgtcctggagccggtgatccgcgatccgcagggcgccctcgcgggctacgtcgccggcgccgagcggctcctcgacgcggggatccgccacgtcgtcggctgctacacttcgtcgagccgcaaggagatcatcccgatcttcgagaagcgggacgcgttgctctggtatccgtcgcattacgagggcttcgagacctcggcgaacgtggtctacaccggcgcggcgccgaatcagcacatcgtcccgctggtgcggcacctcctcgcccggggcggccgcacggccttctgcgtcggctccaactacatctgggcctgggagaacaaccggatcctgcgggagacgctggcgatcgccggcggcgacgtcgcgggcgagcgctacctcgcggtgggcgagactgccttcgatcaggtgatcgcggcgatcctggccgcgaagccggacttcgtcttcaacacgctgatcggcatctcggcgtaccggttcttccgcgacttccggagtgcctgcgcggcgcgcggcatcgaccaggcgcggaccatgccggtggcgagctgcagcctcgccgagccggaactggaggcgatcgggccggaggcggtcgacggccacctgtcctccagcgtctacttcacgtcgatcgacacgccccgcaaccgcgccttcatggcggcctacgcggcgcgtttccccgaaggcccgaccccctcggcggatgcggaatcctcgtacatcgcggtgcatctcctggcgcgggcgctggcgcgggccgggaccgaggaggccgcgacggtgcgccgggcagcctgcgccgacgagttcgaggcgccccagggaccggtgcgcctcgacgagacgaccctccacgcctgcctgaccccccggatcggcctctcgacggcggcggcccgcttcaccatcgtggcgcaggccgaggcgccggtcgcgccggacccctacctggtgcgcagtgatccgcgcgtcgtgccggtgagccggcgcccgcacctgaaggtggtgccatga

SEQ ID NO: 6671 - DNA, 642 bp, Methylobacterium sp.
atgacgacgccccggctgatccagaatttcagcggtgcgcaggccctgctgatcgcgccgccgagcaccgccacggacgtcctggcgggcaccctgatgaagctcgggctgaccgtggcctcggtcctcccggccggcgaggcgccgtggctcgatttcgagatcctcgaccccgagcaccacatcgtcatcgtggacggcgacctgccgctgccgggcctcgcggcgagcgccgtgcccgacctgccgccggtcccggtggtcgggctcgtgggcgtcgaggcgccgagccggctcaaggggctgctccagctcggcgcgaccggcctgctgcgcaagccgatccacggcgcctcggtctacgccgccctgttcctggcggtgaacgagcacaaccggcgccgtctcctcgaagaacggcttgcccgccacgaggagcggcggcgcggccggcgccacgtcgtcaaggcgatcctccggctgatgcaggagcatggcctcgacgacgacgcggcctacgagacgctgcggcgcgacgccatgcgcgcccggcagcccctggaagcctactgcgaggcgctggtccgcgcccgtccgtccgtcgccgcgccggccctctcgccgcggctggcccgatcctga

SEQ ID NO: 6672 - DNA, 621 bp, Methylobacterium sp.
gtggcggccctccgcgccaggggcgtggcggcgaccgggcgcgccgtcgacgtcgccgattccgccgccctgcgcggctgggtcgccgaggccgccgatgagctcggcggcctcgacatcgtggtgccgaacgtcagcgcgctggcggtcggcagcgacgaggcggcgtggcgcagcggtttcgcggtcgacatgatgggcaccgtcacggcggtcgaggcggcgatgccgtacctcgagcgctccgaggccggcgcgatcgtcgtcatctccagcgtctccgggcgcgagatcgacttcgcggaggggccctacggcgccttcaaggcggcgctgatccactacgcgcagggcctggccttccagctcgcgccccggaacatccgggccaactcggtctcgcccggcaacacctacttcgcgggcggcgtctggcaccagatcgagaccggcaaccccgcgctgttcgccgaggcgctccggctgaacccgacgggacggatggcgcggccggaggaggtggcccgcgcggccgtgttcctggcgagcccggcggcgagcttcatcaccggcaccaacctcgtggtcgacggcagcctgacccgcggcgtgcagttctga

SEQ ID NO: 6673 - DNA, 147 bp, Methylobacterium sp.
atgatcgccagcttcctcgccatctttgtcgccttcgccgcctgccaggcgctgctcaccgtcaagttcgcggacttcctctccgccgaccgtgcccggaacactgtcgagccgaccgccgacgtcgcgaacgccaagctcgcctga

SEQ ID NO: 6674 - DNA, 99 bp, Methylobacterium sp.
atgaagctcaaggctctctcctacgtcatgatcggcgccttcgtgagcggcctgctcatgacgttcgtcggttcggccaccgcgctgctcgggcagtaa

SEQ ID NO: 6675 - DNA, 306 bp, Methylobacterium sp.
gtggaagaggtggaggccgacatcgaggccgacgtggaagcggacgtcgaggccgacgtggaggctgtggacgccgacgtcgcggccggtcgggacgcgccaccgggcgggctggactgcccgggcttgccgggcgcggcgtccggcttccagccgccggggccgggcttgtcggcgtcgctgggtggtggcgtcacgggcaagtcctccaactcttcggcgtcgccgcgcccccctagcaccgcggcggcgccgggcgcgagggcgagatacggcggcccggcctccctgtcaccgcgcggttag

SEQ ID NO: 6676 - DNA, 750 bp, Methylobacterium sp.
atgctcgaactctcgctcgacgctgatacaatcgacgcgcagggcccccggctccccgacagcgtgcagtatcacctcggccatctgctcgcggcgacctacgcgcaggacaacgtcgagccgaccatcgcggatcgcttcgccgaactgctgaggctgctcgacggcgccttcggccgggcgcaggacgggcgcgagaaggcgttccaggcctcgctcctctctctggtgccgaacctgcagcgcttcgcccgctcgctcctgcgcagccatgtcggtgccgacgacctcctgcagaacacgctcctccgggcctggcgctcgcgcgcgagcttcgcgccgggcacgaaccttgaagcgtggctgttcaccatcatgcgcaaccagttctacaacgagcaccgcaagcgtgggcgcgaggtgcaggacgaggacggcgcgcaggcggagcggatggtctcgctgcccgagcagggcggccatctcgacctgagcgacgtccaggccgccctcgaccgcctggcgccgccgatgcggcaggcgctggtgctcgtggcgatcgagaacctcacttacgaggagaccgccgccgtcatgcagtgccgcatcggcacggtgaagagccgggtctggcgggcccggacgcagctcgccgagatgctgggctacaccggcctcgaggtcggcagcgacgacatcatgctggccgccgcgggaccgaagggccggaaatccaccgctgtctcgtga

SEQ ID NO: 6677 - DNA, 1302 bp, Methylobacterium sp.
ttgcgctggctcatgatcggcctctgcatggccgccaacgccatcaactacatcgaccgcgccaacctcgcggtcgccgcgccatccatgaccaaggaactcgggctcgacgccaccgacatgggcctgatcctgtcgggcttcttctggacctacgcgatcatgcagctgcccttcggctacgtggccgaccgggtcggcgcgcggctctccctcgtcgtcgcggtggtctggtggtcggcctgcacggcgctgaccgcggtcggacgggggttcctgtccctgctcggcctgcgcatgctgctcggtatcggtgaggccggggcctacccgtccttcgccaaggtcgcggcctcgtggttcccgcgcagcgagcgcagcttcgccagcagcatcttcgacagcggctcccgggtgggctccgccctggcgatcccgctggtctcctgggtcatcgcgacgctgggctggcgggaatccttcgtcgtcaccggcgtgctgggcttcgtctgggcggtgttctggatgtggctctaccgcgagcccgagaaccacccgaaggtgtcgccggaggagctcgcccggctccgggccgcgcaggagcggccgaagaccatcgacgcggcggacgcccagaaccaggtgccgtggctgtcgctgttccgctaccgcacggtctgggggatgatggccggcttcttctgcctcaacttcgtgatctacttcttcatcacgtggttcccgacctatctggtcaaggcgcggggcttctccctggcggagctcggcacgctcggcagcctgcccgccctggcgtcgatccccgcgggctggctcggcggcttcgcgtcggacgcgctctaccgccgtggctggagcctcaccgccgcccgcaagacctgcctcgtcggcggcatgctaatgtcgtcggtgatcaccctgtcgatcatcgcgcccaacatctacgtggcgctgctgtgcttcgcggtcgcctacggcagcctcgccttcacggcggcctcgatttgggcgctacccggcgacgtggcgccgaccccggcccacgtggcctcgatcggcggcatccagaacttcgcgtcgaacgtcgccgggatcgtgacgacgaccttcaccggcgtcatgctgacggtcacccagggctcgttcgtgatccccctgatcgtggccggcgggttctgcctgctgggcgccttcatctacctgttcgtggtcggcgagatcgcgccgctgccggtccgcgacgctcgcgccccggccctgcgccccgaagcggcgcggtga

SEQ ID NO: 6678 - DNA, 648 bp, Methylobacterium sp.
atggccgcgatcgcggcggccgcacagaaggcgccgcccggcgaggcgaccgtgcttaccccggcgcgcgacgtgaatcccgtcgcggcgccggatccgcggtcgatctacacgctcacgccggaggcggccggggccgtcttcgcgctcgtcgagaaccgcatccaggtgatcgacgccgcgctcgacgtgaccgaccggcggggcacgcaggtcgctgccgccgcgatggcgacggccacggcgacgaccccggtcgtgtcgccggagacgacgaagacgatcggcgccgccaatcgcaattggagcgaggatgtccgattggatcacagcccgtcccggctcgtcggcgccgacacggtcgtggcgtacgacagcccgcgggtcacggcggcctggagcctggcctttccggacgtgcccggccggcggttccgggccgtgcaattgccgggtccgagcctccgctccgtcctgcgcgaggcagaggccggtttggacgacacggggagcgacatctacctgctctgcaacagcgcgcatttcgagacgatccgccaagcccatccgcgcacccacatcaactggatcaacgtcgacaacgacgagatcgtcgtcgtctggcggaagccgtccgaggcgggctag

SEQ ID NO: 6679 - DNA, 264 bp, Methylobacterium sp.
gtgagcaccggagccgcgccgccctgtcgcggcgacgccgcgtcgccgcccggcacggcacccccggggttatccatccagccgctggcgggccgctgccgcgtctgcggcctcgcctacggcggcatcctcggccgcgaggcgggggtgatccggctcgatcgcgcccggtggcgccgtctctgcccgggcgcggcgtggctgaccgtgccggccgcctgcgcgggcctccgggccagcttcggcggggacgccggatcctaa

SEQ ID NO: 6680 - DNA, 306 bp, Methylobacterium sp.
atgattgaacagggcccacggatagcgcgcgaattcaatgtcggcgtcggcggcgaccgctgggccctgatgcgcgacctccagaccggacagccctacgtctctcactccccgggcgatgacgcgccggaggtccaactggatctcggttccttcctcgtgctgttcaccggggaggagcgggagaagctgctccgcctgatcgggtcgctgctgccggacgaggacgcgcgtgcggatgccgacggccgggccggcacgtcgcgtccgctgaccttcgtctcccggtggcttcccaatcggtag

SEQ ID NO: 6681 - DNA, 252 bp, Methylobacterium sp.
atggacaaccagcgcaacgcccgacgcgtctccgtcaacctgagcggatgcatctcggtggccggccatcccgccatcccctgcgtggtgcacgacatgtcgcggtggggtgttcgcctccggctcgtcgggaccgagcgggtgccccccgcgttcacgcttacgatcgacgccaccgacacggtgatcggctgcgagacggtctggaagaatgccgacgagatcggggccctgaccgacctgatggagtga

SEQ ID NO: 6682 - DNA, 1161 bp, Methylobacterium sp.; identical to SEQ ID NO: 5628

SEQ ID NO: 6683 - DNA, 1299 bp, Methylobacterium sp.; identical to SEQ ID NO: 5629

SEQ ID NO: 6684 - DNA, 228 bp, Methylobacterium sp.
gtgaccgacgagcagaagggctacctgcaagcgctgtccgacgtgcgctcctggcaccgctgggagttggcgcagtgcctcggcgatgtccgagccatggaagcccacgagaaggccatcgcgtggctcgacatgctcatcgccacgaagaggcagcaagcggccgaggatgaggacgggcggcgcgcacaacgtcatcaaccagcgtcaccaaggagcctgccatga

SEQ ID NO: 6685 - DNA, 579 bp, Methylobacterium sp.
atgtccaacacgatcagcagcgcgctgtcggccggcacgatcagcagcaccgacgcgacggccctcgcgggcgccttgagcagcatcgataggagcctgtcgtcgaccagcgctgcctcgaccagcgcgacgagccggtccgggctcgacccgtcctcgatgaaggaccggatcgacggcctgatcgccgatcaggtcagcagcggcagcctcaccgccgaccaggccacggagctgaagaacctgttcgccagccacggccggagcacccagagcgcggacgccactggcgacgggactggcgacgtcgccggcccggacggcccgccgccggggcccccgcccggcccggcgccgacggacgctgcgggcagcgccgggagcggggcgtcggtctccgcgtcggcctcgacctcgacttcgacctcgaccaccgacgcggcgcgcacgacgaacgacctgctatccaccttcatccagcagctccagagcggccagtcgggccgcgtcggctacggggcgagcggcaccgccaacagcggcgccgtctcggcgctcctcctcgacttccgcagctga

SEQ ID NO: 6686 - DNA, 369 bp, Methylobacterium sp.
atgaagagcacgacacagcaggatcagctcgagatcgtgagcgacctcgcggcctcgctcgccgaccggatgctgatggagcgcctgacacaagggaagctgcccctcgcgaacgcgagtcgcctctggacagcctcgctgctcctggaagagcacgcgcggcccatcccgcgcatcgtgacggacgtcctcgagcaggtccggcacgtggagccggacgacgaggatgcggtcgacggggacgacgccgacgggatcggtgcggggccggaaccggacttggccgcggcgcggcgtgcggcccggccggcgcgccggcgcgggctcacccgcttgctccgaccgttccggcaggcggccgaaggctga

SEQ ID NO: 6687 - DNA, 321 bp, Methylobacterium sp.
atggacaaggtctatgccggggaccggacgatcgacgggatcgtcgtcacggtgaacggggcgccgctgccggatcgggccgaggccaagtgctactcccggaacggcttcgagtggagctacgagggtcccgagccctcgcagctcgcctacgcgatcctggtggatcatctcggcgacgcggcggaggcggagcgcctgcaaccgcgcttcatgcgcggcgtcgtggccaacttccagaacgagtgggagatgacgacggccgacgtcgcccgcgtcctggagcgcctggattcgggcggcgcggcgcggtccggctga

SEQ ID NO: 6688 - DNA, 216 bp, Methylobacterium sp.; identical to SEQ ID NO: 5635

SEQ ID NO: 6689 - DNA, 390 bp, Methylobacterium sp.
atggacatgatcgaaccgaacgtcgccgcgctcgcgtggttcgccctcttcgccggggtcgcctgcaccggcttctacgtgctggccgggatgttcccgctggagacccgccccgacctgagggcgcgccccctcggcctcgcgctgatcgcggccaacgtcctcctgctcgcggcgctgaccggcgggatgctcgcctacggagccgccgaactccgctggtcgagcctcgtgatcgtgggcggcttcgccatcctgttcgcgcccggcctgttcaacgtctggccccagcgctggcgcgacggcgtcgcgggcctggcgatcgtgctcgccgccctctgcggcgccctcggcctgctgcagcaggtcggcaccgtcttcgtcctctga

SEQ ID NO: 6690 - DNA, 792 bp, Methylobacterium sp.
atggaactcgccaacacccgcatgagcgagcggcagcggaactaccgcgccaattaccgccagcgcgtggccggctggtacaacggcttcctgcacatcgcgatcatctacacgatcggcctcacggccctgtacatctacgtctcgaacatccacgcgccgagctggatcgagctcgcgacggtcccggtcgtgttcctgttctgcaatttcttcgagtggtggctccaccgctacgtgatgcaccggccgcagagcaatccgatcgggcgggccgtctacaatcggcacacgctgcagcatcaccagttcttcaccgaccacgagatgcgcttcgccgaccaccgggactaccgggtgacgttcttcccgccctacgcgctggcgacgttcacgctgatgtcgatccccggcgccgtcgtgctcggcaacatcttcacgcccaatgtcgggtggctgttcatcaccacgacgaccagcatctacatgatctacgagttcatgcacttctgctgccacgtcgaggagaactggttcgtccgcaacatgccgttcatcaacacgaaccggcggcaccacacggcccatcacgaccaatcgatcatgatggagcggaacatgaacctgaccttcccgatcatggactggctgttcggcacctcggacctgaaccgcggtctcatcgggacgctcttcaacggctacgacacgcgccacgtgaagaacgacatgcgcaagaccgcgcgcacgcccggtgcccccgagccccgggccatgcaggccgccgagtga

SEQ ID NO: 6691 - DNA, 666 bp, Methylobacterium sp.
atgcgcgttctggtcgtcgaggacgatgccgccctggcgcgcggcctcgtcgccgccctccggcacggcggatacgccgtcgaccacgaggcggacggagcggacgcggtgcagctcgcgctgagcgaaccctacagcctcatcgtcctggacctcggcctgccgggtctgccgggcttcgaggtcctcaaggccgtccgggcggccggctcgaccgttccggtcatgatcctgaccgcgcgcgacgccatcagcgaccgcgtccgcgggctcgatctcggggcggacgattacctgctcaagccgttcgacctcgccgagttcgaggcgcgggtgcgggcgctcgtccgccgcgggcaggcggtgccgaacccggtcctgcgctgcggcgcgctggagctcgaccgggccgcgggcaccgtgaccctcggcggggcgcccgtcgcgctgcgccgccgggaactcgccgtcctgaccatcctgatgacgcgcgccgggaaacccgtcccgaaggaacggctcagcgccgagatcttcggcttcgacgaggcggtcgcgccgaacgccctcgaactctacgtcgcccgcctgcggaagaagctgcagccggacggtcccgagatccgcacgatccgcggcctcggctacctgctgatgccggtgtga

SEQ ID NO: 6692 - DNA, 234 bp, Methylobacterium sp.
atgccgttcgccaatttcaagatcccgcagggcatgatgaccggtccgcagaaggcggatctgatccaccgcacgacggatctgctggtctccttcttcggggaggccgcgcgcccgcacaccatggtcctggtcgacgaggtcgtggatggcggctacgggcgcgccgacgaggtcttcgatctcgaggccctgcgacgcctgcgggcgcaccacgagacgggttcgcgctga

SEQ ID NO: 6693 - DNA, 1095 bp, Methylobacterium sp.
gtgtccttctcagcactgatgatcgcgccggcggcgcgggcggccagcactctggaggcggctctccgcgcggtgccggattccgtcctggcgacgcctgacccgatgccgatcgtcttcatggacgtccaggcgctgtcccgggcagctggcggcgcgctgagcgacgccggcctgcggcgcatggccttcgcgcagagcatccgcccgctgaacgccctcagctacggcggcgcgcagacatggaccgagaaggccggcatcccgttcgaggacatctcgtatttcgcggccttcggccagcctccggcgcgcgtgactcactggggtctggcgacgaaggcggcagccgacaccctggtcgccaaactgaaggacaggaacttccggccggtcccgaccgcgccgcgcattctcgccaacggggagccccgcgccctgaatctcagggcccggcagccgaccgatccctggtccggcccgatgggcgagaccagcgcgatcctggcgatcgatcgcgtcgtcgcgcaggcgtccgcggccgcggatctggagacacgcgtcggggtcggccggagcgcggcggatcacgaggcggtcgccacagcgctgacgggtctggccgccgcggatgagcgcgacccgggcgcgatccttcaagcggccgtcgtgacgccgctgatggggatcacccccgacgatcctgccgccctcctgtcggcgacgaccgatctggccgcgcagaggaaggcgatcgcggatcagcgcgagcgcggacgggacggcgtcccggcttatgccggcggtatcgtggcggactatcaaggcaagaacggtccggccctgctcgtatccctcgcctatcccgattgccggacggccgaccgggccgtcgccgcgctgaaggcgcgttggcgagccggcatggcccccgcggcctccgtcgacggccgctcggtcgagagcccgcagcgcggctgtgccgccgtcctccgcgtcgatcgtgccgcgggtgcgaacaccccgttcggagagttcctcgggacctccctgcagcgcggcttcaatgtcctgcagatcggatcgcagcgatga

SEQ ID NO: 6694 - DNA, 276 bp, Methylobacterium sp.
atggctggagaagcgaagagggccgggccgaagcgccggcgggacgaccccgatccggcgcgcgccgagggcgagaaggtcggcgcgcgcatcgatgccgccttcgagaagctcgccgggaagctgcgcgcccgcgccgacagggcccgcgccaagctcgacgcggcgacgaaggccgagaagcgggcggtgctgctgcgccgctacgaactctacgcggacgcggcggcctatctcgaggagcggctcgtcgatcgcggggggcgatccgcgtga

SEQ ID NO: 6695 - DNA, 228 bp, Methylobacterium sp.
atgctgccgaccgatctcgaccgacccgccgaactgaccctctggccgggctacgcgccggcccgggtggccgtgtcgcacagtttcccgacgctgcgggccgccctcgccgccgcggtcgcggcgatcgacgccgaggatgccaatccctggatcatcaccgagggcggcgacatcctcgctccgggatggatccgcgcgaacaccgcgggcgccgtcctgcagtag

SEQ ID NO: 6696 - DNA, 960 bp, Methylobacterium sp.
ttgttctctacggcggatttcaagccgaaagacagtttccgcctctggcgtgagacgatcttcgagcggatcgtgccggtcgaacttacgcctgccgtggcgcacgctttcaccggcacgctggaggccgcggaggtcgggccgctgctgatcacgcgcgtgacgcagagcgccgtcaccaccgtcgcgaccccggacacgatccgccggcacggcaagtacgagaccctgaacgtcgccatcacgctcaagggccgcgtgttcagcgcgcaggacgaccgcaccgcgatccagaatcccggcgacatcgtcgtgatggaccgtcggccggcgacgatggcctccgacgtcgacacgcagacgctgttcgtcgagctgccgcgcgcggccctggagcgcgccctcggctcgacgcgccggttcacgtgcctcacgatcggcgcggatcaagtcggcacgtcgatggtcacgacctttttccaggaactggtccgcaacgcggagcgcctgacgccggacatgtcgaaccgcatggcgtcggtcggcgtcgatctcatcgtcgcgagcatcgcggaacgcctcgcgcacgagacccccaagaacatccagggcgtcctgatcttccagcgcgcgctggcccacatcgaggcccatctcggcgacctgaacctcgaccccgcccggctcgcggcggccgtcggcgtgtcgctgcgccacctccaggccctgttccgcgagcaggaccgcaacatcgccgactggatctggcggcggcggctggagaccgccgcgcagcgtctcgccgatcccggcttcgcccatctggccgtcggagagctggcctacagctgcggcttctgcacccagagccatttcagccgccgcttcaaggacagctacgggatctcgccgagcgagtaccggtggcgcaaccgcggcgcggaccagctcgccggctga

SEQ ID NO: 6697 - DNA, 444 bp, Methylobacterium sp.
gtgtccgattcgtccctcgtcagcccccaatccaatatcgtgctgacggcagggctcgtcgctgcctatgtatcgaacaatcgggttccgaccgccgaccttccgaccctcatcgcgcagtgtcacgacgcgatcaccgcgctggccgccaacggggcggcgtcgatcgaggcggcgggggacacggacgcgctgcgcgaccggcctaccgccgcgcagatccgcagctcgatccggcccgacggcatcgtgagcttcatcgacgggcgccggtacaagacgctcaagcgccatctcacggcccacggcctgcacccgcagagctaccgcgagcgctacggtctgccggccgattatccgatggtcgcgcaggaatatgccgagcgccggtccgcgctggcgcgctccatcggcctcggcgtgccgggcgagcgcgccgcctga

SEQ ID NO: 6698 - DNA, 225 bp, Methylobacterium sp.
gtgatcggcgtggtcggattgcgggcggtcgacgtgctggggctcttcgtcgagcccgcggtgatctgcctgctcgccgccctggtgatcacctgggccctgcgctggatcttggactggatcggcatcaaccaccttgtctggaaccgcgccctgttcgacttcagcctcctgaccgccgtgacggcgctgctgatcctgtccctgcgcgtccagggcccgtga

SEQ ID NO: 6699 - DNA, 1857 bp, Methylobacterium sp.
atggccggtgaggtggccctttccgacgacgcgccgggcctcctgcagcgcctcgcggcgtggtggccgcgcgaggcggccgaggccgtgcgcatcgcgctcaccgccatcgcggcgatctggctcgccatgtggctcgagctggcgctgccgcactgggccggctggacggtcatctcggtgacgctcgccacccgcgcggcctccctgcgcaagagcctgtggcgcgccggcagcacgctggtgggcgtcaccgtcgcgatggtgctggtggccaatttcgcccaggcgaccctggccttcgacctcgcgctggccctgtggatgggcctgctcaccgcggcctccagcgtcgagagcggccagcgcgcctacggcttcgcctcgatgggcttcaccgtgccgatcatcgcgctggccgacgtgcagaacccggaggccgtgttccagatcggcgtcgaccgctgctcgacgatcctgctcgggatcggctgcgcctacgcgtcgaacgtgttcgtggcgccgggcgtccccgccgtcagccgcgccctggcggggcggctcgaggcggccgcggaggcctgcgacgcctggatggccgccctgcggcggggcgagcggcccggcccgatgccgatcgccgcggtcatgaccctgggcgaggaggtcaccgacacgttcaccgagcagccctccctgcgctccggcggccgcggcatccgcaacgccgccccccggctgcggcgggtgctcgccgcgggcctgctgcgggcgctgctgccggaccggccgggatcgcgctcgaccgacctgatcggggccggcggggcgatcgccgtccggcaggtcgggcgcgtccgggtctcggcgcggctcctgcgggccggcgggcgcgtgggccggcggcgcgtcccgttccgcccgcacctgctcctgtggaacgacctggactgggacggctggcacgccttcgacaacgccctgcgcaccgccgccgccgtcctgctcgtcaacggcttctggtacgtcaccggctggtcgcacggggccggcgccgcgacctgggcgagcctcgtctgcgtcctgctcgccgcccatgccgacccgcgtgcggaatcccgcgccttcctggttggcgcgctgctcgccggcgtggtcgggctcacagtccgctacaccctgctgacgaccaccgggagcttcgcgctgctggccgcggtgctgctgccggtggcgatgctggcggtggtcggccgcgccgacaagcgcgcgatctacgggatcggcttcgggttcttcgtcttcggcgtgctcgatcccaagaacccgatgacctacgacctcgccgactcgctcaacaccgtgctggccgagctgctcggcatggcggtggcggcgatcgcgttcgccgccctgccgccgccggtgagcgccgcgaccctgcgcctgcgggcccgacgccggctggtccggtcggtgcgcggcgcggccctcgacccggcgctcctgctgccgccgctcgaccgctacctcgcccggggcttcggccgactcgccctcatcggcgcggacgacgcggcggcccggagcggcgagcgcctgctcgtcatcgggctcctgctgctcgccctgcgggagacggacgaccgggagggccgccgcgtcggccgggcggtctgggcgcggctcgccgcgtcccgtccggcggggccggagacggtgccggatcccttgcgcgcgctcgccgaccgggcgaccctgcccctccaggcggagcgcatcggggcgctggccgccctcgtgtcggatctcgaccgcgcgggctggccgaacctcgatccgggagggcgggcgtga

SEQ ID NO: 6700 - DNA, 399 bp, Methylobacterium sp.
atgatccgctgcgtacgcatctggaccggtgacgacgacaattcctacttcgaggaaggcgtcatcgacctgccccacggcgagcgcggcgacatcctcagcggcacgaccgacgtggtctcgatctccttccgcgagacccaggccggcgggacctacgcgtggcacgcggcgccgacccggcagttcgtcatcaccctgcgcggcaccctcgacttccagacgagggccggcgcgcacttcacgatccgccccggcgacatcctcatcgccgaggacacggccggctccggccattcctggcgcctcgtcgacgacgagccctggtgccgggcctacgtgatcctcgcccccggcgccgaggcccggctccccttcgtcccgaacaagaccgcctga

SEQ ID NO: 6701 - DNA, 231 bp, Methylobacterium sp.
atgcaggacagcatcgataccgtccgcgagctgagcgccgccgagctagaccaggtcggcggtggcctcggggtcggcctcactgtcggcctcggggtcgacgcgagccaggagctcggtgcggtctcgggggtcgtgggccaggtcggcggtctggtgagcggcctggtgggcagcgtgctcggcgcggtcggcggtgtcgtcggcggcgtgaccggctccctgcgctga

SEQ ID NO: 6702 - DNA, 414 bp, Methylobacterium sp.
ttgcgcaagaaccaggaccagctcgagccgaccatcagcgacgtggccctgcgcgtcgtgaccgcctatctgtcgaacaacgcgctgccgcacaccagcataccgccgctcctgctcaccgtgcacggcgcgctctccgcgctcaccgaccggcccgcggtcgtcgaggcgccgcccgagcagcccgacgccgctcagatccgcggctcggtccgccaggacggcatcgtcagcttcatcgacggccggtcgtacaagaccatgaagcggcatctcacggcgcacgggctgacgccggaactctaccgcgcgcgctacgggctgccggacgattacccgatgaccgcgccgggctacgccgagcgccggtcagagatcgccaaggcgatccggctcggcagcaaggccgcctga

SEQ ID NO: 6703 - DNA, 351 bp, Methylobacterium sp.
atgctggcggcgctcctcggaggcatgctcgcggcgccgttcgcccacgggcagggcgccgacgatctggaggccgagatgcgggcgcgggtcgccgcggccttcccggatgcgggcctcgtgagattccgcaagatccgaccgatccccgccgaggcggagtccgccgtggcgttctgcggccaggtcagcagcggccccgtcgggcaggggcggtcggatttccaggtgttcctgtacgaccgcaccgcgtcggccgagaccgtccgcatcctcggatcggaatccctcaacggctaccgcgtcggccggaagctgatcggcgccctgcggcgggtcggctgcctgtga

SEQ ID NO: 6704 - DNA, 273 bp, Methylobacterium sp.
atggaggttcggatgtgcgcgcggaagaccttctacattttcgtttcggcctcggacgaggagcagttctgcgccgtccgacaggaccagcccatcccgtcgctcatcgacggtgtccgatggatgtatgtcggctgcatcgatacgacccgggacaggccgtacggattcgacgtggacgcggcgcacgcggcgatgcgccaccgcggcgtctacttctaccggcgcgaattgatgttccgccgggccaacttcctcctcgaagccgcctga

SEQ ID NO: 6705 - DNA, 1047 bp, Methylobacterium sp.
atgcccccaccccgcgacctgcagctcgacgccgcgcgcggcctcgccgtgctgctggtcctgtccggccacctgctgcagcccgtcttctacggcccgtcggggccggagccgggaccggccctcgcggtctggcgggtcatctacgccttccacatgccgttcttcttcctgctctgcgggatggtcgaccggatcaagggcgaggcgaaactcggcgaagcctgccgctccgcgctgcggctcgtggcggtgacgctggcgttcggcaccctcgcgctggtgccccaggccctcgccggcaccctgtcgcccggggacgcgctgggcgacgcgctgtgcggccgcgacttcggtctgggcgtgctctggttcctggtcgccctggggcttgtacgggtgatcgacgccgcggcgcgcgcggcgaccttcccgggcggctactggatcgtcctgggcggcgccctggccctgtcatggacctgcagcgcgcgggcgttcccgtactggcaggtccacgcgctcgtgggcgccctgccgttctacgtcgcgggcctgaggctcgggccacgggcgttcgacgtgtcggcgctgctcggcgcctgcggcctcgccgtgctcctgctctgcgcgccgcggaacttcgtccacgtcgcgaccgggcagtacggcgacccggcgctgttcgccgtgacggccgcggcgggctcggcgttcgcgctggcgatcgtcggccggctgcgcggcccgtcgcgcgccgcggcggccgtgttggggcgggcgagcttcgaactctacatcgtcagcggcgtcttcctcctcctggcgccgcactggcccgcctgggaccggtgggacggcctggtgctgctcgccgcaatcggcctgcccctgcacctgatcgcggctcgcgggctgcgcgggccgatccgggccgtccgcgcggccgccgacagtgttgtcgacagcgcggtcgacggcttggtcgacgggctcgccggccgccggcgtcgcgcgcggccgggcttgtccggggcggatccttaa

SEQ ID NO: 6706 - DNA, 219 bp, Methylobacterium sp.
atgaccgctccgcaagtcatcgcaacgatcttcttcctggtctcggtcggttcggcgacgacgctggccctcatggcggcggcctcggccgtgctggacgcggtcgcgaagacctgcgaccgcgcgcggccggacgcgggacgggaccgctcgcgccgtgtcacggaggccgcctgtcggctgcgccgcgcggccctcgcccgcgccgcgatcccgtag

SEQ ID NO: 6707 - DNA, 222 bp, Methylobacterium sp.
gtgcagcacctgttccaggccgtcgcgatcttcgcgttcggctgcctgctgatccatgccggtcgcgcctatgcccgggcgaccacgctcctgctctccgcgaccgcgctgatgctgagcgtcaccctcggcaccgtgctctgccagcggatcggcctcccggggcgttccgtcgcggccggcccgtcctacacggtggcgctcggcaggcccgctccgtag

SEQ ID NO: 6708 - DNA, 144 bp, Methylobacterium sp.; identical to SEQ ID NO: 5655

SEQ ID NO: 6709 - DNA, 813 bp, Methylobacterium sp.
atggcgcgccgcccgacgtatcataacgacggccggggaccggaacatctgatcatgcgtggtactctggtcgtcgcgacccttctcgccttctcggcggtgccggccgccatcgcggccaatccggtgcgggacgtgctctgggtggcgctgcagggctgcgtgctcgccaagaaggccgcggaccggagctttccctgcctcgcggtcgatctcggcgacgccgcgcgcccgggaacggcggtgctgcgggcgccgggtcagcccacccacacggtggtgatgcccaccgacagcgtctcgggcatcgaggcccccgtgctccagggaccgcgaggggcggcctactggcgggcggcgctcgcggcccggcactacgtgtcggacgcgctgcagggccgtctgcccccctccgcggtgggcctggaggtgaactccgtgggcggccgcagccaggatcagctgcacatccacctcgactgcatgcgccggagcgtcacggcggccctgaaggcccacggcgacgccgtcggcgacagctgggccccgttcccggtgccgctggcggaggtgtcctacctcgccatgcgggtcccggccgacgcggtcgcggcgttcaacccgttcgccgctctggcccgcgcgcccggctggcagggccacctgcacgacgcgagcttcgcggcggtggaggccgatcccggggatccgcggggcgggatgatcctgctcgcctatcgggagccggaggccagcgccgaatacctgatggatcacggctgccgggtggccaggcacggccgggccggctga

SEQ ID NO: 6710 - DNA, 306 bp, Methylobacterium sp.
atgacgctgaccggacgtttctggttccgccggacctggaccggcaagctggtcctgctcgtcgaggaggagcgcgggcgctggttccggcgccgcctcggccgcaccctgcgctggcgcgacgcgcggctcctcgatctggccgaaggtcccctgcgggggctcatgacgctggagcggacctaccgcgccgagttcggccccggcgagccgcgccgccccgccggcctcacggcggtcccgggcgggcgggccctgccgcgcggcgggccggagccaggaacaaggccgtccctgtcgggttga

SEQ ID NO: 6711 - DNA, 225 bp, Methylobacterium sp.
atgaccgaacgagacccgtaccggcacgaggatccgatctggtacgatcggatcgaggcggatgagccgcctggcgtcatcctcgatctgctggcgcacgcgttcgtgccgatcgtggcggctctcggtgcggtgagagcgctgtactggctaccgactcgactgtggtgccgggccgcgcgctcgatcctgcgcgatcggaccaccgctgcgaagcggctctga

SEQ ID NO: 6712 - DNA, 201 bp, Methylobacterium sp.
atgagcgacgtgcccgatccgaagcggaaggcgatcgccgacagcgtgctggttcgtctcagcacgttcgcgttgggcatcggcctgtacgacggcatcgcccggagcatcgtcgagaaggcggtcgccgacatgccggaggccaccgtcgagcaggtcgcggcggcggcgcggatgatgatgctgttcgtgtcgggctga

SEQ ID NO: 6713 - DNA, 135 bp, Methylobacterium sp.
atgcgtccctggatggatcgcttcctcacgatgatcatggtcgcaggcggcgtggcgacggtggtgtggatcgccgcgatgctggtggtcggctggcaaatggccgtcgtgctgatgggcctgagtgcagtctga

SEQ ID NO: 6714 - DNA, 117 bp, Methylobacterium sp.
atgaccaagccgatcaccctgacgaaccgtctcgtcgacgccgtcgtgacggccgccatggcgttcagtctcgtcgtgcacgcccaggtcatgatcctgccgccgcacttcgtgtga

SEQ ID NO: 6715 - DNA, 480 bp, Methylobacterium sp.
atgaccctgaacctgcaccgtcccggccggaccacccgcctcgatcggctcgcgccgggcagcgtctacctgatcgccggccgggacgggccggatctcgccctcgtcgtgcagcgtgagggacgtcgggaggccctgctgctgaaccgccgtcacgcggtcgatggccacctgcgggtcgcgtccgagatcgctcccgaggccgacgtgctggcgctgccgggggccgtcctggcgccgagcggcgccctcgcggacgtcgccctcggcgtcaccgccgctccggccgcgctccacctcggcgacggccgggcgtatctgcgcggacgcatctcggacggccggctcgcgaccttcgatgtcgggaccggtcgggccagcgcgatcgatcccggcgacctgccgcgggcgcgcggctggcgcgtgatggtgcccgagggtcgcggcgtcgtgacggtgtacgaggcggagcccggctga

SEQ ID NO: 6716 - DNA, 447 bp, Methylobacterium sp.
atgtcgaagctcagcctgtccctgaacgcggttcggcccggagccgacgatcacccccgtccgcacgtcgccctgcgggacgaggccagcgcgatcgccgcggccgtgcgggtcttcgaggacgggctgacggacctgcgcgcgggcgtgcgggccgcggacgacgccgcgtccgccgcggcggcggccgacgcggcgaccggcctcctggccggcatcgccggtcagaccagcctgatggcgctccgggccgcgatcgaggcggcccgcgacggcggagagggccggggattcgcggccgcggccgcggaggtcagggacctggccgggcagatggtgcgggcgaccgacacgatcgtggcccaggtcggccagatccaggccgcggcggagcgggcgcaggataccgcgacccgggggcagcgccaggccgcgtccgcgcactga

SEQ ID NO: 6717 - DNA, 288 bp, Methylobacterium sp.
atgagcgcgcgcgacgccgcggatgccggacggcggcactggttctacgacagccggatcctggtctgcaccttctgcctgctcgcggtcatggtcatcttctggcaggtgagccggttcgagggtttccagccgatcttcacctgcgcgcgcaatcaggacgtcgatcgcgacctgctctccgtcgggatgcgcgcctgcatgggcgacgcgccctcgcaggccgcccaggcgcgctgcatgcacgtcgtctacctgctggcctgcacggacgagcggtggcgctga

SEQ ID NO: 6718 - DNA, 273 bp, Methylobacterium sp.
atgacgtccaccgctctcgccgtgatgatggccggcgtgctgggggccttctgcacgatcgtgttcgcggtcgactgggtaccgggctccgtcgttggattgccgaacctgccgagccggcgggtgatcggcctgtgggtctacaacggcgttctctgcctcgccctggccgcttggttggtgtgcacgtatttctgcaccgtcgacggctacgacgacattcccgcggtgcgcgacagctactgcaggccgcacgcgaccgtgggcgcgtga

SEQ ID NO: 6719 - DNA, 246 bp, Methylobacterium sp.
gtgatcccgatgtcgggcggcatgctcggttccctggccctggcggccgtcttcacgctggggtgcttcggcatccacagcgcgcgccggcatccggacgcggtgaccatcggtctgttcctcctgctcggcctgctcgcgtccctgtatgtcggccagcacgtcggaccggacgcgcaccatcccacgtggcagcacgaggccctgtatcgcgagagcgcgccgacgtcgcatccgacgatgtga

SEQ ID NO: 6720 - DNA, 192 bp, Methylobacterium sp.
gtggacccccagccattcaccatcgacaccgaggcccaggctcagacgtacctgaccgatctcctcaacaatccgaagaaccggtcgatgagcgagatcgcgaggcactgcgccctgcgggtccgcaacccgaagatcaaggcgttctttctgaccgagggcgcgaagatgctcgccgagatgaaagcctag

SEQ ID NO: 6721 - DNA, 153 bp, Methylobacterium sp.
atgctcgctcgcccgttccgcctgctcgccccggcgctcgcagccctcggactcgtggccctgcgcctcgcgagcccgttcatcgggccggtgtcgcccgcgcaaccggccgcgaccgacgacgcgggcgtcgtcttccggcactatctctga

SEQ ID NO: 6722 - DNA, 678 bp, Methylobacterium sp.
atgtcggtcaacacggtttcgggcagttcactccagcgggatctcgtcagcgccctcaggcaggcgcgggcggcgaacgttgcccgcctcgatgtcggcaccgccgcgacggcgaaccaggagaccggcaagcaggcggccgcggacgacaccgccccgtcgaccgggacggcctcgacgccgaccctgtcgaacgacctgatggcgtcgctcctccagctgcagtcggacttcagccagatggggctgcagaacggcgtcacggcgcccgcggaagccgcggccatcgccgacgacacgtcgacgaccggcaccgccaccggtacggcgcccggtcaggccgcgggcggtgcgtccgccgtccatcaccatcgcggccatcacggccaccggccggcgtcggatgccgagcagagcgagggtgcggcccaggccggcaccgcgaccgacgcgtccgcggcctcatccgcggcctcgtccgcgagcacgtccaccagcacgtccaccagcacgtccaccagcacgtccgccaccgcgaccgccgatcccgcgacggcgaccggcagcggcagcgacctgcaatccttcctgcagcaggtgaccaaggcggtgaccgcctacgcggccggcggaccgctcggcatcgcggccgcgctgaccagcaccaccaaggcctga

SEQ ID NO: 6723 - DNA, 222 bp, Methylobacterium sp.
gtgcccagtcgcttctatttcgacatcgagaacggcgaggagacgatccgcgacgcgcagggcgtggaagccgcggacttggccgaggcgctcgcggaggcccgcagcgtgatcgacgaaatggcgggtgaactggaggtcgcgggaccggccggcgcgtggacgctcgtcgtgcgcgacgccaccggcgcggaggtcggccgggtgccgatcaagggctga

SEQ ID NO: 6724 - DNA, 228 bp, Methylobacterium sp.
atgcccctctcccagaacgtcccgcacgccgcccgccaggcggacgcgatggctgcccagatggcgctggccgcccacgcgctgcggatgcgcggcgatgtcgggaccgccgagtcgctcctcgcgatggcgcgacacaaccggatcctcgcgctcaagctgcggatcgcgcaggatctggcgccgggccaagaccgcgccgagcgccgggccaccgccggccgttaa

SEQ ID NO: 6725 - DNA, 216 bp, Methylobacterium sp.; identical to SEQ ID NO: 5672

SEQ ID NO: 6726 - DNA, 156 bp, Methylobacterium sp.
atggtcgccgccctggccggcctgatgatctggcagggtgagaccgcgccgcccgactacgccagccagagtcaggccgccgcccgcaaggtcgtcaccggctccgagagcggatcaatcagcgccccgccggccgggacgcgatccacgccctga

SEQ ID NO: 6727 - DNA, 198 bp, Methylobacterium sp.
atgcgcgggagagacggcccggataagccaccgcccgagcccgcaccggcagcccgccggcgcggcttcttccggcgcgtgctcgacggtctcgaagccgtcgagctgctggtccaggcgggccggctggtctggtggctcctgagaggcctgtggctggccgccggcgcgatcgcgcgcctcttcggggaccgctga

SEQ ID NO: 6728 - DNA, 1212 bp, Methylobacterium sp.
atgcaagcgcacgttgcggggatcgacaacccgaacccgatgatcggcccggcccgcctgatccgggcggccttcgagggcgccgacatggccgccctggccgccgagatcctcgccgagggcggagactccgccctcgacgccgggacggcgctggacatggcgacgatcctgctgctgaagcaccgcttcaccgaggggctcgcgctccagagagaggtgctggacggacagcgggtcttctcgctgcgctcgaacccggatcaggcgcggattcgcgtcctcgtcctggtcacggccggcgatctcatggccaacacgccgatcgacttcctgctgaacgacggcgatttcggcctcacctacctctatctccgccccggcgagccgatcccgcacgacctgccggcgcacgacgtcatcgtcacgggcatcgcctacgcgcggaccgccgagccgctcctggaagccctcgcggcggcggcggaccagtggacgcggccgatcgtcaatcacccgcgccacgtcctcaagacgtcccgccacgggatcgcggacgcgctccgcggggcggatgagatcctggcgccggaggtcgtccgcgtgagccgctccatcctgagcgccgcggcgtcccgcagagccgagggaccgacatacccgctcctcgtgcgccctctggacacgcacgccggcaacgacctccagaagatcgaccggtcggaggacctgcatctctacctcgcgcagacggaggccgaggcgttctacgtcacgcagttctgcgattaccgcggtcccgacggcctctatcggaaattgcgcatcgtactgatcgacggtgtgccctacctctgccacatggccatccgcgatcactggatgatccactacctcaacgccggcatgctggaggatccggtgaagcggcaggtcgaggccgccgccatggccacgttcgacaccgacttcgccgagcgccaccgcgccgcgttcgccgagatccaccgcaggatcggcctcgattacctgatcatcgactgcgccgagagcgcggacggccgtctgctggtcttcgaggccgataccgggatggtcgtccacgacatggattcggcggagctgtacccctacaaggccccgcagatgcgccgggtcttcgccgcgttccaggacgcgctgcgggggcgggctcgggggcggaccgcctag

SEQ ID NO: 6729 - DNA, 753 bp, Methylobacterium sp.
gtgccctccctcgagaaggtcggcgcgatcgaagtggcggcctccgaggtgcgcatcaagcagtaccggctcatcctgctgtcggatacgccggagcaccgggacggcaatgaggccgccctggcgaacacgcacgcgcggctgcgcgacgcgcgccgggcttacgaaccgctgatcaccaccgccgaggagcggcggcactacgacgcgttcggcgcgtcctggacccgattcgcggaggtggatcaggacgtgcggcgcctcgtggaggcggggcggcagacggaggcgaccgcgctgctgatccggcccgacgtcgtggcactgtacgacggtgcccgggcggccctggcccgtctggcggaccacgacgagaaagcggcccagcaggacgcggacgcggcgatgacccgagtcgaggccgcgtccgccgcggccgtcgccagcatcggcctcgcgctggtgtccgccctggcggcggcgatcttcggcctcctctacatctcgcggccgatcgccgcgatgaccgccgcgatgacccggctggcgcggggtgaggccggcaccgaggtcccgttccggcaccgacgcgacgagatcggcgccatggcggcggccgtgcaggtgttcaaggacaacctgatccgcacccggcagctggaggccgaggccgaggcggcccggcaggacgcggagcgccagcgcggcctcgcgatgcggcaggtcgccgaccgcttcgccgacgccgtcggc

SEQ ID NO: 6730 - DNA, 219 bp, Methylobacterium sp.
atggcggggcgggtgacggatcgagcctccgaaggggaggccggccaggcgcggccggagacagcgccggcgcccgaggggccgggcccgcggcccggcatgaccgaggcagaggtcgggccggagatcggggcggaggccgaggcggtcgagcggcacaaggccgagacggagatcgccgcgggcgacgtggccgacgacctcgccgatttcgcgtaa

SEQ ID NO: 6731 - DNA, 732 bp, Methylobacterium sp.
gtggtgaaagatcggatttccggccggggtggccggcggctcaccgcgacgctggccgtgctcctctcccttgccctgcccgtcaccgccgcgacgctccacagcacctacgtcgacccggcggcgatggcgctgcagcgcgtcctgccgcccccgcccgaagccggctcggaatcggccaaggcggacatgcaggccgtggaggccgcggtccgcgcccgcacgcccgacgacgagcggcgcatcaccgcgaacctgccgtgcaccctcgaccgcttcaccggtgtgctcggcccggccttcacggcggagacgatgccggacaccgcggcgctgatcgagagtgtgttccaggacggggaactcgccgtgctggcggcgaaggccgccatcgcgcggccgcggccctacacggtgaagccggacctcgccacgttcggacatcgctccgacagcacgtcctacccgagcggccacgccacgttcgggtatctcgcggccacggtgctgtcgcgcctcgtgcccgagaagcgccaggcgctgttcgctttcgccgggacctacggggagaaccgggtgatcgccggcacccatttcccgtccgacctcgaagccggcaaaatcgccgcggccgtcatcgccgaggcgctgttccacgacccgcgcttcgaacgcgatctcgcccgggcggcttctgaagtcgcggcccagggcggcgcctccggtcggtga

SEQ ID NO: 6732 - DNA, 798 bp, Methylobacterium sp.
atgattctctccccgctgaacgccctgttcgtcggccccctcgagggctaccgggatcggatcgtgtccgcggaggatccgcgcccctccgtgaggggcgccgacctgctcgatccgcgcgtcctgaccgaccagctcgaccggttcgcccgcaccttcgcggcgccggagccccgcgccgtcgcgtcgatctgggcgaagcagcacttctcgatgctggtggtgcccgcgctcgccgccaacatcgtgctcgacctcgtcctgcccgtggccctcgacgccgtcgagatcgtcccggacgacggcgggctgacgcgggcgctcaagctgcgcgaccccgccgcggggagcgacgggcccggcgggcataccggggcgcgggcgccggcggatcgcttcggcgcgctgatcgacgcgcacctggcgcccctggtcggtgccctggcggcggtctcgggcgtggcgccgcgcgtgctgtggagcaatgccggcaacatcttcgagttcgtggtgcgccgcaccgaggggctcccgcaggcgggccggaccgggcacgcggccgccgcgagcgtcctgacgagccgccgccggtccggcgcgcccaacccgctgttcgcgccgatccgctacgtcccggaggcgggggacgcgccggcgggcgcgccgccgcgtcgggtgcggaaggtctgctgcctgcgctacctcatccccgaccagagcctctgcggcgcctgccccctgccggcacgccccgaagcgggtccggcgggaacggacggcccgaggaggcccgcatga

SEQ ID NO: 6733 - DNA, 288 bp, Methylobacterium sp.
atgcgcaagctcgctctcatctccgccgtcaccctgtccctcggcgcgctcggcgccaccggcgcccaggcgcagggttatggctacggctacggcggccaccacggctacggctacggccgcggctacgatcgcggctacggccaccggcgcgatttcggctaccgccgtcaccgcggcctgtcgaccggggccgccatcggtctcggtatcgcgggcgcggccgccggcgccgccgcggcgggcgccttcgaccggggcccgggctattacggccgcggttactga

SEQ ID NO: 6734 - DNA, 180 bp, Methylobacterium sp.
atgtccgcgcttgtcacgttcgtcggctgcggcctggtcctgtccgggttcgcggccgagaagttcgccgagcgtcgctggctcgcggcgagccggcccgcacccctcgacaccctcgcggtcctggcgctggcgctgccggccgtcgggctcacgctgatggcgacgctcgcggtctga

SEQ ID NO: 6735 - DNA, 165 bp, Methylobacterium sp.
atgctcgatgtcgccttctggtggtgtgtggccgtggctttgaccggatcggtcggcctcgtcggcctggccatcgtcgccggccggagcggccgctcgcagccgcgcggcctcaagcttacccggaccgagcccctcgtgctccgtcacttcgggcgcgcgtag

SEQ ID NO: 6736 - DNA, 198 bp, Methylobacterium sp.
atgcatttcgagatccgcgcgaccgacacccgtctgtggacctgggtcctcctcgatacgacgcagatgccggtcctgacatcggaccgcaccttcccctcggaagcccaggcctcggcggcggcgctggccttcgccaagctcgtcacgcgggccggcaggactctcaccgccgcaccgccgggcggcctgatctga

SEQ ID NO: 6737 - DNA, 528 bp, Methylobacterium sp.
ttgcgcgcggccggctatgtcggcgcctggacagcggacgtgtcggcgggacaatccctcctcgacgaggggacggcggcgctgctcgccggggatgcgaccctggccgggcgcccgctgcccatcgagatcgcccttcgatgcacccatccggacgatcgcgactgggtcttcgcgcgcatcgcccgggtgcgccggaccggcggccccgtctcggccgagtaccgcgtcctcacggacggcggcgaggttcgatgggttctcgaccgtggcagcctcacgcccgatccggcgggacggatgcgcggtcgcggcatcatcatcgacaccacggacagccaccgcggccccttccttccgagcgcggcgggcgatctgccggcggacgacccaatgatcatcgcggtcgatcacctcctgcaggcgcgcgcggcgatcgtcgcgatgggccaccagcggctgcaacaggtgtcggatctggcgctcttcgaggtcgggcgagcgctggcgcggcgcgctcgggcgtag

SEQ ID NO: 6738 - DNA, 483 bp, Methylobacterium sp.
gtgctcgcggcggcgctcgtgacagcgctcgcggcggcatcgaccgccagagccgagcccgccaaccaagtgctggggacgtggcgcatggtgtccgcgcggctcgatccggaggggcgcaacgcgccggcctacggcgcgcgcccgagcgggctgctggtgttcacgcgcgacatgcacttcgtcgaggtgctcacggacgccgacattccccggttcgcctcgagcgcgcgcggtcaggggacagcggaggagaaccgggcggccatggccggcagcatcgggttcttcggcacctacacggtggacgccgacggcgcgttcagcggcaaccgcgtcgagggctcgaccttcccgaactgggtcggcgacgtgcgcacgaccgagcagcttcgcctgaccgtcgagggggaccggctgagcgagagcttccggcgcccggacggtacgcggatcgccatcacgtgggagcgcgtccgctga

SEQ ID NO: 6739 - DNA, 303 bp, Methylobacterium sp.; identical to SEQ ID NO: 5686

SEQ ID NO: 6740 - DNA, 1635 bp, Methylobacterium sp.
atgcgacgcgacgagggtgacgggcgcacggtctccgatggcatccagcacgagcgctcgccgatgaggcgccgcgaggtcctcgccgccctggccgccgccgcggtcgcgcggcccgccgtcgcgcagcccgccaaggttctgcgcttcatcccggaaagcgacgtcgcggtgatcgacccgatctggacgacggcgaccgtgacgcgcaaccacggctacctcgttttcgacaccctctacggccagaccgcgggctacgagttccagccgcagatggtcgagggccacgccgtcgaggcggatggccgcctctggcgcctgaccctgcgcgagggcctgcgcttccacgacggcgcgccggtgctggcgcgcgacgcggtggcgagcgtgcgccgcttcgccgcccgcgacgccttcggccgggcgctgatcgacgccaccgacgaactcgcggcgacctccgaccgcgtcgtgcagttccgcctcaagcggccgttcccgctgctgcccgcggctctgggcaagaccggcacctcgatgccctgcatcatgccggagcgcctggcgaagaccgacccgaacacgcaggtcaccgagatggtcggctcgggcccgttccgcttcaaggcggacgagcgcgtcccgggggcgctcaccgtctacgagcgcttcgacggctacgtgccccgcccggacggcgcggcgagcttcaccgccggaccgaagcgggcccatttcgagcggatcgagtggcggatcgtgcccgacgcctccaccgccgcgagcgcgctggcggccggcgaggtcgactggtggcagaacccgacgccggatctgcaggcgctgctcaggagcagatcggggatccggctggaggtgctcgatccggccggcggcatcggctgcctgcgcttcaaccacctgcatccgcccttcgacaatcccgcgatcctgcgggcgctgctcggcgccatcgaccagaccgagttcatgagcgcggtcgcgggcgacgagcgcgccctgtggaaggaccatgtcggcgtcttcagccccgaggcgccgatggcgacgcgcgcgggcaccgacgggctggtcggcccccgcgactacgccgcggtcaggcgcgccctggcggaggccggctaccggggcgagcgcgtcgtcatgctcgacccgaccgattacccggccacccatcccctggccctcgtcgcggccgaagccttccagaaatgcgggctcgccgtggacctcgtcgcgatggactgggggaccctggtgcagcgccgggcgagccgccagcccccggacaagggcggctggagcaccttcgtcacctacctgaacggcaccaacaacttcgatcccgccggccagctcggcatccgcggcaacggcgaccaggcctggttcggatggccccgcgcgccccgtctcgaggagctgcgcgccgcgtggttcaccgcgcccgattctgcggcgcagaaggcgatctgcgccgagatccagcgacagttcttcatcgacgtgccgtacctgccgctcggcgcctattacgaggcgacagcctatcggggcctgacgggcgtgcgcaacggcttcccgcaattctacgatgtcaggccggcctag

SEQ ID NO: 6741 - DNA, 1182 bp, Methylobacterium sp.
atgcggactgcgccagccttctcctcccgccacctcgaccgcctcggcgaccgcctgacggccgatgtcgacagcggcgcgatcgccggggccgacatgctcgtcggcggcgcggacggggcgatctggcgacgcaccgtcggctaccgcgaccgcgtcgcgcacgcgcccctcgggcccgacgcgctctggcgcatctactccatgaccaaggttgtcgtctccgccgctaccatggtgctcgccgagcgcggcgcactgcgcctcgatcagcccgtggcggcattcattcccgccttcgagcacctgtcggtgcttgatccggacggcggcctcaggcccgccagggccaggccgaccgttcaggatctcctgcgccacaccgccgggatcgcctacggctatctcggcgacgggccggcgcggcgcgcctacgcggccgacggcctgctcgccgaggatctcgacaacgcggcgttcgccgaccggatcgcccgcctgccgctggagcacgagcccggcacggtgtggcactactcgcacgccaccgacgtgctcggccgcgtcctggagatctcgggcggcgcggatctgcagcgggtcctcgacgcgaccgtgctcgagccgctcggcatggccgacacgctgttccagatctcggccgcgatgggatcacgcgtcgcgcagccgctgccgcaagcaccggggcagcgccctgtctttcacgatcccgcgcagccgcggcgcggccagaggggcaatggcggcctcgtatcaagcacggcggactgcgcccgcttcctgcgcatgcttctcgccggcggcagtctcgacggcgcgcgcgtcctggcgccggccagcgtgcggctcatgacctcggatcatctcggggcggcgatcgcgaaggccgcctactatccgccgggaccgggctacggcttcgggctgggcgtggcggtccgcctcgcggcgggcgaggcgccgttccccggcaatatcggcgactggttctggagcggcgtcggaggcacatacttctgggttgaccctgtagaggggttcttcgcgctcctgatgatgcagacctcctcggccgaccagcgccagcactaccgcacgctgacccgcaccatggtctacgccgccctggaagaccgtcgactgtccgagacgtctccctga

SEQ ID NO: 6742 - DNA, 255 bp, Methylobacterium sp.
atgcctcagaatgtcgaatactggatcacggacaggccggacggccacttcgacgttgttgtcaagctcgagtccggcaaaatctttcgccgcagcgggtgcatctcgcgggccgaggccgatacgtggatcgagggattgcgaatgctgatggcggcgatcggcgcgcccgtatcggccgccgacgtgacgtctgacgacccatcacccctcggatcacagacggtggacggtgcggaccactccacctcctga

SEQ ID NO: 6743 - DNA, 390 bp, Methylobacterium sp.
atgccgcgcccgttggactggaacgcgttcgccgatgcgtggtgcgccgcctggaacgcgcacgatgtcgagcgggtgctggcccatttccacgacgacgccgtgttcacctcgccgggcgccgcgcggatcgttcccgcttcgggcggaacggtgcggggcaaggatgcgctgcgcgcctactggaccgaggccctgcggcggatcccggacctccacttcgcggtggagcaggtcttcgcgggcatcgacacgctggtgatccagtatcgcaatcagaagggtgtgagcgtcagcgaggtgctcgtcttcgaggacggccgcgtgcgggcggggcacggcacctacccgatcggcgtcgacaaccccgtcggtgccgcggcgggctag

SEQ ID NO: 6744 - DNA, 576 bp, Methylobacterium sp.
atgcgcgagctggtctacggcccccggcggttcagcgagatccgggcgaacctcccggggatcagcgcgaacgtgctgacgcagcggctagagagcctgggggcggcgggcatcgccctgcggtaccggctgccgtcgccggccaacgtgcaggtctacgatctcaccgactggggccgcgaggccgcgcccctgatgcgcgacctgggccgctgggccgcccgctcgccgcggcacgatccgagcctgttcatgtcgggggcgtcggccatgatgtcgctcgaggccctggtcgaccgcgggcgggcggcggcgctgtcggcgacggtcgctttccacttccccggcgaggacttcgtcgcgacggtgaccggcgacgggatccgcgtgcggcggggcgtcgccgaggcgcccgacctcgccttcaccggcgacacgatggcgatgcgccgcacggtctacggcaaggcgccgctggaccgggacggcgccggcgggacgctcgccgtcgcgggccccgccgacctggcgcggtccttcatcgacctcttcaccctgccggccaaggcgggctga

SEQ ID NO: 6745 - DNA, 183 bp, Methylobacterium sp.
atgtacgacctcatccacaccctccgcctctggctctggcgccgccaagtgcgggccatggcgcgggagtgccggatgtccgggaccagcgacggcgactggatcgccgccaccgtcgcggcctccgcgacgagctcgggtccgggcgcgccggtctcgtacgtgagcggcaccggcctgtag

SEQ ID NO: 6746 - DNA, 276 bp, Methylobacterium sp.
atgccaacactcggcctcaagctcccgctccggatctgcgtcctcgagaacgccgcctgcgtcgaggatgccggcggccggcgcaccggctacgtctactgggacgagggccgttcgggaggcggtgacaggcccttcacccgcgccgaggccatcgagcaggtccggatcatcgcgggcgcctgggccggcgccctggtccacagcggcaccctcgacaccggcccggcacccgagccgggtgccgccgccgccgagccgtctccggaaggctga

SEQ ID NO: 6747 - DNA, 249 bp, Methylobacterium sp.
atgaggatcctgacccgtacgacgctgctcgccgtcctcctcgccggcgcgacggggaccgttcacgccgccgagggccggggcaaggccggccaggatgccggcgcccgcacgaccagcatgggcgcgggcggcctcagcggcaccggcgccacccgggacggcgcccgcacgggcccggtcgagagcaaggggcagccgggcggcgcgaagccgccctccgccccgaaggccgggacgggccgctga

SEQ ID NO: 6748 - DNA, 1104 bp, Methylobacterium sp.
atgacccgcctgcgcctcatcgccgacgatctcaccggcaccctcgacacggccgcgggcttcaccggcctgtgcgggtcgatcccggtggcgtggccggagatcctggcgggggacggattcggctgcctggcgatcgattccggcacccgggaaggctcggccgcggaggccgaccggatcgtcggcgccctcgcgtcccggctggacggggccgacatcgccttcaagaaggtcgacagcctgctgcgcggcccctgggcggccgaactcgcggccgtgctgcgcgccggggcctggaagcgctgcgtggtggcgccggccttcccgtatcagggacgccgcacggagggcgggcggcagctcgcccggcgcggcgcgggcttcgagccggtctccggcgacatcgccgaggccctgcgggcggtcgggctgccggcgcgccgggccgacgtctccgacggccccgtggcgggcgtcgccgtctacgacgcggcgagcgacgccgacctcgcccgggtcgcggatctcggcggcgacggaccggtgctctggtgcggcagcggcggcctcgcggcggccctggcgcgcggcgtggcggcgccgggcgacgaccggctcgccggcccggtcctcgggctgttcggctcggaccggcccgagaccgcggcgcagctcgcggcctgcggcccccaccacctcgtcctgtcggcgcgccatccggaccatgccggcgcggtggccgcgcgcctcgaccgggacggcgtcgtcctggcgagcctcgcgctgcccgagggcaccgcccgggaggaggccgcggcgcggatcgccgggaccttcgcgggggtgatcgaccgcgtcccgcggcccggcacgctgctggtggccggcggcgagaccctgaaggcgctgtgcctcgcgctctccgtcgcgcgcctcgacgtcaccgggcagatcaccccgggcctgccccgctcgaccctgcggggcggacgctgggacgggctcgcggtcgtgtccaaatccggcgccttcggaactgagggcgtctggcgcgatctacttcacggcaacggctttccgcgcagcaggagcgacgcgtga

SEQ ID NO: 6749 - DNA, 378 bp, Methylobacterium sp.
atgccggcctatcacctccgacgcaccctcgagcacgcggacggccgctgcggcctcgccttcgccagcgaccgcctggaggcggacgacgcggaggcggcgatccgccgcgcccgcgacctgtgccggaccgccgccaacatgctcctgaccggggcggtgctgaccgattcccttcggccggatcctgtggtcgttcaccctggcgctggcccgggagccgctctgcgtccggccgacgagctgagggccccgacggaacccgcgcggatcggcgcgccgcgcaacgcccgcggcccgcgcgccgttgtcccgcacgggcgcggcccggagaggccgagagcgcggccgagcgagctgccgggagagctgccatga

SEQ ID NO: 6750 - DNA, 195 bp, Methylobacterium sp.
gtgttcgccggccggggccagtggcgcgggccggacggacgcatcgtccgcgaggccgcccgcatcgtcctgatcgtcaccgaaccgacgcccgaggcggtcgcgaccctgcgtgagatccgggaggcctaccggcgccgcttcgtgcagggcgcggtcgggctggtgctccagcggagctgcgcgctgttctga

SEQ ID NO: 6751 - DNA, 1089 bp, Methylobacterium sp.
atgaacgcggcagagacccgccagttgagcctgtgggagcagagcctgcggcgccccgaggccggagccgaccggccgacgaccaggctcggccccgcgctcgacggccgcatggatgtgtcgttcctccacaagggcttctgcatcgccggcctgccgctgcgccggcccaagaacacgatggagccgtggaaccggcgcgacggtcgcttctcgctgaccgtcgagccggcccggttcgtcctgcccaacgggcgccagatcgaggtgggcgtcccgttcggacccaaggcgcgcctcctctccatgtggctggccacggaggcccgcgatccgcgccggagcgccggcgaccgctggatggagatggggcggatcaccgagtggttgaaggccgtcggtttgccggtcacgggcggcgagcggggctcgatcgggccgaccaaggaccagctcgtccggctgagcttccccatcttcacgatggtcctgaacggcgacgagggcggccacgtgttcaagcgcgagagcctgatcgaggggggcgcgttcaaggatgacgacctcgaggtctgggccgccgggggacacagcgccatgcgctggccggaagcgctgatgctcagccagaacgcctacgaccgcttcacacggcactcgatcccggtgccgaccgccaggctgcgccaggtcgcccacaacgccatggcgatcgatatcctcgtgtacctctgctaccggctgccgctgctctcgcgcggggagagcgaattgctgacctggcgcgatctgatggcgcagttcggatcctcggaattcgcctcccgcttcaagcaggccttctcggaatcgatcaagcgcaccctcgacgcgtacccggaagccaacgtcgcgatgacggccgagggtctggtgctgcggcactcggacccggcggagctgcggcgcgccttcgtcgccgtcgcgggggggccgacccgtcgcgcccgtgccgcgccgcgggcgcgcaaggctgcgcgggtcccggatcagatgggcccctgcgagagcgcggacctgctgacgccggccggtgccgcgcgcgcctga

SEQ ID NO: 6752 - DNA, 189 bp, Methylobacterium sp.
atgactcgaatcctgacatccgtcctcgacggcgccgtgtgggtcgcggacgcgctcgacgatatcctcgtcgaggcggctctcggcttcggcgccgccgtaccgctgatcgccgacccgtccggcgatccgccgaccggcgcaaccaccggccaatccgagacaagtccctcgccgatccggacttga

SEQ ID NO: 6753 - DNA, 354 bp, Methylobacterium sp.
atgttcgatggtgtctggcggagccaagccggcgcggaactccgcctcctccagatgggcgaggcggtctccgggacctacaccgccgccgatcccggcttcgcgcagacgcatcgaagccgcatcctcgtcggcacggccgagggcgacatcatcggcttcgtgaccagcacgtcgtcgccccaggagatcacggcctggaccgggcgcctcgtccggaccgacgagaagacggccgaggcgatccacgcggtcttccacgccgtcgaacggtcctcgcagccgaaggccgtggccgatcacgtcgcgctcgagacgaccatcttctcgaaggtcgagaacgcctgttcgtga

SEQ ID NO: 6754 - DNA, 345 bp, Methylobacterium sp.
atgaagatgatctcgacgaagatgttgatggtggcgggtctcgcggccgcgacattggccggtggtgccgccagtgccgacgcccgcgggtttggccgtggcggtttcggacacggaggcttcggccatcacggaggcttcggccatcgcgggttcgggcacggaggcttcaggcacggcgggttcggtcaccatcgccatttctaccaccgtggattccgtcggcgcttcggcgggttcagctggggctatcccgcgaacagctccttcctcggcccgaacttcggcgactgccgcgcgatctacaatcctgtcttcttcggccatgagcgcgtgtgcggctag

SEQ ID NO: 6755 - DNA, 261 bp, Methylobacterium sp.
atggccgacctcatcgatttccccggaaaacgccgaggctccggctcggcctaccggttgcaccggttcggcgcggacggcagcgaccgcggcacggtcctcatccgagcccgcgacgacgcggaggccaggcatcaggccgacaggctggccgagggattgttggccgagctgtggtccggggaccggctcctggatcacttcgcgccggccggccacccggttgcggcctgcatcggtcccctgcgcgacgggccctga

SEQ ID NO: 6756 - DNA, 1188 bp, Methylobacterium sp.
gtgccgcgccggtccgccggccggcggcgcgccggcgccgcgggcgtcctgtccctctgcctgtgcctctccctgtgctgcgcggccgccgcgccgctcgccccgggccccgtccaggccgagacccgggaggcggcgcccgcgctccgcaccggcgagcccgagacgtggcgggtcgcgacccatccggtgccgcccctggtcatggacgaggacggccggctgcgcgggttcagcatcgatctctggaacgccatcgcgcgggatctcggcgtccggacggcctacctgcgcgtcgacgacctgccggcgctgttcgcggcggtctcggacgggcgcgcggacctcgccatcgcggcggtgtcgatcaccgcggagcgcgagcggcgtttcgacttctccgtcacgatgctggagaccggcctgcgcatcgccgtccggtcggagtcggacgcgaccggctcggccaccgcgcgggctctccaggcgctcctgagcgacgccgccttcctgcaggtcctgctggggctcgccgccctgatcctggcggtggcggccctggtctggtggctcgagcggcgccaccccggcggcatggcggcgcgctcgggaccggcgcgcggcttcgcccacgtcgtctggtgggccctgagcagcctcgccgcccaggcggaggagatgccgcgcagcccgctggcgcgggccgtcacggtgctctggctgttcacctgcatcgccctggtggcgtggttcaccgcgggcctgaccagcacggcgaccgtggagcgcctgcgcggcgcgatcaacggcccgcaggacctgccgggcaagcgggtgggcacggtcgccgacacgacctcggtcgcctacctggcggaccatttcgccacgccggtgggcttcgcgaccctggaggaggcctgcgcggcgctgcaggccggcacggtcgcggcggtggtctacgatgcccccgcgctcagctactacgcgacccggcccggccacgacgccctgcgcctggtcggcaccgcgttcaaccggcaatcctacggcatcctgttcccggccaacgatccccggcgcaagcgcgtcaaccaggccctgctgggcctgcgggaggacggccgctacgacgagatctacggccgctggttcggctccgagagcggcgagtcccaggggcgctga

SEQ ID NO: 6757 - DNA, 243 bp, Methylobacterium sp.
atgcgcgcgaagatcctcgtcctgtccctcggcctgatctgcgccggcgcgggacccgtctgggccgcgcggccgatcctcgaccggctgcccagcgccgtcgcgcaggccacgcccgggaccggcagcgcgccgatcctgagcgccgggatcgcgggggcgccggccctgacggtgctggcccgccgcaagccggcccggcgcccgcgcggcgcgcgcctcggcagcttccggccgctctga

SEQ ID NO: 6758 - DNA, 177 bp, Methylobacterium sp.
atgcggccctcctcacgcgcgttcctcggctgcctggtgctggcgctgctgatcggcggcctcggactcggcctgcgccgcgccgtggccgtcaccccggtcgatcccgcgttccgggcggtgctgcgcgcttatgcggtaccggacgcgtccggcgggccccagcaacacgagtga

SEQ ID NO: 6759 - DNA, 1038 bp, Methylobacterium sp.
atggctaaattcgaaagccgcgcgctcggcgggacgcgcgcggcggtgacgtcgcttggcttcggcacggtgccgctcgccggtttcaaggcgaaggtgagcttcgccgacgcccaggccatcgtgcaggcggcctacgacggcggcatccggtacttcgactgcgcgccgctctacggcttcggcaaggccgagtacaacctcggccacgcgctgcgcgaactgggcatccgcgacgcggtgacggtcagcaccaaggtcgggcgcgtgctcaaggcgaagagccggacgaaggcgctcgataccgtttacggcatcgactgggtcgagccgctgcccttcctcgacacctacgactacacctacgacggcttcatgcggtcgttcgaggacagccagaagcggttggcgctcgaccacatcgacatcctctacgtccacgacctcggcagcgcctggcacggcgaccaggccgacgtgtactggaagcagatccgcgacggtggctaccgcgccctcgacgagttgcgccgttccggtgcggtgaaggccgtcggtctcggcgtcaacgagacggaggccgtcgtgacggtggcgcgcgagttcgacatcgactgcgcgatgatcgccggccggtactccctgctcaaccatgccccgctggagggtgcgttcgacgagctccaccgccgcggcgtgtcggttgttgccgccggcgtgttcaattccggcgtgctggcgtccggcgtcgggaagggcggcgcgagctacgattacggcgacgtgcccgaggacatcgcgaaaaaggtcgctgccatcgaggacgtctgcgccgcgcacggcgtgaccctgtcggccgccgcgatccagttcgtcgccgcgcacctggccgtggcgacggtggtgctgggcgccaaggacgtcgagcagacccggcagaacatcgaatccttctcgcaggtcatccccgccggcttctgggcggacctgaaggagaaggggctgctccccgggacggcacccgtcccgcacgcctga

SEQ ID NO: 6760 - DNA, 150 bp, Methylobacterium sp.
gtgcccgagtacgacatcaagatcgtcgctccgcgagatcggaaagctccggacgcagagcgcgagactccgcccaagcgcaagctcgactgggatcgcgccatgcgcgaggccgcggaagcggaactctcgatccagtcgcacgactga

SEQ ID NO: 6761 - DNA, 294 bp, Methylobacterium sp.
ttgaacgagcccgaacagggcagcgcggaggccgtctacatctcggccatggtcggcgagatgatgcggcgcgtcctggaggacgctctcgccgaactcgcgagaacccgcggtgcggccttcctggagatcttcgtggcgcgcgagctggctcgctgcgccgacctgttccgcgagcggcccggcgacacgccggagacgacggacatgttgcgggcctggttcgtcatggagggcggtgaggcgctgcgcgccgtggtcgatcgcgccagcgtcgaggcggcgcgcgactga

SEQ ID NO: 6762 - DNA, 222 bp, Methylobacterium sp.
ttgcacgagttcgacgagcaattggcgcgtgaattcgtccgcggcctcgtacagtcggccgtcgcgcgcggtctcgatccggccattcggctcgatcagtttcgggcgttgcagcaagcggtcgtcgctctatcgcgagacgctgccgtggttcgaaccagcgagcagatcatccgggcgatcgactgcgctctccaggaactgaccgcggtgagatcgtag

SEQ ID NO: 6763 - DNA, 228 bp, Methylobacterium sp.
atgttggacggcgacgcctttgcccacgagatcgcggcgctcctgatcgccgacatcaagacctccggtgcgcgcacgcgcggcgagatcgaggaggcctgccggatttccctcgatagcctgctcggcggcaccgcggtgccgccgcagatcgccgtactgatgccgatcggcctggagcggtggccgcgggtggtcgtgaagggacggcccctaccggacgtgtag

SEQ ID NO: 6764 - DNA, 99 bp, Methylobacterium sp.
atgctgcgcaagctcctgacggccttcatcgtgccgaagctcatcgcctatctcgggcgccgctacgaccgacgccggggcaccggccgcacctactga

SEQ ID NO: 6765 - DNA, 699 bp, Methylobacterium sp.
ttgcccgcgcccgcgcccccgtcgcgcttcgacgccgtcctcctcgacctcgacggcaccctcgtcgacagcctggccgatctccggacggccctgaacgccaccctggcgcgggagggcctgccgccggtcgggaccgccgcgatgcgggccatggtgggcgacggcgcggtggcgctgctgcggcgcgccctgcgggcctcgggcggcgatccggagcgggcgccggacctgctgccggccttcctggccgtgtacgagccgctcgcggccgccggtaccgccctgttccccaacgccgccgcggcggtccgcgacctccgggcggcgggctacgcgctggcgatcgtcaccaacaagccggcccgcgccaccggcctgatcctcgacgcggtggggctggcgccgctgatcgacacggtcgtgggcggcgacacgctgcccgagcgcaagcccgatcccgcgccgctgcgggaggccctgcgtcgcctgcgggtcgagcccgggcgggccgtcatggtcggcgacatgcaccacgatatcgcggccgcccgcgccgccggcaccgccgccatcctggcccgctacggctacgggcgcccggacgacgcgcggaccgccgacgccgtcctcgacgacatcggcggcctgcgggcgatgatcggggcgctgcccgcgggcggcaccccggcctcctag

SEQ ID NO: 6766 - DNA, 1572 bp, Methylobacterium sp.
atgaggcgacgcaccttcctggccgctggggccgcggccctggcggccccctccgtcgggcgggcgcagggcgcccgggtcctgcgcatggtcccccaggcgaacgtcacctccatcgatccgatctggacgacggcgatcgtgacccgcaaccacgcctacgtggtctacgacacgctgttcggcctcgacgccgacctgcggccgcagccgcagatggcggccggcctcaaggtcgagcaggacgggcgccgggtgacgatccccctgcgcgcgggcctgcgcttccacgacggcacgccggtcctggcgcgggactgcgtcgccagcatccggcgctgggcggcccgcaacggcttcggccagaccctgatggccgccaccgacgagctcgcccacgacggcgacaccgacatcgtgttccggctgaaggcaccgttcccgctcctgccgcaggcgctggcgagcgtcagccagccggccttcgtcatgcccgagcgggtcgcccagaccgacccgtacaagcagatcaccgacgccaccggctccgggccgttccgctggaaggccgacgagttcaactcgggcagcctgatggtctacgagcgccaccccggctacgtgccggcgcccggcacaccgagcctgacggccggcggcaaggtcgcccatttcgaccggatcgagtggcggatcatcgccgacggcgccaccgcggcggcggccctgcagaacggcgagatcgactggtacgagcagccgccgcccgagctccagcagctgctcgcccgcaaccgcgacatcgtggtggagggcctcgaccggctcaccaacccggcgatcctgcggatgaaccacctgcagccgcccttcgacgacgtcgcggtgcgccgggcggtgctgccggcgatcgtccagagcgacttcatggcggcgatcgtcggcgacgatcccggggcctacgacgaccgctgcgggatcttcacgcccggcacaccgatggcgagccaggtcggcctggaggcgctcaccgggccgcgcagcctggaggcggcccgcgcggcgctcagggactcgggctacgacggcgcgaagatccggctcatcggccccacggacctgctggcgcccgcggcgctgacccaggtcgcggccgacctgctcccccggatcggcttcaacgtcgacctggccctgagcgactggggcacggtgatccagcggcgcgtctcccgcgagcccgtcgagaagggcggctggtcggtgctgctcaccaccttctcgtccttcgacaacgccgaccccgccgccctgcagccgctccgggccagcgggccgaacgcgtggttcggctggccgtcggtgccgcggctggaggcgctccggaccgcgtggttcgcggcccccgacgcggaggcgcgccgggcgatctgcgccgacatgcagcggatcgccctcgaggaggtcgtgttcgtgccggtcggctcctaccgttcgatgacgtcctaccggcgcgacctcacgggccgcctcccgggcttcccgatcctctggaacctccggcgcgcctga

SEQ ID NO: 6767 - DNA, 3156 bp, Methylobacterium sp.
atgaccggcgcggcgatgaccggcgcggcgatgaccggggcgccggcctccctcgcggcgccgacccgggcgctgacccccgagcagcgcgcctgcctcgacgcggccggcgccgcgccgagtctcgtggccgagatcgaccttcccgggccggtcgaggcggaccgcctccgccgcggcctcgccgcggtcgccgcccgccacgacgtcctgcgcaccgccttcgtgcgcgaaccgggcttccgcggcctgcggcaggccgaggccggcgcgcccgctatcccgctcgataccggcgcgccgcagggagacgtcgggaccgtcggcctcgcgccggagcgcggccagaccctcgcggccgtcctcctgccgggcgcgacgccgcggctgcgcctcgtcgccagcgccctcgcggtcgatgccggcagcctcgaccgcgtcctgtcggaggtcgcggccgcctgcgcggacgacgcggcacccggcgccgatcccgaggccgcgacctacgcccagtacgcggagtggcgcgaggcggtcgccgccgacgacgcggacggcgagggccaagcctactggcgggaccagatcggcgcgggcgcggcgcccctccggctgccctatcgccgcggggcggccgccgacgcggtggaggagccggccgccgcgatccggctgagtcgggccgtcgacgccgccgtcacggacgccttcgcgcgggcgttggcccggccggacctcgccgcggccggcgccgaggccgtgctccaggccgcgtggtggctgctcgtggcgcgcctcgccgagcggacggagatcctcggcggctgggcgcacgattgccggcgcgactacgcggtcttcgccggcacggtcggcgtcttcaccaagacgctgcccctgcgcctcgtcctcccgccggagaccagcgtctcggaggccgcggccggtctcgccgcgcggctcgacgagcaccgcgccttccaggaactctgccccctcgacgcggccggcggcgaccgccgccccgcggtcggcttcgcgctcgcggctcagggggccgcgcaggaccggctcctgcccggacccgccgggttcgagctctgcctggagccggccctcgacgcggaggggcacctcgccgcgctgaccttgcacgccgacccgcgccgctacgcggtggaagccctggagaccctgctcgatcaggtcgagacgctgctcgcccgcctgcccgcgaaggccgcgacgcccttcgcgacctacccgctcgtcggcgcgcgcgaggaggtgcgcctgcgcgccttcggccgcccggccgcccgcgccctgccggcggagacccttccggtcctcgtcgcccgccacgcggcgacggcgccggacgcccccgccctcgccggcgctggccgcaccctgtcgtacgccgcgctggaggatcgcgtcgcgcgcctcggcgcctggttcgccgcgcgcggcgtcggtcccgagcgcgtcgtcgccctggacctgccgcgctccgtcgacctcgtggtggcgatcctcgcggtctggcgcgcggggggcgcctacctgcccctcgacccggcctggccgcaggcccgccgcgaccgcctgatcgcgctcgcccggcccgcgctgaccgtcgcgctcgcggccgaccccgcggccggccggcacgccctcggggcgatcctcgacggcctcggtgaggcccggcaccccgccgaggcccgggacccctccgacatggcctgcctgctcttcacctccggctcgtccgggacgccgaagggcgtggtgatcgagcacgcccagatccgcgcctacgcggaggccgtcatcgacgccctcgacctgtccggttacgggcgcttcgcgctgacctccacggtggcggccgacctcggcaacaccatgctgttcgcggcgctgcgcctcggcgcctgcctcgtggtcgccgacgaggccgagatggccgacggcccggccttcgcgcgcttcctgcgcggcaacgccgtcgcctgcgcgaaactggtcccgtcccacctcgccgccctcctcgacggcgtcgaggaccccgcgctgcccgccctgctggtgctcggcggcgagccgacgccggccgccctggtccggcggatccgggcggcggcgccgacgacgcggatcgccaaccattacggtcccaccgaggcctgtgtcggcgtgctggtgcatccggacgcggccaccgcgccgccggacgagagcctgccgctgagccgcgtgctcgccggcagcgaggcctacatcctcgacgcggcgggcgcgctcgcgccgaccggcgcggtcggcgtgctccacctcgggggcgcccagatctgccgcggctacctcccgggcacggaggccggcggcgcgggcgcgttctcgcccaaccccttcggagcggggcggctctaccgcaccggcgaccgggcccgcctgctgcccggcggccgcctcgtgctcgccgggcgggccgacgaccagatcaagctgcgcggccaccgcgtcgagccgggcgaggtcgaggccgcgctggcgggcctcgccggcgtgagccaggcggcggtgcgcccgttcacggggccggacggcgcgaccgggctcgcggcctacgtggtcgccgaccccgagcggacacccgccgcgctcctcgcggcgctggccgaaaccctgcccgccgcatggctgcccgccccgatcctgcgcctcgacagcctgccgcggctggccaacggcaagatcgaccgcgccgccctgccccgtccggacgttcatccggacgcggacacgggcgtcccgccccgcacggcgctcgagaccgtgctcaccgacgccatggcggagctgctgggcctcccggcggagcgcctcggcgccgcgggcgacttcttcgcggccggcggcaactcactcctcgtcatcaagctgacggcgcgcatccgcaagctgctcaaggtcgagatccccccgagcctggtcttcgaccacagcacgcccgcgaccctcgcggcggcgctcggcacctacgccccgccggacgcgatcgaggagacggcgagcctgcgcctggaactcgccggcctgagcgagaccgagcgcgccggcctcgccggggtgggcgcgtga

SEQ ID NO: 6768 - DNA, 1293 bp, Methylobacterium sp.
atggactcgagaatcgtcgtgatcggcggcggcttcgccggtctgtgggccgccgccgccgcggcgcgcgcccggaccgagttcggcctcggcgaccgcgtcgcggtcacggtgatcgcgccggacccgttccacgtcatccgggtccgctgctacgaggccgatctcggcgccctgcgcgtacccctcgacgacgtgctcgggccgatcggcgtggaacgccgcgaggcgcgcgcgatcgacatcgaccccgcggcgcgcacggtcacggtcgagtccgcggcggcgtccgcggtgtcgtccgcggtgtcgtccgccgcgtcgtcgggcgtcgtcgagacgctggcgtacgaccgcctcatcctcgccgccggaagcctgctgtggcgccccgagatcccgggaatcgcgggcgccttcgatgtcgacaccttcgcgggggcccaggccctcgcggcgcatctcgatcgtctcggtgacgcgggcgggccggatgaggccggccgctggaccgccgtcgtcatcggcggtggcctggtgggactggaactcgcctgcgagctgcccgcccggctcgccgctgccagggaccgggccggggccacgggtccggtgcggaccatcctgatcgaccacgcgcgcgaagtcgggagcgccatgggcgcggcggccctgccggggatccgcgaggccttgcgcgatgccggcgtgacctgcatcggcggtgcgcgggtcggtgccgtcgatcgcaccggggtgacgctggcggacgggacgcgcctgccggcgtggacgagtgtctgcgccaccggcatgcgggcgagcccgctgggcggcacgctcggcctccccctcgacccgctcgggcgcctgcccgtcgacgccttcctggccgtccaggggctcgctggcgtctacgcggccggcgacatcgcctcggctgcggcggacgatgccggtcatcgcacggtgatgtcgtgccagcacgcccggccgatgggtcggttcgcgggtttcaacgccgtctgcgatctcgccggccggccggagcggcggctgcgcttcgccgcgcccgactacgtcaccgtgctggatctgggcgcctggggggcggtctacaccgccggctgggatcgcggcacgctggtctcgtcgggcgccgccgcgaaggcgacgaagcaaatcatcaacggcacgcgcatctatccgcccctcgaccgcgacgccgcgtccatcctggccgcggccgcgccgatcatccaggccgcgcccgcgacgcaggccgcgcgatga

SEQ ID NO: 6769 - DNA, 1125 bp, Methylobacterium sp.
atgccccggtcggtgtcccgggcgagcccgcgcccggcggccgggctgctgatcctggcctgcggagtcggtctggccgggcccgcctgcgccgagcctgcgcccgctccggccacggccgcggccagttcctcgaccacgtcgggggcgggtgcggccgacgggacgcccgtcgcggccgcggcccgcgcgcggcgccaggaggccggcgtcgccgtcgcggccgccaccgtgatggcggcgccgccgccgtcgttcttcaacttctccgacactgtggtgagctaccgcttccagggaccctcggcggagcccggcctccgtgtccagcgtcccgacggccagttcgtggggcgcgaggtccccaagaccgtcatcaacctgttccacgccaacgcgtgggcctacggcaccaacctgctctccctcgacatcctccggtccggatcccaggacccggccggcaatcaggtccgccggttcgagggcgtcggcgccaccgagttctacctgatctaccggggcgtcctgagcctcaacaaggtcttcgacacgcaggccctagccatccccggcttcgtgaaggatgtcggcctgtcgttcggggccgacgtcaacaccaaggacacgaccttcgactccgagaagcgcgccggaaccttcgggctgagcttcgccttcgacgtgccggccgggttcgtgaacctgaaggtccagggctacaaggagttctcccgcaacggcttcgccggatacgggccggtgccgggcttcgactacgcgcacttccgcagcgtcgagttcaagatgacgccggaattcgagatcacctacacgatcccgctgccgttcaccgggctgccgctgtcgctcgccggcttcaacacgatcgtgctgcccaaggggcgctacggtcgattcaacgagaacgacacccagctggaattcgtctcccagaccaacctcgtgctcgatgtcgggcagctcgtcgccggcacgcccaaccgggtcgaggtcttcgccgggttccagtactggcacaacaagttcgggggcgacccgcggcgcacgctcaacaccgaggagaaggcgctgatcgccggggtggcctaccacctgaaatga

SEQ ID NO: 6770 - DNA, 741 bp, Methylobacterium sp.
atgggcaaccgacgcgaattcctgaccgccacggccgcgggcctcgccgccgccgccgcggcgccggcccgggccgccgaggagcgcacggcggctccgaaatccacgccggcgggggcgccgcccttcggcatgccccgcgacatggtcctcctcaacatgcgccgcggcgacggctacgccctgggcgtgaagacgaaggacggcgttctcgacgtcgaggccgccggccgggcgctcgggatgccggtccccgccgacatggacgaccttctccagaacgggcgcggcccggccctgcgcgccctgatcgacgcggtcgaggccgcgcccgacgggcgcttcgtgctggcggaagccgacgtcgcctacgcgccggtggtcacgcggcccgagaagatcatcatgatgggcttcaactaccgccaccacgcggaggagaccggcacgccgatccccaaggacccgccgctgttcaacaagtacaacaacgccctgaaccaccacggcggcacgatcgcgctgccgactcaggcggcgcgggaattcgactacgagaccgagctggtgatggtgttcggccgcgagtgccggaacgtgtccgaggcggacgccctcgattatctcgccggctactgcacgggcaacgatttcagcgcccgggacctccagacgctgacctcgcagttcatgatcgcaagacctcggacgggttcgcgccgctcggcccctacctggtga

SEQ ID NO: 6771 - DNA, 1023 bp, Methylobacterium sp.
atgcgatccatcctcgccgccgccctgctgccggcgatcgccgtcccggccggggcccagagcctgtcggcatcgcttgagccgatcacccctgtcgccaatccgggccagctgagcctcggcggcagttccaccaccgggcagttcccgaccgtctcggcgcagaccggcggcctcgtgaatgccggccagctgagcttcggcgggggcggcggcggtggcggcggccgcatcggcgcgtcgggcggcctctcggccgggacgacgctcggcgccacgaccgccggttcgggcgcgacgggccagctcggcggcctgggatccaccgcgaccggcggtgccggcgtcaccggcacgaccctcgggaccggcgggacgatcggcgccaccggtgcccgcagcggcctcagcggcgcgtcccgcacgggcctgggctcgaccgcggggagcctcctgacaccgaccctcggaacgggcggtctcgggggtgggtcgggcctgtcccccggcctgggcaccggactctcgggagccggcctcggcgcaggtgtcggcgcaggtgtcggcgcaggtgtcggcgcaggcgttggagtaggtgtcggcacgggcctcaacgctgccggaagcctcggctcctcgctcgcgaccggctcgtccggcgtcgcgtcggccggtctcggcagcggcgtggccgcgtcgggcatcggcgcgacaggcgccaccctgtcccccggcggtctgttcgggctgttcggactgttcgggctcgggaccggaacggccgcgagcggggccacggccgcgacggtttccgggacgggcggcgccggcacgggcggcgccgggatccccgggacgcccgggctgcccgcggacgatcccgcccaggcggcccgcaccctgccgaccggcggcggggcgatcggcggtgccggcatcggcggcgcggcggccgcgccggtccggaccggcgacctctgcggcgggcccttcgccgaagcctgcctcggccaggggttctga

SEQ ID NO: 6772 - DNA, 222 bp, Methylobacterium sp.
atggcacagtgcatggcacagtcgtcgggccacgaggtcccgacccagatccgcgacgtcgccgggaccggtctcgcacaggcccggacggccttcggaagcgtcgtcggagcggcgcgccgcgcccccgacacggtccgcacgaaagtggtgcgagggcaggatgcggcccgggaagcggcggccgccgctcgcgacgctgccggggcggcgtcgcactga

SEQ ID NO: 6773 - DNA, 180 bp, Methylobacterium sp.
atgacgcgcgagaccgcagacccgacgagccgcggcccggacgcgcgcgaggcggacgagcctccggcggagcgcgtcaaggcggcgccggccacgatcccgaccgaggatcccgaggtcggcctcgcgcagaagggcagcggggaagaggcgatcgtccggcgcgagacggagatctga

SEQ ID NO: 6774 - DNA, 255 bp, Methylobacterium sp.
atggccctgaagaccacctacctcgtgcagccgttcgagctgcaccggaatcgcctgcggccggcccgtcaggagcccgcgcagagcgagttcggcgccctcaagaaggcggaggcgctggccgcccgcatgccgggcgcggcggcgctcagggtcgtggccgacgacgagaccggggagctcgagggcgtcacgatcctcggccagttcgggaccgtcccggacgatttcgccgagagcctgctggggggctga

SEQ ID NO: 6775 - DNA, 144 bp, Methylobacterium sp.
atggattggttcgacctgcccgaagacccccagccgccgtcggccgccgacgcgagccggatgcggctctacatcgccgcggggctgatcggcatcggggccctcgggatggtcggcgggatgctgcacatcctccccgcctga

SEQ ID NO: 6776 - DNA, 261 bp, Methylobacterium sp.
atggccacgcccgagacccaggcgccctaccggctgcagtgcatgatccaccgggaaagcgccggcggcatcatcatccacgacgagcagattcccgggcccctcgtggaggcggcggtcgccgccgccaaggcccgcttcgcggagctgcgcgccggccgcgcgggctcggcggccctgcgggattccgccgggcgggtggtctggtcggcccggcaggacgccgcgacgcccggcaccgggggatcggcaggccggtag

SEQ ID NO: 6777 - DNA, 96 bp, Methylobacterium sp.; identical to SEQ ID NO: 5730

SEQ ID NO: 6778 - DNA, 93 bp, Methylobacterium sp.
atggggctggtcgccttcatcgtcttcgtctgtccctggatgggcatcgccggcctgctgtggatgcgggcacagcaggccaagccgctctga

SEQ ID NO: 6779 - DNA, 1626 bp, Methylobacterium sp.
atgacctcgctcacatttgtaattgtctacgtcctgctattgcaggtcggagcgatcgacgctgccagccgcactctggctcaggagatcggggctgcccgggctctcggcaccatgaagcagcggacacaggagctcggtgcgtcggaacgtctcgcgcgcgccgtatcgaccgaggccgaccctcgagaggacatcgaccggacaattgagccgcacgaggcattcctgaaggcctggaccgcctatgtgtcgacgatcaggacggcggacgagcgggagcgcgctcgaggtctgtgggacgcgtggcagcatttcctcgccgtggaggcggaagcggccgccctcgacagggctggggaacgtgatctcgccgacagggtgcgggcgacggcgcttcaggccgacgcggcagccgtcgcacgggatgtcgacgcgctgctgaccgaccgcgacgccgcggtcgccgagcaactcggagctgtcgacgccgccggctcgaccttgcgcccgagcctcgtggccggcttgtccgccgctgcgctggctgccctggtcctggtgcaggccatcctgcgcggcgtcgcgcagccgatgacagcgctcgcctgcgccatgcagcgactggccgaccacgatctcaccgtcgcggtcccggcggcagcggtctgcaccgaactcggcgtcatggcggccgcgacgagagctgttcaggaaacgctgcggcaggccgtgttgcgggacgcggaggccgatcggtcgcgcgctcagagcgagcagcgccgcgccgtgatcgagtacgcgaccgagcgggtcgagaccatgatcggcggcatggtcgaggcagtgtcttcgaccgccgcggcactgcgcgtcaccgccgacgacgtgggccaagcgatccgcgatggggcggttcgaacgaccacgttaggcgccgcgctcgcgcagacgcgatcgaaggtccggcagatcaccgtctctgccgacacgttcggcgcggcggtcgaagaggttggggcgcaggccgaggccaccgcggccctggccggaagcgccgcggcggacgcggcccggacgaccacccgcgttcaggcgctgagcagcgccgtcgaccggatcggcgacgcggtccgcctcatcgccaagatcgccgcacagacgaacctgctggccctcaacgccacgatcgaggccgcccgggccggcgacgcgggccgcggcttcgcggtggtcgcctccgaagtgaaggccctggccgcgcagaccagggaggccaccgagatcatcggccagcacgtctccgagatccgaggctcgaccgacgcggcggtgtcggcgatcgcgggcatcacggcgcgggtcgaggacatgagccgcgcggcgaacgttatcgtcgagtccgtggagcggccgggtgcgaccgcgcgggagatcgtgacggccatcgcggaggcgaccgacggcaccgaggagttcgacgcggagggcgcgggcgtcaccgagatccccgaggcggccgagccgacgacggccgtgttgaccgcggccgacggcctgacccaggacgccgcccgtctcggcgaggcgctcgctggcctcctggagagcctccgtgcggcgtga

SEQ ID NO: 6780 - DNA, 825 bp, Methylobacterium sp.
atgctgagctacctgggtgacacgatcgtcggcctgaccctcgcggtcctgaacgcgctggcgccgctcgaagtccacgtggacaagggcgtcccctatgccgacgggagcgcgcaccgcgccgacatctaccggccagccgccgggaagccgcgtccggtcgccgtgttcctgtacggcggcgggtggcggaccggatcgaaggacgaggttgcctacgtgggcgcggccttcgcgcggcggggcgtcgtcgcggtcatccccgagtaccgccacgtgccggcggcgagcctccaggacatcctcgcggacaacgccgccgccgtcgcctggaccctcgcgcacgcggccgagtacggcggcgatcccgcccgcgtcaccgtcgtggggcactcctcgggggcctgggccgccgcgatgctgggcctcgacgcgacttggctccagcgggccggctccagtcccgccaagctcgccgggatcgtcgggctggccggaccctacgcgacttcggcgctgaccgatccgctggatcgccaggtgttcgcgggcagcgatccggccctgcagccgatcaaccacgccgccgatccccatccggcgatgctgctggccaccggcgcggcggatctcgacgtcaaccccgccggaaccctgtcgctcgaccgggcgctgcgcggcttcgacggcagggagacgattaagatctacccgggtctcgggcacgggcagatcgtccacgcgatgagcttcccgttcagtctccggtactcggtcgcggacgacgtcgcgcgtttcgttaagggcgcccgtgccggcccgtga

SEQ ID NO: 6781 - DNA, 408 bp, Methylobacterium sp.
atggaccacctcaccgaccaccgttcaaccttcatgctggagaaggtcggcgcgatcgtcgcggcctacgtctcgcgcaacgcgatcgaggtcacggcactgccggcgctgatcgaccaagtgcacacggcgatcgcggtgctccgctgcgcgccgtcggagttcggcggggtcgggctgagccagtcgcaggtcgatgcctcgatccagcaggacggcctgatcagcttcatcgacggccggtcctaccagactctgaagcgccacctcaccgcgcacggcctcacccccgagcggtaccgggcgaagtacggcctgccggccgactacccgatggtggccccgggctacgccgcgcggcgctcggagatcgcccgggcgatccagctcggccacaaggcggcctga

SEQ ID NO: 6782 - DNA, 114 bp, Methylobacterium sp.
atgttcgcccagccccacgccctcatcctccgccatcgcgagcgcgtcgccgtgctcatctcctcagcgctgttcctggcgggcgccctgccgctcttctgggcgatcggctga

SEQ ID NO: 6783 - DNA, 273 bp, Methylobacterium sp.
atgacccgaaccctcttccgctccgcgggcctggccctgctgagcctggccgtcccggccaccctcgcggcccagggcctggcgcccgaccagaccgggacgggcggcggcccggccacgacgatcacggcgccgaacaccaacagcctcggcgtgaccaaaccccccggcacgtccctcggcccgggcgaggtgccgccgcgcgccgtgcaggagcacgagcgcgcccggctcaacaagatcgagcgcagcatctgcgacggctgcaactga

SEQ ID NO: 6784 - DNA, 972 bp, Methylobacterium sp.
atgccggcagacatcctcgacgaactcgggccgctgttcctgggcagccgcctcaagcgcctcgccgaccgcttccaggccgacgccgcccggatcctgcgggacgaggggctcggcatccagccggcccagttcccgctcctcgccgccatcgaccgctacggaccgctgaccatcggcgacgccgccgccgccctcggcgtcagccagccggcggccacgcgcacggcggcgagcctcgtcgcgctcggcttgctcgaagaggcgcggtcggacgcggaccttcgccagaaggcgctgtcgctcagcggtgcgggcaaggccctgatggcgcgcgccaaggacgcgctctggccgcgcgtcgacagggccgtcgcgagcctgtgtgccggcctgtcgggccccctactggaccaggtcgccgccctggagcgcaggctcgacgccgtcccgttcgcggcccgcatccgccaggacggcgcggccggcgacgccgcgacgggcctgacgatccgggactacacggacgcgctggcggaccgcttccgcgacatcaacgccgagtggatcgaggcgatgttcgcgctggaggagaacgaccgccggatcctgtccgatccccgcggcgagatcctggaccgcggcgggctcatcctgttcgttgagtcggcggatctcgggatcgtcggcacctgcgcgctgatgcggacggaggcgggctgctacgagctgaccaagatggccgtgtccgcgcgggcccggggccgcaaggccggcgagcacctgctgcgggcggtgctggcccgcgccgcggccatggagatcgagacgctctacctgctgaccaacaccaagtgcgcggccgccgtgcacctgtacgagaaggtcgggttccggcacgacccggagatcatggaccggttcggccggcgctatgcccgctgcaacgtggccatgcgctatcccctgtga

SEQ ID NO: 6785 - DNA, 1245 bp, Methylobacterium sp.
atggacatgcaggtcgagaaagcccagggccggcctctgaaaggcatcgaccggaacaaggtgatcgcgcagtcgctgcggcagttcgcgcgcctcccgggcctgcccgacaccaagaagggcgtgcgctcgtaccagagccacgtcaaaagcgacccctggctgccgctcctgttcgtcgtctgcttcgtcctgccgaccctggccgccgggatctactacgggctgatcgcctccgaccgctacgtcaccgaggcgcggttcgcgatccggccgaccatcggcaccgccgacaaggcgacgcccgacacggtcggcacgaatgccggtgtgatcaaggcgaccgtcgcccaggaaacgctcatcgcgcaggagtacatccacagccggcccatggtcgaagcggtcgcggcggaactcccgatccgcgcgtggttcggtcgggacgacatcgacatgttctcccgcttcaacccggagaagccggtcgagaagttcctgcggtactggcgccgccgggtcgacgtcgacgtcgaatcggcgtccggcatcatgtcgctgaccgtcgaggccttcgatcccgacgagtcgctcgccatcaccaaggcggtcatgacggatacggagcggatgctgaacgacctcagcctgccgtcccggaaggacgccctcgacgtgagcacgcgcgtcctgaagctcgcggaggagcgcgaggccaaggccaacgccgccctgaacgagctgcgcaaccgcgagggcgtgctcgacgtcatcaagtcgaacaccgccaccatcaagtcggtctcggaactgcgggagacgcgcaccaagctcgccgtccagctggcggtgctccagcgggacctcggcccgcaatcccgcagcatcgtcgacctgaagcagcagatcggcgatctcgacgcgaacatcgcgcgggtccagcagcagctggccggcaccgcgccgaccgagaagcggcgcctctcggacgcgctcacgcggttcgaggatctcgagcacgagcgcgagaatgccgagaagtatcaccgcgacgtgcagctggcctatgaccgggcccgcatcgtggcccagcagcaggtcgtggccctggtgccgatcgtcgagcccatcaaggccggatcctcgaccgagccgcgccgcatcctgatgacgagcatcatcaccgccggcgccgccgtgctgttcgcggccgcgatgttcacccgccgcatgctcatcacctga

SEQ ID NO: 6786 - DNA, 240 bp, Methylobacterium sp.
atgtacaagctcccgcccggcagcctctaccggctccgcaccctcgcgcagaccggcgcccgcttctatcaggtcagcggctacatgcggcgcatggaggtcctgggactggttctcgcgacgggtcggacggatccggacacgaagaccgtcgagtaccgcatcaccgaagccggccgagccgaactcgaggagcgtcacggtccggcctggcccggctcggccgaggacgaggcctga

SEQ ID NO: 6787 - DNA, 378 bp, Methylobacterium sp.
atggattcgggcgaggccctttcggatcgacgtgtcgggccggccctgcgggccgtcgtcgccctgctggcgctctacgccctgctgctccaggcctttctcggcggcctgatgccggtgccggcggcgaccgacggcctctgcgcgcagcatgccgacgcgtccgctccatcgggcgcgcccgtcccccacgaccacggcgattgctgcacggcggcccaggccaccggcccggcgctcccgccgcgccccccgtccgtcggcttccgatgggtcgcgaccgcggacctgcggccggcctggcccctcaaccggagcgtcggcgcccgcgcgccgcccggcaccattgcgtccccgagggggccgccgaccgcctga

SEQ ID NO: 6788 - DNA, 1551 bp, Methylobacterium sp.
atgctcctgcgcgcgaccgctacagcgatcagagctcacctggacgatcgcgcctcgcgcctgatcgcggcggccggcacatgcctactgctctgcctcgcgctgctcggcgtctatctctgcctggatctgcgggacgtcgcttggcacaacgcccgccgcaacgccgggaatctcctggcggtgatcgaggagggcgtcggccatagcctgcgggtctacgacctctcgctgcggaactccgcacggctcgcgagtcgcgccgacatcgcggccttggacccggatattcggcgcctggcgctgttcgacacggctgtggcgggctccggcctcggtccgatcgctgtcacggacgcggccggcgacgtccggctgacgagcgatcccggcgtgcggacccggcccaacatgcgcacgctgccggaattcgagttccatcggtcgaatcccgaaggcggcctgatcctgtccgggccgaccgtatctctcatgaccggtgagcccatcatccgcatgacccggcggatctggacgcccgacggctcattcgccgggatcgtgtcgggatcgatcaggctcgcgcattttcaggcgctgttcgagcgcctgcatttcgacgacggcatcgctctgaacgtcttccaccgggacgggacgctgctgatccgggcgccggcacggccggaggcgctcggccagaacatcagcgcgagccccggctacaagatgtaccgggccaaggcgcgcggcgagttccaggggcgctcgttcctcgacggcgtcgagcgggtctacagcttcgccgacctcgacgacctgccgctgatcgtgaccgtggcgacggacgtcgacagcatccgcagcggctggatctacaaggcggcgatcgtcgccgtcctgatcctgtgcctctgcctcctcgccttcggcctgacgatcctgctgcaccgggaggtcgggcgccacgtggccgcggaagcctccagccgcgaggccaacgccgcgctcgccgtgctcgcgcggaccgacggcctgacgggcctgccgaaccggcgcagctacgacgagcacttcgccgtggagtggaagcgggccgcacagctgcggacgcccctggcgctgttgatcgtcgatgctgaccacttcaagcagttcaacgaccgcttcggtcaccagcgcggcgacgaggcgctgaaagcggtggcggagtgcctgcaacgcaccctcgataccgccggcctgagcttccggatcggcggcgaggagttcgtcgccctgttaccgagcgtcgacgcgacggccgccagcgtcgcggcggagcgcgtccgccgggccgtggtgaacctccgcatcccccacgccccggaggtcggtggcatcgcgacggtgagcatcggcgtcgcctgtgccgatccggccggcggcgatccgcccgaagggctgttcacggcggccgacgccgccctctacgcggccaagaaggccgggcgcaaccgcgtccgcgccgccgcgccggcggatcccgtggccctggcgctgcgggcctga

SEQ ID NO: 6789 - DNA, 291 bp, Methylobacterium sp.
gtgctcgacaccccgctcgccgccgagcccgtgcgcgagacggcggcgatccggccggtggtcgacgccttcgagagccgcgcgatcctggaaggccccgtgcacgccgccgccttcttcggcgcggcggccggcccgcaccggctcgacgggatggacgagtggcgcctcgacgcggccgggcgcatcgccgagatgaccgtcccgtggcggccgctgccggaggcgatcgccgtccgggaccgcttggcccgcgccgcggaaacgccgacttccgcggcgaccgggtga

SEQ ID NO: 6790 - DNA, 363 bp, Methylobacterium sp.
ttggagttcagctggttcaccaagtgccagatgatggcgtcaaactatgcccagcactgggagatggttctcgagcctgatctcggaagtctgattcaggccgtcgccactgatgcgcggaccagcttcaccgggccgcaatcgatgcggcgcgtcgccgaacgactgacgctcgttgcagactcgcttgtcgcggcgagcgacgatcgggctcgcgctgccgatgtgcgccgcgaggacggtcgttgcacggaagcgctgcaatacttggcgtcgcaactggcgagcacggcagccagcgtcgaggcatggaagcatgcgtccgcctccgcgactgaaacaagtcaggcgccgtcggcgtga

SEQ ID NO: 6791 - DNA, 219 bp, Methylobacterium sp.
atggagatcaagcgcgatctgatggacatggcgcatgcggacacgatcgtgaagtccttgaagagtcgtggcctgaccagggacgaattcgaggacgtggtttcgggcctggccgccgatggtctgctttcgctggagcgatctcaggtattgaccctcaacttcgagcgcacagacccccaaagcccaagtctcgtggataatcgtgacgctcgataa

SEQ ID NO: 6792 - DNA, 222 bp, Methylobacterium sp.
atgccgacactgcccgacgcctacctccgggacatccttgcacaggcggaacaggacctcgccgcggccgagctgcgccgggcccagcaggcacggatcgtcgccggcccgctcaatagcccggagacccgagccgccgcggaactgcttctgcgggagatcgaccggaccatcacgtccatctgggcgaaccgccatttaatcgaggtcatcctggcctga

SEQ ID NO: 6793 - DNA, 219 bp, Methylobacterium sp.
atgggttccagcgatcccgagacgcgcaggcggcagctcgaccggctgcgcgcggcctacgaggcccgcgcgggccggccggacctcacggccatcggcagcggtgcgcggcactcgcgggtgctcctgggacggatcctcgtggtgctcggcggcctgccggacggggccggactgccggcgatcggtccgggcgggaacggacgcgcccagacgtag

SEQ ID NO: 6794 - DNA, 411 bp, Methylobacterium sp.
atgcggaacgcattcatctacgcgaccatcctgtcgacgctcccgctccccgcggccgcggcggagacgtgccgcgaccattaccggagcgaggggacgccgatgctccaggccatcacctacaagacatggatgatcttcccctcggtcagccccagggccgcgttcgaccgggtgacgcgggcggtcctggccgaggggttcgtgggcgtgcacgtggagaaggcgctcgggaccctgacggcccagcaggagacatccggttcggggcgaccgcagacgctgcgggtcgtcgtgcgcaaggccggggcgggcagccgggtcgacgccctgttcatggtgcaggccggtcagatcggtcaggatgtcgaccagaacctgtgccgcatcgtcgatgccgcggcgcagtag

SEQ ID NO: 6795 - DNA, 498 bp, Methylobacterium sp.
atgccgctggttgtcatcttagccgccctgtgcggcggattgcctgtgcttgcctttggctggcaaacgttcggcttctacacgataatactcgcgtcctgtgtcgccagtgcagccgccgtactggtgggtggcggactcgcgctcctgaaggtcgcgaggtcccggacttcgcaggatccggcgaagatcttcgacatcgacaggctcacgagcggcgaccgcagcgactttcggctcgttccgcgccgcctctacttcgacatcgagcacggtcgcgagatcatcaaggacgagatcggcatcgaggccacgagcatcgaccaggcgctcgacgacgcccggagcgtgatccgggacatggtccaggagctcgccgacgagggctacgcggaggactgggtgctggtggtgcgcgatgccagaggggcttcggtcgcgcgcctgcccatcgagcggacgcccgcgcagacacggcccgaccgccgctccgcctga

SEQ ID NO: 6796 - DNA, 141 bp, Methylobacterium sp.
atggatcagatcgcccccgctcgtaccggccgcacccgcaggaggcctcatccggcccttgtcgtggcgtctgtcgccctcgccatcggcctctggttcgtcatctacgcggtggccggacgcgccatctggttctggtga

SEQ ID NO: 6797 - DNA, 1869 bp, Methylobacterium sp.
gtgacccgctcccaggccgcccgccagactgcccgccacgccgcccgcgtcgtcgcgctcaccgcggcgatcctgctcccggcgcaggccggatcgcgcgccgccgaccgaggaccgacagacgggccgggtgacgggccggcagacgggccgagcgacaggccggacggcaccccgcactttctcgagcaatcctggacgccgcaggagcgcgcgtggttctaccgggcgagccagggctcgcagatcatgccgtatgcctggttcatgtccctggagcgcccggacgacgacacgctcttcgtcgcggacgggctcgcgcgcttcggctacctgccgaacccgtacgacgggacgcgcggatcggaccgcagcgggctccccatcgggttcgtgaaggacgtcgacgatcgcggcgagtggatcggcctgacctgcgccgcctgccacgtgaaccgggtcgacctgcgcggtcggtcgatcctgatcgacggcggcccggccgatgccgacatgttcgccttcatcgaggaactcggccgcgccctcgcgcggacgcgcgacgacccggcgcgcttcgagcgcttcgcccgccgcgtcatcccgacggaactgtcggcgccggggacgggcccgtccgagcccgaccgccgccgcctgcgggccagcctgacgcggctggccgaggacttctcccgttacgtcgcgtcgagccggaccgcggtgccctgggggccggcacgcctcgacgcgttcggcatgatcttcaaccgggcgacgggcatcgatctgcgcgacccgcacaacatcgccccgcccgacgcgcccgtcagctatccgttcctgtgggatacgtcgtggcacgaccgggtgcagtggaacggctcggccgcgaacgggctcgccgtcgagcgcctgggccggaatgtcggcgaggtgctgggggtcttcgcccgcaccgacatccgggagccgaccctgccgccgctctggttcgagacctcggcggaccgggtcaacctcctgcggatcgagaaccagctgggcgccctcacggcgccggcctggcccgaccggatcgcgccgcgcaccgaggcgcaggcccgggacgccgcggccggcaaggtccactacgaccggtactgcctgtcctgccacgcgatcgccccgaccggcgcgaaccgcacgctgacggtgaccctgacgccgctggcggagatcgggaccgacccgaagatggcgacgaacgccgtgtcccggcgcgcgcggaccgggatcctcgaagggatccggatgccgttcctcgcgacgacgccgccgctggccgccgagacgagcagcctcgaactcgtggccacgctcgtcgccggcgcgatcctggcgcccctcgaccgtggaccggacccagcgggcgtcggggcggaccagaccgtcatcctcgaccggctgctcaagcgcggcaccgccgccctcgaggcccgcaacgcgatgctcgacgacgtctcgaccgccggcggcaagggcctcgtcgccgcgttcgtcggtgcgcggagagaccgcgacctcatggtctacaaggcacggccgctcaacggcatctgggcgacgggcccgtacctgcacaacggctcggtgccgaacctgtacgaactcctgctgccgtccagccggcgatccaggacgttccgggtcgggagccgggagctggacgaggaccggatcgggttccggtccgatctcgggccgttcctgttcgacaccgcgctgccgggcaatgccaataccggccacgaggggccgacctacgggaccgagcagctcgacgacgcgcagcgccggcagctcctggagtatctgcgaaccctgtag

SEQ ID NO: 6798 - DNA, 939 bp, Methylobacterium sp.
atgagactgcctgtcaccggcgacggccggttctgggcccttgccttcctgggcctcggcctcccggcctgcctcgcgctggcctggatcggtctcaccggcgagtccccgtccgccctcgccgtctgcggccggctcgccggcatcgcggcgttcctgggcctggggctcgccgccctggccctggcgacccggggccgggccgcgctgttcgcgctgctgtgcttcccggcctcgctcgcggccgccaccggaccggacgcgcccgtcctcgcgctggcggcgctcgcggccgcgctgctcagcccccggccgatgacgggccggcacggatcggcgcgccgcgccggcgcggcgctggcgatcgccctggtggtgctggcgcggccggcctgcgcgcccctcgtggggatgctgctggtgccgttcccgcccccggggcgacgcgtccgcgcctggcgggagcggctgccgctcgccgcgctcgccctgctgccggctctgctgtcggcgctcctgccggccctgctgccggccgcgagccccgggcttccgccccccggcgcggcggggagcggattggtgtccctgcccgtcccgctgcccgggttcctcaccggggtctgggccgccgcgctgctggtgccgcccgtcgcgctgcggcgcggccccctgcccccgcgcgcggagcggctgtggctctcgggctgcgcgctgctcggcctctggctggcggtgctgccgcaggccctcgccccggcgggcggcctcggggggatgcaggcccgggacctgctgccgctggcgccgatgctgatcctggccttcgcccgggggcggatcggcaccgcggcggccctgcgctggccggccctgctcccggtgctggccgccgccctcgacgcggtggtgctgccgatgatcgcgctgcgggcgtag

SEQ ID NO: 6799 - DNA, 219 bp, Methylobacterium sp.
atgaccgtccgcctgttcgctgccgccgcgctcgccgcgaccctcgccgccgccctcgcgacgcccgcctccgcgcagggatccgccgcacgccacggcctgtccgacgtcaccgcggtgatgctgcccgagatctccgtcacctaccaccggcccgtgccggccgaccgctccgccggcccgcacgtcgccggcccggccggccgccagccgcgctga

SEQ ID NO: 6800 - DNA, 207 bp, Methylobacterium sp.
atgacgaacgcgaccgatcgaagggccggccgccgcggcgtccgcggcggccgtgcccaggtccggacggtgccgccgggcctgctgctggccggcggcgtgggggcgaatgccccgctgacggccgtcgacctgatcgcccaggcccgcgcggcccggcgggaggccgaggcccgcgacggcgcggaccgcgcggagcagggctga

SEQ ID NO: 6801 - DNA, 702 bp, Methylobacterium sp.
gtgctgcagccttccgagacctctctgggtctagcctcgatcggacagaccctgagtctgcgtgaacaggcctacgacagcatcaagcaatcgatcctggcgatggatctctacgccggatcggcgcagatccggctgcacgaacaccagatcgcgcaggatctcggcatcagccgcacgccggtccgggaagccctgacgctcctggagcgggagggcttcgtgtccacggtgccgcgccgcggcctcttcgtgacgcgcaagaacaagcgcgagatcgtcgagatgatcaccgtctgggccgcgctcgaaggcatggcggcccatgccgccgcacggaacgccgaggatgccgatctccgcgcgctcggcagggccttcgaggcgttcgatatcgcgactctgcccgaccatctgaaggcctacgacgaggccaacctcgacttccatcggacgatcatccgtctcggcggctgcgggttgatggtcgagatgacgaccaacctgttcattcacatgcgggcgatccggtcggccttcctccatcgggccgggaggctcgaggactcgatgcgcgagcatgccgccatcatcgccgccttgcaggcacgcgacgcggatcgggccgcgatcctcgttcgcgatcacgcgctcgggctgatcgcgcatgtcgaggcgcactgggtttggccagaggggtga

SEQ ID NO: 6802 - DNA, 288 bp, Methylobacterium sp.
atgatcgtcttgatagccgcagccatcgtcagcggtctcgcgacagccacgatcctggcgccggtgagcgccctcgccgcgctgatcatcgcacccctggcagccagcgcgtcggccatcctggcctgcatcttcatcgcctggcgtaacacgcgcgacgatgtcgggccgcccgacctcgagacgcaggccgacgcgatggtggcggtcctctgcgaggttgcccagcagggcaagatcgtcccggtcgccgcgccggtccgggtccgcggccaccggtcggcctga

SEQ ID NO: 6803 - DNA, 114 bp, Methylobacterium sp.; identical to SEQ ID NO: 5760

SEQ ID NO: 6804 - DNA, 282 bp, Methylobacterium sp.
atgaagacgctgatcagcctgaccgtcgccggcctcctggcgacaggcgcggccgccacggccgcggagaataccgggacccgcatgcagggttcgcccaacgcggccggctacacgggccagggcgcgacgggcaaaggcgagacgacgggcacgacgaccggatctccgggctcggagatgccgaagcaggacggccggatgaaggggccgccgaacgcggccggattccagcccggcggcagcgatggcggctcggccggaacctccggccgtcgctga

SEQ ID NO: 6805 - DNA, 642 bp, Methylobacterium sp.
atgacagcccaccggttcgacgccgtcctgttcgacctcctgacggccctgctcgacagctggtccctgtgggactcggtcgccggcagcacggaggccggccgccggtggcgggccgagtacctgcggatcacctaccggacgggggcgtaccagccctacgaggatctcgtggcggaggccgccgcggcggtgggcctgccgcgccgcctcgcggcggacctcgaggatcgctacggcgagctccggccctggcccggcgtgacggagaccctgcaggcgctcgcggcgcgctccgtgcggctcggcgtcgtgaccaactgctccgaacgtctgggtcgcatcgccgccggctgcctgggggtcgaactcgacgcggtcgtcacggcggagcgcgccgggttctacaagcccgatccgcgtccctaccggctgggactgcaggccctcggggtcgagccggcgcgctgcctgttcgtcgcgggctcggccttcgacctcgtgggcacggcgcaggtggggctggcgacgtactggcacgaccgcgtgggcatggcggccccggacggcgcgtcgcccccgctggcgcacgagaccaccctcgatccgctgcgcgcctggttcgatccgggcgcgcgctga

SEQ ID NO: 6806 - DNA, 273 bp, Methylobacterium sp.
atgatcccgaccgtccaggccgacgcgctcctggggagactggccgaggccctggggagcccggtcgagatcttcttcgccgaatgcgcgccggcgaccgggcgcacatccggggacgcgtcgccggattgcgacgcgctgccgacgctggagctgctccgtctgtgggaatcgctgcgggagccggtgcgccgggagcgggtgctggccgccgcccggcaggaggcccgaaccctgcgggcgagccgcgccgaggacgcggcggccggctga

SEQ ID NO: 6807 - DNA, 138 bp, Methylobacterium sp.
atggcgacgccgatcaggacggtcgcgcaggggtccggtgcggcggccgcggagccggatcagacgatccgccccctgagcctgtccgagttcatcggtcagcgcgcggcgcgggcgaacatgcaggtgttcatcgag

SEQ ID NO: 6808 - DNA, 264 bp, Methylobacterium sp.
atgcgccgcgactccgacgggaccggccggatctcggccctgacgcggatgcgacgccgcctcggccggctgcgcgacccgctggccacgccggcggcgctgcaccgacgctgggcgggcgcggcgaccggcgcggatctcgaggcgcgcctgatcgccgccctggccccgcactttgacacggcgttctacgcgagctggtacgggatcacggccgacccggtgcgcgactacctcgtccacggctggcgcgcgggccgcgac

SEQ ID NO: 6809 - DNA, 129 bp, Methylobacterium sp.
atgatgaactctgttctcgcgcttctcaccgtcgtggcggtgctggtggtcacggcgctgatcaagctgccgctcctgccgttccgcctggtcggccgcctgctgcggagccgcccggcggcggcctga

SEQ ID NO: 6810 - DNA, 741 bp, Methylobacterium sp.
atgagcccggcccggagcctcccggccgggcacctccggaccagcctcgccgcgctcttcgccctggccccggtcctctcgctcggaccgggggcgtcccgggccgacgaggcgcccgccgcacccgtcttcaacaaggccgaggctgcggagatcgcggcgccgctgcggcaggacccggccttgctgcgcagcttcggcacctgcccggccgacaccttcgcgcgggagcgcccgctctggcggtgggcgttcgcgccccgccggcccaccgagcgccgctgcgcgcgcgagcccgcttcctgctacgcgctctgcacccggtggtcgaacgcgccggcctgcttcgatctcgccctcgccctggagcaccactccctcgacgtcgccgacatcctcgacaaggagcggctctacgccctcgcctgcgcgggcgggttcccggcgggctgcaccaaccgggcggccgggatccggaacggcggctacgcggaggatcccttccgcgacgcgccgcgcgccgacacggatgcctgcctcgcccggagcttccgcctcgattgcgaccggcgcggcgcctggggctgcgccatgctcggccaagcctatcgcctcggcgagggcgtcgccgccgaggcgtcccgggcccgggcggcgttcgacatggcctgcgcgatcaacccggacttcgcggcctgcaccttcgccaagcggcagctggccgagatgggcgcgccgtga

SEQ ID NO: 6811 - DNA, 399 bp, Methylobacterium sp.
gtgagcgccggcgacgccggaccggattccgacgccctgcgtgccctctacgggcgggtcgacccggagcccgaggggccgccggccccgggccacgcccgcgcctccctgtgcgtggacgtgggcgactgggacgacgtcgccgccgccgagcgctggatgctggcccatgccggccggctcacccgcgtgcgcagcaccggctgcggctgctgcgtgatcggctgggacatcgaggggccggcggcgctcatcgccaccctgccggcggcgctcggggcaacctccgactgggccggcccggccgcagccccgtggcgcgcggcgagcgcgcgaggccggcgcctctgggagcacgggtgggagcgctggtgggagcgctgggtccgccgccgctga

SEQ ID NO: 6812 - DNA, 192 bp, Methylobacterium sp.
atgtcacgagggatcgagaccgacgccctgcccgagacgcccgaggccgaagagccccggattccgagcgcgcctgcccaccccgtcacgggagagcccgccgccttcgacccgaccgacctcaacccgcccgcgccgccgactccgcggcccgccagccagaccgattccggcttcggctccttcggctga

SEQ ID NO: 6813 - DNA, 570 bp, Methylobacterium sp.
gtggcgatcgcgatcccctgcgggaccatggtccacgcggacttcgccgtgagcctcggatcgatgatgcactcgctcggcgagatgccgatgtcgatcgtcgtcgggaagtcgtcgatcgtcgccgatgcccgcaacctcggcctcgaatacgcgcagaagtacggggcggagtacgtcctgttcatcgacagcgacatgaccttcccgaaggacgcactcctcaagctcctcgtaaggcaggtcgacatcatcggcgcgacctattcccgccgcaccgccccgttccacttcctgggcgacatcctcccggagcagccggccgacgcgccgaagggtctgctggagatgtcccggatcccgaccggcttcctgctgatcaagtccacggtcttcgagaagctgaagaagccctatttccgcttccgcgtcgacgaggaagccggcgtgaacatcggcgaggacttcgacttcagcgaccgcgcacgcgccgccggcttccggatctggtgcgatccgtatctcagcaaggagctcggccatatcggcgagcaatccttcaagctctga

SEQ ID NO: 6814 - DNA, 885 bp, Methylobacterium sp.
gcgcggctggtggcggggcatttcgaccacggcttctaccgggcgcgctacggcctgtccgaggcggaggacgcggtgcgcgactactgcgacaccggctggcggaacggtcgcaatccccgacccgacttcaacggctgggcctaccgcgcgcaccacccctccgcggaggcgacgggcatcgcgcccttcgtccaccacctcgcccgggccctgctgcggggcgacgacctcgcgggcgaggccttcgatccgcggtacggcgcgccgccggctgaggaggacgcggagctgttcgagcagggccgcctgattgagccgttcttcgacgcgccctggtacgtcaagcgctaccccgacacgcgcggcttcgagaatggcccggtgatccacttcctgtcccacgggcaggaggaggaccgcgacccgaacaagaccttctcgacccggttctaccgccgggcctacgggcatctgctaggtcccggggagtcgccgttcctgcactacgtgcgcaccggccgggccgccgggctgatgggctgccctgaggatctcggcacctacccgcccatggaagccccggccgccgacgcgtgggaccgcctgccccgcgccctgcccattgatcaggcccgcgtcgtcgtcatcgtcccggtctacaagggccgcggcgagaccctgcgcgccatccacgcctgcctgtcggcgccccaggccacccccttcaccctgctggccgtcaacgaccgctcccccgacccggaactcaccgcggagctcgccgccctcgccgcccgcggcctgttccacctcgtcgagaacgagcgcaacctcggcttcgtccgctcggtcaaccgcgccctcggcctgcgccagggccgc

SEQ ID NO: 6815 - DNA, 201 bp, Methylobacterium sp.
atgcccaggaccgtcgaccgtccccatcccgcgcgacgccgcgccgttcgcctgccgcgcccccgcgccggcgccgccgccaccggcctgttcctggccggactgatcctctcggccgcgacggtgccgctggtcgagcccgccgacgccacgaccggtggcggcaccgcgcaggcggcgctcgcgacgccggcccgctga

SEQ ID NO: 6816 - DNA, 198 bp, Methylobacterium sp.
atgagcgctctcgaggctgaccgcgaggcgacggtcgagcgcctgatggagcgactgagcggcttcgtgcagggaatcggtatgagcggcgctgacgcgcgcgagatcatcgcccgcgtgatcgactcggagccgttggccggggacggcgacctgatggcgaaagcccgcacctggatgctgatcgcgctggggtag

SEQ ID NO: 6817 - DNA, 360 bp, Methylobacterium sp.
atgaccgaacgcctgccggtgccgagccgcctcgccgcggctttcgacggtcgcacgacccttaccctccaggagaccgcgtccgccctggagatggaccagaagacgctccgtcgtgaggtcgaccgcggccggatcaaatacgtgttgcgggggaccggggagaagcggaagcttcgccgattcctgctcagcgacctgctcgattacctccacgacgagaggcgttcggaatgtccgtctataagcgtcccgacgcgtcggcctactggtgcgaattttggatcgaaggtgaccgatatcgcctctctacgggccagactgagcagcgtgccgcgcagctcaccgaaaagcagctga

SEQ ID NO: 6818 - DNA, 180 bp, Methylobacterium sp.
atgtcgaagctaaagactgaggaccgcgaggatctgtccaatagcaagttcgcacttcccgaggaccggaagtaccctgtcgatgacaagacgcatgcccggaacgccaaggcacgcgccgcccagcaggagaaggcaggcaacctctccgcggcggacaggaagaaggtcaacgcgtag

SEQ ID NO: 6819 - DNA, 345 bp, Methylobacterium sp.
atgagacggatcctgcgggcgctgccgctgatcgccgtgacgggcctggccgcgaccgccgcggtcgcggcccccattcccccctgcgcggccgacgccgagcggcaggccctcaagctgctgcgcttccacagcgacggcgacgcgcgggccacggtcgatcccgcgtccgtccggtccgtcggcaccgtcgcgtccctggtcgggacgcgacgcttccaggtgatcgaggtggagggcagcatctacaagggcgcgtatcggatccggctgatctacgcgccgatgcccggtagctgcgtgctgatggggcaggagatcctcgagcgctccgatccctactga

SEQ ID NO: 6820 - DNA, 1305 bp, Methylobacterium sp.
atgcgcccgcacgagccggtgcacctcaccatcggcaaccgggcgctcgatctcgggacgctgctcggcctctggcgggcgggcgcggtcgcggtgcccgttcaccgagccgctgcaccgctcacccgcgcggcggtcgagcgggcgacgcgtgcccgcttccgggccgacgggctcagcttggagaagatcgcggaggatgcgccgccggtgcggccgctcctggacggggccgccctcgtggtcttcacctcgggcagcaccggcgtgccgaagggcgtggttctcggacacgatgccctggcgcgcaagctcgcgatcctcgaccggctgctgggctttcgcccggacgacgtcgtcgcggtgccgctccagctgaccttcatcttcgggatctgggcgagcctcctggcgatccgctctgaggcgagactcgtcctcgtcccgaagttcacgcccgcgacgctcgagggcctgctcgccgcggaggggacggtgttggccgctgtgccgaccatgctgcgagccctgctggccgacggtgtcccgccggccccccgtctgcgggcggtgctgaccggcggcgaggcgctcagcccgtcgctgacgcaagcagtccgcggcggatggccgaaggccgagctcgtcgacctctatggctcgaccgagactggctcctgcgacttctgtcaccgaccgcgggacgtctcggaggctgggtcgatcggcatgccaaccgagggcgtgtcgttccgcatcgtccgcgacgacggcgcgctcgccgctctgggcgagaccggcgagctgcggatccgaactgcctgcggcatgctcggctatctcgacggcgccgagctcacgcgctccgcgctggaggcggaccacttccgcacaggcgatctcgcgcgcctgcgccaggacggtcacgtcgagctcgtcgggcgctcgaaggagatcatcgcgcggggcggcaacaagatcgcgcccctggagatcgagaacgccctgtgcgcgcatccggacatcgcggcggccctgtgcgccggcgtgcccgacccgcgcctcggcgaggcgatccacgcggtcgtcgtgctgaagcctgaccgcgcgctgtcggcggacgaactcaggcgctgggcatcggcccatctcgaacgttacaaggtgccggacgtgatcgtcttcagcgacacgctgccgtcgggcgcgaccggaaaggcgagccgggcgatggtcagtacgctcacgctgatccacgcggagacgacgtcggccgacctgcagggcgcgccagtgagctcctag

SEQ ID NO: 6821 - DNA, 822 bp, Methylobacterium sp.
gtggccttcaagacgatcacctacgagacgctcgcgccggtggcacgcatcaccctgaaccgcccggagcgcaccaacgcgatcagcgcgaccatgctcgacgaactcgcgcaggcgatggacgcggccgaggccgacgatgcggtgcgcgccgtgatcgtgcgcggggccggcacggccttctcgtcgggcttcgatctcaaggatcagatggcgctgcgccctgaaggcgtgagccagtggcgcccgatcctgcgcaaggatttcgatgtgccgatgcgcttctggcactgcccgaagccgaccatcgcggcggtgcgtggtccctgcctcgcgggcgcctgcgagttggcgttggcctgcgacgtgaccgtggcggccgaggatgccttcttcggcgagccggagctgaagttcggggccggtatcgtggtgatgatcctgccctggatcgtcggcccgaagatcgccaaggagatcatcctcacgggcgaggaccgcattccggcgcggcgcgcctacgagatcggaatggtcaaccgagtcgtgccgattgccgagctcgacgcgagcgcgctgcgccttgcccggcacatcgcggcgatcgacccgaacctcgtcaaggagacgaaacgggccctcaaccggtcgatcgaggcgcgcggcatgctggaggccctggagacggccctcgacatcgacctgctgatcgagggcgaaggctcgccggacaagcgggccttcatggacatcgcccggtcgcaaggcctcaaggcggcactggcctggcgcgacagccgcttcccgggagccggatcgtga

SEQ ID NO: 6822 - DNA, 1221 bp, Methylobacterium sp.
atgaagggtgtattcgcgctggcgatcctgtttggcggcctgtccgccgtgcaggccgacccgctgccgaccttccgtatcggcgtgctgaatgatcagtccgggctctacgccgacatcgcggggccgggctccgtcgaggccgcgcgcatggccgtcgaggacttcaagccggacgtgagaggcttccgcgtcgaggttctctcggccgaccatcagaacaagcccgatatcggcgcggccatcgtgcgacgctggttcgacgtcgaccaggtcgacgcgatcgtcgacgtaccgacctcttcggtcgccctggccgtgtcgaacatcgcgagcgagaaggacaaggcattcctgatcgcgagcgccgggtcctcggatctgaccgggaagaactgcacccggaccaacgtccattggacctacgacacctgggctctcggcaacagcacggcgcgcgccgtgatcacgcagggcggaaagtcctggtacttcctcacgacggattacgcgttcggtcacgctctggagcgcgacgccaccgaggccgtgacgaaggcgggcggcaagtccctcggacacgtcctggctccgttccagagcaccgacttctcctcctacctgctccaggcccagggcagcggtgcgcaggtggtcgcgctcgccaattccggcggcgacacgatcaacgccatcaagcaggcctcggagttcggcctcaccgacggcggccagaagctcgtcgcgctcctcgccttcatctcggacatccactcagtcggcctgaaggtcgcccacggcctgactctgaccgaggcgttctactgggacctcaatgacggcacccggacctgggcgaagcggttcgcggcacgcaacggtggccgttacccgacgatgaaccaggccggcacctacgcggcgatgctccactggatgaaggcgatcgccgccctcgacaaggacaaggcgcatcgcggcaccgacatcgtcgcgcagatgaaggcgatgccgacaaacgatccgctgttcggccacggctcgatccgcgcggacgggcgcaccatccacgacctctacctgttccaggtcaaggacccgtccgagtcgaaggggccgtacgactactacaagctcgtcgacaccatccccggcgaccaggcgttccggcccatggccgacggcggctgccccctcgtagcccatacggccgcgaagtga

SEQ ID NO: 6823 - DNA, 984 bp, Methylobacterium sp.
atgttcaaggcaatcctgatcgagaaggatgaggcgggctaccgcgccggcctacgtgagatcgacgaggcgcagctccccgagggcgacgtcaccgtggatgtcgcctactcgacgttgaactacaaggacgggctcgcgatcaccgggaaagggccggtcgtgcgcaagtttccgatggtgccgggcatcgacatcgccggcaccgtccgcgaatcccggcatcacgactacaaggccggcgaccgcgtcgtcctcaacggctggggcgtcggcgagacccattggggtgggctggcgcaagtcgcacggctcaagggcgactggttggtgccgttgccggagacgctcacgccacggcaggcgatggcgatcggaactgccggttacacggcgatgctgtgcgtgatcgccctcgagcgccacggcgtcacccccgacaagggcgaggtcgtcgtcaccggcgcggccggtggcgtcggcagcacggcggtcgctctcctgtcgcgcctcggctacacggtcgtggcggtgagcggccgtcctgaggaggccgattacctgcgccgcctcggcgcagcggaggtgctggaccgggcggcattctcggatccgggcaggccgctcgcccgggagcgctgggccggggccgtcgatgcggtcggtagccacacgctggcgaacgtctgtgccgccatgaagtaccggggtgtcgtgacggcctgcggtctggcgcagggcatggacctgcctgcgagcgtggcccccttcatcctgcgcggagtcagcctgatcgggatcgacagcgtgatgtgcccgcggcccgagcggatcgacgcctggaacaggctggtccgcgacctcgatccggtcaagctcgaggcgatcacggacgagatcggcctgacagaggctgtggccaccgcggaacgcctgatgtcgggccgggtgcgcggccgcgtcgtcgttgacgtgcatcgctag

SEQ ID NO: 6824 - DNA, 777 bp, Methylobacterium sp.
gtgaagcagctgctggtcgactccgtgaccggcgagaccgtcgatcgcgacgatcaggtgaagggctgcgaggtcgccaaggacgacctcgtccccgtcgaggacgaggagctcagcgagatcgcgctggaaagcacgcatacgatcaacatcgaggcgttctgcaggcgcgaggaggtcgacgagcgctacctcgacaagccctactacctcgcggccgaggacaaggtgtcgcgcgaggcgttcgccgtcatccgggatgcgatgaggaagaaggggatggcgggcctaggccggatcgtcatctacaagcgggagcgcatcgtcctgatcgagccctacggcaaaggcctgctggcgaccctgctgcggtaccaggacgagatccggtcgcccaccgcctacttcgaggacatgccggacggcaatccgaccgacgagatgcggtccctggccgaggagctgatcgcccggtcgacgaggaagttcgatccgtcgaagttcgaggaccgctacgaggaggcgctgatcgcgctggtcaagggcaaggcgaagaagcccgagaagggcaagggtcgatcgaaggcggcggcaccgagctccggcaacgtcgtgaacctgatggaggccctcaggcgcagcatcgactccgagaagggtggatcctccgctcagccggccgctgcccggaagaaggcgggttcgaagcggtcgcggctaaattcgacccgcggcgcgggcaaggcgacgtcctcgaagccgcggaaggccgcgtga

SEQ ID NO: 6825 - DNA, 495 bp, Methylobacterium sp.
atgacatcgctgctgcagatctcatcgaccgacaccagtccgatcctggccctcaacaacacgcacgcggccgagctctccctgctcgacgaggaaggtctctccgagctcgtggcggggagcttccacgcacgccggattggccgcaacgacgctttcctgatcgccctcgatgagcggcatccgacctatgcgagcccgaactacctatggttccgcagacgctacccgcgcttcgtgtacgtcgaccgggtcgtggtcgccggcattgcccgcggcctcggctatgcgcggcggctctacgaggatctcttccggaaggcccgcgaggccggtcacgacctgatcgtgtgcgaagtcaactcgatgccgcccaacctgggctcggacgccttccacgcccggctcggtttcgaggaggtcggcgcagccaccattcacggcggagccaagaccgtccgctatctcgctcttcgcctgcccggcccgcgctga

SEQ ID NO: 6826 - DNA, 1236 bp, Methylobacterium sp.
atggctggatcgaagctggaactgtcgattaccgaagcgcgccgcatcgcgctgaccgcccagggcctcggcatgcgcccgctatcggacgggatcgccgtctcgcggatgcgtcggcagataggccgcctgggcctgctccagatcgacagcgtgaacgtcctcgtccgcgcccactacatgccgctgttctcgcgcctggggccctacgaccgcggcgccctcgacgccctggctgtcgcaggctcgaagcgcttcttcgagtactggggtcacgaggcgtccctcctgccgatcgatctccagcctctgctgcgctggcgcatggaccgcgcccgccagggccacggcgtatggaaccagctcaaggcgttcgcgggcgagcggcgcgcggaggcggacgccatgctcgcccggatcgggcaggagggcccgctggctgcctccgacgtctcgggcccgaaggcgtccaagggcatgtgggtctggagcgatgccaagcacgcgctcgaatggctcttttgggcaggactcgtggcgtcgacgcatcggaggggcagcttcgagcgcgtgtacgacctgcccgaacgggtgctgccccgctccgtcctcgcccgaccgaccccggctccggtggacgcccggcgcgaactcgtcgcgcgatccgcggaggcgctcggcgtggcgaccgcgaacgacctgcgcgactactaccgcctttcgccgaccgaggcgcgcctgcccatcgagcagctcgtcgaggagggcgtgctcattcccgtgaccgtccgcggatggcagcagcaggcgtacctgcacagggatgcccggcccggccgccgtcaccgcggcgcggccctcctgtcgccgttcgacccgctcgtctggcaccggccacggacggagcgcctcttcggattccggtaccgcctcgagatctacacgcccgcccacaagcgcgagcacggctactacgtgctgccgttcctcatggacggcgcgctggtagccagggtcgacctgaaggcggatcgacgggccggggcgctgatcgtcctacgcgcgcatcaagagccgggtgcgccggcggctacgatggagcggatactcgcggagttgcgattgatggcctcgtggctcggcctgtccgacgtcgtgatttcgtcgacagccgggctggagagccgcgatcaccgggtcagttcccggatgagcgaccgggcggcgatggaatag

SEQ ID NO: 6827 - DNA, 243 bp, Methylobacterium sp.
atgaagggtctgtctggctgcgtcgccctccttctcctcggcatcggaccggcctcagcgcagaccgtcctggccccgtccggagactcggccgtgacgcagcccggtgggacggcggggcgggccgcgcgacgcaacatccaggaggcctaccgcaacggcgacgtggtcggccatcgacatgcgccagccgcccccgcgccccggccggaccggccccgccgcacgagcccgcgcttctag

SEQ ID NO: 6828 - DNA, 327 bp, Methylobacterium sp.
ttgatcgtttctttccagacgaaagaattgctagtcgtctgctcgaacctggaagcggctgagaagcgcctcggcccggagctcgcccgggtccttaccgtgcagctcgcggacgtcgaggcggccgaccatgcgggcgagttgctagatctcctcgcgggagccgccgaaatcgttggggagaactctgtggtcctctgggtcggcaaggatcatcgggcgaccttcgtgccagttggcaccttcggtcgccgggagcccaacggcactccggactggccgacggttcgacgcctgaagctgatggatatcgcccagtgcccgtga

SEQ ID NO: 6829 - DNA, 966 bp, Methylobacterium sp.
atggagatatcgggcgagggcttggacgaagtcctgatcaaactttacgagaagctcctggaaagcggcgacaccaatgtcgggtcgcggggttcgacagtcgagatgctcggggtgtcggtccggatcgcaaagccacgggcacgtctcagccgctcggagagccgcggcaagcctttcagcgcccttggagagctgctctggtacctgtcgggttcggacaagctcgacttcatccggccgtacgtacccgagtatgtcaaggacgcgactgatggcgtgatccacggtgcctacggcccgaggctatacgcgatgcgcggcatcgaccagatcgcgaacgtttgctcgctcctcaccgcgaggccgtcgtctcgccgcgccgtgatacagctctatgacgcggaggacatcgccgagcaccacaaggaaatcccctgcactacgacgatccagctccacatccgcggagcccagctgcacttgtcggtaacgatgcggtcgaacgacgcctactgggggctgccacatgacgtcttctgcttcacgatgctgcaggagatgctagcacggcggctcggagtggaggtcggcgagtactaccactacgccggcagcatgcacatttacgaggactacatcgatggcgcacgggcctatgtcggcgaggggcaccagaagaccgttgagatgccgccgatgccagccggcgacccgttcgccctggtcgacgctctgttgcgtgccgaggagcatgttcgcgccgggagaaccgtcgccgcggcggagctatttgccgatccgtactgggccgacatcgtccgcatgatccaagtgttctgggcccgtggccgagacgacgaactggccgcgctgaaggccgagctcgcccaccccatctacgaggccttcctccaaggccgcataggcatgaagcccaggcaactgaggccgccgacgtcctga

SEQ ID NO: 6830 - DNA, 921 bp, Methylobacterium sp.
atgtcatggccctcatgggagcccgagcggctcaggctggtggacgccttgcgtcagcacgcggcgcacgtccgaccccttcccggcattagcgaagcgcacgccctcgataccctggcacgtcagttcgtggcgagcttgcgtcgcgaggcctactacaagcaggtccaggcgaagccggtctccgctcggcgagccgacccgaatgatctaagcttcgatgccgagcgggcggtggcccgccacatccagcttggtgacgtcgatgaggctggctggctagccttcctcatgacccacttcgccaggcccgcagacactggctggctgcgccttcgggacgtgtacggccagttgggcgaaggcacctgggactggcctacggtcagatcagaccccgcggcgttcgaggcgtggctcgctaagaactggcggcgcgtgcgcggtaaattcggtaatcaccggaagtaccaaagcctccggccggacgccgataccggcactggccgagtgatccgcagctacgtggaatggatcggaccacagggccaccgggccatgctggccgaagtagtgcgtaggaacggcaaccacccccacgcgatcttcgatgccctctaccgggagatgccgatcgtcggcttcgggcgcctgggaaagttcgactatctctccatgctcggccgctatgggatcgcgcctgtcgaagctgggtcagcgtaccttgacggcgccacggggccggcctcgggggccagcctcctgttcgacggggtgcggaatgggccgacatcgcgtaccggcctccaatcgatgctcgacgagttagaccgagacctgcgggtcggcatggccgtcaccgaggatgccctctgcaactggcagaagagccccggcaggttcgtgcactacaagggatag

SEQ ID NO: 6831 - DNA, 225 bp, Methylobacterium sp.
atgacgaagctcaccgccctgctcgccaacatgcaggcatgcgaggccgcccgggaggcgcgcggcgagccaccggcgtacgtcatcgaggccgaggcctccggcacgacggtcacatggatcctgcccgggcacgggcatgtccggcgcgagcccggcggtcgctgcgtgcgcctgagcgacggggcggtgctcccgaccgccggatggggatacccggcatga

SEQ ID NO: 6832 - DNA, 306 bp, Methylobacterium sp.
ttggagcccgcccgtgccccagacagcgccaccgcggagccgcctgccgaccttcggcgtctcgaggacggccatgtcaacctcgtcctcgagacgccgaagggcagcccgaacaagtacgcctactccgagccgttcgggaccttccagttcaagttggttctgcccgagtgcacgagcttcccgtacgacttcggcatggtccctccacgaagggtgccgacggcgacccgctcgacatcctcatccccccggacgcgcctgcctttcccggatgtgtactggaggcgcggctggtcggcgtga

SEQ ID NO: 6833 - DNA, 879 bp, Methylobacterium sp.
atgcagacgctcgactcggtggtccgcgcgatcgaggccgcgcccgaagctgaggccgagatcatcgtcgtcgataacgggtccgaggacggcacggacgcggcgttgaagcgctggtccgcgtcaatctcgatcgatcgacgcgacgttctgctcctcacgcaggcgcgcccaggtgtcgccgggtctcggaacgccgcgatcgcgcgcgcgtccggagacatcatcgcgttcatcgacgacgattgcgtcgtgtcggaccagtatctgcgagatctgatcgcgcactatgccggcgacacggaaagcgtcatccgcggtggccgcgtcgagctgggatctacccaggacatcgacttcaccacgaagaccgaggccctggccagccggctgacgtacccggctcatcccggcggcttcgtccacggctgcaacatgacctgcagccgggccgtcatcgagcggatcggcgggttcgacgcggcgttcggccccggggcgacgttccgcgcggcggaggacacggacttcatctaccgcggctgggcggccggcgtggcggtcgagtacgtgcccgacatgagcgtcaagcatttccacgggcgccgggacccgcgcacgatcgaccggctgcactggaactaccagttcggcaacggcgcgctctacgccaagcacatcggccgcagcccgtggctgatcaagcacctgtactggtccgcccgcaacgccgcccgcgaactggtcgggggcccgtgcttcgacgcgcagctcggcctgacgtggcgcgccatcgtgaccgccaatctgagcggcgtcctggccttcgcctggcacagcgcgcggacgctgctgacgcgcccgcccgcccgggcctag

SEQ ID NO: 6834 - DNA, 309 bp, Methylobacterium sp.
atgagcagcaagacgccgccccccagcgcccttcatcatgaggaggaatgctgggtctcgacgcttcggcaacagagaacggaacggctcctgagtcgtatcgcggaagcggtgcaggtgccgccctctgcgttctacaggccaccgaacgccgtcgatgcgggagcgtccgccgcggcaattccggtggccccggtcgccagcgacgctgagtgcgcggagttgctggccgctttcaatttagtccgtgatcctgaggatcgacgcaggctcctggagctgatgcagaagacggccgagcgcgcctga

SEQ ID NO: 6835 - DNA, 291 bp, Methylobacterium sp.
atgacgatcacctcgacgaagaccgcgatcctgtcctgtctcgccctcgccgccctggcgaccgtgcccggacgagccgaagcgcgcggcttcgggcaaggaagcttcgggcaccatggcggcttccatcacggcttccaccacgggggcttccatcacggcttccatcaccgcttcggcggccatggctggtggagcccggcgggcggatacgccgcgggcggctttttcggcgactgtcgcctgttcttcagcccggtgtggggccgctacgagcgggcctgccgatga

SEQ ID NO: 6836 - DNA, 729 bp, Methylobacterium sp.
atgcatcatcacggcctgcgcattctgctcgtcgacgatgacgcggaggttcagcgtgtcgtctccggatacctcgacgggcacggggtcgacgtcgtcccggcgtcgacgcgggccgaggcgcgcggagagctcgcggatccgtcgcagttcaacctcgtggtgctcaatcttcgcccgggcgcggagaacggcctcgacctgctgcgggacctgcgcgcggtgagcgatgttcccgtcatcctgacgacggcccatcgctgcgaggagttcgaccgcgtgctcggcctcgaactcggcgccgacgactacatcgtcaaaccctacggcctgcgcgaattcctggcgcgcgtgcgcgtcgtcctccgccgcgtcgcggcgcaggcctcgtcccgtccggcggaggcgccgtgccggcgcttcgacggctgggtcctgaaccgccgacgccggcgtctgatcaatcccgacggaaaagaggtcgtcctgggcaagcgcgactacgcgctcctggcggcgttcctcgacgcacctcagcgtccgctcacgcgcgagtacctgctccaggtcacccgcgtccacgacgacgtcttcgatcgctgcatcgacgtgcagatcctgcggctgcgccggaagatcgagcgcaggcccagcgacccgaagctcatcgtgaccgagcgcggggtcggctacgtcttcgccgccgcggtcgagagcacgtcccactag

SEQ ID NO: 6837 - DNA, 177 bp, Methylobacterium sp.
atgaaccgagatccgagagcccggagcaggcaggccgacggcgaggcccggacggcggagtccgaccgcgagaatgatgcccgcgcacgcgcggcggtggtggatgcctggcgccgggcactgctccggatgcgcgagcggcgcgcgaccgaggaccgcaccgatccgggccattga

SEQ ID NO: 6838 - DNA, 423 bp, Methylobacterium sp.
atgcccatcatgccctggatccacgatgccctctctgtcggcggcctcgccgccctcgtcctcgtcgcgcggcaggcgctcgtgcggcgcgatctcggtctgtccggcctgccgggcctcgaacgcctgcgccggtccctcgggcccggcaccgggttccgtgagcggccccggttcacgtcgccccggaccagcggcaacaccgccttcgacacctggcgcgacggcgagatcggccgcatcgagggggagcgccgcgcgctcggaacgcgtctccgggacttcgagggtttcgtcgacgcgctgaagcgcgccaaggatcgcgcgaccttcgagcgcttcgtggcggaacatcccgcgggatcgggggcagcggtcgacatcgccggcaccgccgatcaggccgaacatcgaaaaggctag

SEQ ID NO: 6839 - DNA, 279 bp, Methylobacterium sp.
atgacgcccgataagatggacgacaggctggagcatcatcggatcgaagatccgcgatccgggctcaagctgttccttcgtcggctgtctccccagttccggggtgagcgggacggtctgacgaccgacgccgcgtggctgctcgatgccttctccggcaccccggaccggcgtgacaccaagctcaggcgcggcacgcatttgatgcatctcgaagccgggcggagggtcctctggcgagcctccgccgcatgtctgagtgagccggtcccggcttga

SEQ ID NO: 6840 - DNA, 279 bp, Methylobacterium sp.
atgagtatctcgaagaccgcttgcctcaccgctgtcctcggcctcgtctccaacatggcctttgcccagccacaggcgagccaggagaacctgaagcgccactgcataggagattacctggaacattgcggccagttctcgcccgacggcggggaagtccaggcctgcttccgcgagagagccggcctcctgacaccgaattgctcgatggccatcgccgcttaccaagaggagcagaaggccgcgaatccgatccggaaggtccgcgccgcacggtga

SEQ ID NO: 6841 - DNA, 294 bp, Methylobacterium sp.
atgacctttctcaagaccctgctggccagcctggccctgtgcgcggctctcctcgtctgggccggcctctcgatcggcccggagcggccgacggaccggaccagtccgggcctgaccaccgccgcggtgctggccagcgacggcatggggccggacggtcgaccgggcgagccggccgcggcccccggcggcccggatcggggtgatctggatcgagcggctctggaccggctcgcaaagcgggtctccggcgaggtccgcgacgcgtccgccgcggggacgccggccggctga

SEQ ID NO: 6842 - DNA, 285 bp, Methylobacterium sp.
atgcttagccagatcagcgcgggaccggcgcgcgcggtcgcgacgcccgaggccgccaccgcgcgggagatccgcgcgtccatccaggccgagggcctgatcagcttcatcgacggcaggtcctacaagacgctcaagcgtcacctgacggcttacgggctgacaccggaagagtatcgcgccaagtacgggctgccgcgcgactatccgatggtggctccgggttacgccgccaagcgctcggagatcgcgcgatcgctgcagctgcgacacagggcgggatag

SEQ ID NO: 6843 - DNA, 270 bp, Methylobacterium sp.
atgcgacacgtgatcggtacctcgtcggccgcggctttcggcacgctctgcgtcctggcgctcgtcggctggacccaagcggccagcacggtgccgatgcaggccagcgggggcgcaaaagcctccgcggcggcccgtgacggcgccgcctgtggcggggcggcctggccgtacccgcccggcgcctgcgcgggtgccggcccggtcggcgacccggcgggccgtcgcgtccggctcatcgcggtcgacgccgcgcccggccgtcgatga

SEQ ID NO: 6844 - DNA, 216 bp, Methylobacterium sp.
atgccgcacttcagcgacgaccccggtgccgacgaagatcccgacctgctcggcgcgctgcgccgcatgctgcacggcggagaacgcgctccgcggcgcctgccgacctgcgccgagcggttcggcgtgccggcgccgcgcgatcgcgcgcgtgacgcgcaggatgccgtgctggccggcccggacccgcggccgccccgatcccgacatcgctga

SEQ ID NO: 6845 - DNA, 186 bp, Methylobacterium sp.
atgctcgacgtcatcgcccgcctcctgctctcggccggcatcatggtcggcacgacctacctgccggcgctctcgcaggccgtcaccgggcagccggccggcacccggagctacgccgcggacgcgcccgcctgcccggtcaagcccgcgatggccgggatccgcgcccggtcctgcctgggctga

SEQ ID NO: 6846 - DNA, 1017 bp, Methylobacterium sp.
atgccgatgtcgatccgccacgcggccgtcgccgcgcgcctcctcgccgccacgctgctgctcccggccctcggcggcgcggcccgggccgaaaccacctccgtccggatcggcctccagtacggcctcgtctacctgccggtgatgatcgcgcagagcgagggtctcttcgacaagcgcgccaaggccgcggggctcgacggcttgtcggtcacgctgacgcgtttcagcggctcgaccgcgatgaacgacgcgctgctctccgacagcgtcgaactcggcaccctcggctcagccggtgccctaatcgcctgggacaagacccgcgggagccagcagatcaagagcctcaccgccctgagctcggtcgtctacacgctgttcaccggcaagcccggcgtcgccgcgttgaaggacttcaccttcggcgacaagatcgcggtcccggccttcaactcgccccaggcgatcctgctgcgagttgcggcggcccagcagctcggcggatcggccaaggccgacgcgctgatggtgagcctgccccatccggacgccaccgcggcgatgcgcgccggacaggggatcgccggctacttcgcgacgccacccttcacgcaggtgctgcaggccgatcccaagatccggacggtcatgacctcgaccggcctgatcggcagcggcgacatcaccgccgcgaccctgaacgcgaagcaggggttcgtcgacgcgaacccgaaggtcgcgcaggcgatccgcgccgggatggaggatgcggtggcgctgatccgcagcgaccccaagcgcgcggcgtcgatctatctcgcctcggagcaggttcagatcgaccgcgcgcaagttgaggcgatcctgaccgacggttccatcgtctacgacgtggccccgaagggaatggtcgccctcgccaaggcgatggcgacgcagggcttcctgcggaaggtgccgggcgactggcaggagatcttcttccccggcctcgagggccgcgacggcagctga

SEQ ID NO: 6847 - DNA, 1377 bp, Methylobacterium sp.
atgtcggtcacgtcggcagccttggcaacggatacggcgggtgcgcgcccggccgcgtcccagtcgatcgaggagaagcggaagagcgccatccgcggcgcgttcttctccgaatacatcgacatgttcgacatctacctgccggtggtcgcgctggcgccggtgatgttcatgttccagccgaagaacctgtctccccagatggagacggtgctggcctcgctggtcttcatcactaccctgctcggccgcccgatcggcgcgctcatcttcggcctgatcgccgacaaggtcggccgccgggccgcctcgatctactcggtggcgggcttcggggtgatcacgctgctgatcggcctgctgccgggctacgagacgctcggcctcgcctcgtacatcctgctggtgctgctgcgcttcctcgacgggatcttcctcgggggcggctacaccggggcgatgccgctcgccatcgagtattccaagaaggacaagcgcggcttcgtcggcggcctgatcatcgcgggcttcccggccgcctacgtcagcatcaacctcatcacgatgctgatgttctacctgttcccgctcgacgggcctgggtcgccctacacggtctggggctggcgcatccccttcatcgtcggcgcggcgctggccggcctgctcgccctctactacgtccacaaggtctcggaatcggaggtctggaagaaggaggccgctgccggggccgaacaggccgaggcatcgcccatggcgggtctgttctccgggaagggcgggcgcgacctcctgcaggttctgctgctgatgaccggcttctggacgacgcagaacatcatcacgatctacctgccgaccggtctgctggtgaagaccctgcacctcaacggcttcgcgctgaccgcgacgctgatgatctgctacacgatcctgttcttcagctacatcggctccggcctgctcgggcaggtcatcggccgccggcggttcttcgtgatcgtcggcccgctgatcgcgacggtgggcgcgtacatcctctacacgctgaccgtcacgcccgagatggcgttcggcacccgcgtgctgctggtcagcctcctggcggtgatcgtgacctcgccctggggcgtcatcgtcacctacatcaacgagcgcttcgccacggatgtccgcgccaccggcttcggcatcggcttcagcctctcggtggtgatcccgtccttctacgccttctacatggactggctgagcgcgctgatgccgctcgcgctgacgcccgtggccctgctcatcgtcggcggcctgatcggcaccgtgggcgcgctcatcgggccggagaccaaggacgtcgatttcggcaccggccactga

SEQ ID NO: 6848 - DNA, 906 bp, Methylobacterium sp.
atgaacgggaaccggatcggcttcatcgggctcggcaacatgggcggccgcatgacgcgccgcctgatcggcgcggggatcgatgtggtcggcttcgacaccgaccgggaggccgccgcgcgctggggcgcgacggacgcgggctcgatcgccgcggtcgtcggtgagacggacgtggtcctgatgtccctgcccgacagcaaggtggtcgagcgcgtcgtgctcggcgcgggcggggtcctcgcgggctgccgggacgggcagatcgtcgtcgacctgagcacggcctcggccagctcgacgcgccgcatcgccgcggcgctggccgagcgcggcgtcgcctacgtcgatgcgggcatctccgggggcgccgccgcggccgagaaaggcacgctgaccctgatggtcggcggcgatcccgccgtcatcgaccggttgggctgggtgttcgcgccgatcgcccagaaggtcgtcgtgatgggcggatcgggggccggccacacgaccaagctgctcaacaacttcctgaacgcggtcagcctcgccgccaccgcggaggtcatggtcgcgggccggaaggccgggctcgacctgcaccggctcctggaggtgctgaacgcctccagcggcgtcaacttcgcgacgctgaaccgtttcccgaagatcgtcgacggcgactacctggaaggcggcctgaccggcaagctgatgaccaaggacgtcgtgctctacaccgatctcctgcacgagctcggcgtcgcctccctcaacgcgtccggcccgatggcgagcttcgggctcgccacggcgctcggctacggcgacgtcatctccaaccgcgtcgtcgacgccatcggcgacgtctccggcggcgtccggctccacggcaaccgacacgagaactga

SEQ ID NO: 6849 - DNA, 765 bp, Methylobacterium sp.
atgaccgggcccgcgccgagcccggagagcctccggcacaccgtgcagggcgagctcggttactgggacgcggagcaggcggccctcgccgagctggccccgggcttcctcgacgcctgggcccggctggcgatggtccccgtgcgcaagaaccatctcggcgccaaggaccgcgccctgatcgcgctctcggccgcgacggccgcgacccacctctacgcgcccgggacgcgccgccagatccgcaacgccctcgacgcgggcgcgacggccgaggagatcacggaggtgctcgcgctcacggcgaccctcggcatccacgcctgcaacatcggcgtgccgctgctgctggaggtgctggaggaggccggtcagcggagcggccccgcgccgctaacgccgcggcaggagcagctgaaatccgacttcacccgcgaccggggctactggcacgcgttctgggacggtctcctcgaactcgatcccgacctgttcgagggctacctcgacttctctgcctggccctggcgccacggcgtgctcacgccgaagatgaaggagttcgtctactgcgccttcgacgcggcggcgacgcacctctacgtgccgggcctgaagatgcacatgaagaacgccctcggttacggggcgaccaaggaggagctgatggaagtcctcgagatcgtcagcctgatcggcatgcacggcgcggaactggccgcgccgatcctgcgcgacgaactggccgcgcggggccggggctga

SEQ ID NO: 6850 - DNA, 111 bp, Methylobacterium sp.; identical to SEQ ID NO: 5795

SEQ ID NO: 6851 - DNA, 168 bp, Methylobacterium sp.
atggccagctcgatgctggtcaccctcgggtggctggccctctcgatcttcgtctgggctcagttcgacgccgagaaggtgctgctgctcttcgcctacctcaccgctctccaggccggctatctcgtcggggcctatatcagcaccgataccggcccgagccgctga

SEQ ID NO: 6852 - DNA, 273 bp, Methylobacterium sp.
atgcccgccgacgacgtcccaacccgcgatgcccgcgcacccgagcccgcacggacgcgcgcgcccccggccggggagagccgcctccgctcgatcgccaaggccgtgagctggcgcgtcgtcgggagcctcgacacactgctgctgtcctacctgttcaccggcagcgtgctggtcgccggctcgatcgcctcgaccgagaccgtgaccaagaccgtgctgtactacctccacgagcgcggctggggcctgattcccctcggtcgcgcctga

SEQ ID NO: 6853 - DNA, 135 bp, Methylobacterium sp.
gtgccgaccattcccagcccgagacacgcggcgcggcgatcgctgttccagagcgggatcggcctgcggctggcgctcgccgcgctgctctcggcgctggtctggctgaccatcgcctgggcgctggcgacatga

SEQ ID NO: 6854 - DNA, 360 bp, Methylobacterium sp.; identical to SEQ ID NO: 5799

SEQ ID NO: 6855 - DNA, 267 bp, Methylobacterium sp.; identical to SEQ ID NO: 5800

SEQ ID NO: 6856 - DNA, 345 bp, Methylobacterium sp.; identical to SEQ ID NO: 5801

SEQ ID NO: 6857 - DNA, 168 bp, Methylobacterium sp.; identical to SEQ ID NO: 5802

SEQ ID NO: 6858 - DNA, 351 bp, Methylobacterium sp.; identical to SEQ ID NO: 5803

SEQ ID NO: 6859 - DNA, 438 bp, Methylobacterium sp.; identical to SEQ ID NO: 5804

SEQ ID NO: 6860 - DNA, 570 bp, Methylobacterium sp.; identical to SEQ ID NO: 5805

SEQ ID NO: 6861 - DNA, 1293 bp, Methylobacterium sp.; identical to SEQ ID NO: 5806

SEQ ID NO: 6862 - DNA, 540 bp, Methylobacterium sp.; identical to SEQ ID NO: 5807

SEQ ID NO: 6863 - DNA, 255 bp, Methylobacterium sp.; identical to SEQ ID NO: 5808

SEQ ID NO: 6864 - DNA, 216 bp, Methylobacterium sp.; identical to SEQ ID NO: 5809

SEQ ID NO: 6865 - DNA, 264 bp, Methylobacterium sp.; identical to SEQ ID NO: 5810

SEQ ID NO: 6866 - DNA, 468 bp, Methylobacterium sp.
atgatcgcgaacacagaggatatgtctggtgggtccgggcatgacgagcccgtgcgcgagcccagcttccagccgcaggacgacaacgtccggaagcacaagctccacatgatcgcaggccgcatcgcggagctgcgccgggatcgaggctggacgcaggccgaactggcgcgccgggctgggctcaaccggaacgtcgtcaacaccacggagaacgagacgagcttcccgacccgggagaacctcgcccgcatggcgagcgcgctcgggatcgagctgaacgagctgacggacgtgttcgtcatagaggcgcaccaccgggcgccggctgcgctcagcctcacggaagccaagggtcggccgggctacatggccgtccagatcaaccggatgctcaagacggccacggcgctcaagatattccagctcatcgccgaagatgacgcagacgctgctgacagaggctga

SEQ ID NO: 6867 - DNA, 999 bp, Methylobacterium sp.; identical to SEQ ID NO: 5812

SEQ ID NO: 6868 - DNA, 453 bp, Methylobacterium sp.; identical to SEQ ID NO: 5813

SEQ ID NO: 6869 - DNA, 492 bp, Methylobacterium sp.; identical to SEQ ID NO: 5814

SEQ ID NO: 6870 - DNA, 1611 bp, Methylobacterium sp.; identical to SEQ ID NO: 5815

SEQ ID NO: 6871 - DNA, 720 bp, Methylobacterium sp.; identical to SEQ ID NO: 5816

SEQ ID NO: 6872 - DNA, 660 bp, Methylobacterium sp.; identical to SEQ ID NO: 5817

SEQ ID NO: 6873 - DNA, 1083 bp, Methylobacterium sp.; identical to SEQ ID NO: 5818

SEQ ID NO: 6874 - DNA, 1029 bp, Methylobacterium sp.; identical to SEQ ID NO: 5819

SEQ ID NO: 6875 - DNA, 2226 bp, Methylobacterium sp.; identical to SEQ ID NO: 5820

SEQ ID NO: 6876 - DNA, 408 bp, Methylobacterium sp.; identical to SEQ ID NO: 5821

SEQ ID NO: 6877 - DNA, 1158 bp, Methylobacterium sp.; identical to SEQ ID NO: 5822

SEQ ID NO: 6878 - DNA, 1305 bp, Methylobacterium sp.; identical to SEQ ID NO: 5823

SEQ ID NO: 6879 - DNA, 321 bp, Methylobacterium sp.; identical to SEQ ID NO: 5824

SEQ ID NO: 6880 - DNA, 153 bp, Methylobacterium sp.
gtgctgctcgacgcctcccacatgacggtgaacgaatcggactggaccttcccgtccgaggcgcaggctttagctgccgcgctggccttctcgaagcagatgacccgggcctggaagacgctgaccgcgccgatgtcggacggcctgctatga

SEQ ID NO: 6881 - DNA, 279 bp, Methylobacterium sp.
atgctggatggcagccatctcctgttccatggcagcgacacgacgcatttcttcctgcgaatctacccgcttctccgaccgagcgtgatcgtgcatgtgcacgacatccatctgccatatgagtatcctgagattgcgacaggctttttttggaacgagcaatacattctcgccatgatgttttactataagcctgcgtccgacattatcgctccgatcaagtacaggcatcgtgagggcatgtgcgacgagggtgccggcttctggttcgaggtctag

SEQ ID NO: 6882 - DNA, 333 bp, Methylobacterium sp.
atgatgcgaccctggccgatcctggtcctcctcgccgcgctgctcggcgggctggcgagtgcgcccgcgcgcgcggcgcccctgccggtccccgcgagcgccgaggccgccgcgcccgcccccgcggtgcagcaggcccactggcgccaccgccgccactggcaccgccgccaccactggcgccgccactggcaccaccgccgccactactggcaccgtcgccatcactggcaccggcaccaccatttccgccggcactggcaccgccaccacgtctggcatggccgcccgtacgcccgtccgtacggccaccggcacgtcacgttctactga

SEQ ID NO: 6883 - DNA, 366 bp, Methylobacterium sp.
atgcgttcactcgttttcggcgccgtccttgccgtcgtgatgccgttcgccgcgcaggcccaggacgccggcgacgccgccgccggcgagaaggcgttcgccccctgcaaggcgtgccacaacttccagaagaacggcgtgggtcctgacctgaagggcgtcgtcggccgcaaggcgggcacctacgagggctacaactactccgccgccctgaagaactccggcatcacctgggacgaggccaacctgcacgagtggctgaagaacccgaaggcgaaggttcccggcaccaagatgatcttccagggctaccccgacgacaagaagatcaacgacgtcatcgcctacctcaagacgcagtcctga

SEQ ID NO: 6884 - DNA, 165 bp, Methylobacterium sp.
atgtcgatgatcgccaccggcgggtgcctcggaagcaccctgctctgtctcctgaccgcgtcgtcgggaccgctcctcgccctggcgggcttcttcggcggcggcacggccgggggcctgctgggcgcactggcggtcgcggccctcggccggggtcgcgcctga

SEQ ID NO: 6885 - DNA, 303 bp, Methylobacterium sp.
atgcgcgtcacatccgccattggcctcgcctccgtgttgctctctgcggggtccgccgtcgccttcgcccccgcgctgttcgcggcgggaccggccgccgtagcccagctgtgtacggagagtgcagggaccgtctcttgtgcgaacggttatgcgggcttccgaggcccctcggggaagctctggattggcaaagatcgccgggggaccgtgatcgtcagcatcgatgatcgtcggaacgatcaggagccatcccggcgcgagcaggatcacggacgcttcgtcctcgagcaggcgtggtga

SEQ ID NO: 6886 - DNA, 99 bp, Methylobacterium sp.
atggccgtgtggtcgatcgtggatctcccgtcggtcgtcggctctcgccccgcggacgaggcgcgcatcaccgcgcaggcagatcggatcggagattga

SEQ ID NO: 6887 - DNA, 267 bp, Methylobacterium sp.
atgaccacagtggtcacggagagcgccatgcaggagatccagcttcgggacgccaaggcgacgctgtcggccgtcatcgaccaagcgaagcagggcgcgccctcgatcatcacccgccacggccgccccgaggccgtgctgctcagcttcgaggactggcagcggctgtcccgcgtcccgtcgttcggccgcctgctcatggccgcgcccgtcgcggcggacgacctcgcccccccgtccggcgggctcagaagcgccgagctgtga

SEQ ID NO: 6888 - DNA, 1347 bp, Methylobacterium sp.
atgcaatccacccctccgtacggtgagccgccgctcccgatcagttccgacgcgatcgccgacggcccgaaggtccccggcgcggcgcggcgtcgctccgtggtcgcgggcgccatcggcaacacgctcgaatggtacgatttcgccacctacgggtatttcagtgccgtcatcggccggaacttcttcccgtccgacagcccgacgacgtcgctactgtcggccttcgcggtgttcgccgccgccttcttcatgcgcccgatcggcggcatcgtgttcggccacatcggcgaccgctacggccggaagacggcactcctgctgtcggcgggcctcatggccgtctcgaccttcctgatgggctgcctgcccacctacgcgtcggccggactcctcgcgcccgtcctgctcgtggtgctgcggctcggccagggtctctccgtcggcggcgagtacacctcctcggccatcttcctgtccgagaccgcagcaccggcgcgccgcggcctaaccggcagcctcgcctgcatcggggccgccggaggcatcctgctcggctccattgccgggacgctcgtcaccggcctgctcacgccggaggacgttcaccagtggggctggcgcctgccgttcctcttcgggatcgtgctcggcgtcttcatcttcgccctgcgtcgccatatcgacgacgatcacgtcgagaccgtgtttcgcgaagatcgggcaccgacggaccagcgctcaccgctgcgcacggccgtcgagatcgacggctccgccatgctgcgcgccttcgcgatgaatctcggcctggcgtgcggcttctacgtggtgttcgtctacctcgtgacgttcatgcacaccgtgtcgggcctcccgcaacacacggcgtttctcatcaactccctcgccatggtggttcaagccgtgtgcatcccgatcgccggagccctgtccgaccgcttcgggcgcaagcgtgttctggtcctgaccggggcgggcctgacaatcctgtcgtggccgctcttcatgctgctgaccaccggcgacacgcttctgatcgtcctgggccaggtcgcgttcgcgatcctgatcgccggcaacgccgccgtcgtgccgacggcgttcgtcgagatgttccagcaccgctcgcgctgcacggccctcgcgatcagcttcaacgcctcgatggcgctggtcgggggcaccgccccgatggccgcgacgtggatcgtccaccacctggcctggcccacggggccgggcctctacgtcgccgtgctgtcggccatctcgctcgccgcagtcctcacgatgcgcgatcggaccggagaatcgctcgcgtga

SEQ ID NO: 6889 - DNA, 672 bp, Methylobacterium sp.
atggagaccccgaccggggaccacagcggcgcctttgaggcgtcccctctcgccacgatcgccgcggcggtcgcccgcggtgaagtcgcgcgcatcgccgcgctggcgcccggcctggatctctccgtccgcggcggccggaacctcaccctgctcgaatgggcgatctggaacgcgcggccgcgcgcgctgtcggccctgctcgacgcgggggcggacccgtctgtgccggggctcgatcaggagaccgcgctgcacatggcggcgatggtcgaggatccgacctacctggagatcctgctgcgccacggcgcgccggtcgacccggtgagcccgcgcggtcagtggacgccgctgttccgcgccgtacagaaccggcgcgaggcgcagatcgcgctgctgctgcgggccggtgcggacccgaaccgggtcgacgccaccggcaactcgctgctccacgtggcggcacaggtcggcgcggccaatccctgggtgctgaggctgctcgaggccgggatcgacccgaccctgcgcaacgcgcagcgaaagaccttccagccgtacttcttcaccacccccgagcgcctgctgaacgattcagggcgcgagacccgcgctgcggtccgcgcgtggctcgcccgcagcggcgtgccggcggatccggaaggctga

SEQ ID NO: 6890 - DNA, 87 bp, Methylobacterium sp.
gtgaggagcgagaccatgctgaccgccctctcgccgctccacctcgccgccctcagcctgatcgtcgcgtatctcggctggggctga

SEQ ID NO: 6891 - DNA, 249 bp, Methylobacterium sp.
atgcggaaggcgttgggacggccggtgcagagggcgcgatcctggtaccggcgctacgggcgcctcggcgcgccgcggacgccgcgaccggtcaagcagggcccgcaggccgcccccggacgctcgctggaggactgggcgcggttcggcggcggtctgctcggcccggaatccgccgatgccccgcgtcctgagatccgcgccgatcgaggggccgccctcggcatcccgatcagtccgccgggctga

SEQ ID NO: 6892 - DNA, 522 bp, Methylobacterium sp.
atgcgcctcacgacacgcacgccgtcccgaccgcgatccctgatcgtcggctgcgccgccgcggcctgcgcgttcctggtcgtgtcctcggaggctcccggtcaggccggaccgggatcggcggaggcgctcgtgaacgggatccagaccattcggcgcggcgacaccgtcacgaaggtcgaccggaccggcaagggtgcggtgctgtgcatgcgcggcatcctgcaggcgatgcgcgccgtcggacaggcgtgccacgccggcgccgacccggacttccagcaggaattgcgcgccgcgctcgcgcgcatcgatcgcttcatcgccgacaacgccccggacggggccggcccgccgcgcgacgggacgacggaaccggagcagcggcccggcgcggtctgcggccgcgacgcggaggccctgtacgaggccctgcggaccggcggcgccgcgggcctgcgcgcccaggtcgacgacctgctctcgaccccgcgcgagccggtcatgaatccgtgtctgtga

SEQ ID NO: 6893 - DNA, 462 bp, Methylobacterium sp.
atgttcgagatcgcgcgggacgacctgtccgatacgcagacacgggcgctgctggcgctccatcttgccggcatgcacgcatcctcgccgccgggcagcgtgttcgctctcgacctgtcaggcctgcaagcaccggacgtgaccgtctggacggcgcgccgcggcgggcgggtggcgagcgtcggggcgctcaggatggcgacggacggcaccgcggaggtgaagtccatgcggacgcaccccgacttcctccgcctgggagccggcgcggcgatcctcgacaccattatcgcggccgccgccgcccgcggcgcgcgatgcctcagcctcgagaccggatgcggacccgcattcgcgcccgcgctcgaactctatcggcgtcggggcttcgtgaacggccccgcgttcgggacctacgtgccgagcgacttcaaccagttcctccatctcgcgatcgcctga

SEQ ID NO: 6894 - DNA, 474 bp, Methylobacterium sp.
atgttctacgaccgcgacgaggaggggcgcgcactcctgcgcgagaccctgcggcagtgcgatccccgggtcgcgccggtcgagacgctccgccagctggcgcaccggctggtgacgggccggaacccggtcgtggaattctcggcgcgcagcggcgccttcgtcgcgacggcggccgggagcgagacgctcaaggcccgggcccgggcgatccgggacgaactcgcgggcgtggtgcgggtcgcgctcgccgaatccatcgggcgcgggccggaggatcccgacgccgacctggcggccggcctgttgctggcgacctggagcgtggccttcctccgggcgcaccggaccttccgggcgacgcggcggacggaggcggcgaatgccgccttcctggcggtcatcgaccgggggacggccggcctcgcggcggcgctggccggcacgccctacgcggaggcggccgcgccctga

SEQ ID NO: 6895 - DNA, 114 bp, Methylobacterium sp.
atgaccgacgccccagacccgccggaaggaccgcccgggaaaacggcgctgctggtggtcctcaccctcacggccgttgccgccgccgcgtacgtcctgatccacatggactag

SEQ ID NO: 6896 - DNA, 1569 bp, Methylobacterium sp.
gtgaacacgatctccaccgcggtccagaaacccgtccccaaacccgatcgggatgtcgcaccgtccccgcatccggcgggcgaccttcaggcgctgccggatgcggcggtgcggggcgccttcgacctggtcctgcgcgcggtctcggggggaacgcccgccgcccgacccgagaccgacgggggtgagatggacgaaccggagggcgcgaccggggaggatcggcggcccgaagccggcgcatcgcccgcgccgccgccgtcaccgggcgatcccggcagcgccgccgcggcgctcgccgagatcctgagcgccgccgtcctgtcggcccgtccggaactgcccgcgggccacgggaccggtgctccgggaccggccccatccgccgcatccccggcgggccccgacgcggccccggagaccagcctcgtgggaaatctcgaggcggcccgcgcggacgcgtcgccgcgcgccgggccgagcccgggcaccctgctgcagggcggccccccgcaggtcgaggtcctcgaccgggcggttcacttcaagcccatcctgcccgaggcggcccgccacgccctcccggccgccgcagcggcaacgtccgcgttgccggccgtcccgaacgcggcggacgctcagcctcgacccgtccgccccggaccggtggctccggccgtcgccgggcccgatcccgctccgatcgcgccggccgcccagatcgccgcccagattgccgcgcaagtcgccacccagatcgccgggacggtcgccgggaaggtgaacgcagcgccgccgaaggcgacggtcgccctcgcgaccgatcccgagcctcgagccggcgatgcgtcggcccgcgctgatgcgtcggcccgcaccgcgacggggatcgatgggccgggggggctcacggcacgcgaggacaaccgttcccgctccggcatcgccggactcctcctcgcccccaccggccggcaggggccgccgggcgtccccatcccgggtcccggcaacggatccgggaccgagccggcccgactcgccgccgtcctgccgacgatcgcggcggccatcacggaggagatcgagcgcgcgaccgcggccggaccggagcgtcgcgtcggcgccgatccggcgatccccgcggctcaggacgggccgctccgggtgctcaagatccagctccggccggagagcctcgggatcgtcacggtggaattgcggctcgtcgacggtcagctcgagacccatctgcgcgccgcgcgtcccgagacggcggcgatgctgcagcgggattcggcgatcctcaccgaactgctcaagcacgcgcattaccggcccgagatcattgtcgagccggttcgccccggcgacgccgggttctccgcgggcggatcaccgtcccagggccaatccgggctcaccgacggcggcgcccggccgggtcacggcggggacgggcagcggcaggcagaccagcgcgcggcgcagcggccgacgctcggcaggcgcgacggggagcggacagatgagacggtacgtcctcgcgacggcggcgtttatctgtag

SEQ ID NO: 6897 - DNA, 135 bp, Methylobacterium sp.
atggccgaaatctgcatcacggaagatcagaacggacggtggaccgtctacaccgccggactggtggtgaccgatctgacgcgcgaggccgccgaggccttcgcggcgagctaccgtcgcgtcacggccggctga

SEQ ID NO: 6898 - DNA, 201 bp, Methylobacterium sp.
atgcaccgcatccgcctcggccttcggcggagggcccctgtgccgccggcgccggcgctgcccgagagcctgacccgctacgtgtcgccgccggctcccgaggccgggttgatcaccgcaccgctccgggacatcggcatggcgctgctggtcggtgtcgtcgtcgcgctcgtcggcggccggattctcgaagcctggtag

SEQ ID NO: 6899 - DNA, 513 bp, Methylobacterium sp.
atgcgcggcttggtttcgacggcgacgctctccggagtgctggcgcttgtcttcagcatgcccgcatcggcggcctccgatatcacggtcgctgccatcgccaccggtcgcctctatgttgtcgggacaaccgatcgcccgcacacggccgtgattttggacaaccggttcaaaacggagtccgacgagaacaggaagtttcagtacgagttggtgtaccatcccgccaattgtgtggtttccgccgcaatcgatgggacgatacatgaagcggttgtcagcaattgtgggcagcaggtggtgcccggaacttggctggacccgaagcccgcgatgacgaggccgactcctctggaacgggtgctctcaccgacggtcgaggtgccctccaccgtcttctgcccctcggttcagacagagcgctcgcaggatccggcacgcatcgagcttgctgaccgcacaccaccggtcttcaccgtcgtgacggggatgaatttctcgccgcgctactga

SEQ ID NO: 6900 - DNA, 96 bp, Methylobacterium sp.
atgatcctgagggccgagcagatatcgaccggcttcgtcggcggccgcattcgcgtgcgggctgccgaacagcaggacgcacgccgccgcaactag

SEQ ID NO: 6901 - DNA, 945 bp, Methylobacterium sp.
atgacgaaacctcgctgggtacgccgcgatctgctgaaatcgtgcttccgggatctaccgatctgcgcggccgcgtccctgctgccgaccagcggctcgagcgcggcgatcgacgcctccgtggatccgacgcagggccgcacgctcgtcttcgatgagcccttcgcggagatcaacggacggatctggaatggcggaccgaaggccacgacagggccgtccggtttctacggccgttccgccttcgctccccttgccggggcggaaggcttcaaaccctacgagatcgtcgcggatgcggaggccacgggcggcacggccctccagatttccgcgaaatacatcggacgcaagatgagcgtcgtgaattactatggaaacaacacatccgactatcagtggatttccggaaatttgcagaccggcagccgcagcggtgtcgtatcggtcggctggcgccaaggctatctcgaagcgcggatgagatttccgcggcatccgctcacgtggccggccttctggcttctcaaccgggatggcatcaccaatgccaaacggagcatagaggttgatatcgtcgagcacaagggtttcgagccgaagctctacggcgcgtacttgcacgaatgggggcagcccggtgagcacaacgaaggcaccggcgttcccacgcccgtcgacatgaccgaacagtactgccggtacggcgtgctgatccaggacggtcaatgcattccttattttgagcgcaagccaattatcaatcctaagacgaaccagctcaatatctggacactcacccgcgcgtcggagatggaacaagccggcgacgtcttctggccgctcctcacattggcgttgcggacggatgtcccggcccctcaactgaccgaagcgcagaagctcacccatatgcgcgtcgattactttcgcgtgtacgcgtag

SEQ ID NO: 6902 - DNA, 885 bp, Methylobacterium sp.
gtgcgtgacgccgtccgcggccggccgggcaccgtgtcaccgcgcggctcgacggggcgcgcgaggaccgggctgtcgcggcgatcgctgggcatcctgctcgtcctcgcggcgacggccgtctggctggccgtcgccctcgtgcccaacctcctcgggaagggcggagccctgtgggcgatcgtgcacggcgcgtgcgtcccccacgcgttgcgcggacagggccccgcaccgtgcagcctggtcgacctggagggtggggtcgagaagggatacgccatcctcaaagaccttcgcgggcgggcgcagttcctcctgatcccgacggcgcgcatcaccggcatcgagagccccgtgctcctccagcccggcacgacgaactacttcgccaaggcgtggcgcgcccgaaccttcgtggaggagcgtctcggccatccgctcgaccggcgggacgtcagtctcgcggtgaattcgcggctgcggcggactcaggggcagctgcacatccacatcgactgcgtccgccaggatgtccgcgacaccctccgccgcctcgcacccacgatcggggatcgctgggcccctctcgcggagccgctggtcggtcgcccgtacagggcgatgcgcgtgctcggcgaggatctcggcaccgcggacccgttcgacctgctggcgcgcgacgacggggcgcgctcggccatgggcgagcacgccctggctgtcgtgggcgccgagtttccgggcgcgaagccgggcttcgtgctcctggacggtctggtgaccagccgcttcggcaaggcctccaacggcgaggtcgtgcaggaccacacctgcgccgtggcggcggagcccgcatcgagcggatttcggccactggaagactga

SEQ ID NO: 6903 - DNA, 300 bp, Methylobacterium sp.
gtgcggaacgcgggcgccgccgtggaggctggcaccggacgcggtgacgcggccgcgcttttcgcgctccggaagccgcgcggccccttctcggacacctatccgatgggccatgccttgagaggcctcgtcatcggcgccggactgggacatgcctgtccgcaccccgatgccgtcggcggccgcaaccgatccggcggcgcgccgccgggaacgcggcgcgaacgacaggggtgggacgacgcgcgcgaggacctgctcgacgcgcgctccgggagccgggagcccggcgaccgctga

SEQ ID NO: 6904 - DNA, 165 bp, Methylobacterium sp.
ttgctgttcagccgtcaagctgagccgaccattcggacgtcggatctggtgggagccacggccggggtcgcactcttgggcggcctgtgcttgctgctcgtggccctgctcacgagcgaggcccaggggttcacggatctcacgtcgatcctcacggacagctag

SEQ ID NO: 6905 - DNA, 240 bp, Methylobacterium sp.
atgctgacgatcctgttcgctgtgacattccgggaggtgcacgtcgtctggccgacctcgatcgatgacgggctggtcgatcgcgtgaagcccgaccccatgctgaccgagatggacgagcggcttctccatctgaccgtcgacggcggcttcgctgtcgcggtgcacgcgcgcgggcggttcggcgccgagctatcaggggtgtcgcggcgcgggtcgccgcgcatgccgcggccgtga

SEQ ID NO: 6906 - DNA, 168 bp, Methylobacterium sp.
gtggagagcgagaccgcgacggctgagcccttcacgatcccgacaggccaccacgtcgacgtggccgaggccatcgaaatgcgctctcaggcgacgagcctccgcgccggcgctgcgctgcacgtggccgagagcgcgatcaacatgagtttcccgaggacgacatga

SEQ ID NO: 6907 - DNA, 267 bp, Methylobacterium sp.
atgtcggaagccatccttgcacgcgatcaacggacggagtggttgcccagaagccggctcggtctcctgattttcgtgccgggtgcactgctgtggatctcgatcgtcctctgcatgctgccgatcacagtactcgcatttcctgcggaatggatgttcaagaacaggccgaacctccatgcgacagccgtgatgattctcgtgtgcctcggcgcagccaatgtcgtgatcgctccggcgaccgtgctctacctcctgtatgcctga

SEQ ID NO: 6908 - DNA, 225 bp, Methylobacterium sp.
atgcaggcatccgaatgctgcatcatccgggtatctatcgccgcgagcctcggctggctcatcgcgattaccctgatgtggaagcatggcgtgctggccgcgctgatcgtcagccccttgttcgggaccgcggcggcgatcgccgccatgaccctgttctggttcgtgagcctgttcgtctcctgcgaacccatcgggccgcgggcgtctgacaccaaccggtag

SEQ ID NO: 6909 - DNA, 285 bp, Methylobacterium sp.
gtggcgaagccggcggcgccgccgcagcaggccgagggcgcgccgggctccggccagccgccagcttctccaggccagggcgtcgacctcaacacggcgtccgtcgaggagctgaacgccctcggggccggcatgatcgggcgccggatcgtcgcgttccggccctacggctccccggaggatctcgtgacccggcgtgtcctgaagaaggccgattacgaggcgatcagggctgccgtcgcggtgcggcagaccgagtccgctggcgcgggccgcccggattga

SEQ ID NO: 6910 - DNA, 255 bp, Methylobacterium sp.
atggaagcgatcggcgtcgaggaccggggcggcggccggcgcgacgccagcgcccgcctgcgtcggatcgcggccgcgaccggcgtcccgctcgccgcgttcttcggggcaccggcgccgcgcccgctggccgagctcagcgagctgatcggcctgtggcagtcgatcgccgaccaggagggccgcaacgcgatcctggcggtggcccgggcgcgggccgccgggacgaaggatgggccgggcgggccggcctga

SEQ ID NO: 6911 - DNA, 294 bp, Methylobacterium sp.
atgggcctcaccgcgttcgccgtgttcgtcattccgtgggtcctgctcgcggtgttcctcacgcggtccccttcaacgcttcgcctggggaccgcttccgcgccgtggcggtccatcccgacccacaaggagatggcccgcgccaaccgtcacgcgctgcacccgcatgggcagcgggcgggcgagacggacggagtctcgggccgggaccagcgcggtcggaccgatccgcccgcgggcggtgcgctgggcacgagcgtggagcccacggagcccgacgacaagctcagctaa

SEQ ID NO: 6912 - DNA, 180 bp, Methylobacterium sp.
atgttgaccatgaccctcgcgctgttggccgtcctgattgccggggcgctgtgtctcggaatgatctccgcgttcctgccgtttcagcgtccgcgcgaggagatcgagttggcagagttcaccgacgacgaattcttcgacatcggcggcccgattatcgatttgcaggcgacgcgctaa

SEQ ID NO: 6913 - DNA, 672 bp, Methylobacterium sp.
atgaacacgacagtcacagcgatcgcgtcggcaatccttgccggcgctcttctcggggcgccgaccggagcccaggcgcaggcgggcagcttcgccaaccacggcttcggcaaccacaatttcggagccgcggccgtcggcggcggcggcttcagcagtcccggtgtcggggctggcgccgcgggcggcggcttcgccaaccggggcttcggcaatcacgccttcgggccggctgccggtgccggagggggtagcttcgccaataacggcttcggcaaccacaatttcggccgaccggctgtcggcggcggattcgccaatcccgggttcgggcacgggctcggcgcccaccggggctacggtcatcatcgccattacggctacaaccgcggctactacggccgcccctatggatacggatacggacggggcggatacgggctcggcctcggcgtcgccgtgggcggtctgtacggcggctacggttatccgggatacggctacgacaccgggtactacggcggttacgcgcccgtcacgtacggctacgccgacaccgaaacctaccgcgtcgcggacgacgaccgctactgcgcgcgccggttccgatcctacgacccgcagagcggaacctatctcggccgggatggacgtcgccaccgctgccggtga

SEQ ID NO: 6914 - DNA, 132 bp, Methylobacterium sp.
gtgaccggcatcgatggtccgacgacgcgcgggcgacatcagcagatcgacacccacgccctcctgaccaccggccgccaccggcgccgcgccaccgtcggggccgcgcccgagccggagccggtgccgtga

SEQ ID NO: 6915 - DNA, 177 bp, Methylobacterium sp.
atgtcgtgtgtcgaaggagaaggtcatcgccgcgtcccgggcggcacgcgcgcggggcccggcgcgacgcggccggtcgcgcgttccgaggcggcgggcaagatcgtcaaccgccacggcgatcacgcctgtcgcctgcggctgaccgccggcgccgcgccgatgctgacccgatga

SEQ ID NO: 6916 - DNA, 153 bp, Methylobacterium sp.
ttgctggtcgtgctggtgttcgctgcactgattggaggagcgatcggtttcgcggttgttctaccgaaggggttcctgctcgcgctgctggccgcccaggccggggcggccgtcgccgtcggcctcgtcgtcctgctcatccgccgccgctga

SEQ ID NO: 6917 - DNA, 147 bp, Methylobacterium sp.
gtgcagggcggtccgttcccggcgacctcgggcggccgcgacggcgcggtcgggccgctggcgaccgagcggatgccgcgcccagtcctccaccgggacctggcgcgccggatcgacggcgctcgcgccccgcaacccggccactga

SEQ ID NO: 6918 - DNA, 138 bp, Methylobacterium sp.
atggacaggcacggccaggaggcgggcgcggacacggctgcggaggcaagtccgggcacggccggggacacagccagggacaccgccgaggcccgggcgccgtcccccgcgcgagcctccgctcggacggccgcctga

SEQ ID NO: 6919 - DNA, 141 bp, Methylobacterium sp.; identical to SEQ ID NO: 5868

SEQ ID NO: 6920 - DNA, 888 bp, Methylobacterium sp.
gtgctggcgcaggagcttcatttcggccgggccgcgcagcgccttgcgacgacgcagccgggcctcagccggctcgttgcggaactcgaggccgaggtcggtgtgaagctgttccgccgtacgacccgaacggtcgaggtgacggaggccgggcgtgccttcctggccgagtgccggatcgggatcgaccatctggagcgggccgtgacgcttgcgcggcgcacggcgaccggcatggccggcgtcctgcgcgtcggctacatggatttcgcgatcaacggccggttgccggagctggtccgcgcgttcagcgaattgcgaccggcgatccggctggagctgtcgcacgtgccctcgcaatcccagcgcgaagccctactcaacgaccgcatcgacgtcggcttcaccctcagcgcggtcgagaacgagcattttgagagcctgctgttcgaccgcgactcctatgtggccctgctgccggtaacccatccactctcgaacgcgcgcagcctgaccctcaaggatctcgccgacgagccgttcgtgctggggtctggcgggagctggagcgcctatcgcgaggccttcttcacgatctgtcatcggcgcggctttcacccgaccatcggccaggaggcctcgtcgagcgagggtatctttggcctcgtcgcggcgggaaccggcgtgagcacctatgcgagctgtgtgcgcaacgtgcagcggcgtgggatcgtgatccgctccctcgacgatgtccccgataccatcgcaacctacgccacttggatgaagccggcccgatccaccagtcttgaagctttcaccaccttcctggcgacggtgtggggctcggcgccggcgcgatccaatacgcgatcgaagttttga

SEQ ID NO: 6921 - DNA, 822 bp, Methylobacterium sp.
atgaagctgtttgacgccgagcccgtctttcctcgggtcccggcgatcatgccaagtccgtggatgcccctcgaggttgggcggaccatgggggcgatctgcaagccccacgacgcgggcggagggacctcgttcctcgggcttcatttcgacgattactgcttcggcccggctcctgagcatgtggcacacgctgtcttggccctccctgtccgagcgttcgacctcgaacgtgacacgcgccgtgaggatctgcgcaaagctttttatctggcggctcccggcttcgggcgccgtcctgacttcacgctgggggccggcgcgttcatggtccgcagcttcgagggagcggacccccgagacaccgtgtacctgatctggcccgtacgatgcgacgagggtgaggcggggttggattgccgcaacggcatgggtcggaaggcttttcggttcgctgccgacggcgccttgcgggatgtcagtgcggacgtgctgccggcggatccggtcctgagcttcgacgaccgcgtgcgtcagacgaagtacggcggcagcgtcctgtttctgctcgacgacaagctgccttatgcgcccaccatgcgctggatcatggaattcgatcctgactcgccaccactcgagaaggacgatccgaaggccgcgggcccttgggcccacttcggcttcgtccactggaccggttctcgtttcgagctcgtcgatcgaattgcccgatcgcaatggccgtgtcggaagctcaatgacgccccggcctgctcgacgtatcccgacggcttcgaggatccctttgtcatcccgtga

SEQ ID NO: 6922 - DNA, 354 bp, Methylobacterium sp.
atggcggtcgagtcgtacggggattaccgtgactatttcgatgcgaagcccgtgaccgcgaagcgcgcgccgcgcagcgcttcccagaagaaggctcccatcgacatcaccacggacttgagcgcggtgcgacgccgcgccgatggcgaccaccgtgagatgtaccgctacgagactgggtcgaggctgatcgctgacatgaggcctcgcaactgggacggcgggcatgttcccgtgcagccgcacagttggtcgccggatggcttctggagccccatggtacagtcacacgaggggcgcgagcggcccgaccagtcattcgaggggcggggacggcccgagcgattccggtga

SEQ ID NO: 6923 - DNA, 450 bp, Methylobacterium sp.
atgcgccctgccgtcgccgcccttctcgtcgccgtgccgctcgccgcagcggcggacgatctcccgccgccggtggctgcggccatcgccgaggtcgaggccgcctgcggatccgcgccggcgaggatcgatccgttcgtcatcgaccggcaggacgtgaacggtgacggggtgccggacttcatcctcaacgtcggcggcctccgatgcggcgacgaagaagtctcccagtgcggcctcatgggatgcccgaagatcgtcctcgcatcctcgaagaacgggttcgtcctggtgctggacatctacgcgcacgacctccggtttcgcgcgctgaatggccggccggcggcttcggcgaacgacgagggatggaattgcggctcggtccggagggggccgggccgcacgaccttcctgtgggacgggacgcgcttcgcctgcgccgagtag

SEQ ID NO: 6924 - DNA, 90 bp, Methylobacterium sp.
atggcttggtccgcccccgtcgtctccgagatctgcgtcggcatggaagtcaccagctacgagtccgctgagatcgacaccttccactaa

SEQ ID NO: 6925 - DNA, 96 bp, Methylobacterium sp.
atgaagcccaccacgatcgcgccgatctccagcgaccgacgcgggaacgggccggaccggcagagcctgccggtcgcccagggagaggaggattga

SEQ ID NO: 6926 - DNA, 81 bp, Methylobacterium sp.; identical to SEQ ID NO: 5875

SEQ ID NO: 6927 - DNA, 144 bp, Methylobacterium sp.
atgaccgaccttctcgtcaccctccaggagccagccgaacccgccgggcaggccgggccgggatccgagacgtcggccctgcgcgcgcatatcgcgcggattctgcgcaggctgcctcccgccaaggcgacgaagacgacctga

SEQ ID NO: 6928 - DNA, 219 bp, Methylobacterium sp.
atggtagagcggtaccatttccgcctgagggggccggacgaggtcatcgaggacgaggagggcgtgctggcaaactcgatcgagatcgccgtggccgaggcgacgcagctgatcgccgagatgcacgcacggggcgagttgcccgatcccgacgagcgctggtgcgtggagatccacaccaccgacggtgtcgtgcttcgttcccttcagctgtactga

SEQ ID NO: 6929 - DNA, 369 bp, Methylobacterium sp.
atgtcaggacctcgccccatcgccgtcctcgccgaggacgaagagttcagccgcctcgtcgcggccgacatgctgacggcgttggggttcgaggtgctggaggcggaacacgcccagggcgcgctccagcatctggaggcatgtgacggggccgtcctgctctacaccgacatcaacatgcccggcacgatggacggccgcgcgctcgcgcacgccgtccgggcacgctggccggagacccggatcatcgtctgctcgggctgcgatccgcgcgaggcgaccgcgctgcccgaggaggcccatttcatcgccaagccctgtggggagaaactggtgcgcaaggcgctcaaggccctgcacctgcactag

SEQ ID NO: 6930 - DNA, 1875 bp, Methylobacterium sp.
atgatcatccgccacacccgcaggctgcagcgatcgggcgaggcggtcgcgagccgcgatggtcggctcgtcgcgcctgccccgacggagcccgactgggatgtcctgggtctgatcgatctcggcgggcgcgtcacagtggtcgcgctcctgggtccgaacgacgcgcgcgcgttccgattcctgaacccggacggcacaccgctggcgtcctgcgctgcggacttcctcgccgcgccgtgggacggcgccggcccgctcgactggcaggccgaggcgctccacaccgacgacggcgacgcgtcgaacacgcgggccatgatcgaggatctccacctcctgatcgaagccctcgcacgcgcggctgccgcgagcccggagcacgctgtccgggtcgtcacgggcggcggttccgatccgcgggcgcaggcgatgcacgcggcgctggcacgcctcaacgccgcaccggcgggggctccgccccacctgcccgaactggtgacgaaggcgatcgtcgcgcgcggcggccaggagacggcccatccggacggcggcgatctgcgcttctcgatctacctgcccatgccgggcttccgctttgtcggctacgcggcggaccggaacgagacgctgtgcacgctgatcggcaagaactcgcgcctcgcgtcggccctgctggacgttcgcgcgaacacggcctacgcccggccgaacctgggaagcgtcgggttcgacgccgcgaccctggtgcaggtgcggttgtggcggcagtacctcctgccggcgctgatcgacggcgcggcgcggtcgacgcgcgtcggggtggtcttcgagcacgcgcacatcagtcacgccatctggaacgagctggccgcggtcgacgacgtgctgtcgctcggtcgcgcgccggcggtgttcctgttcgcgagctgcaacgagccgatctctccggtcgacgccgtcttcccggagctcgccgggcaggtgtatcgcgggatcgaaggcccgctgcccctgctgcaggctgccgtcgccggcgcggccaccttcctgcccttccggtcctaccgcgtgagccagcgattggccgatcgtctcgcggccctggcgcggagcgcggaacccgctctcgatgcccgcctgacggacgcggcgcgccgggccacgatcgtcctgatcgggctgcgtctggagaaccgccagtgggtccggcagctcgacggctacgtggcgctgatccgacgcctcggccggaggcgcggcgagaggttcctcgtcatcgtcgacgggcacaacacgctcgcgggcgcggagggcggctacgtcgagagctactgcgagagcctcgtgcccgcggaagggagcgtgccatccatcgtccggaaggagctcgagctgatcggggcgctgcgcgcacgggtcgccgacgtctccaacgtggagttgatgccgctcgtgccctgctcgatgggggcgagcctcgtggccgcgctccacaccgacctgttcgtgacgcatttcggggccgggctcgccaagtataagtgggtcgccaacgcgcccggatgcgtcatatcgagccgatccgtgctcagcgggaaggacgatctgcgcatctacgacaccgagatctttcgcgagaacgtgtcggcctgtcactactttcccgccgagcgggtgacggacctcgacacctcgaccaacgccctacatgtccccggcagccgggagcgcgaggatttcgatctcgacctcgaagagttcgccagcttcgtcgagcagaacctgccgaagcggcgcgccgcgcgaccgcactggctgagacggctcaccctcttcaggacccgcgccgccaccgacgcggccaggctctga

SEQ ID NO: 6931 - DNA, 99 bp, Methylobacterium sp.; identical to SEQ ID NO: 5880

SEQ ID NO: 6932 - DNA, 207 bp, Methylobacterium sp.
atgcgcgtgcccgccaccgttcggcgcgccgccatcttgccgcgcgggcccatagctgagggcacggccatgctcgaaccattgctcttcatcggcctcatcatcgccgctgtggctgccgcgacccggctcgggatcgccgccgcggcaccgatggcgccgtcgcgcctcgacgcgtgggacggacgcgccgacgcggacgcctga

SEQ ID NO: 6933 - DNA, 132 bp, Methylobacterium sp.
atggccaccaagatgatgaccaagggcatgaccgtcaccgaccacatcgtggcctggtcgatgctgactggcttggcgctcgccgtcctccagctcgccctgaccgcggcgctgccgacgcacttcgtctga

SEQ ID NO: 6934 - DNA, 633 bp, Methylobacterium sp.
gtggtcgacgagggcatccgcggcgaagaccatggccgagaacacgatcagcccgacctgcttccggtggctgtcgcgctcatcggcatcgcccgtgtcgcgcgcttcggacggcccgtgctgttgcgcgtggcccgcgtgagggggctgcgccgcgctctcggtcgatcgctccccgtcatccgcgcgggcgtcgtcgggcgacaggctcagggccgcagccgcgacgagagccgcgagcagcgccgccgggtgaaccgagagcttcgtcccgcgggcatcctgcgggatcgggagaagctcgggatagcgtcgggcgatctcgttgatgagggcgcggaagtcgctgcctcgcatcgggctgtccaagacatcggacgcgatgacgtagctgccgtcgatcctggcgaaatgcatgacggcgtcgccatccggccggcagaagacgaaccagggatccgcctcgtcgctcaggccctgctcgctgccgatctgcaggccggctcggatcagcgcggcctcgacgcggtagaattccgcgagttcctgctgcgaccagccgccctggcacgtcgttgcgggtcggaagaacgagatgaccgcgcccatcgggacctcacgtccgcacagtga

SEQ ID NO: 6935 - DNA, 336 bp, Methylobacterium sp.
gtggcccggcgcggcggcactccggccgggaccttcgccggcccgcgtcgagcctggatcggcagtgcttgtctgagcctgcgccagacccggcggttcatccggacccgcgccgccggccgcgtccagtggaacggccgccgcgtccttgtgatggcctggcgcatcggcgctccggccaggcccgtcgccatcttgaccgcggccctgatcggtgacctccccccggacctgcgcgaggcccgctgttggacgcgggctcggatcggatgctgcactggggtcgccggccgcgccgtgcaactcccgttcggatgcacctgcgccgatgcctga

SEQ ID NO: 6936 - DNA, 141 bp, Methylobacterium sp.
atggccggcatcccgggcgtgcggcgccgtgtcttggacatgttccggcgccaccccgctccgaaccggtccctcgccagcctgcctgtgatccggttcggcggctctggcctcgatctgcaggttggctgccggtgctga

SEQ ID NO: 6937 - DNA, 117 bp, Methylobacterium sp.
gtgaacggcgggaccctgtgcgtgcggtccatcgtctcggaggtgcccgggcggctcgccgcttcgatcgtcctgcccgtggcctggatcggcagcgcgcgcctgcgtgccggctga

SEQ ID NO: 6938 - DNA, 666 bp, Methylobacterium sp.
atgcgtaagatcaccggctccctcttccagtccctcgacggcgtgatccaggcaccgggcggtccggaggaggatcagaccggcttcgcgcacggcggctggaccttcccgtacttcgacgcgtcgctcgccgggccgatgggcaagctgctcggcggcgattacgagctgctgctcggccggcgcacctacgagatcttcgccgcctactggccgcacaacgccgagcagccgatcggcgcgaccttcaacgcgatccgcaaccatgtcgtcaccggaagcgacgccgcgctcgactggaacaacagccgccgcctcgccggcgaccccgtcgcggcggtcacccgcctcaaggagagcgagggccccgacctcctcatccagggcagcagcaggctctatccggcgctgcttccggcgggcctcatcgaccggctcgtcctgatcacattcccggtcatgctcggccgcggcaagcgctggtacgcggacgacccggcggcggcccgcacctggacgctggtcgagcagagccactcgccgaagggcgtccacgtcgcggtgttcgcgcgggacggggcggtccagaccggcagtttcgccagcaaaccacccagcgcggacgagatcgcgctccgcgagcgccaggcggcgggtcgctggtag

SEQ ID NO: 6939 - DNA, 345 bp, Methylobacterium sp.
atggctgtcgcctgccctgttctgacgcccgaagagcgcaaggcgtccgagatcctggacgccgcgcagcgcgcgatgatggagacggtgcaggcggccgtggcggaggccgccgcgcgggtgcgccagcagaatctcgacgccggcctcgacctcgccccgccgcccagggcctatttcgagtccgtggtgcaccagcggatgtacctgacgctctgcggggcggcggtcggcacgttcgcgggcggcgatgccaggacggcgatcggtctcatccggaatcagcagctgatcgccaaccgctactggggggccgggatcgcggtgacgccgagggcgccgtga

SEQ ID NO: 6940 - DNA, 99 bp, Methylobacterium sp.
atggccctgaagatcttttcctacgcgatgatcggcgccttcgtcggcggccttgccatgacggtaatcggctctgctggggtgctgatgggcctttga

SEQ ID NO: 6941 - DNA, 2526 bp, Methylobacterium sp.
gtgggcgacgcgcgtcccaggcagacgacggcgcgggtcctcctcgcgagcctgatcggcacgacggtcgaattctacgacttctacatctacgccacggcggcgagcctgatcttcgggccgctgttcttcccggcggcgctgcaatcggcggagctgatcagcgcctacgcgagcttcggcctcgccttcgtagcccggccgatcggcggcgcggtcttcgggcatttcggcgaccggatcgggcgcaaggcgacgctggtcgcctcgctcctgctgatggggctcacgacctcggccatcgggctgctgcccaccttcgcgctggccggctggctcgcgcccgtcctgctctgcctcctccggttcgggcagggcctggcgctcggcggcgagtggagcggggccgccctgctggcgctggagaacgccccgccgggctggcgcgcccgctacgcgatgttcgcgccgctcggggcgcccctcggcttcttcgtggccaacggcctgttcctcgtcctgaccctgaccctcagcgcggagcagttcgcggactggggctggcgggtgcccttcctgctcagcgtgcccctggtctggctcgggctctgggtccgcaccaatctcggcgagactgaggagttcgccgccgccgtgaaggacgcgcagcccccgcgcgtccccctcgtcgccctgatgcgcgaccatgccgggcaggtcgtcgccgggatgttcggcgtcgtcgcgtgcttctccctgttctggaccgccaccgccttcgcgctcggctacggcacgacgacgctcggctactcccgggcctcgttcctgacggtcgagctcggcgcgatcctgttcatggccgccgccatcgtcgtcgcgagctggctgtccgaccggctcgacccggcccgcgtcctgatcgtcggctgcgccgggaccatcgtgtcggggatcctgctggcgccgatgctcggcagcggttccctcgtgaccatcttcgccttcctggccttcgccctgtgggtgatgggcttcgtcaacgggccgctcggcgcgtggctgccgagcctgttcccgccgcaggtgcgctacacggggacctccgtggcgttcaacgtcggcggcatcatcggcggcgccttctcgccgatgatcgcccaagcgctggccgcgcagagcggcctgaccgcggtcggcttctacctcgctctgaccggtgggatcagcctcatcgccttcgacacgagcgcccggcggcgggcgctggacgcgctcgcccggagcgagcgccgctaccgcgcgctgttcgagcagagccacgtcgcgctgtgtgaggtcgatctctccgaggcgcaggcccacctcgccgaggcgcgggccgccggcgccctcgggcccgacctccgcgggcaggccgacgctgccctcgtcgccgcctgcgcccggcggatcgcgttggtcgacgtcaacgacgcgacggtgcggctcctcggctgcggctcccgcgaggcggtgctcggctcgatgagccgcttcctgccgccgggcaacgacctcgtcctgccgctcctgcagcggatcgaccgggcgggcggccgcttcgaggcccagggccgcctgatccgcgccgacgggcgggaggtgaccgcgatcctcgtcgtggcgctgccggacgacgaggcggccctcgaccgggtcgcctgcgcgatgatcgacgtgaccgagcgggagcgcgccaaggaggccctgctcgcggcccaggccgagctcgcccgcgcgggccgggtctcgaccgtcggggcgatctccgcctccatcgcccacgaggtcaaccagccgatcggcgccatggtgatgagcgccgaggcctgcctgcgctggctgcggcgcgagacgccggacctcgaggcggccgcgcgggcggccgagcgcgccgtccgcgacggcatgcgggcgagccggatcgtgcagcggacgcgcgagcagctccgccgcgaccgcagccagcccgagatcctcgacctgggcgccctcctggcggaggtcgcggccctcctcgaccgggagatcctggcggccggggcgacggtgcggacggtgatcgccgcgaccgaggcgcgcgtcctggccgaccgcgtcgagctgcagcaggtcgtggtcaacctcgtgacgaacggcctgcacgccgtgcgcgacctgcccgagccccgccgcgcgctgcggatcgcgctgaccgcccccgcgccgggccggctgcggatcgcggtcgtcgacagcggcaccggcatcgatccggagcagctgcccaggctgttcagcccgttcttcaccacgaagcgcgacgggatgggcatcggcctcgcgatctgccggaccatcgtcgagtcccatggcggcacgctgaccggcgggaacaacgacgggccgggcgcgaccttcgcggtcgagctgccggcggccgagccgggcgcggcgggcggcgccgcggccgagcccgccgccgtcgccggcgccgccggctga

SEQ ID NO: 6942 - DNA, 177 bp, Methylobacterium sp.
atgctccggcagatcgcgcacgccctcggcgtgcccgaagacgctttcctcgacgaatccgaggcgctcgccacgatcgacatgacgggggatttgctgcgcgtctggcacgcgctcaccctgtcggaccgccgcttgctgctgcagatggcgcgcgggatgatctcccgcggctag

SEQ ID NO: 6943 - DNA, 198 bp, Methylobacterium sp.
gtggcggccctgctcctcgcgctcgcgaccgagaacgccgagctgcgccagcagctcgccaccgcgcaggacatgctgatggagaccgccatcgacgccggtcatctccacgcccgcatcgaggcgcttcaggccgagcgcgacgcgtggcaggcggaggccgagcgcttggcgcgccggcccccgcgttccctgtga

SEQ ID NO: 6944 - DNA, 195 bp, Methylobacterium sp.
atggccatcgatagatccggtgagcgtgccgcgctcgataccgaggtagaggatacccaggacaccatcgcgaagcttcgcgaggctgccgacggaacgccgcccggacacagttcgcgcgtggcgctgaagaaggccgaggagaagctggccgaactggtcaagcacatcacccggcgcgaccggacgggttag

SEQ ID NO: 6945 - DNA, 129 bp, Methylobacterium sp.
ttgatcgccctgtccggtatcgaccgcgcacgaaccgcgccgacctgcggtggagcggccattctcgatctcgccctctgcctgatcctgtccgtgaccgtcgtcgggctgctcctcctggccctctga

SEQ ID NO: 6946 - DNA, 225 bp, Methylobacterium sp.
atgccgaagcacgcccgcctggccctggccgccgcgcttctatcggccatcgcggcgggcgccgcccgcgcggacggcacatccgctttcggggccgccaacgcggcccagctccggggctacaccgcgagcccggcccaggtctacgttccggcaggcggcccgagcgccaagcccgcggcccccgcaccgcagcggccgaaggcgccggcgcgcagtcgctga

SEQ ID NO: 6947 - DNA, 339 bp, Methylobacterium sp.
atgcgcaagatcggtatcatcgccactgccgccgccatggctctcggcagtgttgccgtcaccacgagcgccgaggcgcggccttacggctaccacggtggctacggcggctacggccacggctactaccgcggccgtcgcggcatcggcaccggcgccgccatcggcctcggcatcgccggcctcgcggccggtgcgatcgccgcgggtgcggcccgcgacagctactacggcggcggctacggttacgccccgtcctacggctacggctacgccccggtctacggcggctacggctacgccgctccgggctacggctactacggctacggctactga

SEQ ID NO: 6948 - DNA, 102 bp, Methylobacterium sp.; identical to SEQ ID NO: 5900

SEQ ID NO: 6949 - DNA, 270 bp, Methylobacterium sp.
atgctcaagtccctcgccgccgcggcactgctcgccgtcggcatcgccgcgccggcctcggcgctgcccgtcgcgggttctccgctccccgccgcgcaggacgggctgatccagcacgtctacggcggctgcgggccctatggccatcgcggcccttatggcggctgccgcgccggcggccagtggggcggctatgtcggtcgggcctgtccgcgcggcttccacctcggtcgcggcgggcggcgctgctggccgaaccggtactggtag

SEQ ID NO: 6950 - DNA, 138 bp, Methylobacterium sp.
atgaccctcctcactgccctcgcccttctccccttcgccgtcatcgccaacttcgccttcgtggtggcgctggccaatcacttcgacgccgacaagccggccacgggcttcaccggcccggttccgacgctggcctga

SEQ ID NO: 6951 - DNA, 192 bp, Methylobacterium sp.
atgtcagtctccgcaggccaggaggatcagatgacggctccgttctccctcatcaggcgatggctcgactgccgtcgcgcgcggagcgaactcgcgtcgttcagcgagcgcgacctcgcggatctcgatctcgtcggctgtgacgtgaagcgcatcgcctcggcgcggtccgtgcggagaggcgcggcctga

SEQ ID NO: 6952 - DNA, 147 bp, Methylobacterium sp.
atgcgctaccgggccgtaagtgtcttggatgtgtcggcgatggcttcggaagagaacccgacggacgagaccctcatgctccgcgagcacatccgccgtatcctgcgcaagctctcccgcgcgcgggccgagcttcagtacagctga

SEQ ID NO: 6953 - DNA, 165 bp, Methylobacterium sp.
atggcgggcggcttcgacgcgcgtgtcagcgcgatcgcggaggccgtcgtagccctggagaaccggtccgggtgccgatcatccgccgaaagaatgccctgcgccgcgtcggagattgaccgaaagcaaggcactcggcagagcgacacgatacagctcagctga

SEQ ID NO: 6954 - DNA, 675 bp, Methylobacterium sp.
atggaccacgcggccgacccagatcccgtcctgatccgcctgcgcgagggcttcgagcgcgtcgccctcgtgctgcgggccgatctgtgggcggccgcgggcgatgcgggcctgaatccgacacaggcgcaggtgctggcgctgctcgcaagacgcccggccggcctgagggcgaaggagatcgccgcgcagctggccgtctcggcaccgagcatggccgacacgctcgccgcgctcgcccgcaaggccctgctgacgcgtgcgcccgatcccgcggatgcccgcgcggtgatcgtgcgcctgaccgacgaaggccgcgcgctcgggcgcgccctcgccgcggccacgtcacaggtgatgtcggctctggcgcggctgacgccgcctgagcaggcggatctcctcctgacccagatcaagctcatccggaccctgcagcaggcaggtgccatccccgtgcagcggatgtgcgtcagctgccgccatttcaggccgaacgcccatccggccgaggcccagccccaccattgcgccttcgtgaacgctgcgatcgggacccgggatctccggctcgattgcagcgagcatgaagcggccgatcccgacgtccaggctgccacctggacgtccttcgcgaatggatcgccgcccctccgagcaccacgagagacctga

SEQ ID NO: 6955 - DNA, 720 bp, Methylobacterium sp.
atgacgaggatcaaggcacggggcgtcggcctcgtggcggcggctctgtgcgcgctctctaccggtgcctcggccgggcccatccgggcgcagccgagtcccgctgtcctggcgtcgttcgacatcgtcgagacgacgatcgcgaccaagggcgacaccgccgtcttcaccacccgggtccggggcgaggcgggcaaggacaagccgaatgccaccggcaagttcgagggctcgagcgtctacgcctacgtctggccgacgaccctcgatagcgacgcgatcggcttcgacaaggctcagggtatcgtggcgctcgccgtcaccttccaccccgatttcgacgacgcggcctacggtgccaggaaccgccatgtctggcacccgcactgggtggtgctcgccaaggacgcggcctgcggcggcggcctgaaggtcgtcgatatcccggacggcgcgaagccgaaggttccgccgacctggccgaaggtcccgctcctgatcgacagcccggactacccgaccaccttccggggcgacacggttcaggtcgagatcccggtctcgctcatcaccggcatcaagggtgcctcgttcgacggggtgacgtccggcctcaaggtgaacggcaacctgcacgcgccgctgctctgcgtcagcgacgtcttcaaggtcgcctcgggcaacctgtcactgccgggcaaggtgacccctcagaagtag

SEQ ID NO: 6956 - DNA, 204 bp, Methylobacterium sp.
atgcgcggaacgccgaccacgatcgtcatcgaccgcgacggacgcgtccgggaacacgccttcgggcaggtcgacgacctcgcgctcgggatcctcgtgggctcgctgatcgcggcaccggtcacgggatcggtgcgcggggagttggtaccggacgggtgcgacgaagccggctgccggctcacggaggaagcgcggccatga

SEQ ID NO: 6957 - DNA, 1623 bp, Methylobacterium sp.
atgtcgagtttcgacgagtcggtcgcgcgccagcagcggttcatgggaccgctcctggtggcggcgatcctgttcggcctggccgggctgccggtcgcggtctggctcgacctgcgcggcctgtccgagcgcatgctcgccacgcaggcgatcgagaccggccggatcatcgaccagatgcgcagcttctacgccagcgacgtcgtccaggcggtcaacgccgcgaccggccgggtcgagacgcgccacgattacaagggggtgccgaacgcgatcccgatccccgcgacgctctccctggaactcggcgagcggatcagcggcggggacggcgcggtgaagtaccgcttcgtctccgatctcccgttcaaggaccgcaagccgcacgatctcgacagcttcgagacccaggccctggcggacctccgggcgcaccccaagaccggcttcgtcagcgagacgacggggtccatcttcgaccggcaggtgcgcatcgcggcgccgatccgcatggaatccgcctgcgtgcgctgccacaacgcccatcccctgagcccgaagaccgactggaaggtcggcgacgtccgcggcatccaggagatcgtcctgcaccagccgatcgccgccaacgtcttcgccttcaagtacctgctcggctacttcatcctggcggcgctcgccggcaccaccttcctgctgctgcaggcgcgccagtcccgcctcatcgaccggatgaacagggagctgaccgagtcgaacgggttcctggcgtcggtctcggtgcagatcgccaagtacatctcgccccaggtctacaaaagcatcttcagcggcgagcgggacgtgtcggtggcgaccgagcgcaagaagctgacgatcttcttctccgacatcaaggacttcaccgcgaccaccgagcgcctgcagcccgaggaactgaccgcgctgctgaacgagtacctgaccgagatgaccgccatcgcggtcaagcacggcggcacggtggacaagtatatcggcgacgcgatgctggtcttcttcggcgacccggagagccggggcgtccgcgaggacgcgcaggcctgcgttcgaatggcgatcgagatgcagaagcgcctgggccagctcaacgcccgctggcggcgatccggcatcgagcgcccgttccaggcccggatcggcatcaacacgggctactgcaacgtcggcaatttcggcagcgacgagcggatggactacacgatcatcggcgcggaggcgaacctcgccgcccgcctgcaggcggccgctgtcccgggcggcatcaccctgagctacgagacctacgcgctggtgagcgacatcgtccaggcgagcccgcaggagccgatccgcatgaagggcatcagccgcgagatcgtcccctacgccatcgagggcgacctcaccgccgaggccccggagacgatcttctccgagcacgcccgggggatcgacttctacgtcgacgtcgacgccctggagatggagggcgcggcgcggctccggaagcgcctgctcgacacgctcgccgccgtcgaccgccggatgaccggggcgggcacccactcggatgacggcacgcggccctccgcggccggctga

SEQ ID NO: 6958 - DNA, 1890 bp, Methylobacterium sp.
gtgacgacgccgctcgaccggcgacggctgaacctgcgctggctctgcgccagctgcctgatcgccacctgcggcgcggccctcatgggggcggcgctccgcatgtccgtcgacaccgatctcgcgccagccaagccgacattccgccaggggcccgcccaggtcgcggaggggcaaggcgtggtcggacagcgcggcgaccgcctcgtgcggcgccaactcgtcgcctcggaccgggaggagttctccgcgccggtgacccaccaggtcggcgagcgcgagattatccggacccagcccttcgtgcgactggtcacgagcctgtcctccggcgacgcggtcgacgggcagatcccacccttcgatccgacgcgccagctcgccgcggacggagaggtcgcccctgtcgcagacgagccggtggacgatccgtccgggaccacggtcacgatcacgcgctccgcgctcgagggcacgccggttcccgacgacgcgcccggcctgagcgacgaggacgtcacggccctcgtggagaggcagtcggatgaggcgcgcgagacggggccgcggatcgccgcgccgctcgcgccgcagcggctgctctcgcagatcctggtcgccgcgccggccgacgccgccgcgaccgccgccggcgccgatacgggccgcgacccgttccacgcgatcgaggtgcgggtcgtcccggagaacatcaccgacctcgccgagacccagcccgcctccggcctgagcctgaccgagacgcgcgacgtcgtgctcaagcgcggcgagactctggccgacgcgctggcggcgaacggcgccgagcccgcgagcgtgaccgccatcctggccgccttcagcgagcatgcccgcaccgggctggccgaggggcagcacgttgaccttctcctcgtccggtcgcgcgccggcgaggccgcgcgccggatcgcccgggtgacgctctacggcgcgggcggcgtcgaggagatcgtcgcggaacgggattccggcggcttcgtcacggtggcgccgccgtcggcccaggtcgcggcgtcgcgttccggcgacgacggcgacggagagggttcgggcgccagcctctacaggagcatcttcgaggcggtcctgcgcaacggcatgcccggcatcctggccgagcgcatcgtcggcatcttcgcgttcggcctggacatgcagcgccggatcgccccgtccgaccggctggaggtgctgttcagcccgagcgagaaggtcggcggcccgccggaggtgcgctacgtcgccgtgacgctcggcggggtgaagcaccgcgcctaccgcttcgaggcgcccgaggccgggacggcgagctacttcagcgagacgggcaactcgctccgcaagttcctgatgcgcatgccgatcgccgacgggcggatcacctcgcccttcggcacgcgcgtccatccgatcctccactacgcccgcttccacaacggcgtcgattgggccaacaaggccggcacgccgatcatggcgacgggcgacgggaccgtggcgtatgcgggcccgcgcggcggctacggcaatcgcgtcgagatccaccacgccaacggctacgtgacggcctacaatcacctgcagcggctcgcgcacggcgttcaggtcggcgcgaccgtccatcaggggcaggtcatcgcctacatgggctcgaccggcctctcgacgggcccccacgtccactacgaggtgagcgtcaacgggcgcttcctcgacccgatgacgatccgcctgcccgacagccagggcgtttcgcccaggctgatgacggctttcgagcggcaggtcgcggccaccaatgcgctccgccaccacggcgccctggcgatgtcggccctgccgctctga

SEQ ID NO: 6959 - DNA, 1212 bp, Methylobacterium sp.
atgaacggtgtcgccccctcgatccgccctgccgcgcgagccggagatccggacgcggcgtttctcgcgaccgtcgcggcgcttcggcccctcatcgcggagcaccggtcggccctcgctgtcggcccggacctgccggagccggtcgcagaggcgctcatcgacgccggtctcgcgcagctctggcttccgcggggcctgggcggtcctgaagcgcatccgctgagcgtcctggcggcgatcgaagctctggcggaactcgacggttcggtcgcctggtgcgccgcgatctcgtccgggggcgcgtcacgcttcgccgacctgatcgacgcggacgtgatgcgttcgctcatccctgccggcaggaagttcgcgggcagcgggagcggccagccgacgggaacagcggttcgccatggatccggctggcggatcaacggacgctggtcctgggcgagcttctgccgctacagttccgtgtccgcattgatgtgtgtggagatcgagggcgagcggccgaagctcgacgagaacgggcggccgtcgctgcgcggcgtcttcatcgcctcgaaggatgtcgaggtcgtcggcaactggaatgccggggggctccgggccagcgggagtcacgacgtcgcgtgcaccgacatctgggtgccgaacgcgcagaccatcgacggcgcgagcctcatgatgcctcgcgacagaaggcccctctacatgctgcccatggcatcggcggccgcgatcgccgccatcggtgttccgctcgggatcgcccgggcctcgatcgacgcgttcatcgatctcgcgcagacgaagacgccgcatggcggcaaggtgcccctgagacttcgcgaggatgtccaggtcgcgatcgcgcgtgccgagacgagcctcgaagccgcgcgcgccttcgcccgggacacggtctccgaattctggtgggaagccgagaacggccgtccgataacgctcgcgtggcaggccaagcttcggcgggcctgctggtacgcgggccatgtcgggaagcaggtggtcacgagcatgtacgaggcggccggcagttccgccgtcctcgaagacctgccgttcgcgcgccagctccgcgatgtctacgcggcctgccagcacatgcattatcaggaccggctgctcgtgccgaccggccgcatccttctgggcctcgaagccgacgcgccgttcatctag

SEQ ID NO: 6960 - DNA, 165 bp, Methylobacterium sp.
atgccagtcgggatcgggatcggacgcggggatcccctgcgtcccgcggtgacgaggaccgcgcgcttctcgggacccgagggcttccatccgggcgccctctggctcgccgcggcgtcgccgctcctggcgaccctcctcctcctcgtccggctcgcggcctga

SEQ ID NO: 6961 - DNA, 96 bp, Methylobacterium sp.
atgctgaaggccttctcctacgcgatgatcggcgccttcctgggcggcctcatgatgaccgtcgtcggctcggccggcgtgctgatgggcctgtga

SEQ ID NO: 6962 - DNA, 219 bp, Methylobacterium sp.
atgcgcctgctctgggacagggttctcgaccgagcgtggctcggcctggcggccgccgcggcggtgacggtcgccgtccacgagggtgcggcggtcggccggcgtgcctggacgctggggtccggcggcgtcgcgcaggccgcgccggcggggaccggccgggccgggccgccggcccgcgccgcggcctgcggtcccgccgcagcgccgccaccgtga

SEQ ID NO: 6963 - DNA, 2331 bp, Methylobacterium sp.
ttgggactgtattccaagctgcgggccgcactcgctgaagatgccctcctcgcgcgcggcgtgaagcgctcgctcgtcgacgggctgtatcagcccttcgcgtcgctcgcggtcggcgccgcgtccgggacgatcgtcgccacggccgcggcgttctggtccgacgatcgcgcgatcacggtgaccgcgttcgcggtcggcctgatcggcctcacccgcatcgtgctcgctcggatctacctgacgaaggggccgcagaagcacgatcgttacgagctctgggagacctacttctccctcggcgcgttcgcctacgccgcgtcgctcggcatcctgtcgttcctcatcacgacgcggtcgtccaacctcgcgctccaggtcatcacccccacgttcacgatcggttacgccgcgggcatctcgggccgcaatgcgggccgccccctgctggccatcgcgcaggtgctcctgtcggcgatgccgctgtcggcgggcctgctcgtgtcgggcgacggcgagcgggcctcgctcggcatcctctcgctcctgttcgcctacggcatgatcgacatcacgctcagcacgcgcgagatcatcgtgtcggccctggtgacgacgcgcgagaaggaggcgctcgccgagaaattccaggcccaggcgaatctcttcgacatcgcgttgcgcaacatgtcgcacggactgtgcatgttcgacgcgcgcggccggctccaggtctggaacgaccagttcctctcgatatcgggcattccctcgaaccgcatccacaccaattcgacggccaaatcgctgtacgcattgagccgcgccatcatcgatgagcggaccgcggggcgcggcgcgacgctctcgacattctcggcggcgtcgaacgcgttgaggtcgggaaacctggtcctgatcctccccgacgatcgcgtggtctccctgatgcagcggcggaccgccgagaagggctacgtgatcatcttcgaggacatcaccgagcggcgtcggagcgaagcccgcatccagcagatggcgcgttacgacgatctgacgggcctgctcaatcgcagcagcttcaaggccaaggtctcccaggcgctgaaagccagcgccagcagcaagggcgatttcgcggtccatctgctcgatctcgaccacttcaaggtcatcaacgacacgctggggcatccggccggagacagattgttgcagatggtggcggaccggctgcgcgggatcggggcgctgtccggatcggtcgcccgcctcggcggcgacgagttcgtcatcgtccagcaatccgtcacgtcgccggccgtcgcggaggatctcgcgcagcgcgtcctgcacgagctggagcgacctttcgatatcgacggcactcacgtcacggtcggcgcctcgatcggcatcgcgatcgccccgttccatgccaacgacgaggacaggctgctgaaatgcgccgatatcgccctctacgccatcaagggggccggcaggagcgggttcaagatcttccagcacgagatggaagcggccacgcgcgcgcggcacgccctcgagtccgatctccgggccgccctgaccaacggcgaactggagctgcactatcagccgatcgtcgacgcgagcaccggggcgatcgtgagctgcgaggccctgcttcggtggcagcaccccgtctccggctacatcccgccgtcggacttcatcccggtggccgaggacacggggctcatcgtccagctgggcgactgggttctgaacgaagcgtgccgcgaggcccggaactggccgtcgaccgtgagcgtcgcggtcaacatgtcgccgcgtcagttcggtgatccgcagctggccttccacgtcatcggcgcgctgaaccgctccggcctcccggcgcatcgcctggagctcgagatcacggagagcgtgacgctgggcgcgacgcacaagatcgtcgagaccatccacacgctccgccagctcgggatccgcctgtcgatcgacgatttcggaaccggttactcgtccctgagctccctgagaaacttcgccttcgacaagctgaagatcgaccggtcgttcgtgtgggacctggacaggaaggccgagtcgaccgcgatcatccgggcgatcgtcgggatgggtaggagcatcgggatggccatcgtcgtcgagggcgtcgagacggagacgcagctctccatcctccgggccgagggctgcgatctgatccagggctacgtgttcagtcgtccggtcgccgcatcccagatccgggccatgctcgcggccgcggagcccgtgacgaagctagcgagctga

SEQ ID NO: 6964 - DNA, 90 bp, Methylobacterium sp.
ttgcgcggcatcgcccgccggcggccggacggagcggaagaggagagctggccgttcgtcgacaaggcggacccctacagcgtggtttaa

SEQ ID NO: 6965 - DNA, 189 bp, Methylobacterium sp.
atgatcgggatcttccagccgttcggcgtactccatgtgtggacgtcgatcggccgcccggacaccgctgccatgctctgcctgctcctggacccgatcgtcggcggcgcggtggtcctccgccgtttccgaattgccccggcagtgaagacgatttcccggccgcgctcaagggcaccgcgcccgtag

SEQ ID NO: 6966 - DNA, 825 bp, Methylobacterium sp.
atggccggtatcggtgtcgcgcgcgcccgcgtcgaccgacggacttggtccgttcacggagcggccaaacgcaactcggccatcatccaggccggtctcgcccggatcgtcgaggacgagatcctgccgcgtctggcgctcgcgcatcgggcggatccgccgtcgcccgcgtcgacgacgcgatcaccgacgcctgagcgcgtcgcctctctcgctcaagcgctgatggagggcgaaccgcacgccgagtgggtgcgcgcgctcctggaagagggcttgtcgctggatgccctgctgctcgacctgttcgcacccgcggcgcggtatctgggcgagctctgggaagacgatgccgccgacttcctcgacgtggcgctcgcgctcggtcgcctccagaacctgacccgcgccctgtgtgcggatctggagggcgtggacgtgacggcgaacggtcgccgcgtcctgctgatgccctgtcccggtgagacccatctcttcagcctcgcgctcgtggcgagcttcttccgcgaggcggggtgggacgtggtcctgaccaacggagcggacgaggaccccgccagcttggtccgcgccgaacagttcgatctggtcggcatctcgctgtcctgcgacatcctcctgccggtgatggcggtgtccgtggcgaaactgcgcgccgcgtcgtgcaacccggacctgcgcgtcatcgtcggcgggccgctcttcgtgcgggagcctgccagcgcccgtgtcgtcggcgcggacgccgtcgccgcggacgcgcaatcggccgtccggatcgcggaggccaccctcgcgcgatga

SEQ ID NO: 6967 - DNA, 237 bp, Methylobacterium sp.
gtggaggtccagacgttgccggacttcgacgagcatctcgcgcgtgagttcgtccagggcctcgtgcaatcagccattgtccgcgggctcgatccagcagttcgactccagcagttccgcaccctgcaacaggcggctatggtgatgatgccggacccggccgcagtccggacttccaagcagatcgtcgatgcgatcgatctcatcttggaggaactgactgcggcgaagtcatag

SEQ ID NO: 6968 - DNA, 690 bp, Methylobacterium sp.
atgcccgaccgatccctccgcgccgtctggtccgacagcctcatggccgaggtcggcgcccgccttcccctcttcgacgacctgtccccggacacgatccggcgtctgtcggccgagggcttcgggcgcggcctgctgacggcgtccctgcgcgcccgcctgcggaaggccggcttcccggatctcggtcatctggcccagtcttcaccggtcgcgatcgccacgatcaggaagttcggtcccatccgcgtcgagcgcgtccggcacttcatcctcgacgtgctggcgcgctggcttccgggcgcgcgggagatgcacacacccgaggccacgcgggcgcggcggctcggccggctgcgcgggctgccggccggatgcctgcccctcgcggcggatcagatcgcggcgctccgcttcgcggacgcatcctgtgcggacatcgccacgtgttcgcgtctcgggctcctccggacaggcgccgtgacatccggtgacgtggaccacgtcgtcgccacgctcacccgcctcgctcgggcgcccgatccggttcctccgcgtcccctggaggaggcccgggcggcaccgtcgtgcgacgccgcgagcgcggcggcccgtcgcgccgccctgctggcggggcaggatcgcgaatgggacgaggccgcaccgatcgcgcgccggcctcaaacctga

SEQ ID NO: 6969 - DNA, 210 bp, Methylobacterium sp.
atgcgaaagctgaccaggttggtcgtccgtatggcgcagcgacccggcctcctcgagagcgggcggctgatcgatcagctcacggatctggaaaccgagggcctggcccggaatatttcgtggcgctccatcgagacgatcagggccactcgattgaagctgcgcgtcgagggcctgatgccgacgtcgtctctgccgctcgctccctga

SEQ ID NO: 6970 - DNA, 315 bp, Methylobacterium sp.
atgcgcgacatgtccgacatgcccgagcggatccccgcgatgatccgggtccgggacgcggcgcgctccgcgcgtttctaccggaccaccttccgcctcgacaccgccgaccggcccggcttcgaaaccttcaccccgatcgatctcgcgcatgccgcgtccggtctcgcgtcggcgctgacggtcaacacgggccacgacggcgcctgcggcctgggcgtgggggccgcccgggtcacggcgcgctcctgcttcatcgacgacccggacgagcacaagatcgaggtgctcgcccgcggttggcgcttcgcctga

SEQ ID NO: 6971 - DNA, 786 bp, Methylobacterium sp.
atggatcttcagctcacgggacgaagcgccctggtcaccggctcgaccgccgggatcggtctcgctgtggccaaacggctggccgcggagggcgcggaggtcatcatcgcggggcgccagcaggccaagctcgatgcggccgcggccgcggtcgccgccgcgggccgcgcgcgcgcgatcctggccgatcccgccacggccgagggcgctgccgcgctcgtgcgcgcggcccccgcggtcgacatcctcgtcaacaatctcgggatctacgaggccaaggccttcccggacatcgccgacgacgactggcaccgcctgttcgcggtcaacgtcgtgtcgggggcccggctcgcgcaggcctatctcccggggatgcaggcgcgcggctgggggcgcgtcctgttcgtctcgagcgagtccgggatcgtgccgccgcccgacatgatccactacgccgtgaccaaatcggcccagctgacgatcgcccgcggactcgcccagctcaccaagggcagcggcgtcaccgtgaacacggtgctgcccgggcccacgcgctccgacgggatcggcgatttcctgaagagtgtcgcctccgatcccgacctgtcgcccgaggcgatggaggcggagttcttccggctccatcggccgctgtcgctgatccagcgcctgatcgagccggacgaggtcgccgccatgatcgcctacctggcgagtcccctcgccgccgcgaccaacggcgccgcgctccgggtcgagggcgggatcgttccgaccatcgcctga

SEQ ID NO: 6972 - DNA, 222 bp, Methylobacterium sp.
atgccccgctggctccaattcgccctcggcctcgtcacgctgatcgcgctcgccgcgggcatcgtgcgtacgctcgtgcgtcacatgccgggcgcggtcgcatcgtggctcgggccgtgggcttacgaggcgttgatcctgctgctggccgtcagcgtcgtggcgatcatcgtgcgggccgcccagggctatcgctctcctcgatctgataaggtgcggtaa

SEQ ID NO: 6973 - DNA, 387 bp, Methylobacterium sp.
atgctccgccggctcgcgatcctcctccctttgctcgtctccacggtcgcgcacgctgcgggccccggagccagggcggtgggcaccttcgagcaccaggaggacggctacgagcagggcgtcgaggtgaaggccgcgggcgcagccggcttcacggcccagttctcaacgggaaccaagggctgcggcggtgaggtgacgatgaaagggcggccgaccggacccgacacggtcgtcttcagcaaaaccaacggtgggcaaacctgccggatcaccgcccgctacgcttcggatttccggtccgtcgtcctggaagaacagggctgcacgatgtggcacggcgcctcgtgtgagttccaagggacgttgaagcgaacgggacgctag

SEQ ID NO: 6974 - DNA, 261 bp, Methylobacterium sp.
atgtgcatgattctgtgtcgcttttcgatggagttcctgtctgccttccgcccgaccaccccgagacacggtctccacaacgccgcgcagatgctccgggaggtggtggccataaacctgctccacgtcctgctcgttggtgccgagtgctcgagcaaccttgccgaacggcacgcccgccctcatgccccccgtcgcgaaggtgtggcgcagtgcgcgcggcagttcagccaggtcgagttggcgcccgacaatgcctga

SEQ ID NO: 6975 - DNA, 963 bp, Methylobacterium sp.
atgccagtcacgattccggatcgcctggggctcggcgtcgccgatgccgggaacggcctctccgcccgcgcggccgaggcacggtcgcggctcgtccgctggatcgtgggtaatcgcgcgcaggcgcgcgtcccgacgcggatcctgaccgacgacgagatcgccgcgttccggcgcaacgggttcgtcaccgtcccggcgatcactaccgccgaggagctcgacaccctgcgcggcgcctatgaccgtctgttcgaggaggcgcgcggctggaaggacgggagcctgttcgacctcgtcgacgtcgaccgcggcgccagcgaggcgcgctcgccccagctactcaacccgtcccgcttcgagccgctcctccgggacatcctgttccgggccaacgcccaggccatgtcgcgccagctcctggggaaccgcgcggccctcgtcttcgagcacgcgatccgcaagccgccgaagatcggcgccgccaccgcgtggcaccaggacgaggcgttctacgccgcctacacgaattaccgggcgatcacggtctggatgcccctgcaggacgtctcgccggagaacggctgcatgctctacgtcccgggcagccaccgtgagccgctcctcccccatcgcagcatcggcggcgacccgcggatccacgggctcgaggccctcggcgttccggtggagcgcgcggtcccgtgtccgctcccggcgggcggcgccaccttccacgattgccggaccctgcactgcgccgggccgaatctcagcgccggaccgcggcgcgcctacgccctcggcttcggggtccgcgcgccggagcacacgctccgccacgagcatccctggaacgccgagaagcgcacgctgcggcaggagcgcgagcggcaggcccgcggcgggctggcccggttgaaggcgggcgccaaacagcagatcaaggcgctcatccgctga

SEQ ID NO: 6976 - DNA, 315 bp, Methylobacterium sp.
atgtcaatcatcgattcgggggcgcacatgcagcacgtgtccgcagacaacgacagggtggcgcggtggtgcgcggcgcatcccgtccttctcgccttcggcctgtgcgcgttcggcctcgccgtcgtcgccgcggtctggggattcgggatcctcacaccggccacggccacggtcatcgccttcatctatgtggcctgcctgggcggcttcctcatggagtacctcgggatcaatgaactcatcagaggtgtgagattcctctggttcgttctgacgggcgtctggtggctgttgaccttctggcgggcgtga

SEQ ID NO: 6977 - DNA, 240 bp, Methylobacterium sp.
ggcggcgtcgagtacgccctgcccaccgactcgttcctgaacttcttccgctcctcggccgtcacgctgaaggtcgaaggcctctacgtcagcctcgaccgccagaagaactccgccggcggcgtgttctacggcaacctcctgcccccgaacggcaccgcctacctcaacggcgccgccgccaagaccgagttcgccgtcgtccgcgccggcctgaactacaagttcggctcctactga

SEQ ID NO: 6978 - DNA, 336 bp, Methylobacterium sp.
atggttcatcgccgtcagagacgaggcatcggccggaccgcgtccgatccgacgttcgacgcgaagggtcccctgatcgtgcggtggatcggtgccgcggcccgcaagcgcggccgggcggccgaccgggaagctccgcccgctccgaccccggacaacgtgacgaggctgtcctgggccgacaccttcggacgggcgatcagcgccgatcctcagcggccggagggacccgcgaccgtcctcgcgatgcgtccccgcgcgagcaggcgcgcgtgcgggccgttcgtccgcacgagacaggcggtgagcgccgcgatcccgacctcgctgccgtag

SEQ ID NO: 6979 - DNA, 120 bp, Methylobacterium sp.
atgcgctatcggcacagcagcatcaacgcgttgccgatcgcggaatcggaccgcgagtttcactggcccctcgggcgccggccggacgaccatccggacctgagccaattcgtcttctga

SEQ ID NO: 6980 - DNA, 318 bp, Methylobacterium sp.
atgttcaccaagaccgcacggacccgtttggccgccgccctggccttcggcggactcgccttcgcggcgccggccatggccgcgcccctcggccgcgatgccggcctgcaggcggaagccggcgacgtccagaccgtccagtacggctacggctacgggcaccgccacggcggctggggtcaccgcggctacggcccgcgccatcaccaccacggctggggccggggccaccatcacggctgggggcaccgcggcttcggcccgcgtcaccatcaccacggcggctggggccatcgccacggctacggccgctggtaa

SEQ ID NO: 6981 - DNA, 207 bp, Methylobacterium sp.
atgtcgacctccgccaacccgcccgacccgtgcgccgagacggccgcgctccgcaaggacaagctgcgcgcgcacatcaggagcgtgctgtcgacgatccggtcccatcatatgggccgcggggcgccgtcgatccgggccacgggctacgtccttggagggtggttctgcggctcggccgcggcaacgatcccgctttttacgtag

SEQ ID NO: 6982 - DNA, 213 bp, Methylobacterium sp.
atgaaacacggcgcgcgcaacgacatccccgccacggtgacggcgatcaagcgcggggacgtgatggcccaggtcgaggtggagctggtcggcaccgcctaccgcatggcctcggtcatgacggtcgactcgctggaggagctgggcctccgagagggcgacaccgtccacgtgctcgccaaggcggtgaacgtgctgctggtgaagccgtag

SEQ ID NO: 6983 - DNA, 177 bp, Methylobacterium sp.
gtgaaggtgttccggatcatgcaggcggcgacgggcgcgattctctggagcggtgcggcgctcgatccgatggccgccctcgacgcgatggcgcgcgccgccggcttccgcgaccgcacgcggatcccgaaccatctgcgggccggcggcctccacgtcgaggaactgcaggcctga

SEQ ID NO: 6984 - DNA, 324 bp, Methylobacterium sp.
atggatgagaacggactcgaattcctgcggacgattgctgaccggaaggtggaatcctccgccgcgcgcgcgctgaacaggattgcgcagtccctcgatttgccgatcgaggcgttctacggtttcgatcaatgcggatctgtggaccgtccggccatcgagcgggagacggagcggctgctgatgctggtcggggcccacctgcgccgactcgatcccgcggcgcggaggcgattcggtgaggcggtcctcgctctggtcggccccgaaccgaccgacgcatgcgcgcgcaccgcggagaatgcggagcgcggcgacccgtga

SEQ ID NO: 6985 - DNA, 318 bp, Methylobacterium sp.
atgctttggtcctgcctgatcctcattgccgaacagacgttcgtgcccgtgcagtgggagcgcgcccccgttcgaagggaggcagttctcgaagggctcatgctcggtgccgtcgccgccaccgttggcaccggggctctcgtgttctcgatgggagcgatcgagatcagcggcataacccactgcgtggactggcagcgaaggcacgacttggtgcggctggacgatgggccgctaccgccccttgcccctgtgtgccagggccctcagctgctcaagcaccatgctgccggccccgatcgaaccgacaggatgtag

SEQ ID NO: 6986 - DNA, 342 bp, Methylobacterium sp.
atggcaccggacatctcccgatatcgccggctgccgggggaggagcctcgctacgtcctggcggaggcgcggacgctgatcgcggagcgtgcctacctgttcagcctctacgcggtcgacgtggtcgcctccgacgggctgaccggccgacacgttctcgccgtgccggtcgcgatcagcgcggtctcgatcacggtgggcctcgtcctgaccgaagcggattcccgcagggccgaggcgggcgatctcgcgggcgtcgcgtccctcgcccaggccgtgcagggcggataccggcgcttccgaaccttcccggcgaacgagctcgggcgtttcgtgctctga

SEQ ID NO: 6987 - DNA, 270 bp, Methylobacterium sp.
gtgctgaggaaattcctgctcgcggccctgctggcgctgggcttcgcggccgcggcgccggagggcgcgtccgccgcgcccatcggcccggggctggctctgcccgccgaagccgcgccggcggtggccgagaaggcccagtactactaccgtcgccggttctacggcccgcggccctactggcgccgcccgtactacggccgccggttctactacggcccgcggccctactaccgtcgtccctactggcgccgtcggttctactactga

SEQ ID NO: 6988 - DNA, 153 bp, Methylobacterium sp.
ttgctcggattcggacagcgcctcgaagagggcacgggcatcccgggcccgggtcccgacgaggccatccggccagaccgcgacgagatgctcgaatcgtacggcgaccggatcgagctggccgccggcggctggtcttccgccggtccgtga

SEQ ID NO: 6989 - DNA, 939 bp, Methylobacterium sp.
atgccgccggggcgcggggacgggaccgccgccttcgaggcccaccgtccccggctcctgcgcatcgcctaccgcatgctcggctcgcgcagcgaggccgaggacgtcgtgcaggacgcgtggctgcgctgggtcgcggcggaccggagcggggtcgcggcgcccgaccggttcctcgcgcgcgtcgtgacgcgcctctgcctcgaccagatcaagtcggcgcgcgcgcgcagggagagctatgtcggcccctggctgccggaaccgctgatcgagccgctggtcgagccgggggcggacggcgtggacgaggacgacctcacgctgacgctgatgctcgcgctcgagcggctgtctcccttggaacgcgcggccttcctgctccacgacgtgttcggcctgccgctcggcgacgtcgcggagacgctcgggcgaacggcgccggccgtgcgccagctcgcggcgcgcgcgcgccggaacgtccgggccgcgcgcccgcgctttcccgtgacccgcgacgagggcgagcgcgtcgcccgggcgttcttcgaggcctccgcgagcggcgatgtcgcggggctgcggacgctgctcgccgaccgcgtgacgctctcttcggacgggggcggcagggtgctcgccttcgtcaacccgatccgggggctcgagcgcctgctccggctctacgcgggcgcgcggcgcaagtggggcgacggccgggcggcgctggtcgggttcgtgtggatcgacgggcttccgggctatgtcacccgcgagcgcggcggcctcctgcagacgacggccctcgcgatcgagaacggccgggtcgacgccatctacatcacgcgcaatcccgacaagctccaccacgtcgcgcgcgccgtcgcggccggcccgggacccggcgacgcggccgggcctgcggcgcgccggtcttga

SEQ ID NO: 6990 - DNA, 768 bp, Methylobacterium sp.
atgcatcctgccgtggccgccgccaacgccttcagggcggttcatgacgccggtcaggtcccggactacgagcgcatcctgcggcagggctacagccgcttcctcgctccgggggatgtcgtcgtcgacgtcggcgcccataccgggctccacctcgtcgcgttcgtcgacatcgtcggcccgaccggcaaggtccacgccttcgagccgatcccgttcctgatgaaggatctggtggggcgtttcggccgacgacccgaggtcgagctgcacgacgtcgccctctccgacgcggcggggcgcaccgatttcacggtcgcgagcgtgcccggcgagagcgggctcctcgcccgctacttcagcagtcccgccatcacgtccaagaccatcaaggtcaggacggagaggctcgataccgccctcagtcacgtccccgcggtggcctacatcaagatggacatcgagggcggggagttgaacgccctgagcggcgcggcccagctcctccggcgatgccgcccgatcgtcagcgtggagtacggctgggccggctactccgcctacgggcacgcgcaggattcactctaccggttcgccgagagccacggctacatctgcgcggacatcaccggaaacctgatcgacgatgcgagcacgtggctcgcggtcagcgactacgtgacgtgggatttcttcctcgtcccgcaggagcgtcgagccgactgggccgccctgttcgcgcgccgcccggagcccggacccgcgtga

SEQ ID NO: 6991 - DNA, 333 bp, Methylobacterium sp.
gtggcgctcctcgccctctacgcactggcgctccagggcgtcctcggcggcctggcctccgccgccgcggggccggaccacgttctctgcctcgccgacggcggcccgaccgatccggcaccggccggcaaacagctgccggcccctcaccgcggggattgctgcgtcgcctgccacgcggccgggcccgccaccctgcccgcgccgtcgaccgtcgccgccgtgccggtggcccgacccgccgcggccgccgccgcccggccgcggcgcgtcgccctcccgcgggcgcccccgcgtcccggcctcggagcccgcgccccgcccgtcgtctga

SEQ ID NO: 6992 - DNA, 255 bp, Methylobacterium sp.
atggaggttccgatggacaggaagcaggccctcgaactcgcgatcttcgtcatcgcgctcgtccccttcctccgctgcctcatgccctccgcgacgcgctcccgggggccccgccgctccggctccctcagctacgattcgggctccggcggcgacggcggcgcgatcttcggcgatggcggctgccacggcagcgacggcggcagctgcggcgacggcggcggcggcggtgatggcggtggcggcggcgattga

SEQ ID NO: 6993 - DNA, 1338 bp, Methylobacterium sp.
gtggagttccgcttcgaccgcaaggaaccgggtgtctggatctccgccggcacccacgtcgcgctcctcgcgctggcgctggtcagcgtcgcggccccggccctgccggaggcccaggagggcgtgcccgtcgaggtgatcaccgagaaccagttctccgagatcacaaagggcgagcgtcaggccgacaagccgatgccgaacgccacgtcgcgggcggaccgcaaggccgagaagctcgaggaccgcgagcccgagaattccaagcaggacgcgccgaccgcgccgacccgcacggccgagatgaagctcgccaacgcggacgagatgccgctgcgcgccgagcccgatccgcaggaggcggcccaggccgccaaggcggcggagaaggcggcgcaggagaagcgcgacgccgagaaggctgccgccaaggcggccgagaaggcggccgagaaggccaccgcggagaaggctgccgccgccaaggccgaggcgaaggccaaggccgaggcggtcgcgaaggccgaggccgagaagcgcgagcagctcgagaagctgatcgagaagcaggaagccgaggccgcggcggccgcccagaaggccgccgcgaagaaggccgaagccgccaaggaggcggccaaggaagcggccaagaaggccgccgacgcgaaggccaaggccgaggccgaagccgagcgtcagaaggagatcgcggaggccaaggccgaagccgagcgcgagaaggcggaggccgccgccaaggcgaaagccgaggccgcgaaggccgaggcggccgccaaagccgaggccgccgccaaggcgaaggcgaaggccatggcggacgcgaaggccaaggccgatgccgaggccaaggcgcgcaagcaggccgaactcgccgacaagttcaacgccggcgacatccgctcggtgctcgcctcgaaggcgccgtctcagtcgaccggcgccaccggccacgcggtgcagaaggtggcggcgctcggcgccgcgaccggcaacgcgcagcgcctgtcgccgtcgctgcgcgacgccctggtcggcctgctccagcagcagatcgagcggtgctactcggcgccccccggcgcggcccagggcgtggtcctgccggttctcgacatccgcctgaacccgaacggctcgctcagcacggagccgcggatcatgcgcggcggggcgagcgcggtcgaccagtcgatcgcgcaggccgcgctccgggcggtccgccgctgcgcgccgtacaacattccggccacctatgcgccgtactacaacgactggaaggccatcaacgcggagttcgagttcacggcgacctga

SEQ ID NO: 6994 - DNA, 183 bp, Methylobacterium sp.
atgacaattctgatggccgtcgctctggcgattgcgttgctcggcatcgcgctgacgtcggcagcctaccggtttgcaccggtgtcgaagcacatagcgagcggggatatcgtcctcgtctgtgggatcagcactgcggcgttgggaagcctcggagtcctcctgcagatcttcaccgtctga

SEQ ID NO: 6995 - DNA, 87 bp, Methylobacterium sp.; identical to SEQ ID NO: 5950

SEQ ID NO: 6996 - DNA, 318 bp, Methylobacterium sp.
atggcatacgactgcgcgatgaggacagggatgcgcgtgcgcggcgtcgacaaccgagagcttaggcaatggttctacgacagccgaccaatggtcttcggcttctgcttgacggcgttcgtcgcgatcttctggcaggtcagccggttcgagggctttcagccgatcttctcctgcgcccgcacgacggacgtggaccgtcaattgctgcgcctgggaatggatgcctgcatgggcaacgcgcgcacccagtcggatcgcgagggatgcatgcggaccgtccatctgctcgcttgcatgaaggagcgctggcgctga

SEQ ID NO: 6997 - DNA, 198 bp, Methylobacterium sp.
atgcatttcaggatccaagccaccggacagcatctctggacctgggtgctcctcgacgagaccgagatgacggtggccgaatccgaccggtcgtttccctcccggacgcaggcctcggcggcggctctggccttcgcgaagctggtcgcgcgcgccagccgctcgctgaacgggggcgcgtcgagcggcctgctgtag

SEQ ID NO: 6998 - DNA, 87 bp, Methylobacterium sp.
atgggcatccatatgaaccttcgggatgcgctcgcggcctaccttgacgttggcacccagcatatcgtggtccttctgaagcaatga

SEQ ID NO: 6999 - DNA, 306 bp, Methylobacterium sp.
atgggatcgaagtcacctgtccggagcggatcctccggggctgcggcgcccgaggacgacctgttcgagcgcaccgcaccgccgcacgcgccgggtgccgggcggctgctgcagcggatcgccgacgcgctgcaggttccggccacctccctgtacggcccactgagcgcggagcggggcgccggcgtcgcgggcgggcgtgccgacgaggccgacgccctgctgcatgcctaccggcgcatcgacgatcccgagatccgccgccgcgtcctgaccctcgtgcaggatctggcggccgcacgctga

SEQ ID NO: 7000 - DNA, 609 bp, Methylobacterium sp.
atgcccaagaccaacgcgtccgtcggtcagacctgtcccgaagccttccagatcgcgctcgattccgccgacatgatcgggcactgggcgtgggaccctgcgacggaccgggtgcgggtcgacgccctggtggccctcctgttcaaggtcgatccgaccgcggcggaatccggcatcccgctggccgtctacgaggaggccatccacgtcgacgaccgcgaccgggtcgacaccctgatccgccgcagcgtcgcggcggggagttcctacgtcgccgagtaccgggtgatctccgtcgacggccggatgcgctgggtcctggcgcgcggccgcttcaccagcgaccgtcgcggccggccgacgggcgggcgcgggatcctcgtggacatcacggcgctgcgcgcgcgcgaggcgatcggcggcgcgaccgcgcccgacctcggcgacatgcccctggaccgggcggtcgagcacgccctcgccgcgcaggacgccgtcgcggcgctgggcgatccggccctgaaggccgaggcggacgcgctgctgatggcgctggggcgacggctggcccggcggcaggtcgcggaacggcgccgccgcctgaactga

SEQ ID NO: 7001 - DNA, 477 bp, Methylobacterium sp.
atgccgaccgtgcaggatattgaccgactagtgcgggggaccgcggaacacggggacgtgatctccgccccgggtgcgacatcatgtacgagtcggcgcgagaattttccagaagttgcagaacttgaggaaaattcgcgtctaagacgcctgctcgaccgcctgtcggaggccgcggacgccgcggaggccgaggggcaggtcccggtcggcttcggggcggcgctggtcgacgccgtgccggacctgcgccgccgcgcgctgatgctgacccgcgacgccatcgcgggcgatgtccagggggacgacctcgtccggctcaccctcctgaaggcctgggagcgccgggcggcgttccggcctggaaccgggatgcccgcatggctcgacacgttcctgcgcagccgccccgcgggcggccgcgccgggccgaccggcctgtcgcggaacggcgtgtctgccgggatggcccgctga

SEQ ID NO: 7002 - DNA, 168 bp, Methylobacterium sp.
atgctcatccccgccccgaccatccgccgtctcctcatgctggggctcgtgctcgtcgccctcgtcgcgctcgcggacggcgtggcccgccacgagttgcgcacggccgcgcgcgcgatgaccctcgccgacgcggccccgcagacggagcgcgcgtcggatgagtag

SEQ ID NO: 7003 - DNA, 84 bp, Methylobacterium sp.; identical to SEQ ID NO: 5958

SEQ ID NO: 7004 - DNA, 231 bp, Methylobacterium sp.; identical to SEQ ID NO: 5959

SEQ ID NO: 7005 - DNA, 81 bp, Methylobacterium sp.
atgacgatcctggatccgatcaccggcgagctggtcaccatcgccgttccgcggccgcggccgcaggccggcccgcgctga

SEQ ID NO: 7006 - DNA, 114 bp, Methylobacterium sp.
atggccccggggacgatgatgcggggcgacgccccggccaatgtgggcgtgacggtccaggggcacgacgccctggagcgcggccggcccggcccgttccgccccctgccgtga

SEQ ID NO: 7007 - DNA, 216 bp, Methylobacterium sp.
atgcaggctggcgccgcagcacgcacacgcctgggaacgacgcgggacgattgtatcgggatcatcgctcagcacccggctgtgaccctcgtgagggggcttgccccgctgggcttggagtgcgcgcgctgctccttgcgatccgtcacgggcggcttggatgaggtgcgcgaggtcttgtccggttgctgcagccacagcaccaccttatcctga

SEQ ID NO: 7008 - DNA, 735 bp, Methylobacterium sp.
ttgaacttccgtctcgtcggcgcgtccacctttcagcagcacggccgcgaggcggtgcaggggacgggagacctcaccgtcatcgaccatcacccgggcgtgctggacgcgcgcacggatggccagaccctggtcatggccctgccgcgggagcgcctcgagagcctgctcggaccggcccggctgttcgcggccctgacgatgcccgccggatcggccacgacccgcctggtgacgaccttcttcggggatctgctccgggtgaaccggcaactctcccccgaggcggcggagcgcatggcgaccatcggcgtggatctgatcgtggccgcgctcgcggatcggatggcccgggaggtgccgcatgccctgcacggcagcgtcgtggtccagcgcgccaaggcccatgtcgaggcgaatctcggcgaccagaccctcgatccgccccggctcgccgccgcgatgggcgtgtccctgcgccggctccaggaactgttccacgagcgcggccagcacatctccgactggatctgggagcgccgcctcgcggcggcggccaggcgcctctccgatccggtcagcctgcaccgcccgatcggcgtcgtggcctacgagtgcggcttcgcgacccaggcccatttcgcccggcgcttcaaggaccgccacggcctgtcgccccgcgcctacagggaagccgcgatcttgcgcctgtccggcagccggccggatccgtga

SEQ ID NO: 7009 - DNA, 414 bp, Methylobacterium sp.
atggcgcaggagatgcgctggcagaagcgggaaggggacggtcgcgtccatcttgcctacgagattccggacagcggcgcgcagagcctcgcgctcacctgcgacacgcggggcggacagctgagtgtcgactactacgacgacagagaccgcgctcgggacggcacccgggccgaggtcgagttcgcctcggagggcggcacgctctcgctgccgatgcgggcgaaacagctggaactcgacgaccagatcgtgctccagaccacgacaacgttgacgcaagactgggtgcggatcctgtccggcaagacccttcgcgtgacgctctctggcgacacgcagcggattcctctggccggcgcccggaccggtctcgctgccctggtcgcgggctgcagccgcccttcgcgatga

SEQ ID NO: 7010 - DNA, 765 bp, Methylobacterium sp.
atggcacgacgcgttacgacgggaggggccggcggcaccgggatcctcgtcggcctcctggggctctgcctcgcgggaccggcgctcgcgggatccacgagcgtgaccgcgcggcccggggagcgggtccgcctcgacggctacgccacccacgagacccgaccgggctgcccgtccgttccggcggccgcgatcgagctggtcacgcccccgcgcggcggccgcatcgagcagcggcgcgagttcctggtcctcggccagaacatcgacggcaccccgtcgcgggacggctgccaggacgtcgagcgggacgcgcggacgctctactacacggcccggcccgacttcgccggccacgacacggtgtcggtgatcgtcacgttcgtcaccggcgaggaggccacctacacctacaggatcacggtgcccgagggcgagggccggcgggcgccggcggtgtcccaggcacccgccccccgcgacgcgggcctcgcgcggccggccccggcggcgcgcgccgctcccgccgagcgggcgactccggccgcgactccggctgcgactccggctccggcgccccgggaggcgagcaccggcgacttcctgcgcgacgcggtccggggcgcggtcccggccacccggccggcgccggccgcgccacccccgaaggccgccgaggccgcggcgcccgtgtccggcacgcccgcgccgccgccgcagcagcagctggcaccgccgcgcccgcccgccgcgccgcagctctga

SEQ ID NO: 7011 - DNA, 201 bp, Methylobacterium sp.
ttgtcagatctgtccgcggtcggcgacggcggcgcgccgttgcccggatcccgggcggcgacgcggcagggcgactgcacgatgaagcgacagcgggagaccggggccggcacggcgcgattcagggcggacgccgcgggatcggccccggcggagcgggtgcccagcctcggtctcggcgtcgcagccggccgggcctga

SEQ ID NO: 7012 - DNA, 435 bp, Methylobacterium sp.
atggcccaggctgcgttgtccctcgccgcgttccagaccgcgtatccgagcgcggaatcccggcgaccggcgcccccgcgccccagctacgtcgagaccgcctacgacccggtcgtccgcacccgggcgccctacccgagcgccatgcggcgcgcccgtcgccgcgcccggctgacgacgctcatcgctctcaccggcgtgagcctcgccggctgggccgtgttcagccacccgcaggggccggcccgccccgaggcggagtccgtcgcggcggccgggccggccgccgtcccggtcccgcaggccgcggcggcgccgcggccgagcctcgcctggatgctcgaccggagcccggcgctgggcgccggcaccgccacggccttcgggggcgaaaccccgccggtcgccggcttccaggtcgccgccgccccgtcc

SEQ ID NO: 7013 - DNA, 93 bp, Methylobacterium sp.
atgaagaagcttctcctcgcatccaccgtcctcgccggcatgaccgccgcggcgtccgccgccgaccttccgcgccgcgccgcgccgccgccg

SEQ ID NO: 7014 - DNA, 267 bp, Methylobacterium sp.
atggcacacgacgacagcttcaccctcgatcaggcgatcacggcgcaaaaggcgctgcgctcatccctcggcatgaaggaagaggtgttcgaagcgcccgagttcgtaggcatgatcagcgacgagatcgagcagcaccgcaaggcaggtaagaccgaccaggagattgcggcgatcatcaaccaggcgaccggcaagggcatcacagccgaggcgattgcggagcattatgcaagcccggaacagcgccacccgcacggcggatag

SEQ ID NO: 7015 - DNA, 192 bp, Methylobacterium sp.
gtggcgcagcgtatcggcgtgagcgcaacgacgctgaagcgttccgtcatcgagggaaacgccagggtcttgatcgtccccggaagctgggcggacgcgaggggcgcgcgcgtcactgttcatcactacgacggtgggtggcagggcacgttcgatcagagcggacagctcgtggctgagcatgtctggtaa

SEQ ID NO: 7016 - DNA, 987 bp, Methylobacterium sp.
gtgaagacaccccagaagaccgccaagcccgccactgacctcgtggcgctcgcccgtaccggcaccgatctcgatgccctggacgccgcgctcgccaaggcccgcagccagatcgaagtcgccacccgggaccgggacgccgccgaggccagctaccgggagcagatactcgacgcctcgcccgccgagctggagcagatccaggcggccaaggcccgggccgtcgtcgacctcgaccgcgccgaagctctgaccgcggcgctcacccgccgcatcgctagcgtccggaacgatcgggagcaggacgcccgccgcgcccagcacgccgacgccgtggcgaaatgcgatgccatccgccagcgcctcccggccgagtaccgtcggcatgccctagcgctgcggggcctgctccgggatctcgccgaggcggaagtggcccgcgagcaggcggagcccctgcaggccgacttcggccccattccgccgatcgaaaacgagctgcgcggccttcagtccatccccgagcagatcattgagcggaccgagatcgatctgtgggtgatcgacggccgcgccgaaccgatgtccgcggacaagcaggacgatgttcagtcgaagcccggcaccaacaagggggtgtactactcgaagaacgccggcagtcatgtcggcaccggccacccgctacactgcacgcggcgccgcttcacgcgcattcgctaccatgaggcggtccgggagccctggaacagcggctctctgctcagactggtcaatctgccggccttctatgccttcggcgacgacttcgtgacgagcgagcaggtccgcagcgccgccaccgccctcgaccatctcagccgcgagctcgtcgagcgcccggaggatcagcgtccggtccaggagcggttcgagctggtcaccgctccactcggcgacggtcgcagcggcgtccgcgtttcgcccccgctgcggagcgtggcgtga

SEQ ID NO: 7017 - DNA, 384 bp, Methylobacterium sp.
ttgcgccgcgccgcgccgcgtcccgcgggggccagcctttaccggcctggctccgggaagccccacgctcccgccccgccgcgcgccgcgctgggcgacctgaccgggacggtcaccctcgtcccggggtccagaatccagcaggtcctgaacaccgggcggatgctcgggcacgcggaacaggcgggccagcccgtcggcgacgccccggagaacggcatcggcctgctcgtgatcgtcctggccctgtacgacgatgaaactcatctgcgcacccggatggttcgttcaggtcctcaactcgacacgttgcgaagggttgcctgggcctgtcggaagtcatccgacgattatgcgaatccgcacgtcatgaacgtcatgtaa

SEQ ID NO: 7018 - DNA, 477 bp, Methylobacterium sp.
atgctgcgcggcgtcgacatcctcgccgacgcggtgaaggtgacgctcggcccgaagggccgcaacgtcgtgatcgagaagagcttcggcgccccgcgcatcaccaaggacggtgtgacggtcgccaaggagatcgagctcgccgacaagttcgagaacatgggcgcccagatggtgcgcgaagtggcctcgaagaccaacgacatcgcgggtgacggcaccaccaccgcgaccgtgctggcccaggccatcgtccgcgagggcgccaagtacgtcgccgccggcatcaacccgatggacctgaagcgcggcatcgacctcgccacccaggccgccgtgaaggacatcatcgcgcgcgccaagaaggtctcgacctccgacgaggtcgcccaggtcggcacgatctccgccaacggcgacaaagagatcggcgagatgatcgcccacgccatgcagaaggtgggcaacgagggcgtg

SEQ ID NO: 7019 - DNA, 396 bp, Methylobacterium sp.
gtgctcggcggctacctcgccgccgtggcggcggcggtgacgaccttgatgctggccagtgcggccggtgctctgttcggaactcccccgtcgcccgccgccgagcctaccctcccctccgacttgatctccgtcgccatcacgttcgtcatcgccacgctgttcgtgacggtcttcgcgacgccggcattcttgctgtgcctggcggtctcgatccggacgggatggcgccatccgaccatccacgtggcttgcggcggcgccattggtctcgccctcgggcatctgtttgccggcatggtcgaacggccgctgcaagccgtaagcgccggagtggtggggggcggagtgtactggtggctcgccgtgcgcgagcggcgatggtcagggtcgtga

SEQ ID NO: 7020 - DNA, 657 bp, Methylobacterium sp.
atgcgagcggtgagcgacttccaccgtaccgcggcccgcatcggagcatcggcggcattcgctttcacggcgccggttgcccatgcggcaagcttcgactgcgccagggcatcgaccggaatggaacgcctcgtctgcggggacgccgctctcgggagccgggacgagatcctggcgaggctctactcgggcgccttgaaagtggggaagcgcgaggccgtcgaggctcggcagcgggcgtggctagggaaggcgcaggcctgtgccacagcagcctgcctggccgaagcctacgacgagcggaacgccgaactccagcggtctgagggtggggtgaaggtgggcagtggcttcttttgcgaggagcccaagggcaatcacagcaccctcaacgtcgtgggaccggtccatggcttcgccagcgtgtccctgatgtctaactatgtcgggcccggcggggtggaggccggcgacgtggacaccgcggccacggatgcattcctggatctccagaaagggacagccaccgtcttgaacggccgctgtcgactaaccttcgagcgcctcggcgcggacggttggaaggtcatccaggccggcacctgcgaactgcggggcggcgcggtattcgcgggcgtctaccgccgcctgccttga

SEQ ID NO: 7021 - DNA, 123 bp, Methylobacterium sp.
cagggcgcgttcgtcatcaacgccgccaacaacttcccggtcgtctacagcggcgtcggccgccgcgacgaccagttcgccgtcgtccgcgccggcctgaactacaagttcggcacgttctag

SEQ ID NO: 7022 - DNA, 231 bp, Methylobacterium sp.
atggaagcggatcggccattgtcgtggatcgaggcgatcatcgccacgaacgaggacgtcgtcgcgtgcgaacgtcgcttccactcccagtgcatcctggtcgcccacttggctaagcgcggacaggtcgcggccgaggacgagatgctgctcgcgtcctacgagacgagcctcgctctgctccgggcgcaccgggacaacctcttggcggatgcattggtcggcggatga

SEQ ID NO: 7023 - DNA, 1125 bp, Methylobacterium sp.
atggcggccgccgccggcatcgcggtcgcgaatatctactacaaccagccgatgctcggcttgatcgagcgggacttgcccggcgagatcaccggcctgatcccgaccgcgacgcagctcggctacgcggtgggactgttcctgctcgtgccgcttggcgacatcgtcgagcggcggcgcttgatcgccattcagttcggcggcctctcggtggcgctcgcgctcgcggccctggcgccgacggcgtcgctggttgtgctcgcctcgctcgtcctcgggctgtcggccaccgtcgcccagcagatcgtcccgctcgcggcgcatctcgccgcaccggagcggcgcggggccgccgtcggcacgatcctgtcaggtatcctgacgggcatcctgctcagccgcacgctggccggcttcgtcgcgacccacgggggctggcgggagatgttctggctcggcgtgccgatggcgctcgcagccggggcgctcatgatggccacgctgccccacagccggcccgattcgacgctgcgctacggggcgctcctgggctcgctcgccgagttgtggcggagctatcccgccctgcggcgcgcggcggcgacccaggcgctcgtgttcgccgccttcacggtgttctggaccatcctggcgttccggctccaggggccgccttacggttatggcgcggacgttgccggccttttcggcgtcgtaggcgcgatcggcgtcttcgcggcgcctctctcgggtcgattcgccgacaggcacggctctcggccggtggtgctgggcggatccgtgctcaccctggcgtcctgggcagtcttcgggctctggacatctctggccggtctcgtgatcggggtggtcctgctcgacttcgccatgcaatccaccctggtcgccaaccagcacatcgtcttcgccctgcgtcccgaggcgcgcgcgcggctcaacacggtgctcatgggggcgatgttcctgggcggggcgctcgggtcggccgcagccacgtccgtgtggcagatcggcgggtggaacgcggtcgtcgcccttggcatcgtcctcggcgcctccgcgaccgccgtacaggcgctgggtggacctggccgcgacggctga

SEQ ID NO: 7024 - DNA, 219 bp, Methylobacterium sp.
atgtccactgatctcccccagggtagagtcacgttccgcggccgcggtctggccttcgcgcacggcgccaagctggtgctgaaggtctgccctctgtgctcgcagtggaacgcgccccgggctgccgacctcgggcagtgcggctggtgcgcctacaccccgtcctgtcgcgacgtcgaacccgcgccgagccgccacgacaccgacgtcacctcgtga

SEQ ID NO: 7025 - DNA, 444 bp, Methylobacterium sp.
atgccgaccgtggaccacggcgccctcgtcggtgccgacctggaccgaacctggagcgtgctgaggcgcttcggcgagatcgccacctggcatccggccatcgccgagagccggatcgagggagacctcccggacggcatgcccggatgcgtgcgcgtcctgcgcctttccgacggcggaaccctgcgcgaacgcctgctggcgatggacgaggccaattacggcttcacctaccgcttcgacgacgcgccgctgcccgtcgacgactatcacctcaccgtctcggtcatgccggtcaccggcgagccccgcagcttcgtccgctggaccgcgcgcttcgacgtgcggcccgggcacgatgcggctgggcaggtcgcggtcatccgaagcctcgtcgccggcgggcacgaggcgctggccgagcacctcgcatcacggaagtag

SEQ ID NO: 7026 - DNA, 210 bp, Methylobacterium sp.
atgcccgacaagccaacgaccgcgaacacgcaggatctcgctgagaccgagtacgacgctgagcgctgggctcgagtgggtaccgtgcagcggtccattcctccgatcagtcctaaagcgccctcagacccgctggaaggcccggacgtcggcctgacgcagaagggcaccgacgaggacgcggttgtgaagcgcaaaaccgaggtctga

SEQ ID NO: 7027 - DNA, 285 bp, Methylobacterium sp.
atggtcggcagggatgacgctcggttcgcgagcactgtagccgagaacgccgtcacgacctgcgagtggttccgtgacggcagacggtttgccgtcgccgaccggcagcagatcatcgccgatatggaaagagaactcctggcggccatgcctgccagttccagtgcgaacctcgcgcaggcctgcaaccgcatcctatccagcataccagatcgaggacttccggtaccgcgtgtcgcaggcatcgacacggatgaggggttcatccgaatgcggccgtcgtag

SEQ ID NO: 7028 - DNA, 204 bp, Methylobacterium sp.
atgctcgagagactcggctacgacccgctcggtttctcctccaacaaggatgcggaggcgtggctggaggaggacacgccggaagccgcgatcgtggacgatccctgcgatcgcgaactggaaggcctgttcggcgtcctcaaggcgcggaacgtcgatctgatcgccctggatggcccgccgccgcagccttacagggcgtga

SEQ ID NO: 7029 - DNA, 96 bp, Methylobacterium sp.
ttcgtgcagcgcacaccccgcggacgcgtcctcacccgacacgcctaccggcatctcggcctgccggagccggagccggccccggtcgccgcctga

SEQ ID NO: 7030 - DNA, 417 bp, Methylobacterium sp.
gtgttcggcgtcgtgatcggcggcaccggcggccggcagacccaggattacttcctggagggcggcgccgtgctgaccggcaccttcccgggtcggccctacgacaccctcggcctcgtcttcgccatggagaagctctcgccgctgggcacagccaacatccgggcggcgcgcgcgtcagtggggctcggcacccggaacgtcgagtccatgcagaccatcctggagctgagctacggcatccagctcaccccggcggtgcggctgatgccgaacctgcaatacgtgatcgacccggaccagacccgcttcccgttccgcccgaagccgatcccggatgccttcgtgatcggtgcgaaactgtcggtggacctgttcaccctggccggcctggcgaaggggccgggcagccagtaa

SEQ ID NO: 7031 - DNA, 177 bp, Methylobacterium sp.
atcgacatgcgcgaccccaacagcctgttcgtgtcccaggcgttccggatgcgcaaccgcgacctgatctacgtgtcgaacgcgcccttcaccgaggtccagaaggtcctcaccgccttcaacggcgtcaccggaccggtcgcctccgccgcgacggcctacgcctacgccaagtag

SEQ ID NO: 7032 - DNA, 1101 bp, Methylobacterium sp.
atgctcccacagtaccgctggctctgggccctgacccttctcctcgcctccggcggggcgggcctcctctacaacctgctcttcgtcggcggggcctcgatgctcgccggcctggtctacgccctggcggtgggcgggacggtgctggctttcgtgcccggcctggcactgtcgggcgtccagacgcggctacgccgcctgccggcgctggtctacatgctggccgccgaactgctctacgtggtgctgatcacgctcggctgcgcgctcggcggcctggtcgtctggaccttcggcctcaccgacgacagcctgtccacggcggtgcggatcacgccacggttcctcgcctactcgctggccgtgtcggccctgctggtcttcgtcatgcgaatgcgcgacctgatcggcggcgaggtgttcgtgaacttcatgatcggccgctatcacaagccggtgcaggaggagcggatcttcctgttcctcgacgtggtcggctccacggccttcgcggagacccacggcgacctgcgtgcccaggagtatctcagcaccgtgttcgcgacgctcgccgagccggtgcggcgcaacgccggctccacggacgacttcatcggcgacctcgcgatgatcacgtggccgatgaagcgcggcctcaaggacgcgcgctgcgtgacctgcgtgttcgcggtgctcgaccggatcgaggccgacgccgcggcctggcaagcccggttcgggacggtcccgcggctccgggcggcgctgcacggcggtccggtggtcacggccgaagtcggggtcgaccgccacaagatcgcgtatttcggcgacgccgtgaacgtgacggcgcggatcgaggccctgtgccgcccgctgggtgtcgacatcctgatctcgcaggatctcctcgaccggctggaccggctgcccgacggcgtccgcgcccgcgcgctggggacgcacgccctgcgcggccgcggcgcgcccctggcggtcgccaccctcgagcgcggcgcggcgccggaccggctgatcccggagcagaggccggcgccgccggtgctggaccgcgccgaggccgtcgcggaaccgcgctag

SEQ ID NO: 7033 - DNA, 243 bp, Methylobacterium sp.
atggtggccgggaactcgggcgccgcagcaatgacatgccgaccctgcagcatcacgaacggtcccgacggtaccgagacgcccaacgcatccggtcggctcgctcactggcagctcggcctgtgcacggccctcatggaccgctgcatcgatcgcttgggcgacgtcgccgagactgcccgccgcgacagcgaggccgacctgctcgccaccgccgctgaagccctgaggacgaggctctga

SEQ ID NO: 7034 - DNA, 396 bp, Methylobacterium sp.
atgccgtacctccagctcgacgtgaccggcccgcattccgtggcctccaagaagcgcctcgcggcgcagatgagccagacctatgcggagatgatgtcggtcgacatcaggcggatcagcgtcgccatccgcgaactcggcgagggcggcgtgtggcggataccggaggccggcggcgcgccggtgccggtgtccgtgatgatgctggacatccgcaagggacgctcggccgagttgcggatggaagtcgccaaggcgctgtgcgcccactgcatcgagatcctcgggttgcacaaggatcgcctcaacgtggagttcacgcagcattccggcgacgagatgtatcacccgaccctcgggggctacagccccgagtggtctccggacgagcgatga

SEQ ID NO: 7035 - DNA, 459 bp, Methylobacterium sp.
atgaatgagaccttcgatgagacatccaacaccttggccgtgatgaccgccgagcttgtggccgcctacgtgtcgaacaatccggtgccggccgcggagctgccggccctgatcgcacgggtgcacggcgcgatcagcggactcgtcgccgggacgccggcggcgcaggccggcgcggccccgcaggccgaggtcgagaagccgagcgcggcccagatccgcaagtcggtccggcacgacgggatcgtcagcttcatcgacggcaagctctacaagacgctgaagcgccacttggccagccacggcctggatccgcgcagctaccgcgacagctacggcctgccgaccgactatccgatggtcgcccccggttacgccgagcagcgctccgccctcgccaaggcgatcggcctgggccagcccggcgccatggcgcggcgcggcggcacggaccactga

SEQ ID NO: 7036 - DNA, 333 bp, Methylobacterium sp.
atgtccctgacgccaaccgcgcgctgcctagccgcgctcgccctgatccccgtcttcgcggccgccgcgcccgagtcgatgcgcttcacgtcgcagcatgtcgaatggcccacgtccgatcaggtcttcccggcggaaccgggcgccgaggcgatcagcaacacctgcctcgcctgtcactcggccgggatgatcctcacgcagcccgttctgtcgaaggcgcagtggagcgggatcgtcgacaagatgatccacagctacaaggcgagcgtggatcccgccgaccggcaggccatcatcgactatctcgccgcgctcaagccgcggccctga

SEQ ID NO: 7037 - DNA, 1038 bp, Methylobacterium sp.; identical to SEQ ID NO: 5978

SEQ ID NO: 7038 - DNA, 102 bp, Methylobacterium sp.; identical to SEQ ID NO: 5979

SEQ ID NO: 7039 - DNA, 114 bp, Methylobacterium sp.; identical to SEQ ID NO: 5980

SEQ ID NO: 7040 - DNA, 1155 bp, Methylobacterium sp.; identical to SEQ ID NO: 5981

SEQ ID NO: 7041 - DNA, 117 bp, Methylobacterium sp.; identical to SEQ ID NO: 5982

SEQ ID NO: 7042 - DNA, 324 bp, Methylobacterium sp.; identical to SEQ ID NO: 5983

SEQ ID NO: 7043 - DNA, 195 bp, Methylobacterium sp.; identical to SEQ ID NO: 5984

SEQ ID NO: 7044 - DNA, 846 bp, Methylobacterium sp.; identical to SEQ ID NO: 5985

SEQ ID NO: 7045 - DNA, 246 bp, Methylobacterium sp.
ttgaagcagatccgcggcctgtaccatcgctgggcgcgctccggcccggtccgcgcgagcggcaacccactgatccggctggccgcccgccgcggcctgccggcggcggacgatctcgtcaccgcggacgcgcagatcgccgccctggccccgcacgtcgacgcggcgttctacgcgagctggtacgggatcgcggccgacccggtgcgcgactacctcgtccacggctggcgcgcgggccgcgag

SEQ ID NO: 7046 - DNA, 102 bp, Methylobacterium sp.
atgccgaccatgatcagcgtggtcgccaccgggaaccggatgaacggtgccgagatgccgcccttcatggccgggccccgcgcggggacgcgcccgccgtga

SEQ ID NO: 7047 - DNA, 234 bp, Methylobacterium sp.
gtgagcgacactgacgcccagcccgatgagatccaagaaatccttcggctcgcgacggcgctggcagagcaattcctgcagtctgaggcggaggagtccgcccgtccggagaggcttaaggccctcatcagcgccgcccaatttctccacgaccatgatgtggcttggccgaccgtcttgcgtgaggccgtgggcaaggccgtagagcgaatggaagcggtcagtggacgatga

SEQ ID NO: 7048 - DNA, 810 bp, Methylobacterium sp.
atgatgatgggcgacgatcgcacgcagggcgacgctgaggttacgcagcaggtgaaaacgatcgaggacgtgctgggcctgcggcgcgccggcgcgggcgccctcggcgaagacgtcggcgcggtcgcgagcgatgacctcgatgcccggatgggcgcgcagccaagcggcgacgctcccggcgtcacgatcgggcaggagatcgaggacggtgtgacgttcgaggtcgacgagcatggtgccgtagctgcgcccgcgccgccaagcccactcgtcgatgccgacgatgcggggctcgggctgtgtcggcagaggcgccgcacgcacgaggcgcacgagggtatcgccactcacgggcatcgcgagacgatgggccatacgggcggcgggtgcaccaccgagggcgagaccgagatgacgctggagcacgcgcagccgctcggatcggcgggcgtgagcgacagcgacgtcaccgacgctctggctgaaggtccgccgcgggcaggctgggttcgcacagcggaaacgtcgcagccggaggcgcaggcggacggaccggccctgccagggcaaatcggcgagggtgcgctcgcagtgaccgtgcttgcggcctgcggacgatcgacaggtgggacagcacgtcgggcccggacggggtacgacgcgcacgatgagcgggtcagtcgcaggctcgacgccgacgacggtcaggccatcgggcacgaggggcaggatacggcggggcatggcgtcctccgggaagccgatctccggagatggggcacgtcacgctggccggcccacttcgcc

SEQ ID NO: 7049 - DNA, 402 bp, Methylobacterium sp.
atgacggtggcgccggaccggctgagcccggccgatagcgctcttctcgtgcgcatcgtgcaggatcccgacgcggccaccctacacaggctcatccagcgcttcgtcgtgttcgtacgcgaggccgggaggaaaaggaacggatcgtccgcacatggcgatcgacgcctggcggcgttcggggcttggatcgtcgaggcgaaggcgagcggcatccgagccgcgcagacgttcgccagcgggctcgtcgttgatgctgccgcggtaagggcagcgttgacgatgccgtggagctacgctcaatccgagggccagattacgaaactgaagctgatcaagcgactgatgtacggccgggccggcttcgaccttctacgccgtcgcgtgcttctggctccttga

SEQ ID NO: 7050 - DNA, 1179 bp, Methylobacterium sp.
atgtcgtcgccgaagtcgacgtcgtcgacctcatcgctccagcagtccggctcggacaccgcgccgggctcggtgatggcgttgctgcgccgcgggctcggccgctggaccgcccttctggcgcgcattccgaccctcggaccggccgcggcggcggcctcgatcccagtcaccctgccggcggatggccagttcacggcctcggtcggcctgcccgcggatgccgccgcggcgtccgacacgggcgtggcgagcctcacggccctggccaagcgtgcgctcggcaattggaccgcgctgctcgcccgcgtgccggccctggtcgcggggcgcgtcccggtcgacggctcgggcgtgacacagccggtctcggccgccgcgctcccgcttccggccggcgcgtcgaccgccgcggcgcagggcacgggcaacgcctcgctcgcctcaatcgacggcaaggtgcccgccctcgtctccggtcggacgcccgtggacggttccggggtgacgcagcccgtcagcgcggcggccctgcctctgcccgcgggtgccgctacgtcgtctcttcagaccacggggaacacggcactcggcgcgcccgcggacgcggcatacacgggggccggctcctcctcgatcgtcgcagcgctgaaggggctctacgccgcgatggtcgccgccacgcccgccggggcgaacatcatcggcaaggtcggcatcgaccagaccacgcccggcttaaccaacggcgtcgtggtcaacgcctcggcgctgccggcgcgcgccgcgcaggacgcgaccttgtcggcccgcctcggcacgctcggtcagaaggcgatggcggcctcgacgccggtggtcgtcgcctcggaccagtcgcgcctcccggccgataccgtggtcccggcggtcgctaccgcgcgatccggcacgattgcggccggcggcacggcgcagcagctcatggccgccaacgcgagccggcgcggcttcgtggtccagaaccagtcgagcggcgacctctgggtgaacgggacgtcgacggcgacggccgaccagaacagcctacgcattcggcccgacgcctattacgagacccctgcccaccacgtcggcaccggcgccgtgtcgatcctcggcgcgacgacggggcaggccttctacgcgcgggagttctga

SEQ ID NO: 7051 - DNA, 408 bp, Methylobacterium sp.
atgcgcacagccctcgccgccctcgctctcgtcctagcggccggggaggcgcaggccgcgggcaaggtcgctctgaccgtgagcgagctgctggccgagccgaaagggcaccgcggcgagacggttgtcgttcgcgggatccggtgcgtcgatccagggccgggcgggttcatctgcgaggatgcagccggcggccagcagctgcggctggacgcttccgggctcggcggcgggacgacggaggcgattgccgagaagctaattggcccatgcaacgggctcgccgcgctcgcgaagccgacctgcaccttcgatgtgacgttcgttccgaccggttcgggcttcgaggacggcgtgacgatcatcaacacgccagagatcgacatgagcgtcccgcggcgtcggtga

SEQ ID NO: 7052 - DNA, 198 bp, Methylobacterium sp.
ggctacggcgggtgctacggcggtggcggcgggggtgcctacggcggcgggggcggctaccggaatgacggctacgacgaccggcgcgacgcctaccgcgaccgccgcgactacgaccgcccgccgccgcgccgctcctacgacgacgattacgggccggggccacgccgctaccggggtgatcccgacgagtactga

SEQ ID NO: 7053 - DNA, 957 bp, Methylobacterium sp.
atggctggccggcgaccgacgcgggcgcagatcgaactgcggcatctgcgatatttcctgaccgtcgtggacgagctcaatttcggccgtgcagcggagcgccttcgaatcgcacagcccgggctcagtcagcagatcaaggccctggaggagatcgtcggaacaccgctcttcgaccgttcccgccgcgccattcgcctcacgctcgcgggggagcttttcgccgaggaagcgcggcgggcgctctcgcaggtcgaacgcggcctgcttttggcccgtaaggccagccggggggagctcggccacatcacggtcggctatgtcggatcggccgcctatacgggcgtcctgacgaccatagtcggccagttccggcaagcgtttcccgacgtgcagctcgatatcgccgagatggagatgtctcgccaactggaggaactcggggaagggcgcctcgacgtcggtttcgtgcgaccgcccgtcgaattgccccccggcgtaatgaccgtgtccattcttcaggaggagatcgttgcggcagtccctgctcggcatccgctggccgacttgccccgccttccgctcgccgaatgccgcgacgacatcttcatcacgccgcatcacgcaccggacgtgagtttcgcccatcatacgatctcggcctgtcgggcagcgggcttctcaccgaagctcggccctcagggccgcgacttcacgacgatcgtcagcatggtgtccgtggggcttggcatcgctctggtgccccactcggtcggctgcatcgcattgcctggcattcggtaccgatcgctggaagggacggccccgacgtccgaactcgcggtcgcgttccgccgcaacgatccgtccgcggccgtgcgcgccttcgcccgacatgtgcgaaacggcgcgcacagcgacccgtccgataagtccgcattctcaataatgccctga

SEQ ID NO: 7054 - DNA, 204 bp, Methylobacterium sp.
gcggggggacgggcccgggcgggcgcggaggcgctgcaggcggcccgagccctgcgtgcggccgggctgccggccctcgtggtcgataccggcacgcggggcgacgaggcccgttctgtggcggacgcgatgggcgcccgctacctgaagctaccccgggccgaggccggtcagctcagcgcggcggtgcgggcggcgctctga

SEQ ID NO: 7055 - DNA, 270 bp, Methylobacterium sp.; identical to SEQ ID NO: 6004

SEQ ID NO: 7056 - DNA, 171 bp, Methylobacterium sp.
atgacgcccgccgaccgagaccggttcgagaagtgcctcgcgctcgccgatcagggggccacggcgggcgagcgcgcggccgcccgggcggccgccgagcgcatcgcccggggtgccgggctgaccctcgcggcggcggccgaggcgctccggcggagcgggcaggcctcc

SEQ ID NO: 7057 - DNA, 144 bp, Methylobacterium sp.
atgccgacgacgggcgagtgctggaggcggccgcacactcgaaacgccgcccgcaccgtggagcgcgatcggtacctgccgaacgggagtcccggccgcatggtcgacgaggaggccgacttggagagtaacacgatcggatga

SEQ ID NO: 7058 - DNA, 1065 bp, Methylobacterium sp.
atgttcgcgacgcgcttcatccgacggggagcgacggttgccgcgctgccgcgcggatgcgagatcagcccgctcgatcccgacggacatccggtctcggtcgaggatgtcatggcccgaacgcgcacggcgggcctgctcgtgctgaagcggggcgagatcgtgctggagcgctacggcctcgggctcaccgaagacgcgcgctggtcgacgatgtcgatggtcaaatcgctgacctcgaccctcgtcggcgccgccctccaggatgggcacatcgtcagcctcgaggagcccgtctcgcgctatgtcgaggcgctccgcggctccgcctacgacgacgtcgcgatccgtcacctcctgacgatgtcctccggcgtcggctggtcggaggattatacggatcggcgttcggacgtgaatcgctacagcaagtcgctgggcgacaaggtgccgggcggcgtgctggcgctgatgcgatcgctgccgagggtcgccgcgcccgggtcgcgcttcaactacaacaccggcgacacctacgtgttaggttgtgtcgtgaccgctgcaaccggcaagacgctcgcgcaatacatgtccgagacgttctggacctcgcttgggatggagcaggacgccttctacaccctcgagtccgaaggcggccaggagatcggcggcagccgggccgggatgacgctgcgcgatctcggccggctcggcgccttcctctgtggggacgggaccgtgaacggccggcggattctcccggaggcctggctcgacgaggctggccgacgccacttcgccgtcgaacccacgatgaactcgttcggcgcgaccggctatggctacagctggtggatcccggctgagggcgggatagcggcagtcggcttcgccgggcagtcgctcgtcatcgaccggcgcaccggctcggtgatcgtgacgctggcttgccgcccgcaaccgcctttcgatgctgcctacgggatcgacttcaagaccgaggccaccgccttccgccaagcgctgctgcgaagcctcatggacgtcgccgccgcgcgctga

SEQ ID NO: 7059 - DNA, 237 bp, Methylobacterium sp.
atggaacgctacgagctggtcgagggcagcgcggccaagttctgggaggtcggcgtctccggcccgacgctcaccgtccggttcgggcgcctcggcacccagggccagagcaaggacaagacctgcgtcgacgcggccgcggccgtgaaggagaaggacaagctcgtccgcgagaagaccgccaagggctacgtccgcgccgacggcgcggctcccgccccggcgccggcctctacc

SEQ ID NO: 7060 - DNA, 411 bp, Methylobacterium sp.
atggtgctcgaggcctgtcccgacgtcgtgctctacgcccgcgacggtatccggagctggtccgatctggccggcgcggcggaggtcgttcgtccggcgctgggaatcggtccggacgtctgggaggcggccctggccgcgatggggcgggaccacgcgctgtcggcgctgtcggcgatcctccagcgcgccgagtcgatcggcgcgcccggcgcctatctccgcgacctgacgcggaagtcccgctccggtcggttctcggcctggccgatgctcttcgccctgtggcgccagcgccgtcgagcgtcagccgacggcccaagcggtcccgtccgcgtcgcgggagttgaccgcggtcaacacgctcgcccgctcggaagcggggcggcgcgagcgtcaacattctgttaa

SEQ ID NO: 7061 - DNA, 825 bp, Methylobacterium sp.
gtggcccagaagagcggtcacgaggtccggctggtgccggcggtctacgtgaagccgttcgtcaaacgccagaagaacgatcgtgcagacgcagaggcgatcgccgaggcggccgcgcgcccgaggatgcgcttcgtggcggtgaagagcgccgagacgcagggccgcgcggtggcgttccgcacgcatcagtgtctggtccgtcagcgcacgcagctgatcaacgcgctgcgcggccatctggccgaattcggtgtcgtcgctccgaaggggccggcctacctcaaggtgctggaagaggctctggccgacgaagtcgctgatctgcccgtcgcggtgcgggcgatggggactatctatctcgaccagatcgcggggctgacgcaggtgatcgagcggctggccgacgaactggagacggcgtcgcggacggacaccgatctgcgacgcctatgcaccataccggggattgggccggtgaccgcaggggccgtcgccgccttcgctccggatctcgacacgttcgccagcggacgcaacttcgccgcctggctcggtctcgtgccgcggcagcgatccacgggcggcaaggccaagctcggttccgtcagcaagatgggccagaccgatatccgacggctgctcatcgtcggggccatgagcgtgatccgctgggtggttcgcaagggcgggagcgcgaaccgctggctcgcgaccctcgtcacgcgcaaaccgaagatggtcgcggcggtcgcgctggccaacaagatggcgcggatgatctgggccgtgacgacgaagcaggaagattaccggatggcgtga

SEQ ID NO: 7062 - DNA, 135 bp, Methylobacterium sp.
atgatcctctggcaatcgcgggggcgaggcctccccgtagcgggcctgacccgcgagagccagcacatccgcgcggcccgcgcgccgaagggcttgcgcgggcgcggcgcggaggctaagagccgcgagccctag

SEQ ID NO: 7063 - DNA, 195 bp, Methylobacterium sp.
ttgatcgtgttcgatttccctggcttcggcctgcgcgtcggcgcgggcggctcgcggcagcggatcgtccaataccgcaacgcgatcggtcagaccaagcgggacaccctcggccgggtcgtgctgctcgaccgatgcctggcgagcggcgagcgagcggccggcgctggccaagctcgggtcggattcgcctga

SEQ ID NO: 7064 - DNA, 102 bp, Methylobacterium sp.
atggctgagagcgtggcccgcgcccttttcgccgcgtccggctcgttctccttcaagatcaccccgaggcgctcggcgactgtcgcccggctcacagcgtga

SEQ ID NO: 7065 - DNA, 438 bp, Methylobacterium sp.
atgaagaccttgacgattgcgggcacggcgctctgcgcgctcatcctggccacgccgagtgccgaggcgggcgggttccgcggcggcggattccatggtggcggattccatggtggcggattccggggcggttaccgcggcggctacggctaccgcggtggctacgcggcccgcggcttctacgggcgcggctacggttacggctaccgcggcggctacggtcgggccctcggctacgggctggccggcgcggggatcggcctcgggctcgggctcgccgccggcagcgtctacggcggctacggttatggcggctacggttacggctacccggccgcctacggcggttacggctacggttacggctatcccgccgcctacggtggctacggctacggcgggtgctacggcagcttcacctgcggctgcggctgctga

SEQ ID NO: 7066 - DNA, 174 bp, Methylobacterium sp.
atgacgtccaccgttcgcgtcaccctcgcggccctggtcaccgcctcgctcgccgcctgcgcgagcgcgcccgccgcccagccggagctgacgccggtgccgcgtccgcgggtcgatgccaagacgcagctcgaatacggcaacccgcccccgccgccgcccggccgctactga

SEQ ID NO: 7067 - DNA, 114 bp, Methylobacterium sp.
atgatgctcggtggcgcgatccggcctgctacggtctttgagatcgccggcctctgcccatgcgtgcaggtcgcccttttgctgagcgtttttatttttttgatcgaatattga

SEQ ID NO: 7068 - DNA, 129 bp, Methylobacterium sp.
ttgattcagctcaaggccggtgccgtgaatctgagggcgtcggcgcgattgcgctggatcaaggccctcgcccgcgccacccgcgacatcctgcaggcgagcaccctctgctgcctcatggcgcactga

SEQ ID NO: 7069 - DNA, 141 bp, Methylobacterium sp.
atggcgacgccgccggtcatcgaggcgaacgacctgtcccacccggccgacgtgacggcgaacgcggcccgcgccgacctctgccgcgcccgcggcagcgcgcgggcgttccgcccgtccggcgcggcgagggcggactga

SEQ ID NO: 7070 - DNA, 195 bp, Methylobacterium sp.
atgatttcctccgccacctcggcggcgacctctgcgatctgcaagctccgactcatctacttcgacgccaattgcttgcaggccgcgaagcaccatgcttcgaatgctctctcctcgatcgatgctcatgtgagcaacttgtctacgcaccgcttccggcaccatcacctggatcgggacttctttattgtgtaa

SEQ ID NO: 7071 - DNA, 276 bp, Methylobacterium sp.
gtgaccctggccgagctccacgacctcgacgcctccgaccgcgcggaggcctatcgcctccgccgggacacccggatcgacgcgatcctgggcgctccggaagccgaggcggaggagcgcaagctcgtcgccttcgctctggccctgcgcctcgacctcacgcccgacgccgcggtgctgttgctccgccaggcgccggagctgcgcacggtcgacgccgtctcctcctgggtcggcgcgatcccggtccagcctcatccggagacgcgccactga

SEQ ID NO: 7072 - DNA, 267 bp, Methylobacterium sp.
atgaggcgccatatcggacccgccgccggcaggctcgtcgcgtccggccggttcagaacgttccgggccatggagacggctgtcgtgctgtttcaggaccccgccctcagaacggggcggaaccagatccacctttgcgaggtcgatgccgccagcttcagggggtttggccgagaattggacgccctcaccgacagcgatgccccggaaggcggcttcgcgggtgtcttcgcggatctcgctccgatgcgcacgatcccccggtaa

SEQ ID NO: 7073 - DNA, 345 bp, Methylobacterium sp.
atggcagacgacaccgagaccggcgccgatcacggcttgcgctccccgctgcggcgcaggctgctcatgggattggccggcgccccggcgctggcgctgttgccgcgcaccgcctgggcggcgccgccgaccgcggcggtcaacaccacgggcctcgcggtgaccgacagcgaggtgacggtcggcattctgcactcggtcaccggcacgatggcgatctcggagacgggcgcgcaggaagcggagaagctcgcgatccagcagatcaacgacgccggcggcgtgctcggccgcaagatcaagatcatccaggaggacggcgcctccgactggccgaccttcgcc

SEQ ID NO: 7074 - DNA, 267 bp, Methylobacterium sp.
atgtgcccgcgcgcgagggcgaacccgttgctcgctatcatcaccaaggccgatttcttcgagagtcattctgatagcgcagccggggcgaggacccatgcggcagcggtcatgctcgctgccggacacatgactatagtgattgggagttcagatccgcccaccgacagtcagcgtgagagggcgagtcgcatcccgatgaccggctcgatcttgccccagaagaacgccgagtactgctccgcgcgatcggccgggccggcgtag

SEQ ID NO: 7075 - DNA, 135 bp, Methylobacterium sp.
atgcatgtccggcggttcaacgcgtggcgacgcctctcgacacggcgcgtcgcgctcctgaggctcaaacgcggcgccatcccgcagatcgcgatcaccgcgggatcggctccgtcgcgcgcggcgccgtcgtga

SEQ ID NO: 7076 - DNA, 108 bp, Methylobacterium sp.
atggctctctccctgtgtgacgcggccggtgcgccgtcagcccgcggcgccctgatggcgttctcggccgggttggcccggctcgttcacattgtggcgagtgtgtga

SEQ ID NO: 7077 - DNA, 84 bp, Methylobacterium sp.
atggatacgcgcatgacgatcctcggccagatccgagtgcgggacggtcgcatcgggcggtccgacgcagtcgactgcatctag

SEQ ID NO: 7078 - DNA, 840 bp, Methylobacterium sp.
gtggagcctgaccgagcgggggatcgcggtgccgatcgccaagccgaaagccacgtcccggagcggcgagacgcccagacgcgtgatcgagctgcggaactcggtccgctgacgggtgtcgaggcggccgacagcgccgcggacggcgccgcggtcgcgggcaccggcacggccgtcccgttcgccggccggaccgcgaccgccgcgctcgggaccggccgcgtcgcggttgccccgctcgggtccggcacccggctcgcggccaccccgatcgccggcaccgcgttcacccgcaccgcgttcacccgcaccgcgttcacccgcaccgcgttcgcccgcaccgcgttcgcccgcaccgcgttcgcccgcacctggattcgcggccgcgccgccccggtccgccggtccgttgcgctcggccgcgccgcccgggcgacccggtccctcggcgccgcgcggcccaccctcggcaccgccgggaccgcgcaccgccccgccttcgggcgcgccgccccgcatcccgccgccggcgccgccagcagggccgccggccgggccgccgccggacggacccgcgcccgcgccggccccaccacccggaccgccggcgccgccgcccgcaccaccgggtccggccccgccgccgcccggtccgccctgcgcgaacgccgtcgccgctccggcgacgacgatggcggccgcgaccgcgtctctcagaactcgcttcatggcttcttcctcctgtggtggtcggaacgccatcgacgcccacgccggcccgcaacggggccccgggccgaaccgttccctcccgcggcaccgtggacgcgcggccggtga

SEQ ID NO: 7079 - DNA, 81 bp, Methylobacterium sp.
atgtttgttatgcgaataactttcagcggctcgaagcttctcatcgaagacggcatcgccgacttcccgccggacgcctga

SEQ ID NO: 7080 - DNA, 207 bp, Methylobacterium sp.
atggctgatgctgcgatccgcgagacgatacacctcgacgaaggcgacgtgatcgtcctgctccccggcaacctgtccccggccagcatcggcctgctccaggccaagctcgacggtttggccgcggacctgaacgcgcggtgcctggaggaaagccgcgcttccctctcgggattggccgggctggccgccttcctcgcgagctga

SEQ ID NO: 7081 - DNA, 339 bp, Methylobacterium sp.
gtgcccccgacacggcgaggcggcttccttccggtccggcaccggcatcgacggggacagccggcccttcgccccgaggccgggttcgggtacgagaccgaaatcgcgctcgaccccgtcacccgccgcggcgcgaccgacgcgccacggcccctcgcgcaggagaacgtcctgatcaccgatccgcaggccctccgcgcgcaggccggtgcccgtgcgagccgccgccaggaccgcgccgctcgatggtcgccggcattccgcgcgatcgccggcggtgtccgagccgacatcggcgctcccccgcggggcaccctcggcacggtggcgcgctcctga

SEQ ID NO: 7082 - DNA, 750 bp, Methylobacterium sp.
atgaagatcgtggtgatcggcggcagcggcttgatcggccggcatctgacggccgagctgaagcgcgcgggccatgaggccgtccccgcctccccgagcacgggcgtcgacgccgtgaccggcgccggcttggcccaggttctcgtcggcgccgacaccgtggtcgatgtggcgaacgcgccctccttcgaggaggcggcggtgcgcgacttcttcgagcgctcgagccgcaacctcctcgccgccggccggcaggcgggcgtcaagcaccacgtcgccctctcgatcgtcggcgcggaccgcgcggacggcaacggctacttccgggcgaaggtcgcgcaggagcggctgatcgcggcgtcgggccttccctacaccatcgtccgcgccacccagttcttcgagttcgtcgcgacgatcgccgaagccttcgcggtcggggagcggatcctcgtgccggacgcggatttccagcccatcgcggcggcggacgtggccgcggcgctcgccgcggtggcggtcggcgcgccggtcgacgggacgatcgacgtcgcggggccggagcggctgccgttccgggcgttcgtcgcccggcgcgcggcggccgccggcgacggccgcgcggtgacggtcgacgccgcggcccgctacttcggtgccgcgctggcgcgaggctccctggtccccgacgacgcggccgcggcccgcctcggggatacgcgcttcgagacctggctcacgacggcatga

SEQ ID NO: 7083 - DNA, 552 bp, Methylobacterium sp.
atgactcgtatcgcactcgtctccaccgccctcctggcggccgtcgcgttcgcgccgaccgtcgccgatgcccgcggcttcggcggcggtggcttccacggcggcggatttggcgggggcggctcccgcggcggcagtgtcggcggcggagcgttccggaacggcggcttcggcggcggcgccttccagaacggcgtcggcggggcgcgggccggcggactgggcggcgacttccgcggggccgggctcggcgtggccggcgtcggcggcgtccggaccggcggcctgcgggccggcggatataaccaggccggccggttcggcggggtcgggaaccgcgggatcgccggtcgcggcttggtcaaccgcggctattacggccaccgctacggacgcggcgtcggctacggactcgccggcctcgggctcggcctcggcgtcggttacggcctgggcggtctcgactacggctacgacaattgcgcctacacttacgactacggcgcctacgacccggctgcctgcaacggctactacggctacggctactga

SEQ ID NO: 7084 - DNA, 144 bp, Methylobacterium sp.
atgcaaccgggctcaccccacgcgatccagcgccacctcgggcgcaagttgcagggcatgtacgcccagatcccggcaacgcccctgccggaccgcttgaaccaactccttgcccagctggatacggccggcgggacggtttga

SEQ ID NO: 7085 - DNA, 90 bp, Methylobacterium sp.
atgcggagcgagatcgccgcgaaactggtcaccggacgcgggccgcgcgccgacaccccctgcggcgccgcggcggtccgacagcgctag

SEQ ID NO: 7086 - DNA, 84 bp, Methylobacterium sp.
atgaagtggctggggttcgacaggcgggtccagagggaaggcgtcatcgcggcagctgtctcggacatcgtggaagcggtctag

SEQ ID NO: 7087 - DNA, 102 bp, Methylobacterium sp.
gtgacccagggcagcgcgacgtccggaggcgtggcgcggctggattgcttcgctccgctcgcaatgacggcggtgccgttcctcgacagcgccgacgggtga

SEQ ID NO: 7088 - DNA, 294 bp, Methylobacterium sp.
gtgaccgccgaccgggtgaaggacccgaacaacctcaagctcaagacgctggtcaacggccgggtgcgccaggactggagcaccgacgacatgatcttcaactgccgccagctgatcagcttcgcgtcgagggtgatgaccctgaagccgggggacatcttctacaccgggaccccgcagggggtgatcttcggcgagaagatcccgcgcaaggaccgcgcgtggctgaaacccggcgacgaggtcgtgtccgagctggaagggctcggtgagctgcgcttcaggctggtctga

SEQ ID NO: 7089 - DNA, 270 bp, Methylobacterium sp.
atgatcattgccgctgccctgctggcggctctcggttccgccgtcgcgatcccggcctccgccgcgccgatcggccccggcacgggcgtgtcggcgcccgccggcatggtctcgacggtccagatggatcccgtcgagcgccacatgatgcgccgtcgcatggagcgccggatgatgcgccaccggatggagcgccacatgatgcatcgggagatgcgccgcgagatgcgccaccgcgagatgcgtcgcgagatgatgcgccgcatgtga

SEQ ID NO: 7090 - DNA, 603 bp, Methylobacterium sp.
atgacgagcaagctccgcggcaccgggcagcacggccacgcaccgcccgtcgcgcccgatgcgggccggcgcgcgttcctcggggccgcggcgctcggcgtggcgctgtcgacgggcgcgcgccccgcgtcggcgaccaccgccgcgccggccacggccgcggacgagaccttcatgcgggcggccatcgccgaggcgcgccgcgccgacttcccgttcggcgccgtcatcgtcgcggagggcgagatccgcgcccggggcctgaatctcgggaagcagcagcgcgatcccacggcgcacggcgagatggtggcgatccgccgcttcctcgcggagcacgggccggaggcgctgcgggggacgaccctctacacgtccggcgaaccctgcgcgatgtgcatgggcgcgatcgtctggtgcgggatctcgcgcgtcgtcttcgccgcctcgctgcagcagctcgccacgaagatcgaccagatcatgatcacctgcacggaggtcgcggaccggtcgccgttccgcccgatcgcgatcacgggcggcgtcctggcggaggaggcgctcgcgctctttccgcccggcgaccgcccgtccaagtaa

SEQ ID NO: 7091 - DNA, 603 bp, Methylobacterium sp.
atgccgacctgcgacacagctgaggttcagcccgatcgctccccggccccgacgctcccggagctgttcctgctgttcaaccggctgaccttggtcagtttcggcggcggcctgacggcctgggcacgcaatctcatcgtcgaggagaagcgctggctggacgacacggagtttctaagcgcctacgcgctcgcccgagtgctgcccggcgccaaccaggcgaacttcgccatctatgtcggtcaccgttttcgcggcgcggcgggcgccgtcgcagccctgctcggcctgacgttggtgccgttctgcatcatcgtgtccctcgcctggatgtacttcggcgacggcgcgaccccggcggttcaggacgtcttgcgcggggtcaccgcggccgcggtcgggctcgccctgtcggccggcctgaaagccggggagggacttggccgccagccggccgcgctcgcgttcatcgtcctggcattcgccggctccgccctgatgcatatcccactgcccgccgtgctggcgatcctcgcgccgccggcctttctcctggcgtggcgtcacgtgcgccgccgcgaccggggaccggccgggccatga

SEQ ID NO: 7092 - DNA, 132 bp, Methylobacterium sp.
atggcggcgcgggtgaccgagatcgtcgacagggccggcgacgccctgcgcgcggccgcgctcggtctcatgccggcaccggcgcccgtaccggtccgcgtgcgcgcacgcggaccgcgccggcaggactga

SEQ ID NO: 7093 - DNA, 126 bp, Methylobacterium sp.
atgctgcgtaagacggcgtgcaccgccctgatggccgccctcgcggctggatctgccggcggctgcacgtacatgcccgcggcgggtccgacggcgagcgcgatccaggccggggccgaggtcgcc

SEQ ID NO: 7094 - DNA, 111 bp, Methylobacterium sp.
gtgatcgtgatgatgctcgagagggatggatcatcgccggtccgcttccggacggcgctgtttggccgggcgccgctgctccgccccttgtcccccgtctccctgttgtga

SEQ ID NO: 7095 - DNA, 906 bp, Methylobacterium sp.
gtgcctgccgagatcgagacgccggacggtctcccgttccagggacggctggacgtgacgtgtatcggcgcgatgccgatctcgcatttctggcacacaaccgtgcggaccagaatcacggacgccgaagcgcgacgccgcgggaaccccgatcgggttttcgtgctcctgaagctgtccggacgggatacaatccagcagcttgaccgggaggcgaagaccaagccgggcgacctcatcttgctcgactcgagttcatccgtgatggaggcggagaccggcgactccttggtcatcgatctgccgcgccagcgtttcgagaccgttctgggcccgtcccgactctacaccgcgctcacggccgcagcggacctcgcctcgacgaccctgacgggctcgtaccttcaggaactcgtccgggtcagcgatcgcctcactcctgacgcggccgagcgcatggcatcgatcggcgtcgacctgatcgtggcgagcctcgccgaacggatggcgcaggaggcgccgcgttccatccacggcaacgtcacggtccagcgcgccaaggcctatgtcgaggcgaacctgagcgacccgaacctggacccgccccggctcgccgccgcgatgggcgtgtcgttgcggcggctgcaggagctgtttcatgagcgcggccggcacatctccgactacatctggggacgccgcctggaggtggcagccaagcgcctgaccgacccggcctgcgccgccctgtcgatcggcctgttggcttatggctgcggcttcagcagccaggcgcatttcgcgcgccgcttcaaggatcgctacgacgtgagcccccgtgaataccgacaggcgcacaggccggacgtggaggtatctgcgtccgcctccggtctgtcgtcctga

SEQ ID NO: 7096 - DNA, 351 bp, Methylobacterium sp.
atggccgcgtcgggctcccggccccaccgtggcgccgcttcgggccgtccgccggaacccgttgccggatgcgctccgcgccgaggacggagcgccgcggtctcccgcgcggtcgaggccgcatcgccgatccgcgggtggaccgtaccgatccggtctgtcgccgtcgcggcactcgccctggcgctgcccctctgcggctgcgtctccggccgcgtcccgtccgccgacatcgccgtggcggagcctccgacggccgcgccggccgcggcgcggccgcccgatccggccctcgacccggccatcgtcgcggattcgtccgggtggcgcctgcggctcacccacctctga

SEQ ID NO: 7097 - DNA, 87 bp, Methylobacterium sp.
gtgagaggccgccgcgcgctcggccgcgcgctgctgaccgcgctggtgctggtcggcgtcgcgtgggtcgccttccacctgcgctga

SEQ ID NO: 7098 - DNA, 525 bp, Methylobacterium sp.
atgaagggtgcagtgctcggctcggccctgctggcggcgggtgctctggccttggcgccggccagcgcggacgcgcgcggcttcggcggcggcggcttccatggcggcggtttcggcggcggcttccacggtggcgggttcggcggcggcttccgcggcggcgggttcggcgggttccgcaacggcggcttcggaggcggcttccgcggcgtcggcttccgtccgggcggcttcggctacggccgtggcttctacggccggggctacggctggcgcggcggctacggctaccgcggcgggtacggctacgggctcggcggcctgggcctcggtgtcgggctcggcctcgcggccggcggcctctacggcggctacggtggctacggctatccgggttacggctacggcggctactacgccccggcggcctacgattacggctacggcggcggctgctacacggtcccgcgggtgcgctggacgccctacggctaccgccgggttctggtcgagcgctgctactga

SEQ ID NO: 7099 - DNA, 267 bp, Methylobacterium sp.
atggaagagatcctcgcgtcgatccggaggatcatcgccgacgatcaggccgccaagccggccgaggtcgcggcgcccgctccggagcccgacgacgtgctcgacctcgcggaggtcgccgagccggtgatgcgcccgcgcgtcgtcgagccggaaccggaacccgagccggcgccggacctgctcgacttcgacgcgatcgacttcgaggacccggtgaccgccgcgcccgaaccggagcccgagcccgagcccgagccggccccg

SEQ ID NO: 7100 - DNA, 120 bp, Methylobacterium sp.
gtgagccggcccggtcgcgcgcccgcgcggcggtccggacgcgactacaccgccgtgacgctgatcggagcgggactcacggtgctcgcgctcgcgctgctgctggtcgggatcccgtga

SEQ ID NO: 7101 - DNA, 144 bp, Methylobacterium sp.
atgccgcctcacgtcaccgcggcgcgtcacgcgctccgcgcgggaccgcgcgccgccgcgtcgcttccggcgcgcggtgtcgaggcggcgcgggtggccggcgaccgggccgagcgcccgcgccgcgccgaggcggtaggctga

SEQ ID NO: 7102 - DNA, 702 bp, Methylobacterium sp.
atgcacgcgaggagcggcgacatgaacgcgcccgatctcttcagcttcgagccggccgtccggacgttccccgtggtcgaggtcgaaggcatccgcgcgatcgtcgaacgcgaccagtggtgctgtttctacgccatagatgccggcaggccgttcccgagcgaaaccggcttccggtcggccgggaacgatcggcccgggccggccgaggacatcctcgccgctgtcatcgcggagcagcggaaggacaagaaggggccgtttccgatcccggccaccgtctaccgccagcccttcgcgggtgaggaccggccacagccagctaacggcgcgatggtcgccctcaggcagctcgccgaggccccgctcaacgtcgacctgatcttggccgtctatgcgaacgaccaggtcggcaaggcttgggggaccggcgatccggagaagcttgtcgagatcacgcagcggatcctcggcgaaggcttccgggctgagagcagcccggacggagacggcttcgcggtgatcgcacctagcgggctgcgcctgccggcgaggggcttcttcccggccgtccacaacctgcgctgccacgtggcacgcatcaccagggaggcgacccgggcaaccatgcctgcgctcttccaggcccggaagcggtcagcccgatcagctccggctcccctcttcacgcccgcggagtag

SEQ ID NO: 7103 - DNA, 132 bp, Methylobacterium sp.
atggcctcgaacccgaccgtctcggcgcttcacgaggccgccgagctctctgacgaggcgatcgacttggatccccggcagcgcggccggcggcggaggcgcgcctccccgactttcatcgcccgcaggtag

SEQ ID NO: 7104 - DNA, 144 bp, Methylobacterium sp.
atgacggagatcgccgatgaatcctccgagaccctggaccggattggcgaggccctcggatctggcttgctttcaaaaatgatgaccataatttatatcgagccgcggcgggcaaggtgccgcgtggatcggagggcgatatga

SEQ ID NO: 7105 - DNA, 171 bp, Methylobacterium sp.
atgacgacggcggtgatgccggggctgtcgcccgatcagtccagcccacaccgtcatcgcgagcgcagcgaagcgacccagggtggcgcgccgtcgttgagcatggcgctgctggattgcttcgctccgctcgcggggacgggggcgacggtttcagcctcggggctgtga

SEQ ID NO: 7106 - DNA, 246 bp, Methylobacterium sp.
atgatcggggccgcgcccgcggcaccgacgcgcgagtccgggacggaccacgccgccgggccgatggccggtgtcgatgggccggcccgggccgaggggcggaccctgtcggtcgccgtccgtgccgacggtgcggctcccggcggccggagcctgcggtccggcgacttgcgcggacgacgcgcggacgacgcgcggacgcgcatccccaccccggattgcacagaagccggccgccggacttga

SEQ ID NO: 7107 - DNA, 291 bp, Methylobacterium sp.
atgccgaagggcgttatgaaacctgtcgccgtcggaaccgacaacggctcgacgcgcagaaccagcgccgggttgacgccggggaagtgcagcgaggtcttccgccgcgtcgaccgcgcggaggcctcgcgccggaccgccggccatggcttgagtctcatagcggcagtcgccgacatccccggtgcgcccgtgacgcaggatttcccgccggccggcggcgaactcggaaggccgcgcggcgggatcgacgaggtctctcggatcgcggacagagacgccgggatgtaa

SEQ ID NO: 7108 - DNA, 93 bp, Methylobacterium sp.
atgaccaagctcctcgcctccctgaccgccttcactgcgctgaccgccgcggcgtccgccgccgaccttccgcgccgcgccgcgccgccgccg

SEQ ID NO: 7109 - DNA, 882 bp, Methylobacterium sp.
atgatcaccgcggaagaagccttcgagacctaccggcagcgcctggagctcagcgagaccgagcgtcgaagcacgatcaagcggcataacgaggtccgcgacgtgatccgcgccgatttcgccgttgatcgcgacctgctgaccggctcgtacaagcgccacaccaagacgaagcccttgaaggacgtcgatgtcttcttcgtcctcggtcagaaggagcgtgacgcataccgatcaaggccgcccggcgacctgatcgacgccttcgtgaagagcctccgcgccgcctacggcgagcgggccgtggaaccgggaaggcgttgcgcgaccgtcgcgttcgagaggaacacgacggatgaggagggaaaggtcctttccatcgacgccgttcctgcgttcgatctcggcgattgctacgagatacccgaccgggtccgtggggattgggtgaagaccgacccggaaatccacatggaacaggccaccgccaagaacaaggaactcggcggaaagtggattccgctcgtcaagatgatcaagcgctggaaccggtcggcgggaaagccgatcaagcccgtcttcctcatcgaggtcatgatgcaggatctggtcgacgccccgttcaccacctatccgagcgaggtgaggcggttcttcgcggcggcgctcgacgccatcgaccggccatggccggaccccgccggctacggcccgcccgtctccgaacagatgacgccgcaactggttgccgccgccaaagaaaggctccggcaagcggagatgaaggccgcgctcgcggtccgtctcgaaaagcagggcaagcaaggcgaggcgatcgccctctggcgcgagatcatgggcaggtacttccccaccggctga

SEQ ID NO: 7110 - DNA, 1338 bp, Methylobacterium sp.
atggtcgctgtcctggccggggtggcgctcgccacgctggacaccgccatcgcgaacacagccctgcccaccatcgcggccgatctcggggtcgatccgagcgcctcggtctggatcgtgaacgcctaccagctcgccgtggtggcgaccttgcttccaatcgcggcgctcggcgagatcgtcgggcagcagcggatctacttccacggcctcatcctgttcacgggcgcatcgctcgtctgcgccctggcctggtccctcccggcgctggtcgcggcccgcgtgctccagggggtcggcgcgagcgccttgatggcggtcaacatcgcgctgatccggttcatctaccccgcccgccatctcggccgcggcgtcgggctcaacgcgttcgtggtcggggtcggcttcgcggtgggcccgacggtcgcgtccctgatcctcgcggtcgccccctggccatggctgttcgccgtcaacgtgccgatcggcctcgccgccctggtcctggccacatccgcgctgccagtcaccggccgctccgggcacacgttcgacctgcccggagcctacctcaccgcggccaccttcgcgctcctcgtgctcggcctgggcgaggccgctcaccgaggacccctgtggcgcaccctggcggaggtggccggcgggctcgcgtgcggcgcgatcctcctgcgccggcaggcgggccatccggcgccgatgctcgccgccgatctcctcacgcggccgctgttcgcgctctcggccgcgacatcggtctgctcgttcgcagcgcagggactcgccttcgtgtcgctgccgttcctgttccagcacgcgctcggacgctcgcaggtggagactggcttcctgatgacgccgtggccggcggtggtcgccctgatggccccgttggccgggcggctctcggaccgcttccctccggggctcctcggcggaatcggcctggccgtcctggcggtcggcatggcgctgctcgcgacgctgccggcggacccaagcgtcgcggcgataggctggcgcatggcggtctgcggggccgggtttggcttcttccaggccccgaacctgcgtgccatcatgacgagcgcgccgccggcacgttccggcggcgcgagcggcatcgtcgcgaccgcgcggctcctcggacagaccacgggcgccgcgctcgtcgctgcctgtttcgggatctcggacgcccggggaccggccttggcgttggggatcggtgccgcattcgcgggcgtagcgagcgtggtgagcttcctgcgcctcacggtgcgtcccgggacagacgcagcggcggagcggtcggcctag

SEQ ID NO: 7111 - DNA, 234 bp, Methylobacterium sp.
gtgggcccgctcgcgcgggctttgcgggacgaaaccgagacgacgggccagccgagggatttctacctcaagttgatttcactccgtttcttgaggttgcagataatatacaatatgagcggccggcggtttgtccggcagcgcgaggttttttgctccaccgcgcaaccggcggcattcccgccatggttactgatacgttcactgatttcggccgctgagatcggcgactga

SEQ ID NO: 7112 - DNA, 90 bp, Methylobacterium sp.
atgccggacgagaggggggagaatcaccgcgccgccgagcgcgcccgggtcgccgcggcggtgcgggccctcatcgcgggcacccaataa

SEQ ID NO: 7113 - DNA, 360 bp, Methylobacterium sp.
atgacgacccgcctctgcatcgtcggcgggggccccgcccggacgatggccggcctgctcttcgtccgcgcgagcctcgacgtcaccgttctggagacgcacgcggacttcctgcgcgacttccggggcgagaccatccacccctccggccgatggacgagccgggcttcaccgagcgcttccgcgccctcccccaggcagtcccgcgtgatcgccgcgtcgctggcggccgacgtgccggtccgggcgccgctcgccctgcgcctcttcgacgccctgccgcggcttcaggtccttccggcgctgaggatcgggatggatgtgcggcccgagcacgtgcgcgtgtcgctgcgggcctga

SEQ ID NO: 7114 - DNA, 90 bp, Methylobacterium sp.
gtgcgggcaccgaacaggccggagtggcccggcccgatgaacgaggaggagcgcgccgccctgaaggccggctggagcttcgtcgagtga

SEQ ID NO: 7115 - DNA, 768 bp, Methylobacterium sp.
atggcttcccgtcctgcgaagggtgtggactgggccgcgatggcgcctgagaccgctgacctgattcgtcaggctggtacgcggatcaccgagcgccgcgacaaccgtctcggtgttaagcgggattggctccgtgacggctttgacatcgctcgcatccgcgaggctgctccgcatggcaccttccacctgcttatcgccgagctgacaccctacgttccccatcacgcgagggaccttgcccgtgcggccgacatgctggccgaggcggttaaaacggagattatctcccaaattcccgatgcccccgcgacggtctgcgtcgagctggcgaaaccggcgacgccgcagcacgtccgcgataagttcctgccgctggttctggccggcgagcgtgtgcgggtcacggacatcaaggccgcctgcaaccctgaggcggaccaggaggtgactcctgatgttcccgtcgaggtgcccgttgtccccgcgcgtgacgtggtggaagcggtcgactcgatgtcggacacggcgttcaggacggtcatcgccgccctgaccaaggggcgcaccgaggaactggtccgggccctggagtggcgagcggccaagcccgccgtcccgcatgccgataggatcgccgaaaaggccaaggccgccgttcggaccctgccgctcttggaaggggtgctgcccgaagagacggtggttgccccaaccgctgacgacgacggcgcgtctgacgcggccgacgctccgagcctgcactag

SEQ ID NO: 7116 - DNA, 360 bp, Methylobacterium sp.
atggagcgcaagagccggcacttcagaacgttcgccgacgacatgaagcaattcgccgatttctcggacgtcgctgaccgcgacctcgacggccggacaccgctcctgccgaacggctacttcagctacggcgacgcattggccctgacgactgtcctcgccacacgcaggccagcccagtatgtcgaggtcggaagcggcaacagtacgaaattcgctcgccgcgcaatcggcaagtacaagctcgacaccaagatcgagtgcatcaacccaatccgcgctcaagcgtccgcgacattgcggataagtggatttctaacggcctcctcgatgttgacccgtcctactttcaatcgctga

SEQ ID NO: 7117 - DNA, 150 bp, Methylobacterium sp.
gtgaagcagggcatcggcagcgcgactggcaacgacaagctgaaggccgagggtaaggcgcaggaactgaagggcgaagcccagaagacgaccgggaacgtcaaggacggcgccaagcacgtggccgacaagctcaccggcaaagtttga

SEQ ID NO: 7118 - DNA, 879 bp, Methylobacterium sp.
atgacagctctcgagaccatccacggggccgacgcgctccacccgaggctcggcgagaccgttctcggagcgccccaccgcatcggctcgaacttctccgcggcgcacttctccgaggaagccttcgacgggcgcatggacccgctcctgatggtcgaccacttcgtcatgaccgggccgaccttcgagccgcacctccatgccggcatctcggccgtgaccgtcatgttcgaggacgcgaccggccacttcctcaaccgggacacgctgggccgagacgtcgccctcgagccgggcgacctctactggctcgcggcggcgtcgggcgccgcgcacgaggagaggccggccgaaggggcacgggtccacgccctgcaggtcttcgtcaatctgcccgcgcgcctcaaggcgcagccggcgcgcgcgctgcacgttcgcgcggccgacatcccggtcctcgaaggccgcggccatcgcgtccgcgtcgtcctggggcagagcggcgacgttgttggcgcgggtggcaccccggaggagatgacactgctcgacggcttcctacagccgggcggcgccttcgcccacgccctgcccgaggggcggcaagcctggatctacgccgtgtcggggcgcgtgtccgtccgctgccgtgaggaggagcgcctcctgccggagggcggcgccctagcggtgggcgccggttccgccgcggagatcatcctcgaagccgccgaggctgcgcatgtcgtgctgatggccgggcggccgatccgcgagcccttcgtcaagcgcggtccgctggtgatgtccacggtcgccgacgtcgagcgcgcgctcgccggctacgcccggggcgcgttcggccgcatcccggcctga

SEQ ID NO: 7119 - DNA, 102 bp, Methylobacterium sp.
ttggacgccgggatccggcatccggtggcgctcgcggcggatggggaccggccccggctccgcaccccctcgaccgaccccgccgagatcgcccgcgcctag

SEQ ID NO: 7120 - DNA, 912 bp, Methylobacterium sp.
gtgctcgacctgaacgacttcttctacttcgtgcaggtcgtcgatcgcggcggcttcacggccgccgggcggacgctgcgcgtgccgaaatccactttgagccaccgcctccagcagctggaggccgccctcggcgtccggctgttgaaccggacctcgcgccggttcggcatgacggatgcgggggaggacttctaccgccacgcggtcgcgatgctcagagaggcggagctggcggagacgacgatccgccagcgcctgacggagccgaccggcacggtgcggtgcacggccggcatcgcgaccatgcagttcgccctggcggacatcatcgcggacttcctcgtccgccacccgaaggtgaatgtcgtggcccacggcgcggaccgcaccgtcgacatcgtcggcgagaacttcgacatcgccgtgcgggcccatacggacccgctgccggactcgaacctcgtccagcgtaccctggcgccggcgccctggttcctgttcgcgggatcggcatacctcgacgagaacggcgctccggacaatccggacgcccttcgggaccatccgtccctgttcatgatgcggaccggggtcgcgccggtctggcggctgcggcacgcgagccgcgccggggacgaggcggtactgccgttgagcccgcggctgatgggcgatgacatggtcgggctgcagcaggccgccatccgcggcatcggcgtggtcgctctgccgagctacatctgtcgtcaggccgtccgctcgggtgccctgcggcgcgttctgcccgactgggtcgcgggcgactccaccctgacggccctcattccctaccgccaaggcctgcttccgtccgtgcgggccttcctcgaccacctcgcggcggagtttccgaaggccgtgctgctctag

SEQ ID NO: 7121 - DNA, 114 bp, Methylobacterium sp.
atgaccaccatcatcgcacgactgctgatcgtcatcagcgtgatcggcgccatcgcctgcgcgccgatgctgacgcccgcatccgcagccggtctcctcgcgcagacgaggtga

SEQ ID NO: 7122 - DNA, 90 bp, Methylobacterium sp.
atgggcatgcagtccgtcatcctgctggtcatcgccggcaacttcgcctgcgccttcctcatcccgtatctggcgatgaccggagcctga

SEQ ID NO: 7123 - DNA, 249 bp, Methylobacterium sp.
gtggcgaccacgatcgcggcggcggtggagcagcagggcgcggcgacccgcgagatcgtccgcaacgtcggtcaggcggcgcagggcgcggccgcggtcaccggccacgtcgccggcgtcgccgcggcctccggcgcgaccgaggcggcggcgggcgaggtcctgggcgcggccgccgccctgtcggcccaggccgcgcacctgaccgaagaggtcggccgcttcctcgacggcgtccgggccgcctga

SEQ ID NO: 7124 - DNA, 189 bp, Methylobacterium sp.
atggctgaggcggccgtccggcaggcgacctacgcggatctggaggccgtcctcgcgcatcgcgtcgccgcgaaggtcgacggggcgccggacccgcgtccgcggccgccttacgacgccgtccctttccccctcgacgacctcttccccttcgacgatccggccgccccggccttgcccgagacctga

SEQ ID NO: 7125 - DNA, 207 bp, Methylobacterium sp.
atgcagagcgacatcgccgaggtgaagcgcgatgtcgcagcgatcaagacgaccctgacgggtcataccgagaagctcgaggaattggagatctacgtcgcctacgaaaccggcctcggcacgcaggcgaaggcggatctccaatcgatcaagaagacgatcaaggccatggagcagcggctgagcgcgctggagacctcgtcctga

SEQ ID NO: 7126 - DNA, 768 bp, Methylobacterium sp.
atgaacggatacccgacatgccgctgcaggaagccccgaggtcgcccatccgcggcggtcgcatcgcgatcgccggcctcggcaccgtcgggctggccgtggcgcgcgctcgatgcgggcgccatatcggggctgaggctgaccgccgtcgcggttcacgatgccgccagagcccgggccgccctcgcggcgctcgcggagccgccggaggtcgtcaccgcgttcgacgccctggagccgcgggccgacatcgtgctggaatgcgcgccgtcccagcatctcccggcgatcgtgcggcccttcgtggcggcggggaagaccgcgatcgtgctgagctgcggcgcgctcctcgatcacgaggacctcgtggcgacggcccgcgcccacggcggtcagatcgtcgtcccgaccggcgcgctgctcggcctcgacgccgtgacggccgccgcggagggtactatccgcacggtgcggatgatcacccgcaagcccgtgcgcggcctcgtcggcgcgccctacctcgcggagaacggcatcgagatcggcggcatcaccgagccgatgcgcatctttgccggcagcccccgcgaggcggcccgcggcttcccggcgaatttcaacgtcgcggtcgcgctctcgctggccggcatcggtcccgaccggaccgagctcgagatctgggccgaccccggcctggagcgcaacacgcaccgcatcgaggtggaggccgacgccgcgcgcttcgcgatgacatcgagaacgtcctga

SEQ ID NO: 7127 - DNA, 435 bp, Methylobacterium sp.
gtgggggacatcatgcgcgcgtggctggtggcaggtgtggcgttctctacacttgtgggtagcatcgacaccgtcgaggcgcgcgggcgcgggcgtctgttcttcgggcggtcgtcgacggcgcagcgacccgcgtcgcctccgtctgtcgccgcgaccgacacggccccgagcggccgtgccggctaccgtcccatcatcgcgatcgcgccggcccccatcgctgcggccgttcctgcggcggccgcggcagcggtggcgaacacgccggccgaagcgcgcgagccggagcttcggccacagcccaccctcctccgcccgccgcccgaaacgccgcgtgtccaagcggtgcgcgccgtcgccccgagttgcgagaccgggaggcgcgtcggcggcgtcgacagggcggaagccggcttctgcctgatcaactag

SEQ ID NO: 7128 - DNA, 270 bp, Methylobacterium sp.
gtgttcggccagggcgaacacgtctcccagccagagttgcaggcgccagggtacggggtcatcgctgacctcgacaacgtaggcgatgtcgagggccagatgcgccaggtgggtctggtgttcatccgcgtggccttgttgggcggtatagcggtccgagtccacactgtgggccggtgcccctccatcatctcccgcactacgacggcgccgcaagtcggcgaagtcgtgtgcaccacggccgcagctgagtggaacagccagtggtaa

SEQ ID NO: 7129 - DNA, 93 bp, Methylobacterium sp.
atgcagcacacggcccaggacaaggcccggaacatggcccgggacatggcccgacgggcggatccgctccgcgccggatcgttctccgcatga

SEQ ID NO: 7130 - DNA, 198 bp, Methylobacterium sp.
gtgaccgagcttgagagcgttgagcgcgacatcgccttgctgcgggcgcgcgtccgttattcaaggctcgcgatagcggaccccaacatcacgccggaggccatagaccgtgagcacgccgggctcgatctattcggccggcgcctctgcgcgcttctgacgttgcgggacgatctacgcttcttggcagaggactaa

SEQ ID NO: 7131 - DNA, 696 bp, Methylobacterium sp.
atggtcgttgggttcgccttactcattctcgccggcttagccgctgccgctgccgctctggccagcgcggatgctgatgcgtgggccgtgcactccgctgaagtgcggcgagccgaggcgcgtctatctcggctcattcaagaggcggaaacaggccagcgcggcttcctgctcaccggcgacctgacttacctcgacccgttcacgaccgctcgccgcgagttgccggctgccgaggcggagctgcggtacctcacgggtgacaacgcagagcaacaagctcggttagatcaagtccgacccatcatcagtgagaaagttgccgaactcgcacgaacgaccgaacgcatgcaggcgggggaccaagcgggagcgctcgccatcgtgcgtaccaacgccggacgcgacctgatgaggcgtatccgggcgaccgtcgccgagtttgatcgagcagagatagaactgcaggctacacgcgccgaacgagctgcattccgccggtcgatcctagttgcggttattgttatcgccctgtttctagctgcagccctcgcctggctattcattaggaccgaccggcatcgcacccgccaacttcggtccgcgaacgatgcgctccgcgatgagatcctgcagcgcgagcgagccgaggcacagctacacgcgcaacgccttcttcaacaacgggaagcttga

SEQ ID NO: 7132 - DNA, 243 bp, Methylobacterium sp.
atggagatcgtcatgaagctgcacttgctcgccgctgtcgccctggttgccgtcgccacccccgctctggcgcaggggatcgacagcaagcacagcccctacccggcttccgcttactcgggctacgccggcaatgcctcggtggtcctgccggagatctcggtgacccactatcggccggcgctcgcctaccggtactctggccagcacgcaggtggcccggccgacgccctcgcccgctaa

SEQ ID NO: 7133 - DNA, 228 bp, Methylobacterium sp.
atgaccctggccgacctcgacaagcccgccgaactcaccgtgtggcctggccatgcgccggctcacgtcgccgacgctcgcagcttctcgacactgcgcgcggcgctggccgctgcagccgaggcgatcgacgctgaggacgccaagccctggatcatcaccgagagcggcgacatcctggcgcccaactggatcagggccaacaccggctcgtctcgcctgcaataa

SEQ ID NO: 7134 - DNA, 183 bp, Methylobacterium sp.
gtggtcaacatgtcgatcgcaatccttatggctttggtcgcaggtgcgctatgcctcggcatgctctcggcattcgtgcagctgagaccgaaggcagacgagggcgaggacgcgccgttcgggttcgaggatgagtttttcgatctcggcggtccggtgatcgacatggagccgagccgctga

SEQ ID NO: 7135 - DNA, 255 bp, Methylobacterium sp.
atgaccccgcgagagcaagccgccttcgccgccggcatcgagaccgctcgccagatggcgctcactgctgcggtgacgatcgaggttcggggggacggcgttgcgctacatgggcggatgcaccgagtgcttcacggtgtggtgggcgtgccgatgccccttgcggtgcgaggaatgcggctgtggctaccgagcggacggcgcgagcacctgcggcacgccgggttgcgagacagggcagcgccggatccgtga

SEQ ID NO: 7136 - DNA, 288 bp, Methylobacterium sp.
atgcgcagcgatcacctcgttgcagaccatgcgagctcagaggacatcgcgagttcgcccgccttcgcgcgcgccccggaggggaatggctgcgccgagcgcttcatccgcaccctcaaggagaacctgttgtgggtcgagcacttcgatacggtcgaggatctgcgccacgcgctgctggcgttccgggatctctacaatgagacgtggctgatcgagcgacacgggttccggccaccggccgatatccgcgccgcgcagcttctacccgcggccatcgccgcgtag

SEQ ID NO: 7137 - DNA, 486 bp, Methylobacterium sp.
gtggctcgctactgcgagagtgccgccgaattgctagccggtaacgcgagccttgccgggcgcgacctcagcatgagcgaagccctggcgggggtgtacaccgacgatgtcgcttggcttcgctcgcagatgcgacaggctgtgtcgggatcggacgtgcgaatacgcgagcatcgggtatgctcggaacagcacggtgtgcgccgcgtcctgtgccgcggtcgaacctacttcgatgtacaggggcgcccgaccttcacgttgggcatcgtgatcgacatcaccgaggtggaggcggatggccgccgtcgccatgccgacggcccggacaagctcgatgcggcggcagagcacggtgtcgccgcttacgaggccattcaggcggcggagatcgaaggccttatcgcgccagcgcgagctctgctgctggcaattgggcgtgagatcgcccgcggcctgacgagggggcggaagcccttgcattga

SEQ ID NO: 7138 - DNA, 108 bp, Methylobacterium sp.
atgtgttcgagcgcgaagttcaggctggacgaggcgatcacgcgccagatcgtcgaggaagtcgccgtcaacgtgttgatgcggatggatgaggagcagctgatctag

SEQ ID NO: 7139 - DNA, 450 bp, Methylobacterium sp.
atgaccgaagaaacctttgatcgcgtgccgaacggcatcgaactggccggtgatatcgtggccgcttacgtctcgaacaatcccgtcccggttgccgagcttccgagcctgatccggagtgtgcacagtgcgatctccggactgacttccgctagcgcatccgtcgcggccgcccccggggccgcctccgaggccgcgatcaacaagccgagcgcgtcccagatccgaaagtcggttcgtgacgacgggatcgtcagcttcatcgacggcaagacctacaagacgttgaagcgccatctgaccagccacggcctagatccgcgcagctaccgggaccgctacggcctgccggccgactatccgatggtcgccccgagctacgccgagcagcgctccaccctcgccaaggcgatcggcctcggcgtcccgggcgggcgcggcgcggcatag

SEQ ID NO: 7140 - DNA, 153 bp, Methylobacterium sp.
atgctcggtccccggcatattccggcgtggttcgccgccgtgatccttgatgaggttggagcgttccgggtcgcccttcaaattggcgacctgcttccgagcagccaatgcgaggaaaccgacaccgccgatcgtgccgagcgcgagaaataa

SEQ ID NO: 7141 - DNA, 162 bp, Methylobacterium sp.
atgatcgcgcttgagacgttcccgatcctcgactctgccccgccgcccgatctgatcacgggccggcggggcttggtgctgttcctcacggtcggggccggtacgcgacgcggcccgagatgcaggatgggggagggcggttggctgcgcctcaacgcttga

SEQ ID NO: 7142 - DNA, 156 bp, Methylobacterium sp.
atgttagcttccgatctggcctaccacgcgctcgatctcgtctacagcggccttgatcgtttcggacagcttctgcagatcctcgacttttacgcggccaggtttttccttcgtccaccaaatgccgtcgtcgatcacgcccagcacgcgacctag

SEQ ID NO: 7143 - DNA, 453 bp, Methylobacterium sp.
atggctggccgcaccttcgacgaatggaccgtgggcgatacaatccatcacgacatccgtcgcacggtcacggaaaccgacaacatcctgatcacgacgctgacccacaacccgcagccgcttcatctcgacgccgagtatgcagccgagaccgaattcggccgggtcgtcgtgaacggcacgttcacgttcgccctgatggtcgggatctcggtcggcgagacgacgctcggcacactggtggccaatctcggctacgacaaacttgtcatgccgaagccggttttcgtcggcgacacgctccggatcgagacgatggttgcggatctgcggccatcgaagtcccgccctgaggcgggcatcgtcgtcttcgagcatctcgctcgcaaccagcgcgacgagatcgtctgccgatgcctgcggacggcgctcgtgaagcggagcgtcgcgtga

SEQ ID NO: 7144 - DNA, 123 bp, Methylobacterium sp.
atgttcgccccggccctcacgctcgcgctcctgctcgccaccggactggtcaccggtctcgggttggtgatccgcgcggagacgacggcctccggcaccgcgccggggcgcggactgatctga

SEQ ID NO: 7145 - DNA, 123 bp, Methylobacterium sp.
atgagcccgcacgactacacgtggctcctgtttgcgacgcccgcggccgtcgccctgctcggcgccttcgtctatgtcgcgattggtcttcaggaccggatcgacggccgctgcgaccggtag

SEQ ID NO: 7146 - DNA, 432 bp, Methylobacterium sp.
atgccgtcagtcggagcgggagccatccaccccatctgcttttctcgcggaccttcacggaagaccaacccgaagctcggcctgctgttcatcgacttcgagacgccgcaccgcctgcgcctccacggcacggcgcggatcgcccgcgacgcgagggacctggaacgtcatcctggcgccgagctggtgctcaagatcgatatcgccgaggtgttcgtgaactgcccgcgctacatccaccgttaccgtcgggaggctgcgtcaggcttcgtgccggggcgggcacgagcgggcgaggtcccggcctggaagaggatcgatctgttcgcggatgttctgcccgaccgcgatcggcgagcgatcgacccgcgcgacaccgggacaatgaccctggccgattaccgcctgctgttggagcgtggggaaacctga

SEQ ID NO: 7147 - DNA, 123 bp, Methylobacterium sp.
atggccgcgcgggcgcggctcgggtcgatcacggcgacggtgagattggtttcagtcatcgtggcccggtacggggcgggtcttcttctcgaggccggcccggcgcgggccgccgcgagctaa

SEQ ID NO: 7148 - DNA, 786 bp, Methylobacterium sp.
atgtcgcccgaggtgtcgcccgagatctccgcgggcgcgaccgggccgggcgcgcggcgggggacctggccggaccgccggccgggatcgctgatcgcccgcctctttggtcccgacgccgacgacgcgctgccgagccgctaccgcctgcaggtgcgggcggggctcctcgacgagacgctgaagctcgccacctactcggcggtgacgcacctgatcatcgcgctggccgtcgcgtacttcttctggggttcggcctcgcacacctacctcctcggcctgctcgccgtggtcgcggtgctgatcacggcggcgacctacgcgacctggctctactggcgcactcacggcgacaccgcctcggcgcacaccgtccggtggggctgccggatctccgccggcctcgccttcgccctgggcctcgcctgggcgaccctgccggtcgtgctgttcgccccctccggcggcgacgcgcggctgctcgtcgtcgccatcgtggccggcctgatctcggacgcctacgtggtcggcccgctcctgtcggtctcgtacctgttcgcggtcccggtcatcgtcggcagcttcgtcgggctggcccggtccggggagccagtcgcgctcagcatcggcttcctgctcgccgtctacgcgatcttcgtggtgacgagcgtgagccgcatgagccgcctgtcgcgccagcgcatcctcgaccgcgtgcgggtcgaggaccagagcgagacgatcgggctgctgctcaacgccttcgaggcgaatgccagcgactaa

SEQ ID NO: 7149 - DNA, 2271 bp, Methylobacterium sp.
atgctagaccaatcttttccgcgtgacacggcagaggcaatcagcgacggtgccttgagggcggcaccggatgcgctccgcggcctgcgcgtggcggtagtcgcgagcagcgcctcgaccacgcagcggttcgaggggtcgccggccggcacggccgcgcacgtggtgtccctgttcagcctcatccaggccgagacgatcctaatcgagtacgggcgagcgacgccgcaggagcgccaagagcggatgacgctgtggcgcgcgcgcggcctaggatacattacgataaatatgctcgatcagcttcccgccgatcggccggagctgcggtcgtacttcctgtaccagacgctcaaagagtacgatttcgacatcatcgttttcctggatcagggcggcgccggctattattgcgccctggccaaacggcagggtctggctttctctaactgtatgatcgcggtcatcggtaccgaacttcaccaggtcgacggccgtttctacctgccatcttccgctctcgatttgacgtccgattttctcgagcgttcgaccatcgagcaggccgacgcgtactggcccacgacgcccgccatcgcggacagccttcgggccgccggctgggccttgccgcgtgacacggctgttcggcccgagatcctgctcaacctcgacctcgtctccgaagcccgaaattcccggccgagttccgacccgcacgtggtcatctgctatgtctccgaacagccctacgcggacgatttcgtcgatttccttaggtcgaccagcgagctgttccagtccttcggcgaggatgttcgccagctcgggacgcccctcgtcctcgtgtgcggtctaccggtctcacctcttgagcgcgctgcgctggcggccttcgcggaacagatgcgcgacctgtccgtcaggtgggagctctccgacaccatctcttggcggcagctgcgcgccttcgcgcagaacggccgcgtgttgagcatcgtcggcggctcgggatccgccttcgcctgtgcccagctcgcccaagccggatccgtcgtgctgatgcgcgattcggagcggatgcatggcctgttcgacttctcgcgccgggtccacacgacgttcgcgctcgggaggtgcaacctcgtcgaggcgatgcgcgcgatgctgcaggggcccgatgacgtcgccagcgtcaggccgcgcgcgccggaccatgcccgcgccgcctggtccgccgccgtccagacgctcgtcgccacgccctccgcactggaggccgcaaccgcgcagacatcccccgacgaagctggcctttccgcgccggcgattctcaaggctggcgtggccgtctccgtgtgcatgccgaccttcaatcgggtcgaggagttgcgcgaggccgtcaactcgctggagaaccagaccgacgggaacttcgaactgatcttggtggatgacggcagcaccgccgatgcggctctggccgcgcaggccgagatcgtggcctcgtcgtccttctcctgccggaggttcgaacaggccaatgccggtcccagcgtggcgcgcaatctcgcggccgagcatgccgcgggcgagtacctgctgttcatggacgatgacaacgtcgcgacgcccaacgccgtcgagattttccggcgcagcgctactgcgagcggtgcggacttcctgacctgcgttgccggtattcacccgtcctccgagtggggcctgtccggctcgctcgagacgttctacgtcaaggaggtgggctccgattgccggttctggggaccaccggtggggccgaacgccagcgtcggcttgctgttcaattgcttcggtgattgtaactcgctggtgaggaagacgtcgttcctgtctttaggcgggttcaagtcgttcatgtatgaggatcttgagctcttcatgcgtgccgcgctggaaggcgcaaaagtgacggtgatcccggagatcctgtatctctaccggttccatcgcgcgtcgcggtcgcggacggagcgcctgctcgaggcctgcatcgaatcggttcagccggctctcgcccgcgtccatcctgccctgcactcgaccatcttgatggcgcgctcgcggatgctaagcgaggtcgtgaacgaccgtttccgcgtgctggaggccggcgtcgtgccaccgtcgggattcgatggctctcttgccgccttcctttggcagatcggcgcgaatgcgcaggccgatgcgatccatcagttcgaccagagggggcggcgttga

SEQ ID NO: 7150 - DNA, 111 bp, Methylobacterium sp.
ttgatcgtcttgtacggcttgccgtcctcgaagctgatttacgcctcgtgcctaatcgacgctcggatctgggccggtgtaacccttctgcttcccgacacggccgactga

SEQ ID NO: 7151 - DNA, 588 bp, Methylobacterium sp.
gtgaagcgccaccccaaactatttgtcgaccagcgccctagggaccgcgtcgccgacctcatcgaggagggcattgacgtggcggtccgcgtgggcgaactgcccggctcccgcttgctctcccggcgtctcgcgccgcatcggctctgcgctttcgcgtcccaaatctacctagagcagcgcgggacaccgcagcatccggacgaccacatccaccacgaccgcttgaatttccgcttccagagtgcgggccaggctttgcgctggccgttccggatcggcggccgcgcggttgatctcacgccgaacgccggcggcgtcgcagacttcagcgatgcggtcgcggccatcctcgtggtcggcggcatcggcatctcgctgtcgtatgtcgtcgcgttccacgtcgagcgaggtgcgctggtgcctgtcctgcggaagttttctgtcgagcgttccgtcgtcaccgcgttgcggccggagagccgacacggcaaccagaatatgaacgccttcccggctttcctcggaggtatgtttcattccccaacacctcgggacaagctgctcaaaagtccagcggggaagtaa

SEQ ID NO: 7152 - DNA, 471 bp, Methylobacterium sp.
atgttcggtattgggggcgcacgtagggatatttcattcacattcgacgccctcgaccggtctcaggccgtcatcgagttcgagccggacggcaccatcatcacggccaacgccaatttcctgacgatgatgggctacgccctgcccgacatccggggccagcgccacgccctgttcgtggaggcggcgcatcgggagacacccgcgtaccacgccttctgggacgccctgcggcagggcacccatcaggtcgccgagttcaagcggatcgcccagggcggccggtacgtctgggtccaggcgagctacaacccggtgctcgaccgctccggccgcgtcgtgaaggtggtcaaagtcgcgtccgacgtcacggcgcagaagctgcagatgctcgactatgccggtcagatcgcggcgctgcaccggtcgcaggcggtgatcgccttcgatccgaccggcacgatcctgtag

SEQ ID NO: 7153 - DNA, 267 bp, Methylobacterium sp.
ttgagccagtttgggcgcctgagtgccgatctggcagccgcacacgcgcgcggggagcatctcggctcgcgggtgccgtacatccatgcaggcagtgagaggcttctggagctgagccgtgcgttccagggtgccctcgacgggctggatcgatcgctgaccgaggtcggcctgttggatccggcaacgtgtgaagcgctgcggtgcctcgtcggtgcggtcgagaggctcgccggtacggcgcagcggtttccggccaacgcctga

SEQ ID NO: 7154 - DNA, 648 bp, Methylobacterium sp.
atgacgctgccaatcgacctttacaccgaggtcacttgtccctggtgcatcatcggacaccatcgtctcgacaaggtcctggcggagcgtttccccgagctcgacgtagacatccgtcagcatccggtcctcctgcttcccgatgcgcccgcggagggcctgcacattcccgaccttctccgctcgcgctatggcgtgaccgacccgaaggtgtcgtccgcccggcccgaggcggaggcgcgggcgtccggcctcgacctagacctgagccgccaagcctggacctacaggacgcaggcggcgcacgggctgatcctcgcggcgcgggaacgcggtacgcagcaccggctcgcagtcgcgattaccggtgcccatttcctcgaagccaagaacatctcggacgccgatatcctcgccgatatcgccgtggcctacgggttcgagcgtcaggaagcccgcgcgctggcgttcgatcccgcgcagcaccgacgcgtcgagcaggaggcggcccggtcggcagccgccggggtcaggtcggtccctcactttgtcttcggaggccgcttcgccgttagcgggggacgcagtgaggaggagatagccttggccatccaacaggccacgggtggggctacgaccaaccattag

SEQ ID NO: 7155 - DNA, 177 bp, Methylobacterium sp.
atgatccggaccgggcgcctcgcacgttccctcggccccgcgcggcgttgcaccgtccacgacctgtatgacgacatcgcgccggcggagctgccggacctcatcgtcggcgacgtcgccgggctgacttcggagccgctgcgcgcgaccggcgccctgtttctgtttctcacctga

SEQ ID NO: 7156 - DNA, 123 bp, Methylobacterium sp.
atggatctctcgctccatgagcttgggctgcaggatgctgccacgatcgaagccttgcgaagcttcgtgagcgcggcagaggagctcgccaactcgacgcagcggtttccgcccactctgtga

SEQ ID NO: 7157 - DNA, 399 bp, Methylobacterium sp.
atgacggcgaacctcgtggcggcctacgtgtctcacaatcgcgtcgcagcctcggagatgccggcgctgatcgcgacggcggccgctgccctgaccggccttcagcccaccgatccgtcgaccgcggatggagacaggaaagcgacaccgaagatggtccgggcgtcgatcacacgcgaggcactgatcagcttcgaggatggtaagcggtacaagacgatcaagcggcatctgaccgcctgtggtttgacgccggagacgtaccgggcgaagtggggcctgccgaacgactacccgatggtcgctcctgcctacgcggcgaagcgatccaggatcgccaggagcttggcgcagggtcggtcccagcgcgatcccggtccggaaactgcagccggatag

SEQ ID NO: 7158 - DNA, 204 bp, Methylobacterium sp.
atgagcagcacgaccgacaagatcgagggcctggccaacgaggcggtgggcaacgtcaagcaggcggccggcaaggcgacgggcaacgacaagctggtggccgagggcaaggcgcaggagctgaagggcgaggcgcagaagaccgtcggcgacgtcaaggacggcgccaagtccgtcgccgacaagatcatcggcaagcactga

SEQ ID NO: 7159 - DNA, 123 bp, Methylobacterium sp.
gtgcgctccttcacggtcgtggtggcggtcgtactcgtcggtcgagaggtccggtcgggcgcgcggcccaccgggatagacggcccccgcatgcacgcgggggccgaggggatcaccgggtga

SEQ ID NO: 7160 - DNA, 168 bp, Methylobacterium sp.
atgaccgagttgcgcctggatatacgagatgacgggatcggacgcgccggccggatcgcgctcttcgacagcgggcttcacggtgaagctctgggctcgatggggtggagacagcgtcgcgacgggcacgacatctcgcgggagggctgcgaacttatctctggttga

SEQ ID NO: 7161 - DNA, 129 bp, Methylobacterium sp.
atgatggttcggttttcgacggccgcgatggcgcggccgatgcggctcggaagcctgatggtctcgctcggtcggatgccgcattgtccggtcgccgagaccctggtcgcgagccaccggcggacctga

SEQ ID NO: 7162 - DNA, 216 bp, Methylobacterium sp.
ttgcgcgaccatgtcgggcgcgcctccgccgagtcgaaccgcgcctccgacctcgtggcgctgcggccggcgcgattcctgagcgcccatccggatttcggggtgcgggtcgccgcccgcatggactatgcccacctcatcaccgacgcgttcgacgccgacaacgtctcaggatcaccccgcggcgaaaatttaatgcggatgccgctgggttag

SEQ ID NO: 7163 - DNA, 129 bp, Methylobacterium sp.
gtgggactcggcgcggtcaagctcggtctcccgacgggggcgcggcgccccggcatgaaccgcgctccgcgcctgaccggatccgcggcggcgcgcaaccccggcccgctcccggcgccggatcgctaa

SEQ ID NO: 7164 - DNA, 627 bp, Methylobacterium sp.
atgattgacacccagaaggaggatcaccgccgcgaagaacttgggtccctctacgtcatcacggcgcatgaattcaatcatgtcgcgagatcgacgtcgatagacaggaggtttttcgacagagacctccccgcgaaattctatttcgtcgataaaaccggcgcgccacgcgattttcggagcgcgtacatcgaggaacgcatcctcaatcccagcatcattgacgccgggagcagatttatcgcggaatggtcgttccttctcaccgaattcgagaagcctttcgcgcagtatccgttcttcgtcgtgtcgtcacggttcttcgagaagaatctgtccctacccctggagcttcagacgttgctggcgttcgccttcccgtgcctgaagtgttacggatggggatatctaccttcgtacgatcgaaaggccaattttcaagatctccaattctacaaggaagttggctatctcggcatcaaggatgagggaatcgcttttctcgacgggctgtacggcgtgcgcttcgtcgatcagtaccgcatgatttccgacttttctgcaactatatcggcttccaatcgcgtgaacatcttatcgagtacgtcaaattctatcttccattga

SEQ ID NO: 7165 - DNA, 129 bp, Methylobacterium sp.
atggcgtcccatctgttcttctacaagaataatctgaggttctgtggcgtcagctacgacggcattcacgaagtcgacgagcgcgaaacgatcatgaggccgatcataacgtgggatcaggcgggatga

SEQ ID NO: 7166 - DNA, 135 bp, Methylobacterium sp.
atgctccaagtcggtggtcgtgagtgctttgacgaggcgaagatacgtctcctgcgcggcgtcggctgcgtcggcagggttcccgagtttgcgaagaaggaaccgctggaggttcaggttctcactgcgatgtag

SEQ ID NO: 7167 - DNA, 228 bp, Methylobacterium sp.
atggcccaggatcagagcggcggcgcgaacccctcggcggcggaacgggcggcggccgagcgcgtcgcccgcaagcgcctcggtccggacggctgcccggaaccggcacccgaccggcgatcgccgtccggacaggcccgccggagcgaggccgcggcgccggaccgccgggcgcctccggggcggccggtcgcgacgcgccaccggcccgagaggcttcccgagtag

SEQ ID NO: 7168 - DNA, 453 bp, Methylobacterium sp.
gtgtacgtcgactgcgccacctgcaagcgctcgggccgctataccgtggtcagcctgatcggtcgctacggggccgacatctcgacgctcgacctgctccggcacctgacggccgcgtgccgctatcagcgcgcccgggtgccgcttacgcggaagtacgagcacctgtgtctggccgcgatcacgctgccgccggccgccaagcagatcccgcccgtgccgccgggtgtgccctacacggtcgagatctggcgagagaccagcggcaatgtcgagctgcacctcgcgacgatctacccgctgtcgatggccgaggcggcgttcgatgcagcctgcctggaatggccgacgcacgaggtcacccttcgggaccgcgcgcgggtcatcgtgaggcgggagaggccaccgcgctgggcgctgtctcggcgcaccaaagccgccacatctcgctaa

SEQ ID NO: 7169 - DNA, 255 bp, Methylobacterium sp.
atgaaggaccgcacgggcatgatcgctcaagagcgtggcgatgaggccaagattgtaatgcgccgctgcgtgtcccggatcgagatcaaggcatcgtctgtaatgctgatcggcttcgtgcaggcgcccggcggcatgatgggcggtggccatattgagaatgggtcccaccaaagccttcggctcccgcaggggctcgccccggctcatcgcaagtccttccgacgtcacggcaccatcggtcaacatgcttaa

SEQ ID NO: 7170 - DNA, 465 bp, Methylobacterium sp.
atgccggcgcttctgtccgcgatccatggcgcgctcaacggcttgaacaaccccgccgctccggccgaggctaaggtcgaccgcgccactccgagccagatccggaagtcgatcagcaacgacgcgctgatcagcttcgaggatggcaagtcgtacaagaccctgaagcggcacctcaaaggagtgggccttaccccggacgaatatcgggcgaagtggggcctgccggtcgactatcctatgaccgccccgagctactccgagatgcgctcggccctggcgaagaacaccggcctcggcaacctgcgcaggaacgcagccccgaaggctgccgtcaccgacgagaaagttgcggaggcgcccaaggcccgaggccggaagaaggtggccgagcctgcggtcgcgccggccgggaagcctgtccgcgctcgcaaggcgaagaaggctgctgtcgccgcggagtga

SEQ ID NO: 7171 - DNA, 237 bp, Methylobacterium sp.
gtgcgcctcgtcgacaacatcgaatgcgtcctgaagcacgcgtggacggtccgcctcctcgtgctcacgaccgtcctcgacgcggcccaggccagcgtctcgttcttcgccggcaccgagctcgtctcggcccccgtgctcgcctccctcaatgtcggcctgtcggtcgcggcgctcggcgcccgcctggtggcccaggagaaggtgtcgggcccggccacggggggtgacgcctga

SEQ ID NO: 7172 - DNA, 513 bp, Methylobacterium sp.
atgacctcagatcccggccgcaccgcctactacgcgcgcttcgcatacgcccggccacgcgagttcgactcgtgggacagcctgacaccggaggtgcgtgccatctgggcacaggtggaggtcgcggtcctcaccggcgctagctctggcattcaccccggccaagctcgggaggtcgccgacgatccggatcggccctccaccatctcaacggcggccatagtcccgtccgtggtggctggtgagaccttcgtggttatccaagacgagcacgtgcaactgcttcagcgcattgaccgcggcccgttcttcgtgccgctcctcgagctcgcatacgtgaagctcatcccatggaacggtgacacgctcatcccgcgtctggtgagctgcggctgggctgagatggcgccgcgcgagtcgcgcgcagtccgaatcaccgacgctggccggcaggcattggccgatctcgacgaagctaggctgaaggggcagggagggggcagtgtcgcgtga

SEQ ID NO: 7173 - DNA, 336 bp, Methylobacterium sp.
gtgcgaaccgccttcggcgcgctcgcgctcctcgcggcgggcgcgacggcggcccccgcccagccaagcccgctctcggtgaacgactgcacgctgttacccgatcccggcgccctgcggcgctgcctcgatcaggcggaggggcgcgtcgtcacgccgctgcagccggtcgcgaacccggccttgatcgaccgccccgaacagccggcgcagtccgtgcgcggcgcgcccgccgcgaagcccgcgaccgcgccgccgggcgatttcctcagcaaccgcgggccatccctgcgcagtgcccagccgtcctcccggaacgtcatcgagctcgagtga

SEQ ID NO: 7174 - DNA, 429 bp, Methylobacterium sp.
gtgacccagaacggcacgaatggccaggcacagttccagcagcggggcaatagaaaccaagccaccatcaccgtggacagcaacgtccagaatacgtacgccggcattttccaggacggaaatgacaacaaggcgggcatctatcagcacgatggaagcaaggatgcctacgcggtcgttcgccaggtcggcagcggtaacgaaggctatatcgatcagtacggacagacgaattatgctgcccttcttcaggtgggcaacggcaactacgcgactatcggccaggccggaacggccggtgtgggcgcgtttggctaccagaacggcaacggcaacactggcgcaatcacccagtacggcagctattattccaacgctggctttgctcagatcggcaacggcaacacggcgcgcattacgcaacggtaa

SEQ ID NO: 7175 - DNA, 330 bp, Methylobacterium sp.
atgccgatcatgcccagcttcaccgtcgatccccccgttatctgccgcgttgtcgagaatcgctccgccgacgtggctcgcctgggcctccgcatcgaaacgccgcgccggaccgcaggtcgatacaacctaatcgtgcgcaagatcgacccagccggcaccgccaccatgcagcagggcggcggctttgacctcgccgatggcgacacccgcgaggtcggaaagctgaccatcagcgtccggccggacggccagttgagtgtcgaggcctccgtacacgtggacggccgcagaatcgattgcgcctacgacagcacgcaggatctgtaa

SEQ ID NO: 7176 - DNA, 534 bp, Methylobacterium sp.
ttgttcgttgccgtcccgctcgccgtcgcgagtgcggccggctcagctgcggcgcaggagcgcgtcgcgatcgagcagatccaggcggccgctcagcgccccgctggccctcccgggcgggcgatccaggagagcgactacatcctcggcaatcagtctggcatcctgctgcttaacccgagcggcccgccccagtcggcgcaggccaaccaggcccgcgccctgcagatcggttcgggcaatacgggcacgatcgacatgtcgggctacgcgaacgtggcggtccagaacgtgatcggctcgcgcaacacggtgacacagcagcaggccggatcctacaaccagtcggccgtatcggtcttcggccagtccaacacgatcgggacccagcaagacggcagcggcgcggcggcgaccatcacggtccgcggcgacaacaacgccatctcggcgcagcagcaggggaccaaccccacgccgatcagcatcacgcgggtcggcaacggccccagcgtctcggtcacccagaggtag

SEQ ID NO: 7177 - DNA, 477 bp, Methylobacterium sp.
atgctgcgcggggtcgagcttctcgccaacgcggtgaaggtgacgctcggcccgaaaggccgcaacgtcgtgatcgagaagagtttcggcgccccccgcatcaccaaggacggtgtgacggtcgccaaggagatcgagctcgtcgacaagttcgagaacatgggcgcccagatggtgcgcgaagtggcctcgaagtcgagcgacgctgccggtgacggcaccaccaccgcgaccgtgctggccgcctccatcgtccgggagggcgtgaagtacgtcgccgccggcatgaacccgatggacctgaagcgcggaatcgatctggcggtggccgcggtcgtgaaggatatcggttcacgcgcccgcaaggtcgcctcgtccgacgaggtcgcccaggtcggcacgatctccgccaacggcgacaaggagatcggcgagatgatcgcccacgccatgcagaaggtgggcaacgagggcgtg

SEQ ID NO: 7178 - DNA, 201 bp, Methylobacterium sp.
gtgacacagcccgatgacgcggaactctccgggcaactggtcctcttctacgcggcgataaccacctccgaggacgaggcgctcgccatcgtgcgccgtgccgtcaaggcggacgcagcggtcgagccgacggggggccgcttgtctcagcaaacggccagcgcacttgttctggaagcgggcctcgcgcgggccctctga

SEQ ID NO: 7179 - DNA, 219 bp, Methylobacterium sp.
ttgccgttcgggctgtcccgccggatcaccaggccggccgcgacgagctgggccagcgcgcgccgcagcgtcgccggggacggcccgtgcgaccgcagcgacaattcgcggttcgacgggaagaccacgagcggcgagccgggcgacagcgccgtctcgggatggaacgtgagcagcgcgctcagcaccgcgagggcgcggtccgagacggcgaggtga

SEQ ID NO: 7180 - DNA, 666 bp, Methylobacterium sp.
gtcctcgacgacgcgctgcacccggtgccggtgggggtggtgggcgagctctacatcggcggcaccggcctcgcccgcggctatctcgcacgccccggcctgaccgccgagcgcttcgtgcccgacccgttcggaaggcccggcgcgcgcctctaccgcaccggagaccgcgccgcccgccgccccgacggcgccctcgactaccgcggacgcgccgacgagcaggtcaagatccgcggccagcgcgtcgagcccggcgaggtcgccgccgccctgcgcgcgcagcccggcatcgcccaggccgccgtcctcgcccgccgcaaacccgacggccccgcgcggctcgtggcctacgcggtgccggcgccgggcgcgcaccccgacccgcaggagctgcgccgcgccctggcccgtgacctgcccgacgccctggtgccggccgcgatcgtcctgctcgacgccctgccgctctcgacgagcggcaagctcgacgcccgcgccctgcccgagcccgacgcggacgtgcccgcccgagacgccgacccgccgcgcacggcgaccgagcggcgcctcgccgatctctgggccgcggtgctcggcctgcccggccccgacgccgtcgcccgctccgacaccttcttcgagcgcggcggcgattccatcctc

SEQ ID NO: 7181 - DNA, 159 bp, Methylobacterium sp.
atggtcgagatccggcgcgtgtacgaggcaaacttccgggtctacggcgtgcgcaaggtctggcggcagctcgcccgcgaagggatcattgtggcgcgctgcacggtggtccggctgatgcgaacgatgggcttggctggcgtcgtccgggggcggagg

SEQ ID NO: 7182 - DNA, 342 bp, Methylobacterium sp.
gtggtcgtgctcgccggcgaccaggccgtgttctcgatcgacgcggccggcaacatccaggtgcccgccacttacgcgttgcgctccgaggttggcgtggccctggcccgagcggccgccgtgctcgcggcccagcccgagccaaactcctcgcagcagatcctgagcacggtgttccggcagctcggcgagatcgataccgatgcggcgcgcgaggccctcaccaacctcgaggccgccgtgaacggccagacggcagccctggcggccgcgaccgtcgccatgaaggcggccaccgccgagaccggcgcctcgatcccgaccgcccccggaacgcactga

SEQ ID NO: 7183 - DNA, 690 bp, Methylobacterium sp.
atgaagttacaaaaagataccaatattgcggctgcgagaccgcgctggtacgatgacgcctgcggcgccgcccacggcctggagatcctcggcgagcgctgggcgctcctgatcgtccgcgagttgatgttcggaccgcgccggttcggggcgatccgaggggcgctcagcggcatcagcgcgaaggtgctgaccgagcggctgcagggtctgaagcaggcgggcatcgtcgcacagcggactctgccaccgccggcctcgacgccggtctacgagttgaccccatggggctacgaggccgagccgatcttctcggtgctcgggcgctgggcggcccgttcgccctcccacaaccccgctctgccgctctcggcggcctcgctcatgctgtcgtttcgcacgatgttcgaccccgcacaggcctccggcttcgaggcgacgatcggcttccggttcgacgaggacgccttccgcgtcacggtgagcgagggcgaacttcacgccgcccgcgccgacccgctcggggcgcacgccgtcgtcggcgccgcaccgccggtcgttgcggccatcgtctacggcggcctgccgctcgccgacgcggaggcgtcggggcaggtgtcgctggagggggaccgggacgtcgtgcagcggttcgccggactgtttcccctgccggggaaggcgttctga

SEQ ID NO: 7184 - DNA, 270 bp, Methylobacterium sp.
gtgctgctgaacgcgctgatcctgatcacgaccctggtgccgagcgccgaggccggcgcggacgccctcgcgcgcgcccttccgcccccggcgaccgtttccgctcaggccggcagcccacccccgcgcttcgaccccgcgacccgctccgtgtccaactggcacgcccagaccggcgcgcagctgacgccgcgggcgctggcgatcaccgcctcgctgaccgacgatccgccctacgtcgcccgctgcgtgcggctcaacaacggatcg

SEQ ID NO: 7185 - DNA, 114 bp, Methylobacterium sp.; identical to SEQ ID NO: 6042

SEQ ID NO: 7186 - DNA, 264 bp, Methylobacterium sp.
atgacgatacgacctcccagaagcggcgggccgacggggcgcaagcctcaggccggcaagtccagcgccagcaagttcaggggcggcaaggcccaggccgacggccgcgcccgcacgggcccgcgcaccagcgcccgcgacgccgccgagcgcgcggcccgcaaccgcggcgaggatgccggcacccgcgatccctggggcgcgcaggccgctgcggccccggcgccggcccggccgccgaagccgcgccgcgacgccgccgca

SEQ ID NO: 7187 - DNA, 885 bp, Methylobacterium sp.
atgcagatcggattcatcggtctaggcagtatgggttcagccatggccatgaacttggtgaaggcaggccatgaggtgcgggcctggaaccgtagcaggatcgtccaggatcgcgttcacgggataacgctggtcccgctcgtggcggatgcattccaggccgacgcagtcttcacgatgctgtccgacgatcctgccattcgggaggtcatcctcgatgccggcgtgctcgctagggcgcgaccgggcctgactcatgtcatcacatcgacgatttccgtcgctttcgcgcgggaactggagttgctgcatgcaaaggcggccctcggctatgtgtcagcgccggtgctcgggcgaccgaacgtagcggcgcgcggccagctcaacatcctggcagctgggaaggccgatgcgattgacgcggttgagccgttgctcgcttcgatcagcaagaaggtttggaagttgggggaggatcctgtgcgcgcgaacgccgccaagatcgcctgcaacgcgatgattgccatggctatcgaggcgatggctgagggtgtcgtgttgaccgagagcgtcggcttggatcgcgcggtcttctttgaactcatcctgggcactcttttctcgggccgcgcctatgagagctacagcgcgcagatcacgaaccgatcatttgagcccggtttcaaatccaagctcgcgctcaaggacatgcgcttggcgatcgaggccggcaatcagatcgggcgcacgctcccgatgcttgaggctgtccacgagggactcaccagagctgtctcggcgggcctcggagagaaggactggtcgatcatggccgatatgacggttcgtaacatggcgatcgccgccgcttatagcgagcgctga

SEQ ID NO: 7188 - DNA, 852 bp, Methylobacterium sp.
cgcgggacaccctccccgtccggggcgccggcgggcgaccacgtgctgatcgaggtgcgcgacaccggccagggcatcccgcccgagctgatggagaagatcttcgagccgtttttcaccaccaaggagatcggcaagggcaccggcctcgggctctcgacggtgttcggcatcgtcaagcagtccggcggcaccatcgacgtgcagtcgaaggtcggggagggcacggccttccgcatctacctgccgcgtcacgtgcccgtggcggagcccgaggaggtgccggtcgcggccgccgagccggcacttccgcgcgcggagccgctcgcgccggcttccaccaccgcccatcccgattccgggtcggacgccaagccggtcaccgcgccggccgcgggcggcgacgccgctgtgccgaacgggaagacgccgcccgccaaggtcgacaagccggcgccgcgcaagcccgccgccgatcatacggggcaggggaccatcctgctcgtcgaggacgaggacccggtgcgggcggtcaacagccgggcgctctcggcccgcggctacacggtgctggaggcggcctcgggcctcgaggccctggcgatcgtccgcgagggcgcgcagaccatcgatctcgtcgtctccgacgtggtcatgcccgagatggacggcccgacgctcctgcgggaggtgcgcaagcatcagcccgacctgaaggtgatcttcgtgtccggctacgccgaggacgcgttccgcaagaacctgcccgagggcgagaccttcaacttcctgcccaagcccttcagcctgaagcagctcgtcgagaccgtgaagaagacgatggcggactga

SEQ ID NO: 7189 - DNA, 309 bp, Methylobacterium sp.
ttgctcggcgcgatccaggcgctcatcgccgatctgccgacctacggctatcggcgcgtccatgcccttctgcgccggcaggccgagcgggatgggcggcctgcgccgaacgccaagcgggtctaccgggtcatgaaggtgcacggcctcctgctccagcgacatgcgggcggagccgagacgcgccgccacgagggcaaggtggcggtggccgtgcgcaacacgcgctgggcgggtccccgcccggtctccgaccgggtggcatgcccgctgctcggacgggctggagatcgcagcagagaacggtga

SEQ ID NO: 7190 - DNA, 435 bp, Methylobacterium sp.
atgtccgattcccccgacgacctcctcagcctcaccgctggcatcgtggcggcctacgtcagccggcaggccgtgaccgcagatgcgctgcccgggctgatgcgcacagtccgcgacggcctcgtcgcgctccaggacctggcgccggccgcggcggcggccaaccccgagggctttcgcctgacggccaccgagatccgcaagtcgatgaagcccgacgcgctgatcagcttcatcgacggcaagccgtacaagacgctgaagcggcatctgacgtctcacggtctgaccccgaaggactaccgcacgcgcttgggcctgcctgacgactatcccatggtcgccgccggctacgccgcaaagcgctcggcgctcgcgaaggcaattaggctgggcgtgcccggcgcgcagatggggcgccagacaaaagagtga

SEQ ID NO: 7191 - DNA, 288 bp, Methylobacterium sp.
atgaaattccgtccgctgcacgaccgcgtggtgctccgtcgcatcgaaggcgaggagaagaccaaagggggcatcatcatccccgatacggtcaaggagaagccgcaggagggcgaggtcgtcgccgcgggaccgggcgtgcgcgacgaggccggccagatcatcgcgcttgaagtgaaggccggcgaccgcgtcctgttcggcaagtggtccggcaccgaggtcaagatcgacggtcaggacctcctgatcatgaaggaatccgacatcctgggcatcgtcgcctag

SEQ ID NO: 7192 - DNA, 123 bp, Methylobacterium sp.
gtgagcgcgccctctccccacgggtccggcggcccggccccgcggcgcgtcctcgtcaccggggcggccggtttcgtgggcggccacgtcctgccgctcctggcgggggcggtcgccgcgtag

SEQ ID NO: 7193 - DNA, 177 bp, Methylobacterium sp.
atgaacgagaccgatcccatcacaaaggccgcagaggccctggccgccgccggtcactcggttgagccgatgggcgctggcttcgcgttctggattgtcgatggcaagggactcagcggcagggatctgctcgcgatggcagcgcggctcggcctcatcggctcgtcgagcggctag

SEQ ID NO: 7194 - DNA, 84 bp, Methylobacterium sp.
atgcgcggcacgcctctcctgatcgcgggcttgctcgcgccgaccctcgccttcgcgacgccccccgcgacccaggccgcgaag

SEQ ID NO: 7195 - DNA, 141 bp, Methylobacterium sp.
atgtcttcgatcaccctgtcggccgcgacgcgtcagaacctgctctcgctgcaggacaccgcccagctgatgtcgaccacccagaaccggctcgcgaccggcaagaccgtcaactccgccctcgacaacccgaccaacttc

SEQ ID NO: 7196 - DNA, 318 bp, Methylobacterium sp.
gtggtgacgatgaccgtacccgcgacgctcgatcacgcgaacatccggacgatcccagtctcggtggccgaagcgaacgccgcgatagccgtcgccgtagccttcgcgcacgatcacgcgagaatggccgtgacccggaccgtagccgtagccatagccgccaccccactcatgggcctgagcggcagagactgcacccagcagcgcggtgccggcgaccagggtcgtgataagcttcttcatactccaaccttgttcatcgaactgaaacgagaaatgcagtcgccaatcatcgcgttccaaggctcacgagtttaa

SEQ ID NO: 7197 - DNA, 333 bp, Methylobacterium sp.
atgctcgatcgcgccgaggccgtggtcgccttcgccgtcctggccgccgaggggtcgccggagaccgcctacgccgccgccggcatcgcccgggccgagatgttcgacgctgccagcgatctcgccctgacgctgggtgcgccggacgggcatgccggtccgctgggggcgccgcctgccaccgcctacccgccggactgggcggctctcgccgacctcgccggccaccctgtcgaactggatgcctggcgggaggccgaacgtcggctgccctactgggccgacgccgatccggtcgacgcaccccacccgtggaaatcgacgtcgccctga

SEQ ID NO: 7198 - DNA, 693 bp, Methylobacterium sp.
gtgcatctcgatgcggatcgtgccgccgccgccgaccgcctcgccgaactggaggccggccgcgacgcagtgctgctcacagacgacgacgccaaggccgaggcccatgatgccgagatgcagcgtgtccgccgcgcgatcgaacgtgccgatctgaagcggcctggcatcgtggccgcggtcgaggctgcggtggcgcgtgaggaggccaatgccttcgcccgacggcaggctgaagccagcgctgcggtcgaggccgtgatcgcccgcctcgcgaaggagtacgaagctccggccaagattatcgccgcctttctggcggactggcagcgcgctgccgaactcgccgaagccgccaaggtccccggcccggatgcccgagttcgcgagcgtgcaccgcagatggtcgcgcccgccggtgaggacacgttcctcgtctacatcgacgaacagggtcgggacaccgaccagccctatccgccgggtgcctatacgccgggcatgcccacgcgccggcagcagcgtcgcacccgcgagcgtccggcccgatacgacaatggcatctatctcggcgccctcgcgggccgcgcgaacttgccggccgctcgcgtcggccaggatgcgccgtggaccggcggcgatctcgcgctgaagagcgacctgccgcagccgcacacccgccgcttcctctga

SEQ ID NO: 7199 - DNA, 177 bp, Methylobacterium sp.
atgaggaacttcggcccgccgttggcggccggctgtgccagggacggcgtggcccacgcggcggcgaggcagacgggggcgacgaggcctatgacggtgcgagtcaacatggtggagaccctccagcacctgcgccgcacaagtcccatcggcgatgacggtgcgagacacgattaa

SEQ ID NO: 7200 - DNA, 96 bp, Methylobacterium sp.
atgacgacagctcagcttcttctcctgctcgcggttccgatcggcggcggcgtgctagccttcggtgcgctctggctcgcccagcgggcgcattga

SEQ ID NO: 7201 - DNA, 1164 bp, Methylobacterium sp.
atgaagggcaggctcaagctcggcctggcagcgttgggtatcctaggcgtcggtctcggagtcgcgcgctaccgcgaggctgccgcgccggcggggccggaagcatcttcccccgccgttccggtcgtcaccgcggcggtccagcaggaggatgtgccgatcatcctcaagggcgtcggcaccgtccaggccctgaaccgggcggtgatccgcagccaggtcacgggctacttggagagcgtcgccttcaccgagggccagagcgtcaggaagggcgacgtgctggcccggatcgatcgacgcatctaccaggccaagctcgacaccgccgaggcccagctcggacgcgaccaggccctgctgaccaaccggcaggtcaatctccagcgcaacgagccgctgctgcagcgcggtttcgcgagcgaggaggcggtcaccggcgagaaggcgcagatcgcccaatccgagaacgccgtgaagggcgatcaggcagccctcgactacgccaggaccgagctcgatttcgctacgctgcgcgcgcccttcgacggcgtcaccggcctccggctgatcgacatcggcaacgtcatccagccctccgatcccagcggcatcgtggttctgacccaagtccagccgatcagcaccgtcttcacgctgcccaccgacgacatcccgcaggtccaggcggcgctggcccgcggtccggtgacggtcaccatctacaaccaggcggggacgcgtatgctcgataccgggccgctgctcctcatcgacaacgaggccgagccgaaatcaggcaccgtccaactcaaggtcaacacgcccaacgccgagcgccagctctggcccggcgccttcgcgaacgtcgaggtcacgacctcggtggtcaagggcgcgctgacgatcccgaccaatgccgtccagcagaacgaccaaggtcaatacgttttcgtcgtcggttccgaccacaaggtggcgatccgctcgatcaaggtcgcccagcgggtgcgcggcgtcgccctgatctcagaggggctgaaggccggtgagacggttgtggtccagggtcagtacagcctcgtgccgggtacggaggtcgtcgcggcgcctcccaatcaagtgtccgacaccacgaccgccagcgccgggatgctgccatga

SEQ ID NO: 7202 - DNA, 1065 bp, Methylobacterium sp.
atggacctgcccctcctcttcgcgctcgtggcggccggcgcggtcgccctctatgtgatcgccgacggcttcgacctcggtatcggcatcctgttcctgctggctccgcgagggcgcgaccgggatctcatgatgcagagcgtcgcgccgttctgggatggcaacgagacctggctggtgctcggtggcgccggcctctgggcagcgttcccgatggcctactacgtgctgctgccggcgttctacctgccgatcatggcgatgctgttcgccctgatcctacgcggcatctcgttcgagttccgattccaggccacgcgcttccagcgcgtctgggacttcgcctttgcgggcggctcgctcgtcgccgccatctgccagggcttgatcctgggcggcttcatccaaggcgtggcggtcgagaacggctacttcgcaggcggtcctttctcgttcgtctcgttccttgggttgctttgcgcggccggaattgtcggcggctacgcgctgctcggggccggctggttgatctggcggaccgacgggccgacgcaggtcttcgcccgcgaggtcgcgcacgccgccctgcttctggcagtggcgatgatggcggtggtcagcgcctggacggccctgacggagccgcaggtggccgctcgctggttcgcatggccgggcactctctggctcggcctgctcccgttggcggcggcgggcgtggcggtcctgatctggcgcagcctctgggggcgccacgacagccggccgttcctgctcgccgtcgcgctgttcctgctcggctacgccggcctcatcatcagcgtgtggcctaacgtggtgccctaccatgccaccatctggcaggccgccgccgatgaagcgacgcttcggttcgctctcctggggatcttcgtcgtcctgcccctcgtcctcgcctacacggtgcacgcctactgggtgttccggggcaagaccgtgccggtgtcccacggagccgacgagggcgcgtatgggcacgctggacagcgcccgaacgcgctgggcaccgatttgcacctgtgctga

SEQ ID NO: 7203 - DNA, 1419 bp, Methylobacterium sp.
atggatgccctcgtcctctctcgaatccaattcgccttcacggtgggcttccacatcctgtggccggccttcaccatcggcatcgcctcgttcgtggcgttcctcagcttcctcacctggcggaccggcgatccggcctaccgggcgctgatgcgcttctggatccggatcttcgcgctcggcttcggcatgggcgtgatcaccgggatcgtgctcggctaccagatcggcaccaactggagcgggttctcacgctcggtcagcaacgtgctcggcccgttcttcatgtacgaggtgctgtcggcgttcttcctcgaagccggcttcatcggcatcgtgctgttcggcgagaagcgggtcgggcccgggctgcacttcttcgcctgcctgatggtggcgaccggcacgctcatcagcgcgagctggatcctggcctcgaacagctggatgcagacgccggccggccacatcgtcgacaaggacgggatcttccacgtcaccgactgggccgcggcgttcttcaacccgtcctacccctaccgcttgatgcacatggtctgcgcgagctacctgaccggcagcttcgtggtggccggcgtctcggcctaccacctctggcgcggcacgcacgtgaaggcctcacgcgtcgcgttctcgatggcaatgtgggcctgcctcgtcctggcgccgctgcaggcggtcctcggcgacgcccacggccgcaacacactcgtgcaccagccgaccaaggtcgccgccatggaggggctctgggacacgggtcgcggggtgccgagcctgatcttcgcgtggccggacatgacgcaggcgcgcaacctctacgagatcgctgtgccgatcaaagggttcgccagcctgtacctgacgcattcctgggacggcgaggtccagggtctgaaggcggtgccggccgcagatcgaccctacgtgccgttcgtgttcttcgccttccggatcatggtcggcatcgctcttctgctgatcgcgttggcgttcacgggcgcgttcctgcgctggcgcgggcggctgttcacgacgcgctggttccagctcgcctgcatgggcgcgacgccgctggggttcctggccatcgtggccgggtggacggtgacggagaccggacggcagccgttcgtggtctacggccacctgcgcacggcggacgccgtgaccgtgcagccggcgggcgcggtgctgtcgtcgctgatcctgttcttcgtcgtctacaacacgctgctgctggccttcttctggtacggcgcgtgggtcgcgatgcgcggtcccgatccgctcgtggacgagccgccgaacgcggtgcgccccggcctggaacaggccggccccgccgtggtgggcggcgctcccgcctacgcccgtgcgctggttccgggtgagtag

SEQ ID NO: 7204 - DNA, 903 bp, Methylobacterium sp.
atggccgacaccgataccttctggccgaacggcgcccgcctggcggtcagcttctccctgatgttcgaggccggcggccagccgatctcgggtgcgggtggtgtcattccggatccgatcgagcagggcctgccggacctaccgaccaacgccttcttccagtacggcgtctacgagggcatcccgcggcttctcgacctgttcgaccgacaccaggtcaagatgtcgtccttcatgatcggccgggccgtcgagaaggcgccggacttggcgcgtgagatcgtccggcgcggtcacgaggcggccgcccacgggcgcacatggcagaacagctacttcctcgatccggacgccgagcggcgcttcatcgccgatagcgtcgaggcgatcgagaaggccaccgggcagcgaccggtgggctggaacgcctactggatgcgcaactcgccccgcacgctcgacatcctgcaggggctcggcttccgctaccacatcgacgagccgagccgcgacgagccgttcatcatcccgctgaagggcggcgacttcgtcaccgtgccctacacgtttcacctcaacgacattgtgtcgttcccgttccagggctggaacccggccgcctatgagcaggcgcttagggacgagttcgaccagctctacgaggagggcgcgcgccgacggcgcatgatggtcgtgtcgctacacgaccgcatctcgggccacgccaaccgggtacggtcgctcgaccgattcttcgcctacgcgcgcacgaagccggacgtgtggttcgcccgcaaggacgagatcgccgcctgggcgctggaacatcgcgcccagacgccgatctacgagcgcggcgccccaaccgtcacgggcctgccgggtccgggcccgggagcgtga

SEQ ID NO: 7205 - DNA, 114 bp, Methylobacterium sp.
atggagggctatgatcccccggagggttggggctggtgctatgtggacgaggtctttctcgatctcggaaccgacatcaccccgcaggacgggcccatacccaggttcgtctag

SEQ ID NO: 7206 - DNA, 423 bp, Methylobacterium sp.
gtgccggacattcgttcctatcctgacggccagacggcgccgagccccagcgcgatcgacttcacgcctggtcatctcctgggcgacgtgtccggcgaactcggcctgcggaagttcctcgaggcgtctggtcataccctggtcgccacctcggacaaggaggggcccgattcggaactcgaccgcgagctggtcgacgcggacgtcgtgatctcgcaacccttctggccggcctacatcacgcgtgagcgcatcgagaaggcaccgaggctgaagctggctctgacggccgggatcggctccgaccatgtcgacctgaaggccgcggccgagcgcgccatcaccgtggccgctacgccgcgggtacacgcgaaatcctggaggacttcctcgccggcaagccgatccgcgacgagtacctga

SEQ ID NO: 7207 - DNA, 987 bp, Methylobacterium sp.
atgcacgcaacacagctcatagtccaacctgaccacggcatcgaacccgtggtcgcgttgatgcggggcgccgagcatgagatcctgctcaagcagttcaccttcgatcatcccgcgctgctcgacgagctgatcgcgcggcatagggaaggggtgaccgtgcgcgtcatgttgaattccgcaaaggccacgggcgagcggatcaacgatgcgactttcgcccgtttggaagccgtcggcgtccccgtccgttgggcgccatcccactttctcgtgacgcacgagaaatcgatcgtggtagatggcacacgcgccatgatcgccacgttcaacttcatggaaaagtacttcagcaagacccgggattacgcggtgatcctgacggaccccgcccaggtaagcgccattcgcgactgtttcgatggcgactgggccggcgggccattcaccccctccggtggctcgggcctgtcatggagcccgggtggcgcccgcgcagtcctgtgcggattcctggatggcgcgaggcacacgatcgaccttgcgcatccgaaattcgcggagccagtgattttcgagagggttcatgccgccttggagcgaggcgtccgtgttcggctcctatgcggcgggaagcatggccttcaccagccggacctaatgtattcttttgcgctgtggcgcctgttccgacaggccggcgggcggctgcacaagcagcgcgggctgcggagccacggcaagatcgcgatcgtcgacggcgaccgcgtgcacctcggcacgcagaacctcgaccaagccgccttcgacctacggcgtgagctcggcgtgactgtccgggacgctggagtggtccgagcgataaccgacgtgttcgaggccgattggagggaatcgcgccgatacgaaccgccctatccgacggccaagcccgatgacgccgagaacgcggagttcgagccggatgccgacctgcgacacagctga

SEQ ID NO: 7208 - DNA, 144 bp, Methylobacterium sp.
atggatcaggcgcagccgcgcaggcgcgtcgggatcgcctcagggttcacgtcacggctccagtctgacgagcgaaccgcccggttgacgtccttgcccggcatgcgcctcactccgcgagcacacgcgcaattggaggcatag

SEQ ID NO: 7209 - DNA, 732 bp, Methylobacterium sp.
gtgagcccgcgcctgccgaaggcggttctgccgcccctcgggacgctgaaacgccgcaaccggtcctggctcctggcggccgacggcacggccttcctggtctcggagacgcggctgatcgactacgcgccgctcgcgggcgagcttcccctcgcggtcacgcccgccggtctgctgatgcgcgatcgcgcggatggggtgatcgcgcggcggccgtccgacgggaaggtcgtggcgcggttccccggccgggccggatcgctgcggccgggcggcggcctcgccctctgcgcggtgcgcgggcagcccaccctggggatcgagcaggcgggcgggcactggcacgtggtgagcgccgcggacggagcggtcgcgcacctcgggccgcagggccggatcatcggcatcgtgcccccgtacgacggcgtgagcgcccaggccgtcgagggccccctggccctccatctcgaccgcgacgaggcgggctcggcgcgcctgacgttccggaccccggacggcgcggcggcgtgcgatcccctgacgcttccggacgcgaccctcgaggcggtgcgcgtcgccgtcgatgccgatgccgtcccgtgcatcgcggccgcgcggtgcgacgccgcgggcttcgtcgacgcgctcgccttcggccagctcgaccgcggatggtcccacctgagagatctcggcgcgttcgcggaaaccgtcccgtgcctgggcgcctga

SEQ ID NO: 7210 - DNA, 1695 bp, Methylobacterium sp.
ttgcgggtcgtcacgggcacccacaacgcgctgctcgcattcgacctgggcgagacgaagcgggcggactgccttggcttctcgatcgagcgcaccgacctggacaccggagaccgccgctggctgccgaatatgctgcgcttcccctccgatacgaacccggaacgggtgacgacggcgcgggcgcctttgcagaagttccgctggggcgactacacggtcgaaccgggcaagcggtaccgctatcgggccgtggcccggtacggcacggcggccgatgtcttccgggagggcgtcagcgcggagaagcctggggcgttcgacgtcatcggtgggggcgccatcgtcgacgtcagggccgagaactcacgggacgaccacactgcggtcttcttcaaccgtggcgctgcggcgagcgaggcctatgtgcgccggttcggcgacaacgatcccgccaatatcccggacgcgttggtgtggctctcccgtggcctcgaagaggcgatcttggccttcctcgccaaggcgatcgacgaccggttcgccctgcatgcggcgatctacgagttccagaagccgaacctgctgcaaggcctgatgcaggcgaagcggcgaggggtcgatgtcaacgtcatctatcacggtcgcgacaacggggcgaaggataccacccgcgagaagaacggagcggcgatcgtctcagccggcatgacgttcgccgcgccgcgcaaggccaatccccaggccgcgatcatgcacaacaagttcgtggttctcctgcgcaacgacacggggggcgtcccgcggccgatcgcggtttggaccggttcgaccaactggaccgagggcggcatctacgggcagctcaacgtcggccacggcatctacgagcccggcgtcgccgcgacctacgaagcctacttccaacagctcgcccaggatccggacgcggcggcgtcccgcgaggccatgcaggcgctgacgccggtgccggcgaaccgggaggcggtcgcgcacggcatcacgccggtcttctccccccaagggtcgctcgacatgatcacgctctacgcggaggtctgcgcgaaggcgaaggtgctgatggtttccgcgcccttcgcccttcacccgaagatccgcgccgttttcgaccagaggtcgcccgacaccctgcgcttcctgatggccgacaaggaaggctcgttcggaaagaaggggcagatggagatcatggaacgcgatcctggcaacgccgccgcggtggcgacgatcctgcacaaccccttgaacgattatcaaggtcatctcctcgagcacgccgagggctttcatcatgccggcgtgcacatccactcaaagatcatcgccgcggatcccttcggcccagatccgatcctcatcaccggttcggccaatttctcgtccaactcgaccatggaaaacgactcgaacagtttgatcttccgcggagacactgcggtgatggatatatatgctaccgagtttatgcgaatgttcgaacattattggtttagatacaagcaaaaacgggaagaagacgatgccaaggctgcgggccggacagcgggaacagtgcttgccttgaaagaagacgcgtcatgggccgatccattcttcgtacccggttcgaaggaaatgcttgatcgccaagccttcgcggggattgcggtgtag

SEQ ID NO: 7211 - DNA, 999 bp, Methylobacterium sp.
atggaaatcagcggccgtatcctgatcgcctgtctcgtcgccgccgcatggacgccgacggcccatgcggatccccgttacgagcgctatgacggcgcctgcgacgcctctgcagcgatcggtttggcggccgaccgcttcgtcgtggcggaagacgagcacgacgtgctgcacgtctatcggttcggcggagggaagccggtcgccgagatcaacgtgactgatttcctcggcaatcgtcgaccgggacacaagccgaaggaagccgacctcgaaggggcggcaaagatcgatcgaacgatttattggatctcgtcgcacggtcgagatcggcatggtgactacgagccgacccggcatcggcttttcgcaacggaaatggtgacgggagcttccccgaccgtcaaacccgccgggatggtctacaaagatcttatcagggatctctccgcagcgccgcaaacccgttctctaaatctcgctgaggcgtccgccaagactccagaggctgaaggaggtctcaacatcgagggcctcgcggcgtcgccggaaggtcacctgttgatcggtttccgcaaccctctgccggccggcaaggcgctggtcgtcacgctcaccaatccggcggatgtcatcgagcgcggcggaaaacccgacttcgaggctccccaccttttggatctcggaggccgtggcatccgaagcatggaacgggttgggtcacgctacgtgatcatcgcaggcccgttcggagacagcccgggcggcacatcggatttcgcgctgttctcctggggcggcaacgaccaagcgccggagcgcctgaccgccgatttcggctccctgagaccggaggccttgtttgcgacagacgtcgccgacgaggtctacgttctgagcgacgacggggacgaggacatcgatgggatgccctgcaagagctcagaagtgccgctgattaagaagtacttccgcggcatgcgccttcgcattcgttga

SEQ ID NO: 7212 - DNA, 870 bp, Methylobacterium sp.
atggacgcgatcgtcgagaacttgccgctgccgcagcccgccttcgaactcgcttggaacgcgatcaaggtggacggcggcgtgaaggaccggctggtggcccagtccctcctgtcgctccggctgcggcagcattacccgttcgagacgatgccgatgcacgggctgatcgtgctctccgggccgcccggaaccggcaagacgacgttggcgcgcggcctcgcgaacgaggtcggcaaggcgttgggcaaggctcgatatgtccagctcgacgcccatgccctcgggagcgcctcgctcggcaagagccagaaggaggtctcgcgggtcttccagcagacgatccccgagctcgcggcgctcggtccgatcgtcgtgttgctcgacgaggtcgagacgctcgcggcggaccggcagcgcatgagtctggaggcgaacccgatcgacgcccaccgtgccaccgacgccgccctggccgggatcgacctgctctgcaggaagcatcggaacaccctcctcatcgcaacgaccaattatcccaaggccgtcgaccgggccctcctgtcccgcgcggattggatcgaggacatcgggcctcccagcgcggaggccaggaaggagatcatcctcgacacgctggccttgctcgcccggacgtggcccaaggtcgatgacttgaaaaatcaggtcgccgccttcgtccacgcgtccgacggcatggacggccgtcggctgcgcaaggccgtcatgtcggccgcggccgtctcgatcgagacggcgaaggatctcaacaagctgaggcccgaacacgtgatcgcgacgttgaagcgggcggccagccagcccgacgtccgggaggacgcggcgtga

SEQ ID NO: 7213 - DNA, 462 bp, Methylobacterium sp.
gtgaaggtccggcgcgacatcgcatccatccccaggcgctcggccgccgagacttggcgggagattgtcgggctagtcaccggcgacgggtccgtggacgcgggcacgctggaggccgcggccagcgtgatggaatcgctgatcgcggacgagcatcccgccgaggtcccgatcgtcgtcaagggcgtcgggccgcgcttggtcatctattgcctcttcggcgaggacgccatggacgcggacctgggcgtccccgggttgaactggaaccctacggccggcgactgggccatgacggcgccgacgggtgcggtcgatctcgcctggatgaacaggacgctgaaggagcgcgcgccgcggatcgccgcgcacgacgtcgaagccgcgccgaccgacgacgaggatgctgcggcggaggcccgggaactcacgatcgattggggggcgatcggcggctcatga

SEQ ID NO: 7214 - DNA, 2244 bp, Methylobacterium sp.
atgcagtcctacatggcaatggaccgcgctcggcgttcgcagaccagtgtcccaaagttcgggatagaccccgacgagccacgccttgtcgaggcgctctcatccttcagcaggggcaagtgcgccttctgcgaggcaataggcccgttgacagcccatcggtttcgcccgagcgggaatgcgcagcccgcggccgataggaaggacgcccacctattctatgtgtggctcgccgacgcatggcagaacctgctgcccatctgccgcggctgtcagccggtcgagccgaccttccccgtcgacggcacccgctgcaggctgccgtccccacaacagatcacgagctatatccagaggggcgccggcctgtggccgagctatccaccgaacgagaagaacctgctgattgaccctagccgggagactgccttcgacgggcacttcaagcctaagctcgacggaacgatcgttccgacaagtccccgggccgcactgacggtcgagaccttcgacctcaatcgcgaggagcggctgctccagcgcggctcgaggtaccgcgatcaattggataggctgaagaacctgctcgggactcgcaaaaaggctttgtcagtcgagcaaaaggcctggactgaccttttcgacttccgcgcgatggaattcggtggaacttgtctgctgctcatgaaacgcgtcgccgcccgtatcgacctacccaatggctccgggctcagttcgtcgagcagagatctgaggcacgcattccgacagcttgcctccgcatccgacgcgcgcgagcgattcgataaggcgcttctggagctctcgcgcgaagatccgagcctactgcccgcaagtccgggcaggccgcgagttcacagggtgcgctcgcaattgagaacggtggaggtgacgaacttcaaagccgtggaacgcatgcatctggagttgctgtcgaccgggcccgaaacttccgatgccaagccgctcgcgccggccctggccattctcggcgagaatgcgaccgggaagagttcccttctggaggccgtggcgctcgcactcatgacggaggacgcccggaggtcgcttgaactcgactggcaaaccatcccgctcgatccaagccagatgggcgtcgagggcagcctaaaggcgcctgccacggaagtgcgtctgactttcgacagcggccagacggcagcactttcgatcgtcgacggcctcgtcgccgctcgcagcgaattcggcagcgagagggtctcggtcttcgcttatggagcattccggcgtttttccggtgacgtgcctgccacgatgtcgagccggcatgttcgtaacctcttcgatgcctcgccgctcgcgaaccccgaagcttggctcaggtcacttcaaccacagaccttcgatatggtcgtgagaaccctgcgagatcttctatcgatcgagggtgatttcgatgtcatccagcgcgaaggccggtcgcgccggttgagagtggtgacggcggtcgccgaacccgatgggacgatccgctatagccggactccgtttcaagcggtcagctcaggctaccgctccatgctgggcatgctttgcgacatcctgcgaggcctactggaagccgcccccgaggaggagttcacttccttcgagcggatccgcggcgtcgtactgatcgacgaaatagaggcccatctccatccgaggtggaaggtgcaggtcatgacgagtctgcgccaaactcttcccggcgtgaccttcatcgtcacgactcacgatccgctgtgcctccgcggaatgggcacgggcgaggtcatcgtgctgcagcgagttgcctcctccgactccggagtggagagcaaccttccgattgccgtagagcgaatgagggaccttcccgctgtcgcagatctcaggatcgaacaactgctcacttccgatttcttccagcttttctccaccaccgacgccgcagccgaccgcaagattgctcgcatcggagacctcgtcaggcgtcgtaccgaaggccagacactcacgaccgaggacgcccgcgtcctggccgaattcgaacgcgacatcgcgagtgcgctgcctgtcggctcgagcgaggttcaccgtatggtacaggaagccgtcgcggagttcctggagaagcgtcgcgccgcgtccagcgcgacactcgcccggctgagccaaaaggcaaaggacgagatcctggccgccttggagacgctctga

SEQ ID NO: 7215 - DNA, 345 bp, Methylobacterium sp.
gtgggcgagcagattgatggcagcttcgaactggactcgcagacttaccttgtagaagccaaatggctcaatcgcagggtcggcgtcgcggaactcggcgcgtttcactcgaagctggatcagaaggcgtcctgggcccgagggctattcatcagcttcggcggcttcaccgaagagggcatccgtgccttcggacgcggtcgtcgcgtcgtcggaatggatggtcgcgacctctaccaaagcctcgagcgcggcatcccagttgaccgcgtgatttcccggaaggtccgccatgcggcagagactggagaggtcttcgctcccctcgaaaacctcttccgataa

SEQ ID NO: 7216 - DNA, 135 bp, Methylobacterium sp.
gtgcgctggcgcacctccatctgcgaccaagtttgtcgcgagaccgtaatccagatggcgccggcggtgagtgtcacggcgagcatcgccagcaggatgactttcgtcgacagagtcatcctgcgcagcgaatag

SEQ ID NO: 7217 - DNA, 1428 bp, Methylobacterium sp.
atgaacgccatcacccctgtcgaggccgacacccggcttctcgatgccctgaccgtccagcgcacggccttcctgcgggatggccctccgtccctgcgcgaacgccgcgcggacctcaaaaggcttcgcgccgcgatcctcgaccggcgcgccgacgtcgagggcgcgctgaacgcggacttcggccaccgttcgcggcacgagaccgcgatcatggagacgatgacgctcgtccaggagatcgactaccttcatcgcaacctgcgccggttcatgcgcccgacccgccggtacgtcgcgctcgccttccgcttcggcagcgcgcgcatcgagtaccagcctctcggcgtgatcggcatcatgtcaccctggaactacccgttctcgctggcgctcgcccccctcgcgacggccatcgccgccgggaaccgggccatggtcaagccgtccgagttcacgccggccacgagcgcgcttctcgtggacatgctggccggcctgttcccggaggagcaggtcgcggtggtgaccggcgacgccgcggtgggcgccgccttctcggcgctgcccttcgaccacctcgtcttcacgggcagcacccccgtcggccgggccatcatgaaggccgcgagcgacaatctcgtgcccctgaccctggagctcggcggcaagtccccggtcatcgtcgcgaagggccaccccgccgaccacgcggcggcccgcatcgcctacgggaagctcgccaacggcggccagatctgcgtggcgccggactacgcgctcgtgcacgaggacgacgtcggacccttcctcgcggcctacgaccgcgccgtggccgccctctatcctgatgggccggccagcgccgactacacctcgatcatcaacgaccaccaccacggccgcctgaccgggctggtcgacgacgcccgggccaagggcgccgaggtgcgcctcgtcggccggaacccggatcgggcgggcgggcgtccccacaccatggcgcccacggtcgtcctcggcgcccgggacgacatgcggatcatgcaggaggagatcttcggacccgtcctgccgatcctgacctaccgggacctcgacgaggccgtcgcctacgtcaacgcgcatccccggccgctagcgctctactacttcggccgggacgacggggaccgcgcgaaggtcctcacccgcaccacgtccggcaacgtcacggtcaacggcacgatcatgcattacgcccaggacgacctgcccttcggcggcgtcggcccgagcgggatgggcgcctatcacggcatcgaggggttccgcagcctctcccacgccaagggcatctacgcccagggccggtggaacggcagcggcgtcctgcgcgcgcccttcggcaagctcgccgacctgaccctcgggctcatgctccggtga

SEQ ID NO: 7218 - DNA, 228 bp, Methylobacterium sp.
atggcgacggccacgtcctctgacgaggcggtgctggatgtggcgacgccgatcatcgacgcgcgcgctctgctgcgtgcgtcgagatatgagccgctcttcgtcagatcgagtgcttcgcgctccccggtcgagttcagggcggtcgagcgccaccgtcgagaactcacgagaatgcctgccgttcgcggatcctcggtttcccgtcaggagtggaggtcgaagtga

SEQ ID NO: 7219 - DNA, 294 bp, Methylobacterium sp.
atgaagcagacatccgggccggctcggaagccggcagagaccatgatcaaggacatccgccgcgctacgcgccggcagttctcggccgaagagaagatccgcatcgtgctggaagggctgtgcggtgaggacagcatcgccgagctgtgccggcgcgagagcatcgccagctcgatgtactatggttggcccaaggagttcctggatgcgctcctcgtcgaccgccatcccagcagattagcacgccgcgctcagagcggacgtggtgccagccgatcggttacgttcgattga

SEQ ID NO: 7220 - DNA, 2337 bp, Methylobacterium sp.
atgcccgacatatatccgcagcctgacgcgtctcacgtgatcgatacggcttggtacctgtcgcggtatcctgacgttgcgacggcgggtcaggatccggccgagcactacgagctctacggccgggcggaaggtcggtttccgaacgcggcggcggcggaatcggcgaacttgcgcgcgcaggtcgatcaggactggtaccgtcagcgctattccgacgtcgctgccagcgacatggaccccgccgaccactacgtctcccacgggcgcgccgaaggccggtttcccaacgcagccgccgaggaaatggccgccctacgcgcccgagtcgacccggcatggtaccggcagcgctaccccgacatcggcgcgcaggacgccgatccagtttaccattacatcctctacgggcgcgccgagggccggttccccaacgcggccgccgaggagatggcctccctgcgcgcccaggtcgatccggactggtaccagcagcgctatgcgggcgagatcgaccagacagaggacccgatcgacgattatgtcctgagggggcggttcgcaggccggtttccgaacgagaaggccgaaatccgcagacttctggcgcagcgggtcgacggagcttggtacctgcgtcgctatcccgacatcgccaacgccggcagcgatcccgtcgagcattatctcaacttcggaatcttggaagatcgcgcgccgaattccctcgccgaggagctcagctacgaatcgcggcccatattcgatgccctgctacggcagatcttcgtggctaccaccgggcgcgacgcgaccggggcggagcgggaaatctggtatcgcaaactgaaattgggcctcgattacagctcgatccaggccatcctggaaggcagccgcgacctcaccggacaggcggcgcagacgccacttgaagggtccgcgggcggcacgaacgcgttgtctgaggccgattttcgcgattatcttctgatgtttcacgatcgatttcttggtcgggcgcccaaggccgacgaatacctaaaactcacggagctgaaggagcagggccgtcgcctgagcgatattctcgaagcgatcgagtatggggaagaggcccagaagatccgttaccggccggatctggcactcttgccggagggccagttcgtgcaactccttttcgagatcgccgtcggccgcggtgccaccccgagtgaggtcgagcattacgcgaacgctctcgcgcaaaagacggttgagcggaaggacttgatcgagagcttcttcagctacgcggcgacggagaagctcaacccaacccgcgcgcagttcgggctcgcgcaagcccacgtcgcgcatctatatggcgagcgagacaacctgacgatcgaccggtggcgggagcggcgggatcggctgcaggctgacccgaaggccgatttcgacacgacgcgtcgccatccccggctgctttactctcgttcgaccaagccggaagttagcatcatcaccagcatgtacaaaggtgctaaatatataagaaattttatggacaacatcacctcacagacgatcttcgaagattgcgaactgatcatcgttgatgcggcctcgcccgaggacgagatcagcatcatacagccttatcaagccaagtacgccaacatccgttatcatcgaatcgattacataatcgggatctacgacgcgtggaactacgccgtagaacgaagcaccggccgcttcctcaccaacgcgaacctagatgattgccgttcggccgagtcgctggagatccaggccgcggcgcttcagactttgccctttatcgacgtggtctatcaggacgtgttctacgcgatggaacgcgatctcagcttcgacgagatccgccgcttcggcttcgcaacaaatcttccgatcgtaagccgatataatctgctggaattcaacagcccacacaacgctcccatgtggcggcggagcctccacgacgaactcggcctgttcgatacgaactacaaatccgccggcgattacgagttctggatgcgatgccaagtggcaggaaagacgttcttcaaatcgaatgttcctcatgtcgcatactacgtcaatcctgaaggattatcgacgcggccggacacacgtggcatcgcggaggcgaacgagatcacgaaaaaatattgcaggcagctcatctcagaccatctgaccagcaccgaatccgattatttccactctcttcccggctacgatgccgagcaggacggcgggaaatcgcggtacgaggtggtgcaggcatgcctcagacgcctcgcatccgccacttaa

SEQ ID NO: 7221 - DNA, 309 bp, Methylobacterium sp.
atggcgacagacgatcccgcgcacttcaccctccgccggcgcctgctgctcgggctggcggcggccccgctcgcggcatcgctgccgcgcgtcgcggcggccgccgaggccggcgctctggcggtgaccgacagcgaggtgacggtcggcatcctgcactcgatcaccggcaccatggcgatctcggagaccgggccgagccagggcgagaagctggcgatccagcagatcaacgacgccggcggcgtgctcggacgcaagatcaagatcatccaggaggacggcgcctccgactggccgaccttcgcc

SEQ ID NO: 7222 - DNA, 99 bp, Methylobacterium sp.
atgcgcgccatatggatccggagcccgctcgcggcgagcccgacggctcaggcgttggcgctgaggcgcttgatgtcggcgtcgaccatctcggtgatc

SEQ ID NO: 7223 - DNA, 240 bp, Methylobacterium sp.
ggcggcgtcgagtacgccctgcccaccgactcgttcctgaacttcttccgctcgaacgccgtgacgctgaaggtcgaaggcctgtacgtcagcctcgaccgccagaagaactcggccggcggcgtgttctacggcaacctcctgcccccgaacggcatcgcctacctcaacggcgccgccgccaagaccgagttcgccgtcgtccgcgccggcctgaactacaagttcggctcgtactga

SEQ ID NO: 7224 - DNA, 123 bp, Methylobacterium sp.
ttgctggaccgcgttccgtctccttcggcgctgcggcgtcttccggagtcggagcttccggcggtggcggacgcggtgcgcgccgagatgatcgacgcggtctcgatcaccggcggccatctc

SEQ ID NO: 7225 - DNA, 162 bp, Methylobacterium sp.
atggaacggttcgttgtcggcgccgagcgcgatcagacgacgctgttcccgccttatctcgaagatcggatcgccgaggacaaccctgtccgggtcgtcgatgcctttgctgcctccaggggcacccaaacggaaaggtggctcagggaccgagaggcgtga

SEQ ID NO: 7226 - DNA, 153 bp, Methylobacterium sp.
cgggagcccctcgacgcggcggcgggcgccgtcttcgccgacgtgccgaacctgatcctcacgccgcacatcgccggggtgacgcaggaatcgaacgtgcgcgtctccgccgtcacggccgcggccgtccgccgccatctcacggagcgctga

SEQ ID NO: 7227 - DNA, 312 bp, Methylobacterium sp.
gtggccgcgctgcgccagaagggcgtagagcatcacgtcctcgcccacttccagttcagggtcttcccggaccacatcttgaagcggttggcgccgagcaatccaggcgttgctttgtatgaaattgtcgagccggagcaaacgattcagattataccgctcgaggaaggcaagctccgaccgctcttcgatctcgatccccagaggtccggcgaaattctctgcagtacggaatatgccgggatcatcttcacgccgcactgcgcctgtgtaggccatgacgcattctcgatctttgcagatggcgtctag

SEQ ID NO: 7228 - DNA, 258 bp, Methylobacterium sp.
gacgccgtcgcccgctccgacaccttcttcgagcgcggcggcgattccatcctcgtgatgaagctcgtcgccgccgtccaggagagcctgggaccgcgcctgccgctgcgcgcggtcttcgatcacccgactctggcggatctggccgcccggatcgacgcggacggcagcaccggcggggccggggcggccgacctcaccgacatggagagctggctcgacgcgatcgagacggcggcaggagcgacgcggacatga

SEQ ID NO: 7229 - DNA, 882 bp, Methylobacterium sp.
gcgcggctggtggcggggcatttcgaccacggcttctaccgggcgcgctacgggctgtcggaggcggaggacgcggtgcgcgactactgcgacaccggctggcgcgcgggccgcaaccccaggcccgacttcgacgggcaggcctacgccgacgcgcatcccgggatgcgcgagacgggcctcgcgcccctcgtccaccgcctcgccacggcgctgatgcacggcaccgacatcgcggccggtgccttccacccccgctacggcacgccggattcgcgggaggcggcgctggccgacgaggcccggacggtcgcgccgttcttcgacgccgccttctacgccaagcgcaaccccgacgccgccggggcccccggcgggccgctcgcccacttcgtcgcctacgggcagcacgagggccgggacccgagcaaggccttctcgatcgcgttctaccgggagacctacgggcacctgctgggtcccggggagtcgccgttcctgcactacgtgcgcaccggccgggccgccgggttgatgggctgccccgaggatctcggcacctacccgcccatggaggctccggcggccgacgaatgggaccgcctgccccgggccctgcccatcgcgcaggcccgcgtcgtcgtcatcgtccccgtctacaagggccgcggcgagaccctgcgcgccctccacgcctgcctgtcggcgccccaggccacccccttcaccctgctcgccgtcaacgaccgctcccccgacccgcagctcaccgcggacctcgccgccctcgccggccgcggcctgttccacctcgtcgagaacgagcacaacctcggcttcgtccgctcggtcaaccgcgccctcggcctgcgccagggccgc

SEQ ID NO: 7230 - DNA, 651 bp, Methylobacterium sp.
cagcgcggcctcgcgatgcggcaggtcgccgaccgcttcgccgacgccgtcggcgggatcgtcgcgcaggtctcgaccgcggcggcatcgttgcaggccacggcccgcggcatgacggagaccgcggccgagaccgcggggcagtcgaccaccgtcgcggccgcggccgaggaggcggccagcaacgtcggcaccgtggcggcggcggccgaggaactcggcgcctccgtgcaggagatcggccggcaggtcgacggctcggccggcctcgcgcgggcggcggtcgcggaggccgaccggaccggcgcgctggtccgggacctaagcgaggccgtggcgcggatcggcgacgtggtcggactgatctcgaccatcgcgggccagaccaacctgctggcgctcaacgccacgatcgaggcggcgcgcgcgggcgcggccggccgcggcttcgcggtggtggccacggaggtgaaggcgctggccgagcagaccgcccgggccacggaggagatcgcgggccagatcgggcgggtgcaggcctcgaccgggcaggccgtcgcggcgatcgggacgatcacggcccggatccgcgacatcgacggcgtggcgaccacgatcgcggcggcggtggagcagcagggcgcggcgacc

SEQ ID NO: 7231 - DNA, 102 bp, Methylobacterium sp.
gtcaccgcctgggacggcggctcggccgccggcggcggccgcgtgatcgcgggcggcgacccgcggctgcacgaggccgcgctcaaggttctgaacccgtga

SEQ ID NO: 7232 - DNA, 96 bp, Methylobacterium sp.
gtgcgggccggaccgacgacggatgagcgcgagcggatcaaggcgctggagcgggagaaccgcgagctccggcaggccaacgagatcctcaggaag

SEQ ID NO: 7233 - DNA, 1869 bp, Methylobacterium sp.
ttgatcatctcaaagtcccatttattcgatccagatttctaccgtagatctgcgcaacaagccggcgtacccgtcaagaacagcgacccgatcgcgcactacctctcgatcggcgacaagcggcgcatcgcgacgcatccgcttttcgacacgttctactaccacgaccgctacagagatgttgagccgagtgggatgtcggcgctgttccattatctgcaatatggcgccctggaattccgagatccgcacccgctcctgaactcgaagttcatcgcgacgcaaatcaatctcgggtcagaaaacccgctcatcgcgtatctgcgactgccccccggcacggtcgatccgcacccagatattgacgacgaatacctggcggaacagctcaaggagaacgggcttctcaaatcgaacgccctggtcgattttctcgcagaccgcacctatagcgccaatccttcccggaacttcgatgttcgcagctacgcgcggttccatccggatgcgtgcagctatcaccctttctatcacttcgtctgcttcgggcgatccgaaggccggcggtacgaatccctcgaagacgatgtgagtggcctgctgtctcaaatcgacgagatcagcagcctcgacgtcgatatcatccctccgcataccgacgtgaccgatctgcccaaggttcggtcaatctccgccgcccgggaggtgtcgtctctgctgaaggtcctgcaaaagatatcgggcggctcccgcatcaatcatctcttcttcgttccgcatctggtgttcgggggcgcggagaaggttctcgtgaacatcgtcagcgtcctgtcgcgcgacccgcgtacggaggtgctcatcatcatcaccgacagcagcgaggaagtcgcgattaattggttaccaaaacgggataatatcaagatcgcgaacatctatccatttacaaaacatgtcgaccgtttcgatatcctgcaatgtctcggaatctatctgcagaccggccggttcgacaacgtctacagcctcaattcaaagattggatgggatctgttcgagcgctacgggctcgccctctcgcaattgatgaagattcacgggttcgcgttttgctacgatttcgacatctatggacggcgcggcgggtatgcgtggacacaccttcagcactgcatacgcttcatggaaacggtgatcaccgacaacgatccgatcgtgaaggttttcggtaaagagcttcgcctcgcggaaagcgagatccgtaagttcagggtcctgagacagcccgtggagatcaaggccaatcatgtctatgacatgcagggcttcagccagatcgactcccggaggaccaggccgaccgtgctctgggcaggtcggttccacaagcagaagaacgtcgattgtggcttgaagatcgcggccttgctgccgcacatcgactttctgtttgccggcggatccttcaacgacctgtccgacccttccccggagatctcggcgaatgtcacgtttctagggttgtatgaccgcttcgaatcgcttctcgaccgacggatcgacctgttcttgcacacggcggattgggatgggctgcccaatgtcctcctcgaagcggcctcacatgggataccgatcgtcgcgagagatgtcgggggcgtctccgacctcgtcgattccgacacgggctggcttctcccccagagcgcggccgagagagatttcgcgaccgtggtctccagcgcgctgtccgatcagcaggccctgagaggcaaggtcgaggcgatgacctccaaattacacgccacgcatacgtgggatattttcagccgcgaggttgtgaaggtcctttctgagcaagagatttga

SEQ ID NO: 7234 - DNA, 1971 bp, Methylobacterium sp.
ttgacgcgtcagtggatcgacgactacgatttcgcgaagatttgccgcacatccattgcggaatgccgatatggatctttaggcccggcccgaaaccacgggatctcgatcgcccgcggcgactatatcgcgaccgtcgatgcggacgacctggtgtcgttcaacatgtttgccggcctgcacctcgctgcgcaatcagccggccgaaacgccatcgccattcagaactacattctggccttcggggccaagaatttccttgtagaatatttcggcaccgacacggtcaacaaactcggcttcttttcataccatccgggcgtctccaggatactcgctcaccgatcgctgttcgagcaaatcgaatatgccgacacgaaactcggctccggctatgcatatgaggactggcacttcagctgcgaggccctgtcgcgaggctacgaatacgtcacggctgagaacaccatcctgttctaccgccagaggcgaaacagtctgctccaagcggccgaccaacactcggtccggcaaacacctccgaccgcgctgttccagcccaggaattttctgggtgtgtgtcgccgcgattacaagcggttccggaacggggagatcgcgaccaaggatgccgacgcggtgcggcgacagttcgacgacaatcgcgccctgtgggagatcgtccgcgcggcggcttccatcgaccccgcaatcacgatgcgcagcgccacgagtctcccgatctacacgaacctcagtgaagcgctgaacgccggatcggcctatttccgcgcctgcagccttctcggtgagaggcaattcaccgacgtcgtgcttctaccgttcctatcgaagggcggcggagacaagtatatcctcgacgtgatcggagccctttcggaactggacccggatcgaagcttccttgtgctcgccggagaaccgttcaaccaacatgcctggatggaccggctgccggattccgctcggttcatcgatatctacaggcactgccgcggctgcacagaagccgaacgtcttctcgtaaccctcaggctgatcgagaatttcgctccgagtgccgtgcttcacctgaagagttccgtttacgccgtacggttcatcgaaacatatcacgccgtcctgaatgcgctcacgatcgtgttttatcgattttccgatcatcattacacttataatgacatcgatttctgcgccggatacgtgttcgatttcatttcagaatacggcgagatgttctggaaaattataaccgacaacgccaccatcctgcggcacgacaccgagcgcttcgacagcttcgcggatcgttgggtcgtgctcaaggcacgctgcgtcggcgcatcggcgcggtcacacgctgacaatcccggaacggccacgaagcggatcctgtgggcctcgcgattggatcctgagaagcggcccgatctgctcataaaaatcgcggcggccgttcagggtcggaatcccgaattgtcgattgacgtatttggaacggcagcgacggaccacttcgacgtctcacggttcgaaggactgccgaacgtgatatatagaggcgggttctcgaacttcagtgagatcgattccgatcagtatgacgcctttctctataccaccgccttcgacggcctgccgaatgtggtccttgaggcgatggcgtcgggccttcccgtcatcgctcccgacatcgggggagtcgctgaagtcgtcaagaccggtgaaaccggctggctgctcgacccttcgccaaatgacgagacatttatcgcgcgctattgcgacgctctcggggacatatacgcgaagagcaccgatctgagcctgctgcgccgcggcgccatcgacttggtgtcccagcgccactcggctgagcagttcctaaatgccgtcggtgccatcttcgcgtgtcgtccggagcagcgcgcgcgcgtcgatgcgatctga

SEQ ID NO: 7235 - DNA, 150 bp, Methylobacterium sp.
atgaccaagggatctgcccacctcgcgtgggatgttggcggccagcacgcgctggtgcgatcggagatgctcaacagcgtcagcgcggcgggggagcggcacggtttggcagagcccggccgcgtttggtctcagggggacggatcgtaa

SEQ ID NO: 7236 - DNA, 90 bp, Methylobacterium sp.
atgaccgacggatctgcccacctcgcgtgggatgtgggcggccagcacgcgctggtgcgatcggagatgctcgacagcgtcagcgcggcg

SEQ ID NO: 7237 - DNA, 471 bp, Methylobacterium sp.
atgactaggacccgcgcattctggtggggctacgtcgcggccgtcacgctctacgccggcgccgcggccgcgttccactatggccccggcatcgaggccaagcggttccccgtccgggtcgaccagaccgtgcacgacatcgagcgtgacggcgccggcctgtgttggacctggtcctcgctcaaggtccgcgaccgccggtctgacgacatggacgcctacctgtgggtccgcggccagcgctacgtcgtcgccatccaccgtgcctccgacggcgagccatggtcgcaggcaggcgcgcttcccgtcggggggccgcaccacctccgctactgcaccacccttccgccatcggtgcgacccgcggatgacctccgcctcgaacaggtcgcctggttcccgggcctgctcggcctgtggcgcgtgccgctccgcatccccgacgtcgtctccccgggcagccagtcatga

SEQ ID NO: 7238 - DNA, 354 bp, Methylobacterium sp.
ttggctccggggcaatggctctacacggttcgggacttcgaggacttccggagccgctacagtcagcagctcgcgtgcctcgatgcagacgacatctccgacgagatcgaccgcttggccggtggccggatccccgtgctgtgctgcttctgcaagccctcgaccagaggaacggcgtactgtcatagaagtcttgcatccgcgtggcttgagtatcgcctgggtctcatcgttgaagagcacggggtgcccggcggtcatggtgttttccacccgcttctaccggacagccaccgtcgtcctgtagagacgccaacagcctcgatctacccggtgcaactcgatctcctgtga

SEQ ID NO: 7239 - DNA, 168 bp, Methylobacterium sp.; identical to SEQ ID NO: 6131

SEQ ID NO: 7240 - DNA, 495 bp, Methylobacterium sp.; identical to SEQ ID NO: 6132

SEQ ID NO: 7241 - DNA, 225 bp, Methylobacterium sp.; identical to SEQ ID NO: 6133

SEQ ID NO: 7242 - DNA, 147 bp, Methylobacterium sp.; identical to SEQ ID NO: 6134

SEQ ID NO: 7243 - DNA, 870 bp, Methylobacterium sp.; identical to SEQ ID NO: 6135

SEQ ID NO: 7244 - DNA, 303 bp, Methylobacterium sp.
atggaggggccgggcatgatctcgcgctccctgcagctcgacgacttcctctgggcgctggacaacagccggcgccggtaccgggtccgcccgacgcggctcggggatctaaccttccggttcggggaaacctaccccggcctcatcactgtcgtgagcatgaacggcatccaccgcgtcgtgatgacggcgcggtgtgaggtctctcccggcccgtggctcgataccgacgcctacgccgacttccggctactggcgatcaatcgcaagcgcgctctgcggaattatggaggcgcgcgatga

SEQ ID NO: 7245 - DNA, 201 bp, Methylobacterium sp.
gtgccgcagcacctcggcggggaaagcttgagcttacatcagggttacaccgcgaacacagtcgcggacctgatggagacttccatgaccctcgttgcccgcttcgccctcgccacggccgtcgccgccgccaccgtcgcggttctcgccgggacctacgtcgagatcctggaccgtgccctcccgatgcacttcgtctga

SEQ ID NO: 7246 - DNA, 339 bp, Methylobacterium sp.
atggtcccgaacgcgctcaacatgctcctgggcgtcgcgctcctcctcgcaccgtggtacttgaatctgggctacgagacggccgccgcgcgcaacgccttcgtgaccgggggcgccatcaccgtggtcgcacttctggccctcggcgtgacctgcgcctgggaggaatacctcaacgtcgccctcgggttctgggcagccatggcgccctggcttctcggcttcgccgacgcgacggcacccgtgtgggtgcacggcctgaccgggctcgccgtggccgcgctggccgcgtacgcgctgtggcggctcttcgtgtcgccccaggcgcgctccgtctga

SEQ ID NO: 7247 - DNA, 144 bp, Methylobacterium sp.
gcgcccgcccgcgtcccgccgccggccgcgtcgggtcccacgtcgggtcagggcccgtcgccccggtcgacggcagggcggcggacgaacgagctgcggctcggcgagcgctggaagcggcgcctgccgcacttcatgcgctga

SEQ ID NO: 7248 - DNA, 240 bp, Methylobacterium sp.
ggcgggaccgcggagatcgtcaacgcgggtggccggatcacgaccgagggcgactcggccttcggggcgttggtgcagagcatcggtggcagcggcggcagcggtggcggcgccttcccggccggggccttcttcgcggtcggcctgggcggcagcggcggcggcggcggtgatggcggtctcgcgcgcttcaccggccgggccggcgcgatcgagaccggcggggcgggatcgacggcc

SEQ ID NO: 7249 - DNA, 171 bp, Methylobacterium sp.
gtgcattggaaggagccggcgcagtcgctcgcgatcgcgggggcaagcggcgatccgatccagcacgtggccttgtccagggcgaccgatgagcgacaggccgcgctcactgccctcttcggtcgggccgtgcggcctcgcgggtcggcggcacctcacaggatgcgctga

SEQ ID NO: 7250 - DNA, 195 bp, Methylobacterium sp.
ttgcttcggctgaaggtcgagaccgatctcgcccgagcggtggaggccgcagcccgccagcgcggccagaccatgagcgagttcacgcgccagagcctgcgtgcccatctcgcccgctgcggcgttcggctcagcccagatgacggccctcgcgctccgacgctcgacgcccccgcccagcggcaggccgcctga

SEQ ID NO: 7251 - DNA, 183 bp, Methylobacterium sp.
atgcgctatcgcgccaccaagacgccccacgtgcagaccgcgatctatgccccgggcgagatgttcgacccggtgctgcacgacctcccgcagcacgaggtcgactggctgctgaagcaggaggcgatcgaggttctgaaggatccgccggcgccgcaggcacagaatagccggggccggtga

SEQ ID NO: 7252 - DNA, 3429 bp, Methylobacterium sp.
atggcgtccaagaccatcgaggccaagctcctcatcaccgcggaatcgcgggtcgaagccgagatggccaaggtcgccaaggcgatccagcagggcctcgacgtcacgaagtacacggccgagacggccaagctgagccgggcctgggagcaacaagcgaaggcggccagggcagccgcggccgtgatggatgcccgcaagccgctcgaggcgacggtgcaggggatgcagcgggtcggcgcccaggcgacgcggctggctcgcgagtacgacgtggcgaagaaggcggcggccgaatacggcaaggcccaaacgttcatcaaaggcagcgagcaggcggagcaggccgcgcggctggccgccgaggtccggcgcctcggcgatgcgcatcgggcggccgtcaacgacagcaaggccctgacggcagccttcagcgccgagacggcggcgctcagggcggccgagagcgcggcctcccggtacggcgtcgacctgtcccgggtcgagcagcagcagcgcagcctgacgcggagcaccgatctcgccgccgccgctttccgccgacaggtcgccgctgaggaagccggcgcgcgggcggctacggcccgggctcagcgccggcaggcccaggatgtggccgccggcgtcgttgccacggcgacgggcgccggtctgcgcggcgcctacgtccggtctcgcgacggctggatcgagatggacgaggcgagccgtcgacaaagggcggtgctcgggatcgaccaggcgaagcagagcaccctgaacacccaggcgctgaagatcggtcaggacacgcgcttcagcaacccggacgtagtgaaggcacagacccgcatcgggtcgagcctgcccgaccacctgaaggatccgaaggtcctcgtcgcgatcaccgagaacgcgaaggactacgcgctggccatgggcacgaccatggacgaggcctcgtcggccgtgctcggccggatgctcggtctgcgcatgaacatgtccaacccggaggcagcggcagcgtctgccaagcacgccaccaaccgcctggttcagttcgccaagagctccggcgccgatcacaacgacctgatgggctacaccaagttcggcgcggcgccgagctcggtgggaggcttctcggaggagttcacggacgcgatggccgctcagctgcggcgaatcggctacgaaggctctatggcgggcaacttcgtccgggcagcggcgaccaagctcgcggtcccgaccgcgaagggtctcggcgtgctggcggggtcgggcctgaaccactccgactacgtcgcccccggcaaggcgctctcggccgacaacctcggatcggcgctgcggctgaagttcggcaaggggttgaacgacagccagcgttcccgcatccgcgagctgatggaagacgaggacatcgtcggcaaccgggaggagttcgtcccgaaagtctccgcgatcatccaggagaccttggcgagacggacgaagaagggcgcggtcaacgctcaggatgccgagcggatcgcgaaatcggtcaacgagtacctgtcggcctctgcgggcgccgtcgatatcgagcgcctgatgcgggacgtgatcgccaagggcatcacgcccgccatggcgaagtacctcttcgggcaggagcacggcggtcgagcacaggcgctcgatctgaagacgctcaacaaggacgtcgagacgttccgcaatacgccgcaggaccgggcgcagaagatcggcgaggacatcaacgctggcacctacggcgcctaccagcgtatgatcggctcggtcgagacgttctggatgaagctgggccaggtcaacgacggcccgctgaccatgttctacgacaaggtcggcaacgcggtcgacgccgtcacgaacctgcctcccaacgtcatccaggccggcaccgccataggcgggctggccggcgccgcgatcgccgcccgtggcgcgttcggcatgttccgtgtcgggcgcgaccttctcgggttcgggggcggcgcggcggccctgaacggctcggcggtggcgctgaacgcagccgcggcggccctgaccgaggctgcggtgctccagggcgccaagaccgcggccggcgccttgcccgacgcggcgaagaagggcggcaagctggccgggctggcgaagggggcactgggcatcacggcgatcggcggcctgtccgagctggcccagcaatacgacaccctgaagatgcccgagttcacgaaggacggcatcggccgcgggctcctcggcgccctggatccgaacctgcccgacatggtgctgggcaagaaggccgacgaggtcgggaaggatgccgggaccaaggtcggcaagggcatcgcggagggcgtgaaggagaaggcccccgaggtcgaagccgagggcaagacgctgttccagcgcctgaacgagcagttccgagagggcatcttcgtcccgatcaacttcgcccctggcgcgggcatgggcggcggtgggtccggcgggctgatccagcgcgcgagcttcagcccggatggcggtggtggtggcgggatcaacctcggtggcgttggcgccggcgttccgcgcttcgggggcgggaccggcacaggcggcggctccggcggtggtagcgcgtcaggcggctcgatacccggcatcccctcctcggtcgacatgacggatgccgagcgcaacatgctcggcctcattcagctgcacgagagccacggtcggaacaccctgaactacgtgggcacccgccagggtctcgatccgatgacggcccgcggcgccaccgctcagggctactatcagatcctgaactcgaactggcggcggctcgcgcccggcctcgggatcaagacgcggaacgccatgtcgtccaccctggaggagcagacgcgcgtggcgctggcgctcctgcgaagcagaggtggacgtccgcaggactgggctccgttcaacccggcgctccgtgcagccattcgccggggtgatcgggccccgttgggcgccggtgtggccaaggatgcggccgggcttgaaccgaagctgatcaagggcctcgacggcaaggaaggcctcgacctcggcgatggcacgatgcggatgtcggacgggtcgatccggtcgatcacccgcagcggtctggaaattccggacgcgccggcgggcggcatcggtgcggcgggcaacggccgcggcagcatcggtgcgcacgtcgaggagttcgggcgccacgtagaccggctccaggacatgggcgtccacgcgcaggtggaggtcacgggcctgcggcgcagcggcctccgggcaacggcgctgcgcgtgcgcggccgcggcggcatgtcggcggatctcggcgtcagcgagcccggcgccaaggaagacctgagcgactggagttga

SEQ ID NO: 7253 - DNA, 474 bp, Methylobacterium sp.
atggagccctgttctctcactcctgacctgtttcatggccgcactcgtaccgagacggccgcccttcatccgccgcccctgcggtacactgccgtcaggagggtcaatgcgctcatccctcgcgatgagtggcagtacgtcggatgccagcagcgcaagctgccgttggtccttcgccggatcgagtacagcgacaatcccttgtccctgtgcgtcacgccagaggatcccgagcagatcgaggaggtctgggagatcctgcattccaacgacccggaccgttcctacaacgtgctgctcaagcgccggataccggcggttggttacccgctgtggtgctattgggacggcgcctacgagcagcaggaacggcggctcggtgacgccgtctgggaggccatgaacgaccagcaggtcgaccggtcttcgaccggctggcggaaggacaggtaccctaccccccctgagtattga

SEQ ID NO: 7254 - DNA, 120 bp, Methylobacterium sp.
gtggcggcgatgcgccatccgggttcgatgatcaagggccggcgcggcggccgacccgccgacacgacaatggtcgccccgggcgatatgctcgccgcctatccgcacgcgctcccctga

SEQ ID NO: 7255 - DNA, 522 bp, Methylobacterium sp.
gtgatggcgcgcgcgggctgggttcggcctagcggcgtgctagcggcgtgcacgcgccttgcgggccgcgaatcgcgcgtcgcgtgccgccttctgttcggcggcgcgggcaacctgctgctccgccttctcggcggccagacggtcggactcggcctcggcgcgggcctgcgcggcctggacctcagcctcacgctcgatctcggcggccagacgaacggcttcccgttcggtcgcccgcaggtcccgggcctggacgaccgcgcgccgcgcggcttgccgagcgaggacgaccggatcatcggccgccgggcgtgcccggaaccgggccagtgtggcctgccgcgctctggccgtctccgcgagacgatcgacgaggtgatcggttttcaaaggcttcacgaactctccgtgggcgcaccggacgtcagcccccggtggcgagacatggatgaagccgctccgcgtaggaacggcttcgaagcgcgtcacgagtggacgcgtgagactcaggccgcctga

SEQ ID NO: 7256 - DNA, 669 bp, Methylobacterium sp.
atgcggcccacgagtggccccgtcctgggtcagcgagtcgagtgggaggatctgggccgggcttccctcatgacagtgctcgccggcttcgtcgacgccgtcggctatgccgccacgggtcacctgtacctgtcgttcatgagcggcaatagcacccagttcggcatggcgctcgcccgcggcgacgcgcaggtgataggctgggccggcgctgtgatcgccacgttcgtgctgggagcgttcctgggatcactaggcgtcgccgtcgaggcaatggtcaggcttccgattgtgctggccggcgaacttctgtgcttcgtctcggcgtggatgctcctcggtccgtggaccgccgaggccgcgctactgttcctgtccctcgtgatgggcatgcagaacgccatccgcacgtccgtcgccggggcggcgatcggcaggagcttcgtcacgggctctttgtttggcgtgggcaacgccctggctcgcgcttgtctcggccgcgcacgcttggccgaggccgcggccgacgccgcctcctggttggccttcatcctaggcgtgacctgtggcgcgctcgccatcggcgcacttggcctagccaatgccctcatcggggcggcgtccgtcgtcgccgccctcatggcgctggcgatgatatggaggcgctag

SEQ ID NO: 7257 - DNA, 834 bp, Methylobacterium sp.
ttgctctcgtcaaatcacggggcacaggtcatgatcatagaaaatgagcacgtcgcctcgttggcggaagctttctccatcaaggacgcgggacagttggcgcgcatggccgagatgggcgctcgatccagctccatggcgcacgacctgaacaacctcctccagatcatcgtcggcaatcttgatttcgtggccgccggccccctggacgagaaggccgcccggcacctgtcgctcgcccgtgccggggtcgagcgctgcacccacctggcgcgccgtaccttgaagcaaggatgctcgcgcgagacggctgggctcctccaggtgtcccgcttcctcgaggaggtggccgaccgactcggcttcgctggcgggcacgggatcacccttgagatcgtcgcggtcgactcggctctcgcgatcgaggcggatgaggcggagttggagaacgcgctcctgaacctcgtgctcaacgcacgggacgccatgcacggccagggccggatccggatcagctgccacgcctcgccggccgggggctcgcggtcggacgggagcacggtcgcgctcggcgaggtcgtgttgcttgtcgaggacagcggtccgggcatcgcgccggagatccaaggcgccgtcttggaacggttcttcaccacaaaggcccacggaaccggcctgggactggcaaacgtgcgggctttcatggccgaggcggccggtacgctcgccattggcaacaggcccgagggcggggccgtcgtcacgctgtccttccctcaggcgcaggcggaatcgccgcccacgtacgtcaggagccgcatccatgtcgattga

SEQ ID NO: 7258 - DNA, 231 bp, Methylobacterium sp.
gtggatctacatcgccgcatcgccgaggcggagctgcgctcaacggccgcgacccgcgcgcttaccgcactgattgggaccgaagccgacaccaccgaggccgagcggcgcctcaacggggagctggacaggttgctggtcctgcgtcggcaacttgccgatttgctgttgctgggtgaggcgggaagcatccttcgcctggccccgcccccgactgggcgtgaaacttga

SEQ ID NO: 7259 - DNA, 684 bp, Methylobacterium sp.
gtgcacgacggtggtgacacgcgtcgcagccgccacgtccaacgtcccgccgtccagaacctggttgagcaggtcctgcttggcgacgacgccgaccagctcgtcgacgacgccccggctcaccaccatccgcgcatggtcgcacgcgcggatggtggcgtggacggaactcgtctcgccgtcgaggtcgagccactcgacgtcgtggcgcggggtcatgatgtcccgggtccgacgcccgccgatcgcgaggattcgctcgacggcttcctgctgcgcctcctcgatcaggcccgctttctggctcgcctggacaaggaggttcaattcggccgtcgagtaccgcgcgccctcgccgtggcccgggcgcaggccgaccaggcgcagcaccccgttgccgaggccgttgaggataaggatcgccggtcggaacacgaacaggaacaggcccagcggccggacgatcgccagggccgtgcgctcgcttcgctggagcgcgaagctcttcggcgacagttctcccaggacgatatgcaggcccgtgatgccgacgaaggcgagagcggccgcggcgctgtgcgaggcggccgtcccgagggagctcggaagccaagtcagggacggctcgatcaggtgggcgggcgggctcgccgattcagccgagcgccaacgacgcgagggtga

SEQ ID NO: 7260 - DNA, 207 bp, Methylobacterium sp.
atgcccctccgcgagatcgacgtgctcggggtcttcatcgcgcccttcgccctcggactgctcatcgccacgatctgcacgttgatcgtcggagccaccctgaaacgggttttgccgaccacgtcgatgacgcgctcgccaattttggaactcaccctcttcgtcgcgaccctctccagctttgtcctgcttctcgggcgtctgtaa

SEQ ID NO: 7261 - DNA, 522 bp, Methylobacterium sp.
atggcgatgaaatccgaaatcgcgaggagcatccgttcggctcctctgatgacgccgagcgatttttcatctgccgatatcaacagcctgtccgcggaactgcgcgtgcttctggcggacgtgttcgcgatatatttaaaaaccaagaatttccattggcacatgtccggcccgaacttccgggattatcatctccttctcgacgagcaatccgagcagattttcggtatggtcgatgacatcgccgaaaggacgcgcaagatcggcggcacctcggtgcggtcgatcgggcaagtcgctcgcctgcagcgcgtgctcgataacgatgccgatttcgtcaccccgaaagacatgctggccgaattgcgtgaagacaaccgtcaattggtaaagtcgatgcgggcgattcaccaactcagcgacgagatcggagacgtggcgacggccagcctgttggagaactggatcgacgagagtgagcgccgggtgtggttcctctacgagatctgccgaagcctttga

SEQ ID NO: 7262 - DNA, 528 bp, Methylobacterium sp.
atgaaggtcagcgacctcatcgcgctggcgagcttcttcggcacgctgtcggtcttgtccattggcggcagcaacagcgtcgtcccggagatggcccgtcacgccgtgggggagcggcactggctcaccggcgatgccttctccgacatcttcgccatctcgcaagccgcgccgggacccagcaacctgatcgtcgcgatgatcggctacaaggttgccgggtttgccggcgccgtggtcgcccaggccgcgatgatgctgcccgccggtctcctgatgatcggcgtcgcgcgcttctggcaggcatcctcgggcacccaatggcatgtcgccctagagcgcgcgctcggaccgatcgccgtcggactgattctcgcgagcggctggatcgtggccgagaacgccgccctgtcgttccgtggctatctcgtgacggccctctgtacgctcgtgttctggcgaacgaagctcaatccggtgcccatcctgatcgcggcaggcttctttggctgggccggcgtaatctga

SEQ ID NO: 7263 - DNA, 627 bp, Methylobacterium sp.
gtgtcccatcgcccgttgcgccagcggccgagcggcagcgtcggttccggctcccccgtcggggtgctgggacgcgtcgagctgggcgggcgcctgccgatcatcggcgcccccgagatggacgtcctcgggcagggggtgcacgcgttcctggcggccgaccggaccgaccggagccgcgaggatcgcttcctccgagaggggatggtgctcgatcgttggaacgtggcgggccacgttggatggtcgtccctcgtgggggcagccgaccggctctgggcgttcctggaccggcgcttccctggggcccggctgcggcgcgaggtgcccgtgttcgccacggtcggatcgcaggtcatcgtcggacgcgtggacctgctcgtcgagatcggcgatcggttcgccgtcatcgatcacaagagctttcccggtcgggaaagcctgtgggacgcgagggcgatcgcggcggcctctaagctcgaatcatacgcgcgggccgtcacactcgccacgggccgggcctgcgccgggcttctcgcgcacctgcccgtcgtcggcgcgctctcggaagtcggttccgtcagtccgaggcggctcctgccgctggctgaggccgcgcgaacctaa

SEQ ID NO: 7264 - DNA, 93 bp, Methylobacterium sp.
gtggccgtcctcgcgggcagcgcgaatcaatccagcggcatcacgatcgtcgagatcgcgcggctctgggtcgcttcgccgcgctcgcgatga

SEQ ID NO: 7265 - DNA, 297 bp, Methylobacterium sp.
atgatcgttgaccgcgcgatgtccgatccgatgatcccgctgatctcggctgccgcgttcgtgagcgtgggctggctgatcattcacgccgggcggcagtacgacgacgcgatccggcacacgctgacggtcttcgcgttggtgttcgggctgttggtcctgatcggcgtgaccgcgaagctgcgatcgatgatgggcgtcgggcgcatgtcgcaccggatcgaggcctggtcgcagaacgatcccgcaagcccgatccgtgcggtgcgaaagctcgatgctgggctgaacccatag

SEQ ID NO: 7266 - DNA, 660 bp, Methylobacterium sp.
atggccgagtccagcaccatcacgcgcgagatgatcgaggccggcgcgcgggccctgtacctcaaggatcggggcgtcccggatgacgcgtgggggcgcgaccttcccgaaagcaccatggagctgtggcgcggctacgcccgcgccgcgctgacggcttctgccgcggcgatgttcggctcgaagcgccgcccgtattacggtgacgcctgcctcggcgtggacggcatgggcgcgaacctgcgtctgactgacggctcgctgcaactcgtcttcaaggacgaggagatggacctcatcaacgaagagggtcgcgacctctacgtggcgcggctcgcggcttccgaggtgatccacctccggcagtggctgatcgacttcctgccggcgtccgaggccgagatcagcgcggggcatggcgtgtcgccacccgtgagcgtcaccgttcccgccgccggcagcgaggaacggcacttctggctggaggcggcggagcagcacggcttcgagcagaccagcggcgaggaggaactgcccgcgttcgacccgcccgcctacctcgcgaccgaggacgaggtgctgaagctcatggccgcggcccgggagcaggggcggaaggacgtgctcgacaccctcgcgacgggaggcgcccgtggctga

SEQ ID NO: 7267 - DNA, 231 bp, Methylobacterium sp.
gtgtcgagccctcgccgcgcgggggcgccgcggaggatcgccgcggggatcgccgcggggatcgccgcggggatcgccgcggggatcgccgcggcgatcgccgcgaaggcagccgcgaaggcagccgcgaaggcagccgcgaaggcagccggcccggtcgggcggcgcgtccgggcgagggccgatccgcgctacccggcgacgggcctgaccacgacgtcctcggcgtag

SEQ ID NO: 7268 - DNA, 444 bp, Methylobacterium sp.
atggccggacatatcgggatcagcaaaagcatcgacgtctttgtaaatatgagcctcttcggcaacctgagcggaaaagagaaggggccgccgacgatgagcgatgccctggaattcacgacccgatttacgggttccgcaaaccccgccctgacgtttctgcccggtgtcccggcgacgaggcttgcctccgccggaatcatgtcaacctcctacagggaggacaaacataaagtcatcatcggcctttccctgcctccggaagattcaaagctggcaagcgcgacggaggttttcacgggccagattgtcacgctggctcagacggcgacacccgcggaggtgcgcgcggggaacgccgtcagccaatacatcctgcgattcgaaattggtcgacgagatcccacgccagtggtcgttcagtctctgatcccccttctttaa

SEQ ID NO: 7269 - DNA, 561 bp, Methylobacterium sp.
gtggcgcgctacgtcccgaagaacctgcgggtctacttccaatccgagaatggcatcatcggcttcggtgcgcgcccgcccgaaggcatggaggacgtacacctgacagatgcgggaggcgccttcgtgtcggcgcttccaggggcggtcgccttcgacagcgcgacgtcgttcgcgctgatccgatgcggccacctcgacatgacagtcctcggcagccttcaggtcgaccgtcacggacatctcgccaactggatggtcccggtcaaaattgttcccggcatgagcggcgcgatggacttggtgagcagggctaggcgcgtcgtcgtcgccatggcgcacacgcagaagggcgaccccaagatcgtcgagatcctcaccttgccatcgacctcaatacggccggtgacgctcgtcgtaaccgagatggccgttatcgaacccaccttttccggcttggtccttcgcgagaccgccccaggtgtctccgtggatgccgtccgtgccgcgacgggcgccccgttgtcagtcgccgaggacgttcgcggaatggcactatga

SEQ ID NO: 7270 - DNA, 1512 bp, Methylobacterium sp.
atggaagcgacgtcgattgtcgcgctgatcggtctctttgccgccgccgcgaacgatcgtcggattttcggttcgaacgcacgagggctggccgacgaggcgatctctgcttggaccgcagatcacgccgaaacggtggccagggcggcggtggcggaactgcagcgctccgaagtcgcaccgtcgctcggagattcggtggcgtttcccgccaatccccatgtgcgtggcaccgccgccatccagcgtgtattcctcgatcgtgagtcgcagcttgcggaattggaggcaatctgcacggtcaaagccgatgcggccgaccgtgtgttcgacatctcgtgccgatcgcttacctgggcaatcatcgactgcggcatcgccgcaaatcacccggccttcgacgagttcgaggcggcgcccgatggcgcccagtcgcgtcgtctgggacgcaggaggatacgggccactttcgacctcacgcgcatcgaccgcattcgtaatctcgacctgacgacaagtgatccacagctccgcgaaatggtcatcgagcacatcctggcggacttgagggaactcccgggttctcgcgcgccgaatttcgaccaagtcaccagagagaatttaaaccttatcgccgagcaacttcgacgccgcctgttgccagactgggcgctcatcgagccattgatccgcatcattgaggacgacggggagggcttgtcctcggaccacggtacgcacgtagcgggcattctcgccgccgattggcgcgaacgccgggtcgacggcgcgccggaggaggtggtgctgcgtggcgtgtgcccggacatatcgctttacgatctgcgtgtcctgcacccgaagtcgatcaagaacacagagttcgccatcatcgccgccctggaattcgtgcggcatctgaacagccgcgccgccgggccaccgctgatccacggagtgaacatcagcctgtcgatcccacacgaggtccgcaattacggctgcggcgtgacacccgtctgcgtggcatgcgacgacttggtccaatcgggcgtcgtggtcgtcgccgccgcaggcaaccgcggctggaacgaacgggagatgggcttcggcaacttcgtgttctgctcgatcaccgacccgggcaacgcacagcgcgtgataacggtcggtgccacgcacaaggccaagccccatacctacggcgtaagttacttctccagtcgcggaccaaccggtgacggccgagtcaagcccgacctcgttgcgccaggcgaaaagatccgcgggccgacccgcggcggcgccgacgacgaactcgacggcaccagcatggccgcccccttcgtgagcggcgccgcggcgatgctcatggcacgcaaccgagaactgatgcgcaacccacaacgtatcaaagagatcctatgcagcagcgctaccgacctaggccgcgaacgctacttccaaggacatggcctcgtcgacgttttgcgtgccttgcaatccgtatga

SEQ ID NO: 7271 - DNA, 195 bp, Methylobacterium sp.
atgcccatcccccttcctcctctcgccgaacagcagcgcattgttgccaaggttgatatgctgatgtcgctctgcgatcgcttggaggcaagtctcgatgttgcgagtgagtcgcgaagtcgcctccttgatgctctcgtctctgaggcgctgatgcctaaccaggccactgagttgatggtagctgccgagtag

SEQ ID NO: 7272 - DNA, 588 bp, Methylobacterium sp.
atgtacaagatcacaagccgaaccctcgacgccgtgggcccccaacgcggactcaaagcccgtgaggatgccgcccgcgcccgcatggccgcgccgatcccggaacacgtgctggagaacctgcggatcgctgccgagcgggatcaggccgagcgtgatgctgccgcggccaatatcgcagagagtgagcgtctgcgccgcgagaccgcctgtccgtgcccggcctgctcgggtggccagaaggatctcagtatcgacgaagcggcattcatcatgacggcgctcgcctactaccggagccacgggttcaaggtcgatcccgagatggtcaagcggatgacctactacgctgccaacccgacgttcgttgttcggggaacggccgtggtcgatcccaagacctacgataacgccccaaacatcggcgccatgaacaccgcctctgcgccggtcaccgtccacgccgacgccgatcttgccgctgtggccgatgccgttcgggagcagatcgccccggtagccgagaccgccaagcccgccaaggcgcagcgcaagcatgtcgccccgccgttcctggacggggactga

SEQ ID NO: 7273 - DNA, 426 bp, Methylobacterium sp.
gccggggaggccggccgcggcttcgcggtggtggccgccgaggtcaagacgctcgcggagcagaccgccagggccaccgaggagatcgccggcaaggtcgcggagatcaccggatcgaccgaggcctcggtccggtcgatcggcggcatcacggcggtgatccgcgacctcgcgcggatcggcgccgagatcgccgccatggtcgagcagcagggcgcggccaccgcggagatcgcccggaccaccgcgcagacctcgcaggacacacgcggcgtctcgggccacatggcgggtgtcggcgcggcggccggcacggcgagccagggctccgcccaggtgctgcgggcggcggccgacctgtcccggcaggcgggcgacctgcgcggcgccgtcgaaggcttcctggcccgggtccgcgcggcctga

SEQ ID NO: 7274 - DNA, 579 bp, Methylobacterium sp.
atgcacgtgctgcccatcgtgaccgattacctcgacgcctacccgaccatggcggcacgcacgctgttcgtcgaccggcaggtgaacgtcgtcgaggaaggcatcgacgtcgccgtgcgcatcggccacctctcggattccggcttcacggccgcgcgggtcgggtcggtgcgccgcgtcgtctgcggctcgccggcctacttcgagcggcacggcgtcccgcagacaccgcaggacctgagggaccaccgcgtcgccatgtccacgggcgcctgggcctcgacggagtggcggttcgcgggggatcagcgcgtgacggtccatcccgccttgatgagcaacacgaacgaggccggcatcgccgcggcgctcgcgggctggggcctgacccgggtgctgcactaccagatcggctccgccttgatggaaggccgcctgcatgtcgtgctcgccgactacgaggaggaaccgctgcccatccatgtcgtctaccccgaggggcggcaggcgccggccaaggtgagaacattcgtcgacctggccgtggcgcgactgcgggccaaccgcctgctcaactga

SEQ ID NO: 7275 - DNA, 141 bp, Methylobacterium sp.
gtgccggacatccagctccaggcgatgcaggacgtgccccactacccgctgggccagtacctgcagccgaccgcctaccgctcccgcctcaccgggatcctcgacgggttcccgacgttctggaacgtccggcccgcctga

SEQ ID NO: 7276 - DNA, 99 bp, Methylobacterium sp.
atgccggaccagttggtgacgaaggcgctccagccgccctccgagaccggcccctttcggttgcgccgctgcagcatcgcgttgaactcgaccgcgtag

SEQ ID NO: 7277 - DNA, 99 bp, Methylobacterium sp.
atgccgacccgctgcagcaggtcggccgcgacctggccgagcgccagcagcggcgccgagttcgacggcaccatcagcagcacggtctcgccgccgtag

SEQ ID NO: 7278 - DNA, 315 bp, Methylobacterium sp.
atgcacgcggtctggtcgatcccgccccagagagcccgccggatcgccgggttgttgaagggcggctgcaggtggttgacccgcagcatggtcacgaagccggtcgggtcgaggacgcgggtgctcacgcccttggccgcctgcaggagcgcgatctggtcgtgcgaggcgtattcctgccagtccgtctcgccggcgatcagcgcggaggtcgccgtggaggtgtcgccgatgacgcgccactcgacccggtcgaaatggacgaccttcggacccgaggtccaggtcagcgggccgtccgggcgcggcacgtag

SEQ ID NO: 7279 - DNA, 348 bp, Methylobacterium sp.
atgagctccggcacctgctggaacgggtcgatggcggcgaggcgctccggcatcatggcgcagaccgggacggacgccttgcccagcgcgattggcagcagcgggaacgggtgtttcaggcggaaccggatcgtccggtcgtcgggcgcggagagttcgtcggtcgcctccatgagggagccgccgaacgggtcgcgcttcgcccagcgccgcagcgacgcgacgcagtcgcgggccagcaccggcgtcccgtcgtggaagcgcaggcccgcccgcaggatcaagtcccagcggcgcccgtccgcctcgacccaatggccctcgaccatctgcggcgtggcgcgatag

SEQ ID NO: 7280 - DNA, 240 bp, Methylobacterium sp.
gtgccctgcttcacgccggtgcgctcgccaaagagcaacggggtgagcgaggcgttcgtgaagacgctcaagcgcgactatgcccgcgtccaaccccggcccgacgccaacacagtcctggcgcggatcggcgcctggatcaccgactacaacgaacaccatccccatcgtgggctcggcatgcgctcgccgcgcgagttcatccgtgctcagatgcaaccagccccgtgtccggtttga

SEQ ID NO: 7281 - DNA, 300 bp, Methylobacterium sp.
gtgaacagcgcgcgcatctcaagccatccaaccttccgtcggctctgcttcgagcggaactgcctcggcatcaccctcgcggccgccatggcgacggcctacttcgcctacgtcctcaccattgccttcaggcccgacctcctcggcataccgatccgggacggatcgatcgtgacctggggcgtcgccgtcggggtcgcgctcctggtcctcggcttcgtgctcaccgtcatctacgtgctcgtcgccaacacgcgactcgacggcctgagccggcgcctgcgggaggatctccgatga

SEQ ID NO: 7282 - DNA, 1665 bp, Methylobacterium sp.
atgaccggcgtccgcttcctgttgtccgcggcggcgatcctggtcgccggccaagcccgcgcggatgccttgacggggcccgtgacgcggcaaccgctgaacgcgacggcgatcgcgatgtttctcggcttcgtcgccgtcacgctggcgatcacggtccgggccgcccgcagcggcacccggacggcgagcgactattacgcggcgggtggcggcctcagcggtttccagaacggattggccatcgcgggcgattacacgtccgccgcaaccttcctcggggtgaccgcgctcatctacacgtcgggctatgatgggatgatctacgcggtcggctttctcgtcggcttcccgatgatcctgttcctagtcgcggagccgctgcggaacctcgggcgctacacgttcgccgacgtggcggcgtaccggctatccgaggtgccggtacgtctggtggcgggcctcaacaccctcgtcatcgtgctgttctacctgatcgcccagatggtcggggccggcaagctgatcgagcttctcttcgggctgccctacgtcgccgcggtcgtgctcgtcggcgtgctcatgatggcttacgtcgtcttcggcggcatgcgcgcgacgacttgggtccagatcatcaaggcggtcctgctcctcacggggtccgccctgatgtccgcgctgatcctcgcgcgcttcggcttcagcttggaggagctctttgccagggctgtcgcgctccatccgaagaagcaggccatcatggcaccgggcgggctcgtcaaggacccggtgtcggcgatgtcgctcggcctcgccctgatcttcggcaccgccggcctgccccatatcctgatgcgcttcttcaccgtggccgacgcgcgtcaggctcggttctccgtgctcgtcgcgaccgggttcatcacggtcttctacacgctcctgttcgtgctcggtttcggcgcgatcgccctggtccagggcgatccggcctacaaggacgctgccggcggcgtgatcggcgggaccaacatggtcgcgctgcacctggcggataagctcggcggcccgctgctgctcggcttcatctcggcggttgcgttcgccacgatcctggccgtcgtgtcggggctgaccatcgcgggcgcctcggcggcgagccacgacctctacgcccgggtcctgcgccgcggccgggcgagcgaacagcgggaggtctgggtctcgaaggcttcggccgtcgcgattagcctggcagcgatggggctcggcgtgctcttcgagaaccagaacatcgccttcatggtcggcctcgttttcgccatcgcggcgagcgcgaacttccccgtgatcctcctgtcggtggcctggcgggacctcacgacccgcggggcggtcgcgggctcgctcgccggcctcgtcagctcgctgctcctggtcgcgctcagccccggcgtctggactgcgaccctgaagctgggcgtcgcgccgttcccctacgacaatccggccctgttctcggtccccctcgcgttcgtgacgtcctgggcggtgtcgcgactggaccggagcgcggccgcaacgtcagtccgcgccgcgtacgcggcgcagcacgtgacggcccataccggtttcgaccggcccgccgcgccggcagcgcattga

SEQ ID NO: 7283 - DNA, 4914 bp, Methylobacterium sp.
gtggcgcccttggccctcatccccgctcaggatgggcctgtcctcgtcttcgaggacgcggccgggtcatctgcggccatcgatggcgcccctctctcgatcgagcgcttcctcgagattgccgtgggcgcgacctccgcgctggcgcatgctcacgagcgtagcatcctccatcgtgaccttcgtccggcccacctgctcgtccaggacgacggcgtaatccgacttgccgggttcggcaggggcatcgccctcgacgagccggacgtgcagtggtccgacctgccggtcaccgacgacgcgttgccttatgccgcccccgaggccgcacggcgcgcggacccatacgccgacgctcggagcgacctctactctctcgggatcacgttctacgagctgctcaccggacggctgccattcgccgcgagcaccgcggccgaatggcttcacgcccacgtggccgtgcaacctccccggccaagccactcacgcgacgtcccgacggtgctggaggagatcatcctcaagctcgtctccaaggagccggtcgatcgataccccagcgcgtccctgctgctcgccgatctcgtacggtgcaggaccgagtgggccgaggccgggtcgatcaagccattccggctgggacgggagacgagaccgaagctggccctgtccgagcggctcttcggcagggattccgagacgggcgcgctgctcgacgcggtcgaacgggtgaggcggaccggccgatccgagttggtcctgatctccggcccggccggcgctggcaagtccgcgctcgtcggcgcggtgcaggcgaggtccgaacgggcggacacgatcttcaccttcgggaaaagcggccagcaccaaggcgacataccgtacgccgtcgtcgcgcagatcctgcgctccttgatcgaccgcctcctgagcgcgagccgggatgaactccaacgccgccggaacctcctgttggccacgctcgccggacacgggcagctggtatccaaactcgttccggagctggaactcgtcctgggacggcagcctcccgtcgccgatctccaggcggaccaagctcagcggcgcgtcaacgccgccatcctgaacacgttgcaggctttcgcgcagaatgacgagaccctgatcgtctttctcgatgacctccagtgggccgatgactcgacctgggccttcttcacgtttctgctcacggagagcgccaggaacatcctgctgatcgggtcctaccgcgacggcgagacggcgcgcagcgccgaacttcaggcgctgcgctcgcacatgtcggcgaggtccctccccgtctccgagctcagtctacggcctttggcgataggcgacgtggcaacgctcatcgcggtggcgacgaagggccgagaggaactcatcgagcccctggcgcgtaccgttcacgagaagacggccggtaatcccttcttcgtcggacagcttctccggacgctggtcgatgaacacgtgtttcgtttcgacgaacacggcggcggctggtcatgggatctggccgcggtcgcccgccatcattcgaccgacaacgtggtcgacctgatggtccgacgcctcggccggttgccgaaggaaggacgcaagatcctccgctgcctctcttgcgtcggatcaggctgtgacgaggcccttctggcgcgcgtcctggagaccaccccagcgtggatccgggagcacgccgatggcctgagggcggcaggcctgctcacgcgcgatggcaccacctacgggttcgcgcatgatcgggtgctggaagccgcatacgcctcatccacgcccgctgcgcgatccgaggtccatgcccgcatcgcgatgacgatggtcgagatgtggcaggccgccccggacgactcgccgtttgcgatcgcgaatcagatcgagcgggccaagatcgacggtctgccgatcgagatcacgacttcattcgcccgcctgctgctcgccgcggcccgtcgcgccaagagcgccgcggcgctcgatcaggcgctgggctatctcgataccgcgagacggctcctgacggagacgagctggaaagaccaatacgcgctcacatatcaagcgaccgcgctaagatgcgagtgcctgatcatcaaggctgagttggccctggccgcgacagagatcgatcaccttttggcgaattccagctccgccatcgaccgcgccggcgccttccgcttgaaggcggcactacagaccctacggtcggactacgagtcggcgatcacgtcagtcctcaccgggctggacgccctgggtatcagcttgaagcgctacccatcatcggaagatctatctcacacataccaacacattcaaaataggatgcaaggccgcgagatcagcaacttggtggagattccggtttcgatggatccagagctggaagccgccatggggcttctggtcacatgccaggcatccttcttcgtcgacgacggcatcagttttcttcatcttgcgaagatcgtcgagctgacgctcgaccacggggcgacggcggcgtcgccgtacggcttgtcttggtttggcgtctatattgcgcatcattatgatgcgtacgacgacggcctgtcgttcgcgaaggtggccgccgagctccttgaccgccacggctgggaatacagtcgtgcggcaacgctggtcgcgatggaccaggtgagcgtctggacgcaacccctgccgtccgccctggccaacgcccgtgaagccgcatcggccggagtgatgagcggcgacctcggcatggcctgctacgccggcaaccacatcgtctcgaaccttattttcatgggcgaacacctgtcgcgcgtcgtcgacgaggccgagggtcgcctgaacctgacgcgccagattggcttcagggacatcgagcggctgctgaactcgcagattggcttcgccgagcgcctttggcggggcggggactcagcaatgatgccgctgcccgatcccggccaagctgagtcaggggaagccggcgcaacaccggtctcccagcctaccctcttttgggaatggctgtacgccggcatgtcggcggcctacttcaaggactaccgcgcggcggcgcttaatctggcgatgttgaagcagcttgaatgggcgatccccgcccacatcaaccttgccgactaccacttcttctcggctttgaccgccgcccatatcgaggacgcgtttgccggaagcacgctacggatcgagaaattgggtccccaccggcagcgactggtttcttgggccactctcaacccggcctccttcgcgaacaagctgctgattatcgatgccgagatcgctcggttgcgcggcgccgatctggaagccatgcaattgtacgagcgctcggctgccgccgccgccgctgtgggcttcatccatgagcaggccctcgcccatgaactggcggcggcacattgcgagtccaacgagctacgcaccgccgcccggcagcatcttcgaacggcgatcgagtgctaccgtcgatggggagcggaggagaaggtccgccgtctcgaggccgaaaaccccttgttgggggcggaacgtcgcgaggagacgagcccgtctcgaagcggccaagcctccctcgacatcgcggtctgggcggctgccgcgcgcgccttctcggaggagatcgtgctcgatcagctcatcaggaagctgatggacagcatgatcgtccacgccggcgcacgctacggcgtgttgctcctgatgcgggaggattcgcccgtgatccaggctaagggccatgtgatcgatggggcgatcgccgtggacttaagtcaggccgagccgaccgccgagtcggttccgctcgccatcatcaacatggtgatcaggaccaggaagacgatcgtcctggaggatgccgatggcgagggccgccacgccagtacgctcgatctcggcgaccggtcaccgcgggcggtcatgtgcctgccgctcctcaagcaaggccgcctcgtcggcatactgtatctggagaacgatctcgcgaccggcatattcactcccggccgaaccgcggcgctcgaactgctggcccctcaggcggcgatatccctggaggccgcgcgactgtatgccgaactcctggaggagaacgcccggcgccgggaaacggagcgggccctgcgcagcgcgcgcgcggaattgacgaggacggcccacatgaccgtgctcggggggctcgccgcctccatcgcccacgagatcaatcagcccttgacgggtgtcggctccaatgcggcagcggggcagcgatggctgaggcgggacgccccggagatcggtgaggccctcgcgaatctccaagctatccaggagaacgcggtccgggcggccgacattgtgagggcattgcgctccctcgccaaacaaacgccgccgaagcttggtaatgtgcaggtcgatgacgtgatccgcgaggtgttgaatctaacttccaccgagctcgaagccatgcaggtggccctcgacgtgcatttggccagcgaggactgccatgtcgtcggggaccgcacccagctgcagcaggtcgtcttcaacctggttacgaacgccatcgaggcaatgggctcgaaggataccgccgggcggaagcttacggtgcgatcggcctgccgggacgcgaagatcacggtccatgtccatgacaccggcgaggggatcccgcccgacgtgatcggtcgcatcttcgaacccctcttcacgacgaagagcagtgggatgggaatgggcttggcgatctgccgctcgatcatggaggcccacggcgggatgctgagcgcccttccggcatcgtgcggcggcacgacctttatcttctcgctgccggccgcaaccgggatgtga

SEQ ID NO: 7284 - DNA, 1197 bp, Methylobacterium sp.
atgtcgcttccgaagatcatcctcgccctgctcggggccggcctcgcctgctgcggtcccgccgcggcagccgatccgatcgttatcggcgtcctcacggacatgtccggggtgtatgccgacttcaatggccgcgggctcgtccgcgccgtggagatcgcggtccgcgagcacggcggcactgtcctgggccgcccggtccgcgtcgaatcgattgatccacagggcaaggccgacaacgcgctcactgcggcccgccaatggatcgaccgagaccacgccccggtgctgctcgagagcgtcaactctgtcgcggcaatagcactccagaagctgacggaggagaaaaagacgttgttcttctcgttttccggcacatccgcactcacaaacgaggcgtgcagtccctacggcatccagtatgtctggaacaactatgcgatgtcggggggcgccggaaaatccgagacccagcccagagagaagtggttcttcgtgaccgccgactacacgttcggcaagacgttggaggaggaaacccgcaaggtcgtcgaggcgaggggtgcgacggtggcaggcgtcgtccgccatccgctcgggatagcggatttctcatcctacctcctgcaggcgcaagcggccggcgcccaggtcctagcgctcgccaatgccggtcgcgacacgcagaacgccgtactacaggcgacggagttcggcctgccggcggccgggatccgcgtgcagccgctgttgatgttcgacacggacattcgcgggatcggattgaagaatgcgcagggcacacatttcgtcacatccttttactgggatcagaacgaccgggctcgctcattctcgaagaccttctttgaggcccatcaggcgatgccgagcatgaaccaggccggcgcctactcggcaacgctgcaatacctgagggcggtggaagcgatcggcacgctcgatcccgatgccgtgcgaaagcagctcggcaagatgcggatcgacgatgccttcgtgagtggcgggaccatccagccgaacggcaacatgctgcacgacctctcgctgatggaggtgaagagtccgaccgaatcgaccggaccctgggacatcgccaagctggtccgccgcatcccgggagccgacgtctatcagccgctggccgagagcaactgccggttcctcgcgcattga

SEQ ID NO: 7285 - DNA, 1701 bp, Methylobacterium sp.
atgtcggattggcgagccaggggcggcagctccttcacctgcgagaagaccgccgtccgggcttcgcgcgggatggcggtcaccaaccatccgctcgcctcggcggcagcggtggagatcctggccgcgggcgggaacgcgatcgacgcgaccgtagccgcactcttcaccctgacggtcgtcgagcccatgatggtcgggatcttcggcggcggcacggctctcatccggctcgcagacgggcgcgagaccgtgatcgatgggctcgcgaccgcaccggcgatcgcgcggcccgactcctacacgcccgtttccgacacctggcccgattacatggaggccgcaggacgggagaaccgggtcgggccgaaggccgtcgcggtgcccggcaacctgaaggcttggtgcgaggtggccgagcgtttcggaaggctcgggctcgacgcgctcctcgaacctgcgatccgccatgccgccagaggcttccggatcacgccatatctcacggcatgcatcgaggacacggcaccggacctctcgctcgatccgacgatcgccggcgtgttcctgcccggcggtcgccccctcgctccgggatccctgcttgtccaatcggattacgctgccactctacggcggatcgcaagcaagggcccggatctcctttacggcggtgcgctcggccgcgaggtcgcggcttatctggagagcgtcggctccttcgtgcggctcgacgatctggcggcctacggcaccgtcgaacgtgaaccggtccggggcacgtatcgaggtgtcgagatcgtcggaccgccgccgccctgctcgggggcggtgcacacgatccagatcctgaacatgctcgaggctttcgacctccgggcttcgggtttcgggacgccagaaacgctgcacctcgtgctcgaatgcctgaaggttgcggcggccgaccgccgcgcggcgacagccgacccggcgttcgtggacgtgccgcaagcccggctgatctcgaaggactacgcagccctgcggcggacggaaatcgacctgggatgtgccggcgcctacgccgcaggcgtcggctcgaacgagtccgccaacacgacgcacgtcaccattgccgatgcggacggaaacatcgtcacctcgacccagaccataaacagcctgttcggcgcccgcatcatggtgccgggcacggggatcatcccgaacaactatatgtcgctcttcgacccgcatccgggctttgcgctgtcgcttcagccgggcaagcgcatcacgagcggcatcacggcgctgatcggcaaacgggatggcaggccgctcttcgcgctcggcctcccgggtgcgcaccgaatcccggcttccgcgatgcaggcggtgctgaacttcgtcgaccacggcatgagcgtgcaggaagtcgtcgaggcgccacgggtgttcacctgggggcaggaagcggagatcgagcggggcatcccgaccgacgtgcggtcggccctctccaggctcggtcacgacgtcgctccggtcgatcatgtcgccggcggcatgtgcgcgatcgccttcgaacccgatggcgtcatgacgggcgcggcctgctggcgcgccgacggcgtaccgatgggcttgggtggcggcctcgcccgtagcggaacctcgttctggccggatcctcgacggtcgcggcctacgaactaa

SEQ ID NO: 7286 - DNA, 282 bp, Methylobacterium sp.
ttgaccgctcacgcccggctcgcggtcgccgcccggatcgccctggcgatcttcggcggctacggtctggcggccctggcgaccgcgacgctggctcttgccctgcccatgggccaagccgatgcgtcgtcgacggccaccatgctgagctttgccatctacgctgtggcggtgctctgggcgttcggggcgcgtcgactggctacggccgcccttggcctgctgctgccggcactcctgcttggtggcctcgtctgggtgctgcacggaggagctctgtga

SEQ ID NO: 7287 - DNA, 1566 bp, Methylobacterium sp.
gtgaaggcgacgttccggcagtcgatggcgtggctgcatgcgtggtgcggcctggtggtcggctgggtgctgttcgcggtcttcctcaccggcacccttagctactatcgcaccgagatctcacaatggatgcggccggagctccgagccgttcaggccatcgacgccccgggcgccgccgagcgcgccgtcgccgccctgagcgtgcgcgcgccggacgcccgcgcctggttcatgacgctgccgaccccggagatccccgcgacacgtatcgtctggcgcaccgcgcccggagccccgttctcggtcgcgctgctcgacccgacgaccggtgcgcccctgtccgcccgggacacccgcggcggcgacttcctataccggtttcattacgagctgcacctgcctcccctgtggggacgctggatcgtcggcggctgcgcgatggtgatgctgaccgccctgctgtccgggatcgtcacccatcggcgcatcttcgtcgacatgttcaccttccggcccggcaaggcgccacagcgcgcgtggctcgacgcccacaacgtgaccggggtgctggcgctgccattccacctgatgatcacctacaccggcctcgtcacgctgatgctgctgtacatgccctggggggtggacacggcctaccgcggcgatcgcgagcggttcttccaggaccggggccagtcgatcgcggcccgtcccccggtccacgcacccggggagctggcacccctcgggccgatgcttcgtgcggcgatgcgggtgacgaactcggagccgaccttcgtggcgatccacaatccccgcgacgcccggagcacggtggtggtgaccatggacgagcctgaagggctcgcccacctgcatcctgcggtcgggttcgacggggtgaccggctcccttctcgccacgaccacgccagccagcgccgtgaccaccgcgcacgggacgatggtcgggctgcacgaagcgcatttcgcgcgcgcgccactacggctgctgttcttcctgtcgggcctgctgggctgcgccatggtggcgaccggcctcgtgctttggaccgtcgcgcggctcccgaaacttggtgtcccgacgcgatggtcgttcggccaccggctggtcgacgcgctcaacgtcgccaccgtagccgggttgccgatcgcggtggggtgctacttcctagccaaccggctgctccctcttgcgctgcccggtcgcccggaggccgaggtgcatgtcttcttcgcggcatggctctcgacggccttgccggccctgctcctcgcaccgcgacgggcctgggtcgtcgcgctggccaccgccgccgccgcattcctcgccatcccgatcgtcggcggccttaccaccgggcgtcatctgatcgcgagcttccgggaaggcgacgtcgtcttcctcgccttcgaggccattgccctaagcgctggggctggattcggtctcgccgcctacgccctccgccggccaggcaagcgatggctaggacgaaccgcttccccggacgggatcatggggacaagctcgtcgtcatag

SEQ ID NO: 7288 - DNA, 261 bp, Methylobacterium sp.
atgcattataccagtggcctgacgcatgggtcgtcctcaacgcacctcgcgccctcgtcagaaacgtcgggggcgttttttcttgggagcggtacggccggcagcttcggatggaagctcgacgaggtctgcagcggcggtccttcggccaggaaggcgcgatggacgctctcggtcgccggcgacacgatgatcgcgtcgatcgcacgcggcttcaaggccggcgagccgttcaccctgaagcgctgcgccacgaggtag

SEQ ID NO: 7289 - DNA, 180 bp, Methylobacterium sp.
gtgatcggcgtgcccgaactcgccttcgtggcggcgcaggtgaacaaccgcgcgatggtctacccggccgagatcttcctcttcgtcggtgccgtgtacggcatcctctgcgccggtctcgacgggctggccgcccggctgacgaataccggcaaggtcgcggcacatcgcaccccgtga

SEQ ID NO: 7290 - DNA, 249 bp, Methylobacterium sp.
gtggcgaccacgatcgcggcggcggtggagcagcagggcgcggcgacccacgagatcgtccgcaacgtcggtcaggccgcggccggcaccggcgaggtgacccgcagcatcgtcagcgtcgctggggccgtcgagaagaccggtcaggccgccgggcaggttctggccgaggcgtcgcggctctcggagcagtccgagcacctgaacggcgaggtggcgcggttcctcgatcgcgtccgcgcggcctga

SEQ ID NO: 7291 - DNA, 549 bp, Methylobacterium sp.
gtgacctctgactggtgggacttcgaggacgaagagatcgagatgcctcctgccttcccggtcaaggtggcgccgccagactacatgatcgcgctggagcgttgctggctcgcgaccggatttcctaaccggaagcggtgcctcatcgggattgacggcttcgacttggcgggcaagtcgtcattaggcgcgtggctcgcttggcagctcggcacgccctgcatattcctggacgactaccgcatgcgatggaagccgccgcgatcctggcgcgcgaaggaaatcaatcggcttctcgacgctcgcttcgacttgaacaggcctgtcgtgatcgagagcatcttcctgctcgaagctctccgtcagcttggccgtgaacccgacctgcttatctacgtcgagaaccaaaagcgcgaccccgatgacgcgatggaaggccttgtcaattacgtcgcatgggaggggctgccaggaagggcggacgtcgtggtccactggtccagtgataacccgacagcggatcacccctggaccgccgccaaggcgtag

SEQ ID NO: 7292 - DNA, 228 bp, Methylobacterium sp.
atggccgaccataccctcaccccggaggaaattggcgccctcaagcttgcgctcgccagagtcctcgttgaggggaagaagaccgccgagcgcgtcgatcaagccaccgacgacccctcgttgtacgatcaggcgcataccagcatcgccgcggagaggcgccaagcggaacgtttgatggagatgctggaaaacgcggacgcggtggtggttcagatgccagactga

SEQ ID NO: 7293 - DNA, 1056 bp, Methylobacterium sp.
atgagtactacggcgctgaacccgttcgatgtcgcgagcctcggcggcgacatttttgggcccggcggtctgatcaaggctggcctaggcaccctcgaactcgctgggaccaacacctatgcaggcggtaccgcggtctatggcggtaccctcgcggtctcccgcgacgccaacctcggcgccgccggcaccggtctgatcctcggcggcggcacccttgaggtcctcaccgatggctttaccaccgcacgcccgctcacactcaccggcctcggtgccctgcagatcgacctcggcaacgccaccttcgcgggctcgattgccgacggtagtcagtcgggcaccctcgtcaagactggacttggcaccgcaatcctatcggcttccaacacattcacggccggcaccgtcatcagcgccggtaccctggctctgaccgccaccggcagcctcaccgcgccggtcctcgtcggctcggcggcgagcttcctcaatgccgggctcgtctccggcagcgtcgccaatctcggcgtcctggccaacagcggcaccgtcgcgggcggcctcgccaatgccggtctggccctgaacaccggcatcatcggcggcggcgcgaccaacaccggcagcctagttaacgtcggcactctcgcgggtgggctgaacaacgcaggaaccacgctcaacagtggctccatcaccggcggcgcggccaacaccggcagcctggtcaacgccggcactctcgcgggcggactgagcaacaccggcaccgccctcaacaccggcaccatcgccggcggcgcgaccaacagcggcgtcctgagcaacgccggcgccatcggcggcggcgtcgcgaacaccggcacgctgtccaccagcggcatgatcagcggcggcctgaccaatgccggcaccgtgctcgccagcgctggccgcatcgacgggcccatcgccaacaatgccggcctgctcgccgtctccggatccgtggccggcaccggccccttcgccaacgccgccggcgcgacgctcgccgtcaccacgggcggcagc

SEQ ID NO: 7294 - DNA, 123 bp, Methylobacterium sp.
atgaggagcggccacgatcaggccgcggaggttgccgtgagcggcagcgggctcccgaagcgccagccgtcctggccgcccatgtggatgggggtcatcatcggtccgccgaggcgccggtag

SEQ ID NO: 7295 - DNA, 219 bp, Methylobacterium sp.
atgaaggcgatcagcagcgaggataacggtaagaagtggcaggaggagctcagacttgctcaacagacttggatgcgcttccgcgatgccgactgcggcgatctcatcaccgatgagtggcatggcggtacagggacttatccagctatcgccacctgcttactcgggcatacggaagcgcgaaccgcggagcttaagcggcgctatgaccgctggtaa

SEQ ID NO: 7296 - DNA, 276 bp, Methylobacterium sp.
atgccccgcgctcgcttccaccgtgctcgcatgctgtggcgccgcctcagcggttggcgcacctttatcttcttcaccccggccttcctgctggcgctgctcgacgcgctgcacgccgtcgacttccggcagttgctcatcgacatgggcgcgccggagggcaccgcgaaggcgatcgtggccgggtgcttcctgatgggcctcgtgatgcgggcttacacgaccacgccgcccatgcgcgcgccggaccgtgacgcgccgggagggccgcgctga

SEQ ID NO: 7297 - DNA, 462 bp, Methylobacterium sp.
atggcctggagggtgcgggcgaggtcggcctggaccagccggtccccgggctgccaggggctgccgtccgggcgcaggaagatccgggcgacgttcgcttggcccgcgaacagcttcgtgccggattcgaggatgtcggtgtcgccccgggtcagcacgaacccgtcccgggcgagcgcgatcgccggcgccatcacccgcgccagcggcagggtcccgtacgcggtgagggcggtgttgaggccgagcaccgtcccgggcacgccggccgccttccagccgcgcaggctcgcgcccttcacgacgttgccggcagcgtcgagatacatgtcccgggtggcggccgccggggcggtctcgcggaaattgatgaagcggctgcgcccgtcggcgctgtggagcaccaggaagccgccgccgccgatgttgccgcagcaggggttcaccaccgcctcggcgtaa

SEQ ID NO: 7298 - DNA, 273 bp, Methylobacterium sp.
atgccgaaatcgagcacgttgatcagcgtctgcgcgttgatcgtgatgatccgcgagccccccggcgagcccgccaccagcgcgaccttgccgtcgcgcagcacgatcgtgggcgccatggaggagagcgggcgcttgcccggctggatcgcgttcttcgtcccctgcacgagcccgaacaggttcggcaccccggtcttgaccgtgaagtcgtccatctcgtcgttgaggaagaaccccgtgtcgccggcgatcaccccggcgccgaaatag

SEQ ID NO: 7299 - DNA, 153 bp, Methylobacterium sp.
ttgcccgacgacgcggcctccggcagggcgggcgccgcggcccggaccgcgatgagctcctgcgccccccagggcctctgctcgacgatcgtgtggcccatgcccctgaggatggcctgggtgtccgccgagagcgcgaagggctcggcgtag

SEQ ID NO: 7300 - DNA, 159 bp, Methylobacterium sp.
gagtacgccctgcccaccgactcgttcctgaacttcttccgctcctcggccgtgacgctcaaggtcgaaggcctgtacgtcaacctcgaccgcaacacccgcaaccagggcgcgttcgtcatcaacgccgccaacaacttcccggtcgtctacagcggc

SEQ ID NO: 7301 - DNA, 123 bp, Methylobacterium sp.
aacctctacggacccgccgaggccgccatcgacgtcaccgcctgcgacgtcgcagcctgggacagcacttgcgcagatgggcccgtccccggcccgcgcgtgccgatcggcgcgcccatcgcc

SEQ ID NO: 7302 - DNA, 264 bp, Methylobacterium sp.
gtggctggccaggacaacgtcgagaccctggtcgtgctccagcccatctcgatcgacacggcgagcccggaccaggtcggcatgctggtgatggccaacgggctgctcgtggcggttctggtccgtctcgacgcaccggagcatgcacgctgcgggagctggttcctggaggttggattgggccgtctcgcgggagcgcgcgcacccacgttcgacacgcttgaggacgccacgcgctggatgcgacaacggcttaagcgctag

SEQ ID NO: 7303 - DNA, 906 bp, Methylobacterium sp.
atgccgtttgacgtgatcgtcgtgggaggcagtttcgccggcttggcggcggccacctacatcgcccgcgggcgacgctcggtctgcgtggtcgacgcgggcagcccgcgcaaccgcttcgcggcggcctcccacggcttcctcggccaggacggcagcgacccgcggacgatgctcgcgcaggcccgcggccagctcgccgcctacccgcaggcgaccctcgtggagggcgaggccgtcgatgtccgcgcaggccggaacttcaccgtcaccctcgcaagcggtgaggccctggatgcggcccgcctcgtcctcgcctacggcctcacggacgtgcttcccgagatccagggcttggcggagcgatggggcaagagcgtccttcactgcccctactgccacggctacgagttcgccgacgggaagctcggcgtgttggccgtgtcccccatgtccgcgcatcaggcattgctgatcgccgagtgggggccgacgacgctctacctgaacggcggcgacatgcccgatgaggcgacatgcgcccggctcgcacgccgcggtgtcgggatcgaacccgcccccgtggcggccctcgtcggcgagggcgggacgctgtcgggcttgcgactcagtgacgggcgtaccgcagccgtcgacgccctctacctcgccccgcggacgcggatgaacagcccgctggcggaacggctcggctgcgcgctcgacgaagggccgttcggtccggtcatccgcacggatgccgccaagctgacgacgatggcgggggtgtatgcggccggcgacatcgcgcgggccccccacagcgtgagttgggccgtagcggacggtgtcacggcgggtatctcggtccaccagtccctcgtactggcgcgcttggctgcctga

SEQ ID NO: 7304 - DNA, 1788 bp, Methylobacterium sp.
atgtctctgtcctccccccggcgggcgggcgcggtccgccgcgtcctcgccttcgtcgtccgcggctggcgcaagcgctggcccctggtcgccggcctgtccggcgcgatcacgctggccaccttcgcggaggtgatgctgccgctctacgcgggccggctggtcgacgcgctcacccggcccgagcgccaggcggccctggaggccgccctgcccgccttcctggcgatgacggcgctcggcctcgccaccgcgctgctgcgccacgtcgcctggagcctcgtggtgccgctcaccctccacaccatgagcgacatggcccgggacggcttcgcccgggtccagcgcttctccaccgagtggcacgccaacaccttctcgggctccaccgtccggaagatctcccgcggcatgtgggccctcgacgggctcaacgacacgctgctgctggcgctgctgcccgccctggtggtgctcctgggcaccgcccttgtgctgggcctccattggccggccctcggcgcggtggtggcgctcggggccgccgcctatgtcggcgccaccgccctcctggcgacccgggtcatcgcgcccgcttccgcgctctcgaacgccctcgacacgcggctcggcggcgccctgagcgacgcgatcggcaacaacgccgtggtcaaggccttcggcgccgagggccgggaggaggcgcgcctcggccggctcctgggcaagtggcagcggcgcacgcaccgcacctggatgatcatcacctggagcggcaccggccagctcgggctgctgctggcgctgcgcaccgccatcgtcgccaccgccctctggctgtggtggcgcggggaggcgagcccgggcgacgtcgcctacgtgctcaccaccaccttcgtggtgcatggctacctgcgcgaggtcggcggccacatcaaccacctgcagcgggcgatcaacgagatggaggagctggtcgcgctggcggccgagcccgtcggcgtccccgaccggccgggcgcggtcccgctcgcggtcgcgggcggcacgatccgcttcgcggatgtgcgcttccattacggcgcccacggcaacccgctctacgacgggctgtcggtgacgatcccggcgggccagcgggtcgggctggtcggccgctcgggctcgggcaagaccaccttcgtcaagctgatccagcggctctacgacgtctcgggcggtcgggtgaccatcgacgggcaggacgtggcggcggcgacccaggcgagcctgcgggcgcaggtcgcgatcgtgccccaggagccggtgctgttccaccggtcgctggccgagaacatcgcctatgcccggcccggcgcctcggcgcaggacatcgagcgggcggcccggctcgccaacgcgcacgatttcatcgcgcggctgcccaagggctacgccacgctggtgggcgagcgcggcgtcaagctgtcgggcggcgagcgccagcgggtggcgctggcccgcgccttcctggcggacgcgccgatcctgatcctggacgaggcgacctcgagcctcgactccgaatccgaggccctggtccaggaggcgatggcgcggctgatgcacgggcgcaccgcgatcgtgatcgcccaccggctctcgaccgtgcaggcgctggaccggatcctcgtgttcgaccgcggacgcatcgtcgaggacggcccccacgccgccctgatgcgccgcccgggcggggcctaccgggccctgttcgagcgccaatccgtcctggcggagagcgcgtga

SEQ ID NO: 7305 - DNA, 438 bp, Methylobacterium sp.
atgacgcaggctgtgaacgatgaacggctatcgctcgactacgtgtcggtcgaggatctaaacgccgctctccgcgtatttcgccggctgccgttggagttgctgggcttcctgatcctcttgccgatcgtcggcttcggcctatcctggctcagcgctgccctcgcgcccccctacggcctctatattttcggggagggcctcgtgacttggggtctgcttctgatgtgcgccctgctgttcgggctgctctggtggcggggacgacaggtcgggcggctcttgaacgatccggccatcctggcttcaccggtgatgagtctgctgtcggtgcccggcgtggtcgccgagcgggcccaggccttgggcatggaatggagcggcttctacgggccgctccgcccgtgccgggagtcagtcaacgtcgaagggcgttaa

SEQ ID NO: 7306 - DNA, 354 bp, Methylobacterium sp.
atgacgacgcgtgacacgaccaagcgaagggcgcctcccctcagcgatgccgaggaggcgctcctgcaggcggccatcgccaacaatcccgattcggaggaactgaccgatgcggaacttgcgcgtctgcgcccggcccgcgacgtgcttccgccggccgtctacgccgcgctgacccaggggagcccctcgcaggctgagagcgggcgcgtacagctcaccttgagcgtcgatcccgacgtgctcgccgcctacaaggccggcggtcccggctggcaggcgcgcatgaacgaggccctggcccaggggatcgcccgcggcaagcggcgatccagggccgtcaagcgcggctga

SEQ ID NO: 7307 - DNA, 1401 bp, Methylobacterium sp.
atggacgcacggacgaataggcttctcaccggcgcgcctctggcaaccctgttgcggttggccgctccgaacatcctgatgacgacggtccaggcttcggtcggattgatcgagacctacttcgtcgcggaactcggaaccgacgccctggccgggatggcgttggttttccccctgttgatgttcgtccagatggtctccaacggcgccgtcggcggcagcatactgtcgaccatctcgcgctccctcggcggaggacggcgggacgacgcgaacgccttcgtctggcatgccgtcgcgatcgccaccgccttgggcctggcgaccacgctcgccgcacggctctccggcggcctcctctatcgcgcgatgggcggtgccgacgcatcgctcgacgccgccctgacctactccaacgtcgtgttctccggcgccgtcctgctctggctcttcagcgcgttggcggccgtcatccgtggcaccggcaacatgtggctgccggccgcggtgatgtgcctgggcgccctggttctcgtgccgctctctccggctctcatcttcggctgggggccgcttcccaggctcggcatcgtcggaggcgggatcgccgtcgtcgggtactatgccgtcggcgctgtgatattcgcgggctatctctggtcgggacggggcgtgctgcacccgagcgccaagccgcctgcgctgtccgcaggagccgcgtgggtcatcctcaaggtcggtgccatctcggccgtcgtgagcgccagcaccaacatcacgatcgccgcggcgactggcatcgtcggcgtcgcggggccggcggcggtggccgggtacggaaccggcgcccgcctcgaatatcttctcgttccggtcgtgttcggtctgggcgcgccgctggcggcgatggtcggaacggcgatcggtgccggcgacctgtcccgggcgagacgcgtcgcttggacgggagcggcgatggcgggagtgctgacgggcggcatcgggattgccgcggcctcataccccgacgcatggcttcgtctgttcggaaacgaccccgccatgctcgcgacgggcagccagtacctgagactggtcggcccgttctatgggttcttcggtgtcggactcgctttgtacttcgcggcccaaggcaccggacaggttggatggcccctggtcgccggcctcctccgaatggccgtagcgctgatcggtggaagttgggcgatcggggccggctatggggcaagaggtctgttcgtggctctgggtctcggcttgaccacgatagccctcgtcaacgccggctcgcttgccctgggcgcatggcctaggcgtgccgccagtgccgtgcctgccgccgctccccgtcgcaccgcgatcgcagcggacctttga

SEQ ID NO: 7308 - DNA, 1161 bp, Methylobacterium sp.
gtggtacgcgcggcagcggactccgtagttcgccgcaacgagttcctgggccgcatccaggcggtcgatcgggtcgacgtggtggcccgcgtcacggcgtacctggacaaacgcctcttcgaggaaggggcggagatcgcgacgggcgacaggctctacggcttggaacggggtccgttcgaggcggatctcgaagccaagaaggccgtcgtctcccagctcaaggcgacgctggtgaacgccaacctgacgctcggccgcgctcagacgctgctgaacggaccggccggccagcagtcgaccgtggatgccgcgacagcgcaatcgttgagtctgcaggcgcagatccaggccgccgaagcgcaggtccgcatcgcgcagatcaacctcgactacaccgacatccgctcgcccatcgcggggaagatcggacgcacgaacgtcaccgtgggcaacgtggtgacgcccgggaacggcgtcctcgccacgatcgtcgggcaggatccgatgtacgtgagcttcccggtctcgtaccgggagtttctcgatctgcggacctactacgccgatcagggcggactgcgtgccgtcgcgatccgggtcaggctgccggacggacgtacgtacggagagatcggcagactcgatctcgtggacaacacgatccagtccgcgaccgatacgatcatccttcggggcacgattgcgaaccccctcctcggctccgcccgatccggtgcggtcgcccgccaaccgcgtccggcgaacctcgccgtgcgtgagctcgcggacggcgagttcgtcaccgtctccctcgagggcgtccgtccccaggaggtcgtctctatcccgagaagcgcaatcctgaccgacaaggagggcgactacgtcttcgtcgtcggcccgtccgacaaggttgagcagcgccgggtgagattgggccagtccacctcgacggtggcggcaatcacgtcgggcctggaggtcggggagcgtgttgtcgccgagggcgtgcagcgcgtccgcgtcggccaagttgtcgccgccacgcccgcccgggaagccatggcggccgagccgcgggagccgagctccaagacatcggccgacgctccgggtcgcgagagcgcctcggccgccgcgacgcgggtctctcactga

SEQ ID NO: 7309 - DNA, 786 bp, Methylobacterium sp.
atgacgctcctgcgcaacctcgtcccgcccctgatcacgcttgccctggtgctggctgtctgggcctacgccactggcccgggcgggctgccgagctacctactgccggatccggtctcggtcggccgcgccctgtggaccgggctcgtcagcggcgagtacgggccgcacatccagttcaccctgacctcgacgctcctgggctacggcatcggctcggtcgcggctgtcgcgatcggcgtcctggtggccgagagccggaccttcgagcgcttcgtcttcccctacatcgtggcgatccaggcgatgccgaaggtcgcgctcgcgccgctgatcctcgtctggttcggcttcgggctcgcctccaaggtcgtgctggtcgcgctgatctgcttcttcccgctcctcgtgaacacgatcgcgggcatccgccggaccgaccccgagctcatcgacatggcccggtcgttctcccggccgtcttggtggatcttcctgcacgtgaagcttccggcggccgccggggcgatctgcgcgggcctcgagatcgggatcgtgctggcgctgatcggcgcgatcgtcggcgagttcgtcgccgccgagaaaggagttggctacctgatcggctccgcgacggtgaacatgaacgtcgccaccatgttcgcgggcgtcctgctgctcgccgggttcggcatcgcgggaagcgcgctcgtgcgcttcgcccagaggcggatcgtgttctgggagtgggcgccggatccatcgtcgcggggagagcgcgcatga

SEQ ID NO: 7310 - DNA, 552 bp, Methylobacterium sp.
atggcggagatcgcgcaggccgtcggcggcaagccgatagagatctggttcgccgacgaggctcgggtcggccagaagaacacgattacccgccgctgggccaaacgcggcacgcgacctgcggcgccgaaggaccagcgcaccgcctccgcctacatcttcggtgcgatctgccccgcccttggcaaaggggctggcctcgtcatgccccgctgcaccaccgaggcgatggccttgcatctcgaagagatcgcccaggtcgtcgcccccggtgcgcacgccgtactgctgctcgatcaggcgggctggcacacaaccaagaaactcgtcgtgcccgccaacatcaccctattgcccctgccggctcgctcccccgaacttaaccccgtggagaacctctggcagttcatgcgcgataactggctcggcaaccgcgtcttcaaatcctacgccgacatcctcgaccactgctgccacgcctggaacaccctcatcgaccgaccctggagcatcatctccatcggactgcgcgcctgggctcatgggttctga

SEQ ID NO: 7311 - DNA, 720 bp, Methylobacterium sp.
gtgcgcaatctacgggagcgactgggttccgcaatcctgctcggcggcgcgatcctcctctggggcgccaactggccggtgatgaagatcgggctcggtcacatctcgcccctatggttctccgcgtcgcgcttcgcggtcggggcagcctgcctgttcgcatggcaggtgatgcgccgggagttgcggctgccgcggcgcgcggacctgcctgtcgtcgcctcgatcggcctgctgcagatgatgctgttcacggctctgggcgcaatcgccatgacgcacctgccggccggccgctcggccattctgagctatacgacgccgatctgggtgctcccggtcgcggtcgtgctgttccgggagaagatcagccagcggcagtgggttggcatcgccctggctgggatcggcgtcctcgtcctgctcaatccgcatgccatcgactggcaggacagtcgggttgttggcgccaacggcttgctcatcgcggcttcggcggcctgggccgtgtgcatcctgcatctgcgatacggccgaacgccgtcgtcggcgatccagctcgcgccctggcagatgctgctcgccgcagccgtgctggtgcccctggcctatacggctgagggaccgttcaccggagacggcacaggcgtgttctgggcttgcctcgccttcgtcggcccggttgcgaccgccttctgcttctgcgccgtcaatgccgcg

SEQ ID NO: 7312 - DNA, 642 bp, Methylobacterium sp.
gtgacggacgggcggcggttgaccgggactgccggccgcgcgcacgctatggcgtccccgtctcggcttctcgaccgcatggcccagcccctcgaccgcccccgcctcttggaggctttcgaagcgctcggtgccgacctcgctgagcatgggcgcttcgtcgagctggccgtctacggcggcggcgccctgatgctgcaattcgcatggcgacgcgccactgaggatgtcgatgcggttgtgcgagccggctatgacgagtcggcgctcgcgccttcggtgatccgtgtcgccgcgcggatggggctggaggcggactggctcaacgatgccgtcggcatgttcactccgcttgaggaggacgaaaccctgttcgccgtgtccggcacgtatcccaccggtgggacaccaggacttcggaccgtcctggctagcccgacctacctcctagcgatgaagttgcacgccttgcagagccttgatcgcggagaccgggacctgaacgacgcacgcgccctctcggcacacctgggcttaggcgatgtggaggcgctcgagcgcctctatcgctcgatctacggcgaggacccatcgccggaggtgcgagctcggtttcctgcggtgatcaggtcggcgccatga

SEQ ID NO: 7313 - DNA, 132 bp, Methylobacterium sp.
atgagcatcgagaagcaacgcggcaaccgcgagacgaagaagccgaagaagccggtgccgaagatgaatgccgcggccccgtcccagaagaacaccgtcgcgtcggttgtgaagcggtccgaggggcgctga

SEQ ID NO: 7314 - DNA, 459 bp, Methylobacterium sp.
ttgtcttatcgcacgatcaccgtcgccctcgcgctcgcctgcctctcggtcccggcgctcgcccagacgacgcccacgaccccggctcccggcaccgcgatgcccgcatcctccgacatggggatgaagatggccgataccgccacggtgaagctcaagtacgtgaccgtgaagcctgccgacgtcatgtcgtccaagctcgttggcaccaccgtcttcaacaacaagaacgagaacatcggcgaggtcgaggacctcgtgatcgagaacggcaagaccgtgaccggtgtcgtcgtcagcgtcggcggtttcctcggcatgggcgagagctacgtggtgctcgacccgtcgacgcttgccatcagcgacaaggacggcaagtgggcggtccacgctgacaccgacaaggacacgctgaagaacgcgccgaagttcacctactccaagaagaagagctga

SEQ ID NO: 7315 - DNA, 300 bp, Methylobacterium sp.
atggccgctagcccccgcgcccggttcacccccctcgcccgtgccgacctggaagagatctggcgctacacgttcggccggtggtcaccggaccaggccgatcgctaccaccaggcaatcgtggacgcggccggcgaactcgccaccggcgcgaaggtcggccgtcccgtcgagatccgcgccggctatctcaaatacgcggtcggatcgcatgtcatcttctaccggcggacggagtctgggatcgatgtcatccgcgtcctgcatcggcgcatggacgtgccgtctcgcctctcatga

SEQ ID NO: 7316 - DNA, 447 bp, Methylobacterium sp.
gtgttcatccgcaatcccgaggcgcgcttcccgccccaggccctgctctgcgcggatccgacacgcgagcccgcgcagatcgtcgggtggttcgttcgccgttggagcgtcaaggtcacgttccaggaggtgcgcgcccatatgggcgtcgagacgcagcggccgtggtccgacacggcgatcgctcgcaccacgccctgcctgctcgccctgttctcaatcgtcacgctgctggctgcgcaactcccggcccgccaacggcgacgcgtcgcgatcgccgcgtggtacctcaaaccgcgctcggccttcgccgatgccctggccgccgtacgctgtgcgatctggcgcgagcggacttcggcaacatcaccgcgccgacgcgcccaaacaaaaccccgcttccgtttgcccgcgccctgggcctatgccctctgccacgccgcatga

SEQ ID NO: 7317 - DNA, 138 bp, Methylobacterium sp.
cccccggccgaaccgcccgccgagcccgtgccggctccgcggccggagccgaaggccgccggcaacccgttttccgtggaggagatcgaggccgagttcgcgcgcctgctgggccggcctctcgacaaacggagctga

SEQ ID NO: 7318 - DNA, 324 bp, Methylobacterium sp.
atgaccgggaagcgggcctttaagagcgacgccttcgaatcaatccacgcgaccgccatggccttccacgaggtcggcgtgacggatgcggaaacgatgcgcgccttcgacgagatctgcctcgccgtgccgccaacgatcaagcccgcccagatcaagcagctgcgcgaaaacctcaacgtcagccggccagtcttcgcccgctatctcaacaccagcgagcgcaacgtggagaagtgggaaaccggcgccaagaaacccagtggcacggcgctcaagcttttagcggtagtccagaagcacggcctacaggtcttggcttga

SEQ ID NO: 7319 - DNA, 1488 bp, Methylobacterium sp.
gtgagcgcgcgacgcctcctacgcctgctcgcggtcgagattcggctcatcctgcgggagcgcacgacttgggcgatcatcgccgctctgatggtcgccctctggttcggggcctataccggcgtagcgcgcgtcgcttcggagcgggccgcgatcaccaaggcagcggaggatgcggcacgggcggtgcgcgaggccaaggccgcgcacgagcgctacggtcgcccgggtccgctcaaggtcagctattggcaggatccgacccacgcttttggctacctgacgcagttccttactgtctacgcggtgaagccaccgacgccgctcgcggcgctcgcagccggtcaatccgacgtgcagccggccctgatgcgggtgggcttcggccccagcaccgtgttcgacgacaccgcctacgaactgggctccgccgccaagatcaagctcggtccgttcgacttggccttcgtgctcgtctacctcgtgccgctggcggtgatcgcgctggttggcacgcgcctttcggccgaacgggacgccggcatcctccggatgatcgcggcgcagcccgtcagcccgcgcgtcgtcgccggcgcgaagttcggcgcggcgacggcggtctgcgtcgtctcggtgctcggtgggacggcattgtcgctctggctcaacggcggtctcgagccgttaggaggctgggaggcgacgctggcgctgctcgctgtcgcgctcgcctgctacaccgtgttgtgggtgctcgcttgcgctctcattgcgagcctgtggcgtggggcggtgaccgcgctgacgctcctggttctcgcctgggcctgcgccacgatcgccttgccaacggcgctgggtctcacggtcgatggcctcgccccgaccccgtcccggatcgccgcgatcgacgcgagtcgagtggcccaggaccgcttttacaacggagacgaaggcccacggatcatggagtcctggctcgccacgcgagcgccggaggctgccggccgcgtggacctgcgcgacgcccccgagatcaagcgtctggcccgcgacgctttctacgatgtcgcgctcgccgagcaccgagatgcgatgcaggcccacgccctagatgcggacgtatggagctggcgactgacgttgctctcgcctgcgacgacgctcgcacgtgccctggagacggcggcggggaccgacggcggccggcacgcgaccttcctggcggccgtggctgagtatcgccaaagcctgcgcggcttcttcgagccgctcatcctggcgcaggcgctcaagccggccccgatctgcccgggttgtcaggcgcgtctcgacttcgacgcctacgatgcggtgccaagctttccaggtgttgtcgcggccgacaaggccgagcggcaagcgctcgtgagccttatttgcctcatggtcagcgcgacggtcctgtccgcgctcgtctaccggcgctacgcggactggccggcctga

SEQ ID NO: 7320 - DNA, 1386 bp, Methylobacterium sp.
gtgtcggcggaactcgcgctgatctggggcgacgcacgcctgcgctggatcggcgctgtcctgatccttctccaggccgtcgcgggcctcggagcctggcaggcggccgagcgctacggcgcggaagtggctcgcatcacagccgccgagcgggcgcgctggctggggcaggatgccaagaatcctcattcggccgaccattatggcctatgggtgctccggccctcgtcaccgctggccgtgctcgatcccgggatcgaaccctataccggccggatggtgcggatcgaggcgcacctgttcaacgatgcggtttatcgcgccgtacaggatgccggcccgctcgaccgcgccgggcttcgcgatgttgccgacctcgtcggccttgtggtcccgctggccgcgatcctcctcggcttctccgccttcgccgccgaccgcgagcgcggcaccctgaggctggccctcggcaatggagccgcgccgggccgcttgtttgccgggcgcttctgcgcgctcctgctcgcactcggcgcggtggtggggctgccgctcctcgttctcggtggtctcgccgccacataccgtgagaccgaagcctggcaggccggcccgcgcctcctcgtctgggtcgtggtgcaagtcgcctacgcagcggtgttcctgctcatcgcgatgctggcttcgctctctgcccggacggcgcggggggcgctcgccaccgcgctcgcggcctgggtcgtgctctgcatcgtcgccccgcggctggcgagcgtgggcgtcgaggagatcgcacccacgctctcttatcaggagacccgggcacggatcgatgcggccttccgcaccaacaggaccgcggaggcgagcgatgcccgcgtgcgggaggtgctggcccgctacggggtttccgaccccgatgaactgccgatgaatctgcacggtttgacgatgaccgagaacgaacagcgcaacttcgccatctacgatcgcgagttcggtgccttcttcgacagtctcacgcggcaggagcgggcgttcggctgggccggtctggcctcgccgcggatcgccatgcaaaccctctctcagacgctcgccgggaccgacttcgcgcaacacgcgcatttcgtctggtcggcggaagcctatcgccggggcatcacggagcgcatgaacgctgagatccgcgaccaccctcagcgcggcagccaatcgcttgtctcgggaccggatctgtggcgaacgatcccgcccttcgtgcacacgccgcttcccttcgcccgctcgcttgccgacgcacgggtgccggctctcgtgctggccctgtggctgacgctgctcgccggcttgagcgtgcccctggtgcggaggctgcagccgtga

SEQ ID NO: 7321 - DNA, 735 bp, Methylobacterium sp.
atggccgggacgaccgacgacgcggtgctggcgctgcgccgggtgaccaagcgcttcggtgcgcgcaccgccctcgacaacctcgccctgaacttgcgcgcaggcgaggtcttcgccctgctcgggccgaacggcgcgggcaagaccacgacgatcaacctcgtgctcggcttccaccgggccgacgccggggaggtctgcgtctgcgggatcgacgcgggggccgagccaatcgccgcgcgggcgcagatcgcctacatcccggagcaggtcgcgctctatcccgatctctccggggtggcgaacctgcgctacttcgcgacgctcgccggcctcgatctcgacgggccggcggcccgccgccacctcgacgaggccgggttggcaccggaagcgcagatgcggccggcggcttcctactcaaagggcatgcgccagaaggtcgggatcgccgtggcgctcgcccgccgcgcccggcttctgctgctcgacgagccgacctcgggcctcgatccgagtgcggcggccgacttcagtgagatggtgcgagcggcagccggtcgcggtaccgcggtgctgatggcgacccacgacctctaccgggtgcgggagatggccgaccgagtcggcgtcctcgccgcaggccgcatcatcgaagagctcgaccccaggagtctcgatcacgtcgggctagagcgactctatatcgaacgcttggccggagctgccgcgtga

SEQ ID NO: 7322 - DNA, 819 bp, Methylobacterium sp.
gtgacctccgacgcgaacggcacgctcttcgtgagcagcatcgcggatggtggcgtgctcaaggtcgccgcggacggagccgtcacgtcgcaatttctgaagctgggcgaccacggcacccggtccacctttggtttgctggcggatcccaagcgcggggtgctctgggtcgcctcgaacgacgccacggccctgggagcgaaggggccaacggacacggaaggggcgtggatcaaggccttcgacgtcgcgacgggcgccatgaagacgagcgtcaggctgccgggcgccaaggcgctcgcgaacgatatggccctcgacggcgacggctcgctctacgtcaccaccaccttcgccccccagatcctgcggctcaaacccggtgccgcggaattcgaggtgttcgtcgagaacccggcgctcgccaaggggctggacggcatcgccatcggcggcgatggcaatctctacgtcaacaccttcttgggcggcgagctgttccgcatcgccatgaaccagggtgtcgccggtgaggtcacgcaacttgagacgacacggccgctggaattcccggacgggctgcggaccttcaaggacgggttcctgatggtcgaaggcagcggtgccctgagccgcgtcacggtctccggaaacgccgccaagatcgagcctatccaccagttcgccggtcccaccggtgtgacgatcgcaggccacaagatctgggtggccgaggggcagttgggcctgatgtccaagccggtcgaggccggaagcgaggcgccgagcttccatctccgctccgtggacgcgccatag

SEQ ID NO: 7323 - DNA, 1725 bp, Methylobacterium sp.
atggagcagcgcgagaggatgctgcggctgatgagccagggtgcctggcgagccgccctcagggggcgccatctcggcggcataccctacggctatcgccgcggacaggaggtcggcgatctcgtcgtcgaagcgaacgaggctgccgtcgtgaaaaggatctaccacctcttcgacagcggcgtcagcgccacccagatcgcccgtctgctcaacggcgagaacttgccgccgccttcgggaagcggccagtggacgcgcagcgtgatcctcggaggaccgagtcacgggaacgggatccttcgcaatccgaaatacgttggcgtttacatctacggcaagagtaggcgcgtgcgtcgccccggcacttcgtcgaagatggtccagatgcgtccgagcaccagctgggtgtacggcgcaaagccggcatggagcttcgtcgatcgggatttgtggctgcgtgtgttgtgccgcctcaagctgatgcacgatgacaaggggttgcggaagccgcgggaaaagctcagcggcaaggccacactcctgtttcatggacgatatcgctgcgtctgcggtgcgaccatgcatggcatattcagaggcgcctcgaccacgcgcagcttgcgctgctacagccaggccgagggtggtacgtgcgagagatcgcgctccttcagttcgacgttcgtcgaatgcgagatcctgcgggtgatccgcgacacggtactgacctcggccgatctaccggcgtatatccgggagtatacggctcagttgggccgcatggaagaagagatcgcccgcgagaagagggagcggctgaacaggatcgccgagctcgaccgatggctggagaagagtatcgacagcgcgatcaacaagggtggtgccgacgaggatctcgaacgcgcccgcattcggaagcgtgccgaacgatccgatgagcggctcgccctggccgctcttccggacatcgcgtcgatgccgcgagtcgatccggaagctttcgtgtctctgcgggacgagatggacgggctcatccggcggatgccgatagccgccacttccgaagccgatcttctcctggtgcagacgctgagagggctcgtcgagaaagtcgtgatcgatcaaaccgatgaagagcgcggctatgcgctcgaaatcacgttcacgccgtccgctctcgtcgcccggaactatcgtctcccgctcgccggcttggatcccgtcacgatccgcaggatctgtccgccatcgcgaaccacgatcgcaaatctggcggagatcgatgcgttgctacgagccaaggccgatagaagggaatacaccctttcggacgaagactgggagatcgtccgagagaaggctcagtcctggccattcgacgacgctcgatgggcgatggatgccacgctgttctatctgcgcagcggacggggtcttcgatcgttgccgccgcctttctcggggccgaaagtcagacagcgggtccgtagtttcgtacaaagaggcttctggcgtctcgcctacgacgcgctcgtcgaagcggcctcgccggcggtccgtgccctggatacgtctcgtctggcgtcgatggagagggtcgctctaagccgtcgcgccgggcttccggaaatcgtcggccggcgcgatgcaggaggcgaaccggccggcggatcgcgtcttcggccatcgggtcctccggccccgagcgggggcacgtga

SEQ ID NO: 7324 - DNA, 480 bp, Methylobacterium sp.
gtgttcatcgaccgccagctcgccggtccttacggcgagggcgcacgcctctacatgaaaggccccttcgccgaggggacgaaaacccagggacagcagtcaccgctgcggcccgcagcgcgcttccgcgccggcctcttggcactcgacgctcattgccgtgctgccttcggcgctaccttcgccgacctcgcatcggaccgtcaggtcgaggtgctgaaagggctggagactggcaccgtgaagttcacgggaagcgtcgcagccaagcccttcttcgagctcctgctcgcgcggacgatggaggggttcttcgccgacccgatctacggcggcaaccgcaacatggccggctggcgcatgatcggcttccgcggcacccgctacgactacactgactggatcgagcgccacgacgtagccttcaccgacccaccgacctcgatcatgggcgcggccacgtggacgcagaggggctaa

SEQ ID NO: 7325 - DNA, 639 bp, Methylobacterium sp.
atgcgccgtacactcgccgccgccctcgccctcatcatcgccaccatggccctcgccgcacagaagatgtgggacggcacgcgctgggtcgcccgcacgctctcgggcatgcccacaccctcgagcaccggcgtcgaagacgccctcgacgacatcgcctacgaagccgcccccgtgacaccgtccgcgcccgcagccgaatccaccgtgacaccgtccgccccggcgccgaaggccgagaccgcccccgtggccaaggcggcgcagatcgtcgagctcgatccggtcctggcccggggacgcctcgcggctcgattcgtcgagtgcacgttctcgctggagcccgaggaaaacatcctggctgagtgcgacgacgtcctccgggcgtggctgctctcgctcaacgcgcaggagatgatggccgtccattgcgccggggcgcaccgggtcgccgcccacctcgccggcaagcggctcctggagggggtgccggagatcgcgacggtgcaggagtaccggcactacatggggcaagccgcccgcatcacgcctcagcgtagggccgagatcgcggagttcgacgccgccttcgaggacctcatcaacgatgagggctacgagctgaattgcggcgtctaa

SEQ ID NO: 7326 - DNA, 723 bp, Methylobacterium sp.
atgaccaacactctccaggaccgcaccgtcgtcatcttcggcggtacctcgggtatcggcctcgcggccgctcagcaggccaataccgcgggcgccaaggtcatagtggtcggcttcaacgccgagggtgccgagcgcgtggcggcggagaacggcttcaacggctggcgcgccgcggacgtgacccggccagagaccatcgctgcggcgctcgccgacatcccgcatgtggaccacctcgtactgctggccggcacgttcgtggccggaaagatcctggaggctgagattgactacctcaagcgggccttcgacgagcggatctgggcggcgctccacacgctgcgcaccctggacggccgacttgcgccggacggctccgtgaccttcatctccggcgccctggcagaccgccccagcgctcagggcaccgccgtgctggcggctgcttcagccgcgatggaggcgttcgcgcgcggcctcgcgctcgaactggcaccgatacgggtgaataccttatcgccgggcaccaccgacaccccgctcctggcccgtacgctcggcgcccaccgcgacgcctacgtgaccgcgttgaccgagaagctgccgcagcgacgcctcggcacggccgaggaggcgggcgcggcggtcgtcttcctgatgagcaatggcttcatgaacggcgagaccctacacatcgatgggggcgcccgcctcgtctga

SEQ ID NO: 7327 - DNA, 243 bp, Methylobacterium sp.
atgctgagcatccgcgacgaggaagtgcgcaccctggcggagaccgtgatgcggaagagcggtgctcccaacctcacggcggcaattaagctcgcgctgcagcatgagattcggcgcgccgatgaagcggttcctttaacccagcgcgtggccgctatccgggcaaaagccttggcgaaggcgaccggaacgccgcagcctcccttgagcgaagccgaacgtgacgccctctggggcgcgtga

SEQ ID NO: 7328 - DNA, 648 bp, Methylobacterium sp.
atggacgacgaaaccgtgcaagagcagctgaagggcaaggcgcccgcatccggggccatgcggatcgcgatcgtgttccattccggctacggacacaccgcccggcaggccgaagccgtggcggcgggcgtacgcctcgtcgacagcaccgaagccctgctcctgcccgtcgaggacgtcgaccggtcctgggccattctcgaagcctccccggcgatcatcttcggcgcaccgacctacacgggggcggcctccgccgcgttcaaggcgttccaggaagcgacgtcgcgcgcggttatggctgcgggctatctgtggaaggacaagatcgccgccgggttcaccaattccggtgcgcgggccggcgacaagctgtcgacgctcgtccagatggccctgttcgcggcacagcacggcatgcattgggttagcctcgatctgccgccagcgaacagctcgaccacggggtcggagcaggatctcaaccggctcggctactggctcggcgcggcggcccagtcgaacacggacgaaggtcccgaacgcgcgccgccggaagccgacctcgcgaccgcgcggcatctcggccggcgcgtcgcgcaggtcacgcggcagttcgtgcgcgggcgtgaggcgctgagcctgtga

SEQ ID NO: 7329 - DNA, 630 bp, Methylobacterium sp.
atgaagctgtactacatccccgcgagctgctcgctcgcgccgcacatcgtcgcccacgagctcgggctcgaccttaccgtctgccgcgtcgatcacgccacgcacaggacggaggcgggggaggattacggcgctatcaacccgcacggctacgtcccggcgctggccctcgacgacggctcggtcctgcgggagggcccagcgatcctgcaatacctggccgacctgaagccggaggcgcgcttggccccggaaaacgggagcctcgcccgctaccgcctccaggaaatgctcggattcctcaattccgagatccacaagggcttcattccgctgctctacgcccggctggcggggcgctgggtcgagaccgccaagcccaggctcgcggcgcgctatgcctggatcgacgcccagctcgccgggcgggacttcctgatgggcggcacgttcacggtcgccgacgcctacctgttcgcgctcaccggctggggccaggccccgtggctgacctcgtattaccgggccgacatccagttcgacgacctgcacaacctccgggcctggtacggccgggtgcgcgggcgccccgcggtgcggcaggccctgcaggcggaggggctgcgctaa

SEQ ID NO: 7330 - DNA, 300 bp, Methylobacterium sp.
ttgtgcgcggcgatccgggaggtcgagcagggtcaagctgacgatctcggcggcggtgtcttcaagaagcgcctgaacaagaacatgcaccggagcgtcattctggccaaaatcggccattactggctctatcagtacctgttcgcgaaaaaggatcgcgccaacatagaggacaacgagctgaaggcatttcgcttgctcgccaaggacctcggcaggacgacggatgccgacatcgctcggctcattgcggcgggccacatcatggagatctgcgatgaccgggaagcgggcctttaa

SEQ ID NO: 7331 - DNA, 801 bp, Methylobacterium sp.
atgaaaattgccattattacgccgtcacggcttaaacggtcgacgctggtcggcaaatcccatctctattttctggagcatgccgttgcgagcgctgcggctcaagagctcatcgataaacagatcacgatccatttcttcgtcggaatcgatgcggataccgtgattccggctcggctggccgaccatccgcaactcacattcgtgcggagcgactgcaaggctcaggtccccgcattgaatgcggcaatccgggccgtggatgccagctgggaccttgtcggcttcctcgaggacgacgaccggtggctgccgcaatatctcgccgtcgccatccgggccctcgaggggttcgatttcgtctcctcgactcaactcgaggtgaacgaggccgacgagcccgtccggatcaacgatttcccggcgccgtccggttggctcatgcgccgcagcacgttcgagaaggtcggcgcgatcaatccggcctcgaagtggcactacgacaatgagtggctcggtcgcctggccgaaaccggcctgcgtcgcgcccatctggtcgaggcaacggcaccgtggaccatggacgacgccttccaggtccgtccctggctggcgaacgtcctacgtttcggcggcccgaacatccacctcgtgcgccacggcttcgtcctgccgctcgtgtaccgtctcgtgcatccgggatccgggacctcgcatgtcggcgggggcgggacggccaagacggagagcaacgcggaataccaatggctcgtcgaccgcttcggtcggatcccgtggtga

SEQ ID NO: 7332 - DNA, 480 bp, Methylobacterium sp.
gtgccgcagagactgaaaacgacgcgacacgaggacgacgtccatgcctgggcccaggagcaggtgcatttcctgcaagccggggcctgggcgcgtctcgacatcgaacaccttgccgacgagatcgcggatgtgggtcgcagcgaacgccacgcactgacaagcgccctgagcgtgatcctgctgcaccttctgaagtgggatcatcagccgacgcgacggacacgcagttgggtcacatcgatacggacgcagcgcgtcgtcgtggccgagcgtctcgaagacagccccagcctgaagtcccggatcgatgtgctggtcgcgcgggcctatcaccgcgccttgatcgaggcagccggcgagaccgggctcgacgaggggaccttcccgccggcctgcccctacgatgtcgagacgatcatgacgcgcgagatcccctggccgccgagcgacggccagccgcggcctcaacgcgggtag

SEQ ID NO: 7333 - DNA, 1170 bp, Methylobacterium sp.
atgctgaacggcctgaagggcttcgatttcggcctcggcgagacggccgacgccctgcgcgccgaggtcgcccggttcgcatccgtcgagatcgcaccgcgggccgccgagatcgaccggtgcaacgacttccccgccgatctctggcgcaagttcggggatctcggcgtgctgggcgtcaccgtcggcgaggaatatggcggcgccggcatgggctacctcgatcacgtggtgatcatggaggagatcagccgggcctcggcctccgtgggcctctcctacggcgcgcactcgaacctgtgcgtcaaccagatccaccgcaacggcaccgaagaccagaagcgccgataccttccgaaactcgtctcgggcgcgcatgtcggcgccctggccatgtcggagccgggctcgggctcggacgtggtgtccatgcgcctgcgcgcggacaagcgcggtgaccgctacgtcctcaacggcaccaagatgtggatcaccaatggtcccgacgcggatgtcctcgtcgtctacgccaagacggatgccgaagcggggccgcgcgggatcaccgccttcctgatcgagaagacgttcccgggcttctccaccgcccagaagctcgacaagctcggcatgcgcggctccaatacctgcgagctggtgtttcaggactgcgaagtcccggaggagaacgtgctcgggcaggtcgggcgcggcgtcaacgttctgatgagcgggctcgactacgagcgggccgtgctcgcggccggccccctcggcatcatgcaggcctgcctggatgtcgtgctgccgtacatccacgagcgcaagcagttcggccagcccatcggcacgttccagctgatgcagggcaaggtcgccgacatgtacacgatcgccaatgcggcgcgggcctatgtctacgccgtcgcgaaagcctgtgaccggggccagacgacccgcaaggacgcggccggagcgatcctcttcgccgccgagaaggcgacctggatggcgctcgaggcgatccaggcgctcggcggcaacggctacatcaacgattacccgacgggacggctgctgcgcgacgccaagctctacgagatcggcgccggcaccagcgagatccgccgcatgctgatcggtcgcgagctgttcaacgagaccgactga

SEQ ID NO: 7334 - DNA, 96 bp, Methylobacterium sp.
gtgagcgatgtgttgatgattccgctcttgcggatcaccgttacgagaaacccgagcggtgagtggtttgtgaccatcacgctcgggctcgcgtaa

SEQ ID NO: 7335 - DNA, 162 bp, Methylobacterium sp.
atgggcctggtgcaggccatcgccccgaaccctcacgccgccctggaactagggctaggcatggcagctaggattgcctgctgtggcccgttgggcatcaagaccaccttggcttcagcccgcgccgcggtcgtcgggtcggaaggcatgggccttctctaa

SEQ ID NO: 7336 - DNA, 1776 bp, Methylobacterium sp.
atgctcgccctgtccggggcgccctccgctgtcgagagccgtcccgctccgcggttctgcttcgagctcagccctctcgactacgcccgccttgtgcacccgcgcgcgcccggcgccgtcctgttcggggcgcaccttccgtccacgaagctccgcaaggccgacggctcgccgaaggtggcgtggcaggaccggcgctggagccccggcgccctcgcgaaccgcgcggtcgacctcgcgcggttcaagttcatgagcttcgcgacctacccctaccaccggcccggtgagccaaagccggtcaagatcgaggcgaacgtcgtcagcatcggcgcctcctgggtggacctggacttctacgaccagtcggagtgggaagacgtgccgcccgcgaccgtcctggagaacgtccgaaacatctgccaggaccggggctggccggcgccgtcctacgccacgcactccggccgcggcctgttggtcgtatggctctacccagtccagccggcccaggccgtcatggcccggcacaaggccctgcagcagaccctgcacgaagcctttcggcacatggggtcggacgcctccgccaggaccatgaccaagcagttccgcatgcccaagaccttcaacgagaagagcggcctgccggtcagcatcatctggccagccatggtccgcgagatcgagcggaccaccttcgacgaactctgccgcgtggtcctgccgttcaagcgcatgaagcgggcggagcgcgaggcaaaggaggacgccgccaaggccaagcgcaccgctgcccgcctcgccgcccgagcccccagggaaggccacttcggagcccgcctgaccggtacgtcctactgggccaccatccgcgcggacctggagaagctcctcgcccacaggcacggcaagaagggcgtggtcgacggcgtcgcccgctctgagtacggcgccggccgcaacgcctggctgacgtccctcgtctacgccgcggcctgggacatgacccccgaggagctcgaagcctacgtcctggagtgtgccgaccgcctcggctacgagcacgccgaggccaaggacaagtgctgcagcatcgtcctgcgggccaagcaagcggcccggggcatgcgcaagaccttcaaggggcgcccggtcgacccgcgctacaagctgtccccggcccgattcatcgagaccctcgccatcaccccgcgggagatgcgtcgggccgacctgcgcatcctggtggacgagacgcgccggtcggagaacgcggtcgcccgcgtcgtggccagccgccgcgccaagggcgtgaaggcccgcagcagccagcaggacctccgtcgccaggtcggcgagcagaccctggagatggtcgccgagggcatgaccgtgaagggggctgccgagctctacggcgcctcgccaaggtggatggacaacgccctgcgggatgcccgggccgtcgccggcatcggctgcgtgcggaaggagaggccggcatccatgcctgaatccgagaccaccatcaagcaacccctcctcgtcgtcgacgatgtcgccgacaccctcgacaccatcccgcaggccacgcacgaagtgttacggggtattaggccggacgcagtcgaaggtgttgtcgctggcgccgtcgtgacctattctgcggctgtcacgacgaagggcagcactcttctcagaccgacgcccgctgcgcgccaaccggcccggcgggcgttgtcatgtcctgacctcgtaggggtgggagcgtga

SEQ ID NO: 7337 - DNA, 507 bp, Methylobacterium sp.
atggcgtatcggtcgcccctgtcgctcgtggccatcacctcaaacgacctgggtgaggtgaacgccgtcttcgacgacctgacaacctattccatgcaggtggatggcgtgccgaagcgcgaggacgctgccttcgcgttcgtgacggcgcgcccgtcgggatgcgagcttcgcaataagcacgcgttcctggcaaaatgcagtggtgcggtgatcgggcttctcgatctcatcgatggctatccggctccggggacggccttcattggacttctggcaatccggcagagcgcgcagggagctggcttcggccgggcgttattccaagcggcggagcacttcgctcgcgaggacctccgggcccgaaccctgcgcttggccgtcgtcgaaaccaatccggtgctgggcttctgggcgcggatgggtttcgagccgacaggcgagaccagaccgttccacggtgagcgcctgacatctcaggccgttctgatggaaaagcagctttga

SEQ ID NO: 7338 - DNA, 1185 bp, Methylobacterium sp.
gtgctggaggtcgccgatgtcttccgcgccgccgggccggcctaccgcgccgcccgggccgggcacctgagcccgcaccagcgcaaggtcatggcggcgatcgagacctgccgcaccgccgcgctgggcgggcacgtcgaggcctgcgacggctgcgggcacacgcgcatcgcctacaactcctgccgcaaccggcactgcccgaagtgccaggctgcggcggcccgcacgtggctggccgcgcgcgaggccgacctcctgccggtcggctacttccacgtcgtgttcaccttgcccgccgaggtcgcgcagatcgccttccagaacaaggcggccgtctacgacctgctgttccgggcagcctccgagacgatgctgaccatcgccgccgacccgaagcatctcggtgcccgcatcgggctgaccgcggtgctccacacctggggctcggccatgacgcaccacccgcacatccacatgatcgtgccgggcggcggcctctcacgcgacggcatccgctggatctcagcaaagcccggcttcctgctgccggtgcgcgtcctcgccaagctgttccgccgcctgttcctggccgggctcatcgccctgcacgcggccggacggctcgccgccttcggcagcctgtcgcccctggccgagcgcggcgccttcctgcgccacctcgcgccggtccgaaccaagcgctgggttgtctatgccaagccgccgttcgccggcccctcggcggtgctcgcctatctgtcgcgctacacccaccgggtcgccctctcgaaccggcggctcgtcggcttcgacacggccggcgtcaccttccgcgtcaaggactatcgccgcgacgggccggagcgctacggcgtcctgacgctggccgcggacgagttcatccggcgctttctcctgcacgtcctgcccaggggtttccaccgcatccgccactacggcctgctcgccagcgccacccgccgcgccaatctcgcccgcatccgcgacctgctggccgccgcgccgccggctaacccgccggaacctgcgtcgccgcccgaccggctcgccccgtgcccgtgctgcggtgggcgcatgacgatcgtcgagatcttcggccgcttccggcagccgcgaggtccgccgaccgcctcggcttcaacccggatgagggccacgtga

SEQ ID NO: 7339 - DNA, 849 bp, Methylobacterium sp.
atgttcgacacgacgaaagtggtcgccaacgccctgggcgaacaccttgcactcacgtaccagcgcacgttcggaagccgcgagccgcgatatgccgagatcatcgaggcttccgcgcggctcacgatcgagcgcatcgtcggcagcgacgcgctctatcacgacggcgaccacacgatcctcgttaccctcgtcgcccaggatatcctgcgcggccgcttcctgcagcggggcgtcacgcccgaggactggctgcacatgatcctggccgccctctaccacgacatcggctacgtgcgcggcgtctgcgcgggggaccgggccaacgccttcgtcatcgacgcccagggcacgacggtaggtctgccgcgcggcgcttcggacgccgccttgacaccctatcacatcgagcgctccaagctggcggtgcaggaacgcttcggcacgcacgacatcgtcgacgcgggccgtgtgatacgggccatcgagatcacccgtttcccggtgcccgaggacgacgagcaccgcgagaccggcacggaggcgggcttgctgcgggcagccgacctgatcgggcagctgggcgatccgctctacccgcgcaagctcaacgctctgttccacgagttcgtcgaggccgggctcgacggccagctcggctacgccagcccggccgacctcgcggagcgttatccggcgttcttctggggcaaggtcgagccggtgatcggcgatgcggcacgtttcctggacctcacagtggaagggcgtgtctggatggccaacctctatgcccacgtgttcgccgccgagcacgaccgccgtcgaatgggtccgcatccaggttga

SEQ ID NO: 7340 - DNA, 444 bp, Methylobacterium sp.
ttgtcggcgatctatgagggcggctcgcgctcggccgctgccgctctcggcggggttgggcttcagacggtgcgggactgggtcgtggcgttcaacgcgcacggtccggacgggctgatcggcggcaaggcgcctggggcccgcccgcgcttgaacgtcgagcagcgggaggcgctgcgcgcgttgatcgagcaggggccgatgccggccgcccacggggtggtgcgctggcggctggtcgatctcgcccagatcctgttcgaggatcacggcgtgtcggtgtccgagcagacgctgagccgggtcctgcgagccatgggctaccgcaagctctccgcccgcccgcgccatcacgcccaggacccggacgccatccccgtttttaaaaagccttccccgcccgcatggcggagatcgcgcaggccgtcggcggcaagccgatag

SEQ ID NO: 7341 - DNA, 1644 bp, Methylobacterium sp.
gtgatttatgacgtcgtcattgcgggaggcggccccgtcggcctgctcctggcctgtgaactgcgcctggcaggtgtgtcggtcctggtcttagagcaggccgagacgtgcacgaccctcttgaagggaccaccgttcgggctgcggggactgtccgcacccagcctggaggccttttaccgacgcggtctgctcggcgatatcgaggcactggccgccaccagcccgatcatccggaccttctaccagcgtgacgaaggcgccgaagcccctacaacgcagcgcccgattttgtcgcgcacgccagctggccatttcgctggcattccgttctttcaggaggacatcgatgtctcgcgatggagttggcggctgcccagtccagcgggtcctcgtatggcggtctatctcaacgctttggagcctgcgttagtggcatgggcggaggaacgaggggccgatatccgccgcggttgccgagtcgatgagatcgccgcctcagaggacggggtggtcatcaatgcgggaggccaaaccttccgtagccattggcttgtgggatgtgatggcgggcgtagcaccgtgcgcaagctcggcggttttgagttcacgggcaccgaacccgagttcaccggctattcgatcgaggtcgaactcgcagatcccaatcaacttcctggtgggcggaatgaaacggctcacggcctgtatatctacaccaagcccggatccatcatcataggcgagttcgacggcggtcggtcccaccgcgctcactcgctcacacgcgagttcgtgcagtcggtactgcgtcgggtatccggcgtggaggtcgaggtttcagcgctcaaggtcgcgaccacctggaccgatcgcgcttaccaagcgaccacctatcgtcggggtcgtgtgctgctcgccggcgacgcggcccacatccattcgcctctcggcggccagggcctcaatctcgggcttggcgacgccatgaacctcggctggaagctcgccgccacgatccggggcgaggcaccggatgacctcctcgacacctattccaacgagcgtatcccagtcggtgctgctatcctcgactggtcgcgtgcgcaggtcgcgatcttgggcccgagccgcagttcacaagcgttgagagccgtcatgcgcgatctggcggccacgaccgaaggagcgacgtatctcgccgagcgcgtttggggtgttggcctgcgctatgagttgggcagcgaccacccgctggtcgggcacagccttccggacttcacgctgactgacgggcgaagggccggagagctgttgcgttcaggtcgtgggctactcctcgacttcaatgtcttcgctccgctggagactcttgctcgacgctggccgaggcagatcgcctatctcgggtgtgacgccgtggatcggctcggcctgaatgcgatccttgtccgtccggacggcgtcgtggcctggatcggcgtgggcgagccggatgtccatgctgcggccgcagcagcgatccgttggtttggagatccgcggggggagcgtcacttcgctgacggggaagccttgaatgccgcgggagatccgcatgcgctgcggcggttcaagcgtgaggcacgcgcgggttcggcgtga

SEQ ID NO: 7342 - DNA, 429 bp, Methylobacterium sp.
gtgttcgctcccgtaaccagtctggggttgctgaccgagctctgccctggtgtcggcatccaggcctgcatgctggtcggatgcggagccgaccgatgttccaccgtgaggcttctgaccgcgaaggactggcaccgacgcatcgtcgcgctgtcgaacggcaggagccgatgcggctcccaccatgtcctgctcctcggcggacttccctcgcgcgaaccggagcgctccgccgccctgtccggaatcgagcaggccgtgcatcgaggtgggaacacccgattggtgttctcgaccttgagaaagcgctccgaagccgatcgttcggtccattcccaggaccattcgcgggagatgctggcgatgatcgagctggcgtttcccggcttggtggatgttcccgctccggccggtggagcgcagcgatga

SEQ ID NO: 7343 - DNA, 753 bp, Methylobacterium sp.
atgcggatcctgctcctcaaccccaacacctcggcggccatgactgcccgcatggcccaggcggccgaggcggccctcgcccccgacgtccagatcaccgcgctcaccgcggcgacaggcttgccctacatcgccagccgggccgaggcgcagctcgccggcgcggccgtgctggagacgctggccgcgcatcacgccggccacgacgcggcggtgatcgctgcttacggcgatcccgggctgatcgcggcgcgcgagttgttcgacctgccggtggtcggcatggccgaggccgcgatgctgaccgcctgccagctcggggcgcggttcgcgatcgtcacgttctcgcccgcgctgctgccctggtacgaggatgccgtggcgctggccggtctgtcggcgcgctgcgtcggcctctatgcggtgcgccggccgttccaagtcgtgatcgcggttcaggacgaactgcgtccggagatcctcgcgctggccgagcgcgcggtcgcggacggggccgatgcggtgatcctggcgggagcgccgctggccggtctggccaccgtcctgcgccgggcggtgccggttccgctgatcgatccgctggcggctgctctgggccaggcacaggcgctggtgcggctcgggacacgcccgcccacggccgggcgcttcgcccgcccgcccgcgaaacccgccacaggcctgacgggtccgctcgctcggtggattgcgcatcgcgagggagaggcatga

SEQ ID NO: 7344 - DNA, 873 bp, Methylobacterium sp.
ttgcgccaacgcctgatcgaggagatgaacctgcgccggttctcgcacgagacccagcgcaactacctgcgcgacgtcggccgtctggccaccttcctcggacgccggcccgacacggccaccgcgcaggacctgcgccgcttccaggtcgaacagcgccaggccggcgtgccggtgccgaccctcaacggcatcgtctcggccctgcgcttcttcttcacccacgccctcgaccgcccggatctggcgcgccggctcgtccgtctggcctacccgcgcacgctgcccgtcgtcctcagccgcgcggaggtcgcccgcctactcgccgccacgacctgcctcaagcaccaggcggccctcgccgtggcctacggcgccggcctgcgcgtggccgaggtcgcggcgttgaaggtcacggacatcgacagtgcgcgcatgctgatccgggtcgaacgaggtaagggcggccggtaccgcaacgccctgctctcggcggatctgctggccctgctgcgccagtggtggcgggccggccgccagcaaggcgtgatgctgggcgacggctggctgttccccggccagcacgccctcaagccggtcagtacccggcagctccgccgggtggtcatcgaggccgcacgggccgccggcatcaccaagcgcgtcggcccgcacaccctgcgccacagcttcgccacccacctcctggaggacggcaccgatatccgcgtgatccaggtcctgctcggccacgccaagctcgacaacaccgccttctacaccagggtcgccacccgcacggtgcgcaccgtgatcagccccctcgaccggctcggcctgtgcgaggccggggggatcgcggccggcggctga

SEQ ID NO: 7345 - DNA, 798 bp, Methylobacterium sp.
atgaaccccaagccggatcacggcgagacgagctaccgcggccacggtcggctggaagggcggaaggccctggtgaccggcgccgactccggcatcgggcgcgccgccgccatcgccttcgcgcgcgagggcgccgatgtggcgcttagcttcgtcgaggacgagatgcccgacgcgaaggaggttgccaagctgatcgaggcggagggccgcaaggcggtgctgctgccgggcgacatcaccgacaaggcgttctgcgagacgctcgtgaggaaggcggtcaccgacctcggcggcctcgacatcctggtcaacaacgccggcaagcagacgaaccagaaggacatcggcgacatcacggacgagcagttcgaccggacgctgaagaccaacctctacgccatgttctggatcaccaaggccgccctgccgcacatgccggccggcgcttccatcatcaacaccgcctccgtagtggcctacaacccgccgcagatcctggtcgactacgcgaccaccaaggccggcatcgtggccttttcgaaggccttagccaagcaacagatcgccaggggcatccgcgtgaacgcggtggcgccgggcccgttctggacggccctgcagccgtccggcggccagccgcaggagaacgtcgaaaagttcggctccgaggtgccgctgggccgtcccgggcaacccgtcgagctggccccggtctacgtgttcctggcgagccaggaggccagctacgtcaccggcgaagtctacggcgccaccggcggcaacggcaccgcctga

SEQ ID NO: 7346 - DNA, 759 bp, Methylobacterium sp.
atgctgcgcgatatcgaaggacaggtcgcctgggtgacgggcgccgggtccggcatcggacaggccgccgcggtggcgctggcccgggccggggtgcggctcgccctcacgggacgccgggcggaggccctagagcagaccgcggaacaggtccgcgccgtgggtggcgaggcgctggtagcggcggccgacatgggctgcgccgacgcggtggaacgcgcctgggacgccgtccacgcggcctaccggcgctgcgacatcttggtgaactccgccgggctcaacgtgccgaagcggagctggagcgagatctcacccgtcgacatcgacgcggtcatcggcgtcgatctcaacggccccttctacgcctcccgggccgtcctgccgacgatgcgcgcccagggcggcggcctgatcgtccaggtctcgtcctgggccggccgctacgtctccaagctgaccgggccggcctattccgcggccaagcacgggctggtcgcgctctccgagagcctgaaccaggaggaatgcggccacggcatccgctcctgctgcatctgcccgggcgaggtcgcgacgccgatcctggacaagcgtcccgttccggtcaccgcggacgacaaggcgcgcatgctgcaatccgaggatctcgccgagacgatcctgttcgtggcgcggcttccgtcgaccgtctgcgtcaacgagatcctcatcagcccgacctggaaccgcggttatctggaaggtgtgaagctctag

SEQ ID NO: 7347 - DNA, 1542 bp, Methylobacterium sp.
atgaccacatcgctgatccgcagccggcggatgattgcccgtaccctcgactatgatcgctgggaggaggtcgccgacggcgcggtacttcagaaggacgggatcatcgaggcggtcggcacctacgcagacctgcatgcccgctaccccgacgcccctgtcatcggctcgggccgggagatcctgctaccgggcttcgtcaacggccaccaccatgtcggcctgacgccggtccagctcggatcccccgacatgccgctggagctgtggttcgtgacccggatggtggcgcgcaacctcaacctgtacctcgacactctgtactccgccttcgaaatggtcggctcggggatcaccacggtccagcacatccacggctggatgcccggctccctggaggaggtcgaggcgcgctcgaacgaggtgctgcgcgcctatcgcgacatcggcatgcgggtctcgtactgcttcgcggtgcgcgaccagaaccgcctcgtctaccaggccgacatggacttcgtggcgagcctgccggcgccgctgcaggatccgatgaagcgctggttcgagcgcttccagatgtccctggaggacaacttttccctgtttcgcagcctccacgggggccaggcaggctcccgccgggccaagatccagctcgcacccgccaatctccactggtgctccgatgcggcgctcgaaggcctcgccgggctctcagaaacctacgacgtgccgatgcacatgcatctcgtcgagaccgcctaccagaaagcctatgcggagaagcgcggcggtgggaccgcggtggagtatctggaccgcttcggcatgctcgggccgcggctgaccctcggccacggcgtctggctgaacgagtccgacatcgaccgggtggccgagaccggtacctgcatctgccacaattgctcgtcgaacttccggctgcgatcgggcgtggcggcactcaatcgtttcgaggcgaaggggatcaacaccgccatcggcctcgacgaggccggcatcaacgacgaccgcgacatgctgcaggagatgcgcctcgtgctgcgcgcccaccgcgtgcccgggatggacgaggccgatgtgccgagcatggcccaggtgctgcgcatggcgacggtggggggcgcccgcacgaccccctacggcggcagcctcggtacgatcgaggtcggcaaggccgccgacctcgtcctgatcgactgggaccagatcgcctatccctatctcgacccggagacacccctcctcgacgccgtgatccagcgtgccaagaccggcggcatcaccgccgtcctatgcgagggcgaggtgctctacgccgacgggcgcttcacccgggtcgaccgcgacgctgccttgaaggcgctgcacgacgacctgtcacgggcgctgtcggacgacgaggtcgagcggcggcagctctcgaaggcgctcttgccgcatgcgaggcgcttctacgccgactacatcgaccccgcgcggcacgagccgttctaccgcccgagttcgcgcgtctga

SEQ ID NO: 7348 - DNA, 807 bp, Methylobacterium sp.
ttggcctctgaacccgcatcccaggacgccgtctcttgccgcggcgtcgccaaggtctgggcggccggcaccgcccgcgcccacgaagcgctgcgcgacatcgatctcaccgtgcggccgggcgagttcgtggtgttcctcggcccctcgggctgcggcaagagcacgctgctttacctgatggccgggctcgaagccgcctccgggggtaacctcttctccttcggcaagcccgtcgctggcccatcacccgagcgaagtctgatcttccaggagacgtcgctcttcccttggctcagcgtctggcagaacgttagcttcggcctgtcgctgaagggtgtgccggaagcggaacgccggagcatcgcccgggccgcgctccagcgcgtcggcctcgccgaggcattcgacaagcggccggacgaattgtcgggcggcatgcgccagcgtgtggcggtcgcccgggcgctggccatgcgccccaaggtcttgctgatggacgagcctttcgcggcgctcgacgtccagacccgccagaagatgcaggacttcctgctcgacgtctggcgcgacagcggcgcctcggtgctgttcgtgacccatcacatcgacgaggccgtggcgctcgccgaccgggtggtggtgttcaccgcacgccccgggcggatcaagacgatcgtccgcaacgacctcgcccgcccgcgcgacccgttctcgcctggagccgaggcaatgcggcggcacctcaccgaactcctgcgcgacgaggtcgaccgcgccttcgccgagcaggaagcgctcgtctga

SEQ ID NO: 7349 - DNA, 930 bp, Methylobacterium sp.
atggccatcgatcttgcccgcgccgccgccgtcccgcacggccagccgcgcctcctgttcgcgcagcgcctcgcgctgcccgacgggctcatccccattctgcgccggaccggctggatgctggtctcggtcggctgtttcgccggcctctgggagttgctctgggcgctcggcgtcgccgacgccaagctgcttccaccgccacacatctttctcggcaacctcgtcgagcaagcgcggttcttcaataccgcccagcgttggcagatcggcaccggcatgaacgccggcccgagcccggccatggcggttctgatcaccgtgctggcctccacgggtcgggtgctcgcgggcctgttcctggccgcaacgctatcgatcctggtgggcgtggcgatccgctatgtcgtgctgttcgagcggctgaccctgccgaccatcactttgttggcgccggtctcgccgatcgcatggctgccggtggcgatcttcatgttcgggatcggcaacgccccggcgatcttcatggtgttcatcgccttgttcttcacgatggtgctttcgaccatccagcagatcgacgacgtcaatcggaactacatcaacgtcgcccggaccatgggagcgtcgaagcgtcagatctacgcccgggtgatcgtgccggctatcctgccggggctgctcgcggtgctgcgcctcaacctgttcggagcctggatggtggtgctcgtggccgaggcgactggcgtcggctacgggctcggccaggtaatcatgctggcacgcaacaccttcaacccgtcgctggtcttcttcacaatcaccctgatcggccttctaggcttcgccttcgacctgctgttccgccaagtgcaacggcgcatgctctactggctgccgcgcgacgcggggtcctcccttggcctctga

SEQ ID NO: 7350 - DNA, 1053 bp, Methylobacterium sp.
atgtgcgaccgtcacggcgattatcgcgtccccgacttatcgcggttcaagaccagccgccgacgcttcctcggcggcaccgccgcggcgctgaccctcgcagcggggccgggccttgtcggccgggccgcagcggcctccggtatccgggcgacgcacgggaccggcttttgcaatctgaacttcttcctggccgaggcgatgcaactcgctaaggacgacggtctcaccatcgacttcgtgaacaccccaaccttttcggatcaggtgaccttcctcggaatgggtcaggtcgatgccggcgtgatgccctacaccagcttcatggcgctctacgatgcgggtgccccggtgacgatcgtggcgggcggcggcattgagggctgcgcgctcgtagcccagccgggcctcgatagtccggagaagctcaagggcaagacgctcggcaccttccagctcgatacactcgaagtgctgccctacgactggctgaagaagaacggcgtcgccttcaaggacatcacggtccgctacatgggctccaccccggaggccgtggaggcgttccgcgccggcgccctcgacctcatctccacgatcgagccctacggcacggcgctgctgaccgacgtgaagggcgccgtaaagctctccgacggcaccgacatctacggcaagggctataccgactgcgtgctcgccgtgcgcaatgagttgatcgccaagaacccgggtgccgtcaaagccctgatcaagggcatgatgaaggctcaggccctggccgagggcgacccccaggccgctctgaacaagctcgtcggctcctactacaagacctcgatgagcaatgctcagctcgccatgggccggcagccctcggtggtggacgcccgcaaccagacgcagttcatcctcgaccggaccgactccgtcgccgagatgggctacatcaagaagaagcccggccgcgacgcgatcgactggacgctcctggagcaagtcattgccgagaacacggatctctacagcaagctcaagctgaagtcggcctga

SEQ ID NO: 7351 - DNA, 1446 bp, Methylobacterium sp.
atgacgaccggcgtcaccctggtgacgggggcccggtgggtcgtcgcctgggatcccgagaccggcggccatgtctaccgcaccggcgcggacgtggctttcgaggatggcgccctcatccatgtcggtccggactacgcgggtcccccgcccgtgcggaccatcgacgcatccggctgcttgatcatgcccgggctcgtcgacatccacacgcacctgttctcggaacccatgaacaagggcatgtgggacgaggtcggcagcccgcggctctacaacacctctctctacgagtaccttccgatcctcaggccggatgcggcgggcacgcgggcggcctacggggtcgccttggcggagctggcgctctcaggcgtcaccacggtgtgcgacctcgccctgccgagcgagggctggctcgacctcctcggaagctcgggcctgcgggtctgcatcgcccccatgttccggtccggccactggctgacccggaacggccaccgcgtggagtacgaatgggacgaggccgccggccggcgcggcctggaggattcgctggccgagatcgaggccgcgcaggtgcatccgagcggacggctcttcggcatgctctgcccggcgcaggtggacacctgcacggcggagttgatgcgggacgcccatgccgaggcggtacggcgcgatctgcgcttccacacccatgcggcgcaatccctgtcggagttccacgagatcacccgccgcaccgggatgacgccgatcgagtggctcgacgatctcggagtgctcagcgagcgcaccatcgtgggccacgggatcttcctggacgaccatccctggacacactggcacagcccgggctcggacatgcggcgcctggccgagcgcggcgctacggtcgcccattgcccgacggtcttcgcccgccgcggcatcgcgctcaatcatttcggccgctacgttcaggccggcgtcaacatgggcatcggcaccgatgtctacccgcacaacatgctcgacgagatgcgccttgtctcgtacctcgcccgggtcgtcgccgagaacccccgcgacacccgcgcggcggacgtgttccacgccgccacaatcggtggggcccgggcgctggggcgctccgacatcggccggctcacggcgggctgcaaggccgatttcgtgctcgtggactgcacgcatcccgccatgcggccgtgccgcgaccccgtgcagtcgctgatctattcggccgccgaccgcgcagtacggcaggtcttcgtcgatggccgcgagatcgtgcgcgacggtcgcgtcctgacggtcgactacgccgccgcagccgcagcccttgaggaagcgcaaggtcgcgcgctcgcgcagatccggcagctcgactgggcggggcgcggccccgacgccatcgcaccactgaccttcccggggctgtga

SEQ ID NO: 7352 - DNA, 681 bp, Methylobacterium sp.
atgcccaatcccggcgtcatcagcccagcgcgcatcctggtgatcaacccgaattcctcccaaacggtgacggccgccgtcgatgcggcgctggcgctgctgcgcctgccaggcggccccgacatcaccgtgacggccctgcctgaagggcccgagagcatctcctcgcagcaggatgcggatcgcgtggtgatgccactggcgcggcgcatcgcggaggattcggcggacgccttcgtcatcgcctgcttcagcgatccgggcctgcagaccgcccgcgaggccgccgctggccggccggtgatgggcatcgccgaatggggaatccttcgcgcgctcaccctcggtgagcgcttcggcatcgtcgcgctgtcggagggcagcgtgcatcgccagcgccggatggtccgtcaaatgggtctcggggagcgctatgccggcagccggccggtggaggcgcgggcggacgagacggtgggcgaggccatccgcgcccgcctgatcgcggcggcccggatcctgatcgagcgcgacggcgccgacgccatcgtgctcggctgcgccggcatggcgcctcaccggatggcgatcgaacgcgcgatcgggcgcccggtcgtcgagccctgtcagcaggccgtcgccgcagccctcggggcggtcctgctgcgcgaggttccttag

SEQ ID NO: 7353 - DNA, 1578 bp, Methylobacterium sp.
atgagcgctgccgtgtacgatgtcatcgtcgtcggcgccggctctgccggtgccgccctggccgcgcgcttgtcggaggatcccggccgccgggtgctcctgctggaggcgggccgcgactggcggtccgcagatgccccgccggccctgcgctcggccaacatcgtcccgttcatgtacgatccgagccaccaggcggactggcaatggccggggctgatgagccgccgaacccgcacccaggagccccgcttctactggcgcggtcgcgcgctcggcggcagttcaacggtaaacgcgcagatcgcgatccgcggtgtcccggctgccttcgatgcctgggcggcgcagggctgcacgggttggtcggcagaggacgtgatgccgctcttcgaccggatcgaggacgacgccgaattcgccaccgaggcaggggcccgtcgcggcggtccgctgccggtctaccgcgccccgctggacgcgtggggcgccgtcgaccgcgggctgagggaggccgcactggcggacggctatgtctggaaggcggatctcaacgcgccgcagggcgagggcgtgtcgtgcaacccgatcaacagtcgcgacgggcaccggatcaccaccaacgacggctatctcgaaccggcccgcaaccgaccgaacctcgagattcgctgcgaggcgctggtcgatcgcgtcctgttcgaggggcgcaaggccgtcgggctccgcgtccgcttcgggacggacgcctggaccgagctccacggccgcgagatcgtcctctgcgccggcgccgtccacagcccggcgatcctgatgcgctccggcatcggccccgccgagccgcttcgcgccctcggcatccccatccttcacgcgcacgaggcggtcggcggtaatttcatggatcacccgatcctgagggcgacgatggatctgaagcccggccgccgggccctcgggccggatgcccgccataccaattgctgcgtgacctattcgagcggtctcgcgggcggcggcgagcgcgacatgatcgtcgtcgcctacaatcaccgcggcctgacgggtctggaaccgaccccgcagggtgccgtcggcgtcggtctgtacgacgccttctcgcgcggttccctgcacctcacatcggctgatcccgagatcaatccggtcatcgaggagaacatgctcgacgatccgcgcgaccgtctgcggctgcgcgatgcggtgcggcggctggcgcgcctgacgacgcatccggcgctggccgacctcgcgacggcgatccggttcggcgagagccccctcgcgccgggcgaagctgcgcgcctcccggattccgaactcgacgacctaatgctcgcggaagcgggcgacatccagcacgcggccggcacctgccgcatgagcggttggcaggacgcatccggcgtcgtcgatcccgatctgaaggtccgcgaggtcggcggtctgcgggtctgcgacgcgtccatcatgcccagcgattgcagggcgaacctgcatttcacctgcgtgatgatcggtgaaaatctcgctcggcgcatgagcaatcattag

SEQ ID NO: 7354 - DNA, 771 bp, Methylobacterium sp.
atgatgctcgccgcatcggagacatatgcgatggcggaaccgaacgggacgacgcgtctgggcatgctcacgccctcgtcgaacagcgtgctggagccggtgaccgcgcatctactcgccggctgcgcgcaggtcagcgcgcatttctcacgcttccgggtcacgcagatcggcctgtcgcaggcggccctggggcagttcgaccccgagccgatcctgatggcggccgagctgctcgccgatgcccgggtggcggcgatcctttggaacggcacctccggcgcgtggctgggcttcgacgcggacgagcgcctgcgcgacgcgatcgaggaccggaccggttgccccgcctccaccgccgcgctcgccttccgcgacctgttctgcgcccggggctatgaccggattggtctcgtgacgccctatacgggcgacgtccagcggcagatccaggcgaattggggggcagccggcttcgactgcgccgccgagcgccattgcggactgtcggagaactttgccttcgccagggtcggcccggaggcgattgcccagatggtccgcggggtggcggccgaaggcgtcgatgcggtggcgatcgtctgcaccaacctcgcgggcgcggcgcttgtcccggctttggaggccgaactcggcgtgccggtcctcgactcggtcgccgtcaccctctggaagggcctggacctcgccggctgcaggcatgcggatctggccgcgcggggcagcgtgttcgcggaggcccgaccgtga

SEQ ID NO: 7355 - DNA, 426 bp, Methylobacterium sp.
atgaatgcgagccacgctgccttcttcgagcggcctgaagctgccgcgctcaagcagatcctcatccaaccggcgaaaatcccgcaatacgagcttctgagccgcctggagatcccggcagtacaggccgtgatctgggatatcgagccgatcatcgaagggttcgatccggcgacgcgcaatcatgcgattcagtcaacaggcgcgctgatcggtgatctgctgacggcacgcggcttcagggtcgcccgcgacgcccgtggcaagaagcgtcgcggccgtgtgcggaaggccaagttcgtcaaatcgggtacgatctgggaattgcccgcggagccgaacaacgggcatgccgagaaggtcgcgtccattatggacggtatcatcgatcggtatcgacatacgcttgccgagttggcgaaatga

SEQ ID NO: 7356 - DNA, 966 bp, Methylobacterium sp.
atgatcttcgcggaagcgctcggtcgcctggaagggctcggtcgctcagcggcggccctcctacccgggctcgccatcgccctcgtcctgttcggcctcggcctgctcgtcgcccggggcgtccgcgccgccgtgcgccgggccgcggaactgcgcgacgcatctccgggctcggcctcagtgctggggcgcatcgccgggggcgtcactatcctggtctcgttcctggtggcggcctcggtggccttcccctcggtttcggcggccgacctgtttaacctgctgggcatcggcggcgtggccatcggcttcgccttccgggacgtgctgcagaacctgctcgcgggcatcctgatcctgctcacccggcccttcgtcatcggcgaccagatccgcgcaggctcgcacgagggcacggtggaggacgtctgggtgcgcgccaccgtgctgcgaacctatgacaaccagcgggttctgatcccgaacgccaccctgttcgtcgacaagatcaccgtcatcaccgcccatgacaagcgccgcctcgccttcccgctgaccatcggcaacggcgacgacatgagggaggcgcgccgcgtcatcgtcgaggctttgcgcggtacggaaggcgttctcgctgatccaccaccggaggcgctggtcaccggtctcggggccgccggcgtcgacatgacggcccggttctggatcgacccgccccggcggcgcgacgcggtcgatgcgctcgaccacgccatctcgaacgtcaaggaggccctgaccgaggccgggatcgacctgccgtacccgacaagccaagtgctgtttcacgaccagaccgaggagacggacggcgacaggacgagccagcgagagggctggcctgccgggaagggcccaccgcgagcccgctggcgcgtgctgcgggaggatgatgccgtcagccgccgtgccgaggaccgggcgtga

SEQ ID NO: 7357 - DNA, 360 bp, Methylobacterium sp.
atgtccgctcatcagatcgcttcgaccttcgaccgggccggcctctctctcgctggcgttgccgccggattcgccgcagacgcccgggccaggcaggctgccgccgatgccgagcaggccgaccgcgatctctcggcagccgagcgcgcacgccgcgccgtggcccgccagcgtgctgagctccaggcctccgtcgacgagaacgccgccttgcgcgcgcaggtcgctcggctgcagcgcgagctcgccgcctcgaaggccgccaccgcttcggccgaggcccgggcctccgccgcgcgccaggagaccatccgcgcaaagacgctgctccgcggggccgtcggcatgcgggcggcctga

SEQ ID NO: 7358 - DNA, 471 bp, Methylobacterium sp.
atgctggacggcaccgcatacgacgagcgccgcgcccgcctcggcgcgatccgcaccggttggtacggagacgccccagccgtgtccccgcatgggcgccgcatctacaaagaaggcggctcggtcgagcacctcagcgaccagaacgaaaaccgtcagccgccacccagccatgaggcagggcgtgcattcctccggtccctgctgcgcgactggcgtaccgagaacgctctcctggcgcagtgggacgtcgagcacggtggagcgctgcggcgctgcctcgtggccgccggtgtggccctacgggacgagacggacgacgggcgcgagcgggccgaccatcttgtccgtttggcatgcagggccgtcacggcgtcgggcctcgcacggctcgatgccggcgtcgctgaccttgccgcggtgcctcgggggccatggaggcttggttggcttgggcccgcctccgtctga

SEQ ID NO: 7359 - DNA, 1227 bp, Methylobacterium sp.
atggcgctgatccgcaattgcgtcctcgcggccgcgatcgcctgcagtgccttggccgggacagcctccgccgagccgatccgcgtgaaggtcggcgtcctcaacgacatgtccggggtctattccgacacgggcgggccggggtccgtcgtcgccgcgcggctcgcgatcgaggactttgccagggactccgccacgaccggcgccgaggtgcgggtcgagttcgtcgccgccgaccaccagaacaagccggatgtcggcgcggccatcgcgcggcaatggtacgaccgcgacggcgtcgacgcgatcttcgacgtgccgacctcctcggtggccctggcggtgagccaggtcacccgcgagaagaacaggatcttcatcgattccggcgccggcaccacggacctgaccggcaaggcctgctcgcccaacacgatccagtggacctacgacacctacgccttggcgcacggcacggccggcgccatgctcaagcgcgggggcgggacctggtacttcctcaccgccgactacgcgttcgggatctcgctccagaacgaggccaccgcggtcatccagaagggcgggggccgcgtactcggggccgccaaggttccgtttccggccaccgacttctcgtcgttcctgctccaggcccaggcttcgcaggcgaaggtggtcgggctcgccaatgccggcggcgacaccatcaacgccgtcaagcaggcgcacgagttcggccttatggacagcggccagacgctcgctgcgctgctcgtctacgccgtggacgtgcatgcgctcggtctgcagacggcccgcgggctggtgctcaccgagtcgttctactgggacctcaacccggacacgcgcgccttctccgagcgcttcgcgcagctccacaacggcagcatgccgacgatgaaccaggcgggcgtctatgccgggctcctgcattacctgaaggcggtggcggcgaccaagtcgaaggacgcgcagacgacgatggcctggatgaaggccaacccgacggacgacccgctgttcggcaagggatccgttcgggtcgatggccgcaagctgcacccgatgtacctgttcgaggtgaagtcgccggccgaatccaagggcgcgtgggacctgtacaagctcctcgataccattcccgccgagcaggcgttccgccccctcgcggacggcggctgccccctggccggcaagggctag

SEQ ID NO: 7360 - DNA, 765 bp, Methylobacterium sp.
atgtccgccgaggagcatcccatgccgaaccagcaaatcacgatccggacgcgcgatggtgattgcccttcgcacgtggtgattcccgccagcggcggaccatggcccgcggtgattttctacatggacgctggtggtatcaggccggcgatgctcgacatggcacagcagctcgctaacgctggctacatcgtcctgctgccggatctcttctaccgttacggaccctacgggccattcgtaccggaggaggtgttcgcgggtgactttcgtgccgtcctcgggcccctgatggctactaccggttccctcacggccgcggaagatgcagaggccatgctcgtttacctcgacacgcgcgacgacgtcagaggtcgggaggtcggggtggtgggcttctgcatgggcggcggcatggccctggttacagcgggaacctaccccgaccggttcgcggcagccgcgagctttcacgggggcaatctcgcgactgatgcgccgacgagcccccacctgttcgcgccgaagctgaaggcggaggtctatattggcgcggcggagaacgatggcagttatccgtctgcaatggccgagcggctgcagagatctctcacggaggccgacgtacgctatacatcgcaaacgtatttggctgcgcacggttggatgatgccagactttccagtttacgaccacgccgccgcagagcgtggctggagcgcaatgctcgcgctcttcggccggaccctgcacggtggcgagtga

SEQ ID NO: 7361 - DNA, 1431 bp, Methylobacterium sp.
atgacccggaccgaacggatgggcgatagcggcccgctctggaccctctcggcggccgccctgtgccgccggtacgcggacggcacggcgagccccgtcgcggccgctcggtcctgcctagagcgcgccgaggccgtgaacccgaccctcaacgccctcgtcgccatcgattccgatggagcggaacgcgccgccatggcgagcgaggcgcgctggcgagcgggcacaccgctgggccctctcgacggcgtgccggtgaccatcaaggacagcctgaacgtcgacggcttcgcgacgcgctggggcagccggctctctggggagcacagggtcgatcaggacgagacgccggtgcgccgcctccgcgcggctggggcggtgatcctcgccaagaccaacgtcccagagctgaccgtccagggttacaccggcaacccagtcttcggcgtcacccgcaacccgtgggatccggcgctgacgccggggggctccagtggcggcgccgtcgcggcggtggctgccgggatcgggccgctggcgctcgggacggatgcgggcggctcgatccgccggcccgcctcccataccggcctcgtcggcttgaaacccaccaccggccgggtgccgcgccggggtggcctgccgccgatcatgctcgacctcgaagtggtcggaccgatggcccgcacagtcgacgacctcacggcggcgatgcggatcctcggggcggccgatccggattccgtcgcgccgaacggcttcggcccgttcgggaccgctgcggtgccggagcgcccgctgcgggtcctttacgtcccggccttcggggcggccccggtcgatcccgagatcgccgacagcgtcgcagaggcggccgggcgcttggccggcctggggcaccgggtcgagaccggccgtttcgacgcggcgacagccatcacggaggcatggccaatcctcggccaagccggcatcgcctggctgatgcgcgcgcatccgggccggcgcgacgtgctgggtcccgacatccgcgccctggccgaggccggcgcgaacctgtcggcgagcgacttgttcgacgtgcagcggatggcgctggctctgcgtcaggacctcaccgcgctgttcgcgggccacgacatcctgatgaccccaacggccgccgcgctgccctggccggcgcaggagacccacccggaccggatcgccggcgtgccggtaggagcccgcggttcggcgaccttcacgggcttcgtcaacgccgcgggctgtcccgggatctccattccgtgccgccccgccggcgcggggctgccgatcgggttccaactcgtggcgccctggggcggtgatgagaccctcgtcgcggtagcggcctcctacgaagcggcccatccctggccgatgctctgggaggacactgatccatga

SEQ ID NO: 7362 - DNA, 927 bp, Methylobacterium sp.
atgccggggcctgagcacgacatcgtcatcggggccgacggcttcctcgggcgcaacctcgtcccgcggctccgggccgagggccgcgaggtcgtgggcatcggacgcgcggcgggtgacctctccgactgggcgaatgtcgagcgtgcgctgcgcgcggcgcccccggccggccgcatcttccacgtggtgacccgccagcgcaccggcgccgtgcagtacgacatccagggcgagctcctggcgatcaacgcccggattcacctcaacgtcctcgaagcgtggcgcctgtaccaaccgcaggccaagctcgtctccacgggctcgtcctgcacctatccggaatcggcggagccgctccccgaggcgcgcttcggccagggacccacgcacccgtccgtgatcggctacgggctcgccaagcaggtcctggcgacgggctcggcggcctacgcgcaccagtacggtctgagcttcctgcactgcgtgctggcgaccctatacggcccccacgacaacaaggccgccgatcgcagccacttcgtcggcgccctgctcgaccgggccgtgcgggagaaggcggcgggcgcgcagcaattcgaggtctggggcaacccccagaccgttcgcgaggtgctgcatgtcgatgaccagatcgacgcgatcctcgcggccgaccgggtgttcgacaacgagatcctcaattgtgccgccaacacgcccgtcaccgtcgaggcggtggcgcgggcggccctggccgccctcgactggtccgtccccttggtgagcccgcccggctcgttccagggggcagcctacaagatgctcgactcgacgcgcttcctcgaccggaccggctggcggccgcggatcgatctcgaatcgggcctgcgcaggctcgtggcggaggaatacgccaagcggtga

SEQ ID NO: 7363 - DNA, 963 bp, Methylobacterium sp.
atgggcgctctccccgagaccgtcgtcgtcgtcggtgcgaccgggttcgtcggccgtaacctcgtcgcgcatctcgccggccgcgtgcagcggctgatcgcgatcagcccctccggccgcgcggtgccgggagcgaccgaggccgcccgcttcaacgcgatggacgcgctgtcggtccccgccgacacgatcgtcgtcaacgtcgccgcgcagcgctacgatgccgaccagttcgagacggcgcagagcgatctgctcaccggcaacgccgagatcaccaaccgcctctaccggttctgcctgacgaagggcatccgcgaggtgcgcgcggcctcgagcgtcgccgtctacccggcggcctgcgatcccctcgacgatgccgagtcggtcgacctcaacgccccgcccaatcggaacgaggccttctacgcctggtcgaagcgctggggcgaggtggtcgccgacctccacgccgagcgctacgggatccacacgatcagcttccgcctgagcaatccctacggtccccacgactcgaccgatccgcgcaaggcgcatgtcctgccggctttcgtgatgcgcgcgctggcaccgggggagcgcttcgagatcaagggcaacccgctggtcgagcgcgacttcgtctatgtcggcgacgtcgtcgacgtgttcgcccgctccctggagatgcgggaggcgagcgacgtgttcaatctctgccgcgggcagaccacgacgctcctcgacctcgcccgcaccatcctggaggtggcgggggaggaccggccgctccacgcccccgacacggcgacccacggcgtgctcgcccgccgctcgaccaaccggcggctgcgcgagcgcttcgggatctcgaccttcacggggctcgcggacgggctgcggccgacgatcgcgtggtatcgcgaggcctatcgcgacggggctcaccatgccggggcctga

SEQ ID NO: 7364 - DNA, 933 bp, Methylobacterium sp.
atgcgcattctgatcactggcggcgcaggctatatcggcacgatcctggtgccgatgttgctggaacgcgggcaccacgtcacggtcttggacacattcaaggcaggaactccggacctgtccgccgcctgtctctacgatgggttcgagcccatcaaaggtgacgcgcgcgatacgcggattctggacgacctggtgccgaagcacgatgtcctcgtcccgcttgcggccctggtcggagcgccgttgtgcaaggaagacgcgatcggcgctaccacactgaaccgggatgccgtcgtcgcgctggttcagcgggcgggtggcgagcagatgatcgtctatccgacgaccaactcgggctacggcgtcggtgagaccggcaagttctgcaccgaggagtcgccgctacgaccgatctcgctctacggcaccaccaaggtggaagccgagaaggccgtgctcgacagcgggcgcggcgtcagcctgcggctcgcgacggtgttcggcatggcaccgcgcatgcggcttgatctcctcgtcaacgatttcacgcatcgcgccgtgaccgatcgagcgctcctcgtcttcgaggggcatttcaagcgcaactacatccacatccgcgacgtcgccaaaggcttcattcacgcgatggacaatcacggccggatgcgtggcgaggcgtacaatctcggcctgtcgagcgcgaacctgtcgaagctggagctctgcgagcgcatcaaggcgcacgttccgaacttcgtctacgtcgaggccccgatcggcgaggatccggacaagcgcgactacatcgtgtccaacgagaagctggaggcgaccggctggttccccgatttcgatctcgatcggggtatcaaggagctgatcaagggcttccggatgatccgaaattctcggttcgccaacgtttga

SEQ ID NO: 7365 - DNA, 1014 bp, Methylobacterium sp.
atgcgcgacttcttcgaggccgccaggaaggctgccccgtgcgtcgcattgatcgacgagctcgactcgttcggcgatcggcggaagttcgcagatcgcgatcgaagatattggacccttgtggtcaacggacttctggagtgtctcgacggcgccggggggcgtgccggagtcctcctggtgggcaccacgaacgatcatgatcggatcgatcccgccatcctgcgttcaggccggttcgaccgatgcatcacgatcccccttccttccatctccgatctcgccgccatcctgcgccatcatctcggtcgtgacctcgccgacgcagatctgatcgagctggcgaagagagccttgggtggcaccggggcggactgcgccgcctgggtgcgcagagcccgcggccgggccagacgggcggagcgtgctctttcgcccgccgatctcctcgccgaaatagatgcgaccgacgcgtcgccgaaccgagccgacgaccttcgcgcagcggtgcacgagagcggtcacgccgtggtcgcgcacgccctcggtttcgaagtccaaaccatagcccttcaccgcacctccgagcgaggcggcctgaccggactgcgtgctcgggacatgtacccgaccgccgacggactgcgcgacctgctcgcagtctatctggcgggacgcgccgcggagatcctcgtcttcggggatccgagcaatgggtccgcttccgatctggccgtcgcgaccgcgatctgcggccgcatgcattgcagttggggtctggaggggcggatcgcggttcgccctgtcgaaacggcgtcggacgaggtggcggccgcgatcgagcgggatctgcggcgagcttccgacgtcgccgcttccattctcctggaacgcaggaccggcttcgaccggctcgcggacgtgctggtcgcgcggcgcgcgctcgaccgcgcggagatcgaagcgacgctcgcgatcatgcctgagcgccggtcggtctcgaacgcctcttag

SEQ ID NO: 7366 - DNA, 1398 bp, Methylobacterium sp.
atgatcgggggggcgtgcttggccgcgaaattcagcgacgtcgtggtggtgctgcccggcttgatcggatcggttctcgaacgggacggcaagcaactctggggcgtatccccgggggggctttgggggatcgtggccggcaacaaccttgaccagttgaggctggcggcggcagataacggcgacgacgatctcggcgacggcatcgtcgcaacccgtctcgtacccaacatcgagttgataccgggcctttggaaacagggcgggtacgaccggatggggcgcggcatcgtcgaccgtctgggtctgatcccgggcgagaactacttcgagtttccctatgactggcgtcgcgacaaccgcgtcgcggcgaggaggctcgcggcgcgggcctcggacaggatcaaggcctggcgcgagaaatccgggaacccggacgccaaactcgtgctggtgacgcattcgatgggagggttggtcggtcggtacttcgtcgagtgcctaggcgggtggaggatcgtccggacgatggtcagcttcggcgccccgttccggggctccggcaacgccctcggttatctctgcaacggcttcacctgggacgtcggcggcgtgccactgttcaacggcacggatgcgttgagatcgttcgagtcagtccatcagttgctgccggtgtatcccttcgtggatgccggcggcgggacgttggaacgcgtcggggagttggacctgccgaacctcgaccgcagccgtgcgattgcggcggcggctttccataaggaaatcgccgacgcgcgggccgccaacgccaacgaccctgcatatcgtgaccacggtaccagggtccgccccgtcatcggcttcgggcagccgacatgccagtccgcggtcctggctggcgggtcgctgacgccttccaaccgcatgccgggtcagaatctgacgggcgacggcacggtcccctccgtttcggccatacccattggagatgacgagatgggcgccatgtatctcccgacgacgcactcggccttgcagagcaggccggcggggctcgatcatttccttggcatgatgacgcaagcgaacgtcgacgatccgaggttccggtcggccgggcgacacatcgcgttgtccgtccgcgatgccaacccctcgaccgaaccggtgagggtggcggcggtcccgtcggattacaggcagacgctgggcggcagcatcgaaaggctggatgccccggcttccatcagacggatcacgttgtatccgaagggcgacgagttcgtcgtcgacgtcgggctcgcccctgggctgtaccgcgtcacggtggaaggcaatgaccttccggcggtcgaggatgtcttcctcgtggtcgatccgggcgagatctcatga

SEQ ID NO: 7367 - DNA, 1893 bp, Methylobacterium sp.
atgacgcatcccgggggcggcgaggacgcctggacctggacctggcgaacggacgccctctacctcggggacgcctggatccagctcggcctgaaggataccggcggcccgtccatcgaggcgggaggctgggcccaggtccgttccctggtgcacgcgtcggcacgcaatatctactggctcgacgtcgttcgttcggggcccacggtcacgctcggcggaagcgtcgcaagcgagcgggtcaagtcgcgactgcatgctgccttcgagcggatggcgcccgaggttcgaaacacgttggaggttgccgcggtcttcgagagcgcgtccgacgacaaggaggcggcgcccgtcgcgaaggatgcgggacatgtcgcctcgatcacgcgcttcccgtcgataacgccccgttccgaagccaaggcgggacatgcattccgcttcgaggtggatctgggggcggcgcccgatcctgccacggagagcaggcctgtcgaaatccgcgacctgcccgcaggctggtcgagcgtccgggtcggcgtcgaggtgtactgcagcgagatcgtgttcgacgcacctgaggacgaggtcggcgtcatcgtcgtgtccaaggacggctcgtccatcgcggcatgcttcaatgggaggatcagggacgacgtccctcccggcaagccgttcaggctgaaggtcatcttcgaccaggacgggcgtcccgccggatcggccgtgcgccacgtggaggtcgagccctcgcgggccggcggcaccggggtggggtcgcctgccgctgcggcgggcgttgccgggaccgttgaactgaaggcagaagtatccgccgcgatgctcaggatcaccatcatcgccgactcggagccgggctcgttccattggcgggtgggcacgccgaggggcatccggtgcaaggccccggtgggtaaggacaagatcgtcctgggtggggacgtccgcaattatgcgcggggcctacttcggagatgccccaacctgaagcccggcgaacggcacgaaaacgccctaaggggcatcggcgagacgatatggaagcaaacgccgccggcattcaggctgttctacgccgagatgcgcgaactttacggcccaggcttcccgatccagatcatcaccgaggagcactatgttccctgggagctgatgcatcccgtcgagagcgagacgatgaccgatccccggcatctctgcatcacccatcccatcgccagatggttcggcgaggaggagacacgcatgcgctccgaactcgcgatgggtggcatcgcgagcttcgtgcccgattaccaatcgggaaattcgagcttgccggcggcgcgcgaggaaggacgacggctggtcgaggagttcggtgccgtcgcccacgaggcgacctatgcgggcttcaccgggttctgggtcgaaccgcttcccgaggaagaagtcgcggtccttcatttcgccgggcacgcggcttcgccgctcgacgaccgggagggcgggagcgaggggctccgaatggtcgacgactgggtgtcggcgtccgaccttcacagcggcgtcaggctaggcgaccgggatgggaccttcgtcatcctgaatgcatgcagtgccggaacggccgacgagatgctcggcgccgtaggcggatggccgacccgtctggccgaacgaggtttcggcggggtcctcgcgccgatttgggcagtgcaggacgagcatgcctcggcggtggtcgtcgaccacctgcaaggcatgttggagggcaagacgctgggcgtcgccatgagggatgcccgcgcattccatagcaatgcgtccggtacccccttcgcctacctgtgccatggcgacgtcatggcccggatggggcggggctag

SEQ ID NO: 7368 - DNA, 258 bp, Methylobacterium sp.
atggcgtcgatcaccatccgcaatatccccgacgccgttcatcgtgccttgaaggtcagagccgcgcggcatggccgcagtgccgaagccgagattcgcgccatcctggaacaggccgcgcagcctgaatgtcgcgtggcgctgggttcgctcctgacatccatcgcacgcgatgcgggcgagctgagcgatgccgaggtagagcagatcaacgatctgcgcgacacgcgtgcgtcggaaccgatccgcttcgaatga

SEQ ID NO: 7369 - DNA, 2673 bp, Methylobacterium sp.
atgagctctgtcttcgcgccgagtgcggccgtcgaacatccgcgccatggcgccggccgagtggtgctacagagtggcgacctcgtcatcgtcgagttcgaaagtgggctgcagcgcgtgccggccggcgagttaaccgccgcggcgagcctcgctgctgcgctcgccgagggccgagccggcgacccggtcgaggcggtgctgcgcgctcaggcgctcgccatcacctccgtcaacgagcagtggggtgtgttctcgcgctcgcgggtgcagatcctgccccatcagctctgggtctgccgcaaggttacggccacgtggccgttccgctggctcgtcgccgacgacgtaggcctcgggaagacgatcgaggccgggctaatcctgatgccgctgctcgccgcgaaccgcgtgcgccggctcttggtcctcgcgcccgctaagctcgtgccgcagtggcgcgcgcgcctgaagaccatgttcgatatccgcctgcagcaatacgcggcggcggccgactcggcgcggggcaacttctgggacacggccacgatggcggtggcctcgttccacaccctgcgtgccgacgggcgtggcgcgcggacccggctcctggaagccgagccgtgggacctcgtgatcgttgacgaggctcaccacctcaacctcgacgagcgcagcggtgacaccctcgcgtacgggcttctgcgggagatgcaggagcgcggccgcgtctcctcgctgctgctctttaccggcacgccccaccggggcaaggattacggcttcttcggcctgatgcggctgctgcgaccggacttgttcgaccccgaagcggaccgcgaggggcagctcgccgccctgtcgcaggcgatgatccgcaacaacaaggctacggtgacggacctgaagggtgagcggctcttccggcccgtcgtcaccgagagccgcgattacgcctattccggggccgaggacttgttctaccgcacgcttagcgacttcatcctcgacgggcgtgcctacgcggacacgctcactgggcgggcacagaccacccgcatgctggtgctcatcactctgcagaagctcgccgcgagctcgatcgccgcgatccagagcgccctgacccgacggcgggccaagctggagcgggcactggcggcgggcggcggtcgcgacaggtctccgccgtccgaggcagagccgggcgacgaggagtacgcggccgcggagttcgccgccctgctgatggagaacgagatcgcgcggctcgacgagctgatcgcgctcgccgccgcggcctcaccggagaccaaaattgcgcggctcctcgacctcatcgagacggaactcgatcccggcgagccggtgctgttcttcaccgagtacaaggccacgcaggcactggtgctgaacgcccttaacgcgcgcttcggcgcggacaccgggactttcatcaatggcgacgagcggctcgatggcgtgcgcacggcaaccggcctccggacgatctccatcggccgggaggtggccgccgatgccttcaacgggggtaaggtccgcttcctgatctcgaccgaggcggggggcgagggcatcgacctgcaggagcgctgctcgaccctgatccacatcgacatgccctggaatccgatgcggctccaccaacgcgtcgggcgcctgtcccgctacggacaacgtgaggaggtgcgtgtctacctgctgcgcaacccggctacggtagaggcgaggatctgggaccttctgagcgcgaagctggagcgcatccaggcggcgctgtcgaacgcgatggaggagcgtgaggatatcactcgcctcgtcatcggcatcgccggcgaagcgttcttcaacgagctctacgcaggggcggaggaactgcgcggcaaccggctcgcggactggttcgacgagaaaaccgcgacgctaggcgggcgcgacgtgatcgacaccgcccgcgacctgttcggcaacgtcgcacgcttcgattttcaagcggtcggccgcgacgtgccaaaggtcgaccttcccgccctcgaaccattcttcgccgcgaccttgcaacggcacgggcggcgtgtaagccggtctgatgatggcagtctggccttcaagacgccgacgccatggcgggagaggtcttggagcgtcgatgaccgctacgaggggctcgttttcgaccgcacgctgaggggcgagaacgctgccagccgcgttctcggcgtcggccaccagctgatggatctcgcggtccaagaggctcgtgagcttccagtgcgcctggcgtcgctcgacagcctcgatgcgccgctccttattgcgagcgtcgaggatgaggtgacgggaaccgggggtacggtgcatcgcctaatcttcggcgtgcaacagttgggcggatcggcaactgttcttcaggattgggagcttctcactcgccttaatgacctccctttgcgcaggcctctaacgtcttttgaagacttaaatggcgaatccgcgcgcgcggcaggagagtcgaccgataggcttctgaccgcactgcgtcttaagctgccgcgaacggcagcgatttttgtccgcccaatggcgcgagcggagatgctgctcgtacccgcagctgttgtccccgatcgaccagccgcgccgccatga

SEQ ID NO: 7370 - DNA, 3072 bp, Methylobacterium sp.
gtggagagcgtcgaggaggccaatggagttcctctagtcgatctcgtttcggtcgacgacgactcccaaggcgagacactgcgcctgacgctctcacctgagattggcgtcgaaatcatcgactcgcaagactgggcgccgctcctacatacttcgttcgagggacctgaccggctcggcgccttcctgcgcgccacggagtggcgcaccgcctcagcagcggaccgcaagctgttccaagctccgtttcgcgccggcatccggctcgatgcctatcagctcctgccgctcgccaaggccctcgacttgccgcgcgtgaacctgctcattgcggacgacgtcggacttggcaagaccgttgaggccgggctgatcgtgcgcgagctgctgctgcggcggcggatcgacttcgcggtagtggccgcccccgcctcgatgctgctgcagtggcaagacgagttggctcagaagttcggtctcgatttcaccatcgtcgatcgtgagcacctgctcgacacgcgtcgcagccgcggcttcgcagctaatccttggagcatcggctcgcgcttcatcgtctcgcacagcgtgctggcggatgacacgtacatagggggtctgcgcgatctactgggcgagttccgcggccgctcgctgttcatcctcgacgaggcccaccacgccgcgccctctgcgggggcggcgtgggccgtcgagagccagatgacccggtcagtgcgccaggtcgctcggcgcttcgagcaccggctgttcctctccgccacgccccacaacgggcactcgaactccttcgccacgctgctggaaatcctcgacccgcagcgcttccaccgcggcatcgcggttgagcccgaagacctcgcgcccgtgatggtccgacgcctgaaggatgacctgcggcgcttggggcagcccttccccgagcgcgtcgtcgagccgatccgcatcgcggacctcccgcctgacgcgccggagctgcggctctccgaaatgctggaggagtaccgcgcctcggctgagggcggggcgcgggcccgcttcctgttcgctaacctgcagcagcggctattctcctcaatcgcggccttcgatcgcacgctcgccactcaccgtcgcacactcctgcgcaaacgcgtcgaggagggcgggccggcgcccgaggtcgcggaggacgacgacctactcggcagcgccaccgagggcgcacgaggcgagctcggcgacatcgacgcggccatcgcccacgtcgaccgcatgctcgcggtcacacgggccgcgcgcgacctgccagacgcccgcgtcgagaagctcctcgactggatcgaggccgagatgctcgacggccgccagcgctggcgcgaccgccgcctgatcctgttcaccgagtgggacgatacccggcgctggctagtggagcgcctgaaagagggcctgctgcaacgcagccggggcgcgatcgacctcgatgggcgcatcctggtcttcacgggccagacaggcctagaggagcgcgaccgcatcaagatcgcgtttaacgcgcccttcgcgaacgagccggtacgcatcctcgtctgcaccgacgcagcacgcgaggggctgaacctgcaggcccgctgccgcgacctcatccacgtcgacctgccctggaatccgtcgcggctcgaacaacgcaacggccgcatcgaccgcaagctgcaacccgccaagacggtgagctgccgctacttcgtctacgaccagcgcgaggaggaccgcgtcctcgacgcgctggtgcgcaagaccgaaaccatccggcgcgaactcggcgcctcaggcgaggtgctgcgcctgaacatcgaagggcggctggcgcgcggtggcattcggcgcggcgaggcggctcgcctcgcgcgggagatcgagggcgagacgtcgcgccgcacggcgctcgctgagcgggaactcggcgaggcgcaggagcgccggatcgcgcgtctgaaggaggagcaggagcgccttcacgccgccctagagcgcgcgaagaagcgcgtcggcgtcgcgggagcggacatccgccgcgtcgtcgagattgcgctagcacaggatggcgcggccttgcagccgggcgggttcagcgtggccgaggcgacgctgctcgaccccgagcaggccgccttcgctaaggatccaagctgggcctcgctgttcgacgaactccgtcccggccggcccgcccgcccaaaggaccgagcgcgctggcgccgtgagacccccgtgcgcggcctcgtgttcgacccgcccctcgtagctgagggcgagcccgagccgcaggacgtggtgcagctccacttggagcaccggctggtgcggcgcctaatctcgcgcttcgcgagccaaggctttcgcgcctcggtcgggcgcgtcacggcgatggtcgcgcgcgacccccgtatgcgcgtggtgctgatcggccgtttatcgctgttcgggccaggtgcgcgccggctgcacgaggagatcatcccggtcaccgcgcagtggcgcgacgtccggcgcgagaccgagccgctagtcccctacgcggagaccggcgaggcgaccacgatcgccgaactcgacgaggccctgcgccgcggagtctcgcctagcgagggcgtgttggcgcgactgcgcgcgagcgtcgcggccgacatcgcggacctgcgcccgcatctcgaagctcgcgctgaagcagccgaagcggcagcggtggccgacctcgccgagaacggggagcgggaagctggagcgctagcagatttgctgcggcggcaaatcgagaaggtgcgcgaggcgatgcgtgacgcgcaggctcccgcccagttcgaactcgacctcgcctccgcggaagaccgccagcagcgcgagcgggaactacgccaattcgaggccgaccggcgctcctgggacgacaagcttcttcgccttcagaacgacctcgacgccgagcctctggccgtacgtgagggctacgccgtgcgggcccgccagctcgaacccctcggcctcatttatctttggcccgcgacgaactga

SEQ ID NO: 7371 - DNA, 240 bp, Methylobacterium sp.
atggacctcaacaaaggcgaacagattggtgcgatcgatggcgatgaacaggtaaagccggccctccgccgtgtggacctcggccggatcgatgtggaagtagccgagcgggtaggcctcgaagcgcgatcgttcgggcttgtcaccgtcgacctccggcagtcggctgataccctggcgttgcaggtaactgtgcagcgacgaacgggtcaggtgcaggatcgtggcctggaggggtag

SEQ ID NO: 7372 - DNA, 1125 bp, Methylobacterium sp.
gtggagcgtgccgcgaacctgaccacggacgacttccgcgcccttgcggacgcgctgccgcagatggcttgggtcgccgagccgagcggcgacatcatctggtacaaccgacgctggtacgactacaccggaaccaccatcgagcagatgaggggttggggttggcgcgacgtccaccaccccgaccacgtcgagcgcgtggtggaccgcatcggcgaggcgttccggacgggcgagccgtggaaggacacattcccgctccgcggcgccgacggcgagtaccgctggttcctgtcgctggcccaaccccatcgcgggccggacggacgcatcctgcgctggttcgggaccaacaccgacatcaccgagcgcaaggggatggagcgccggctcgcgcgccacgccatcgacctgcgccgctcgaacgaggaactggagcagttcgcctatgtcgcctcccacgacctgaaggcgccgctgcgcggcatcgagaacctcgtcgggtggatcgaggaggacctggaagactccctgaccggcgacgtccggaccaacatggagctccttaagagtagggttcggcggctcgacagcctgcttgacgacctcctcgcctactcgcgggcggggcgggccgacgcgacgatggacacggtggacacgaaggccctcgtcgaggaacttgccgtgctggtcagccctccagagggcttcgccataacggcggatgcttccctgccgacgttacaggcggcacgggccccgttgacccaggccttgcagaacctgatcggcaacgccatcaagcaccacgaccggccggccgagggacacatccgggtcgaggcggggtcggcaggggacgtggtcgagttcgtcgtgacagacgacggccccggcattcccgaacagttccgcgagcgcgtgttcggcatgttccagacgctcaagccccgcgacgaggtcgagggcagcggcatggggctcgccatcgtgcgcaagctggtcgaccgtcagggcggaaaggtctggctcgccgatgggccggacgggcgcgggctggcggtgcatttcacgtggccgcgcgacggccggaagggacaggcggatgggctcgacggttaa

SEQ ID NO: 7373 - DNA, 2577 bp, Methylobacterium sp.
gtgctgacctatggcgacacgcgcacccgcctctcggccgctttgttcgacttgatcgaggccgtcgacgcctacaatgccagtggaggcgcaactctcgaggcacgcgtccaggcctggatgccagtccagcaggctctgcgcaccaccctcgggccggacgttgcggccgacgcctacacgcgcggtctcacactctatcaggcgggcgccttcgccctcgatgtccgcgagacacgggagggactcaccttcgaaccgcgtctgatggcacgggagagcgccgcctcgcttaccgacgatgcccccgacgcattgcttccagatgctgattccgcggtcgagggagaggccgagggattgctgccgcctgaagatcaccgcgcattcctgcgccatgcactcgaggcagcgggcgcgacgcgcgacgcctacgtcgtcggtcgcaaccgctttgtgctgatcgacccacatttgaagccgctcctagacgtggtgcggaccaagcgcgccgcgccggacgccgagcgccggcgcttcgtggccaatcctcgcgccggtctcgccgaggcgctcggcatcgacaccgagcaaacgcgcctgttcatcgagacatccgcctactcgagccgtgtgctggagctcggcatctgggagaagccgaagctgccatggctgacccggcgcggccacgcctggctgccggagggcggctggcacgacgcggaaggccaacccgtcgccgcgccggatttgtcggataccgagcggtgggcactggccgaggctatcgggatcgcccgtgcgcagggacacgcacaagtgagcatcaaaggcgtgccggtcccaattgccgccgccgaggctttcctttcagcccttgaagtggatgcggtagcctcgggcgagccagtacgagagggggacacgaataaggacctacccgccgagaaggcggtgctgctgatcaagtcgaactacgacggcgtcgattacgagcagccgctcacgccgcgccgcgcggtgatctctgccgagcctgtggcagagcgcttgggcctaacgcggttcaaaccgcatcaacgaaaaggcttcaagtggctcgtcgaggcatggcaggcaggttggccgggcgtcctgctcgccgacgatatgggactcggcaagacgtttcaggcgctcacgttcatggcttggctgcgcagcaatcaggaggcagcgcaaactgcgcgcaccgagcgcggcccgatcctcgtcgtcgccccgaccgcgctgctcaagaactgggaggccgagtgcgccctgcacctctcaggtcggggccttggggaccgcctcgacgcctacggcagcggtttgcgatatctgaagcggccgcccgagcggcgggccgatcccggtgagaccctggacgtcgcgcaactgcgcgcggcggactggatcctcacgacctacgagaccctgaccgaccatgaacagacatttgcgcgcgtccgctacagcctcgtgctgttcgacgagatgcagaaggtcaaagcccccgacactctgaacacgaaggccgctaaggccctgaacgccgacttcgtccttgggctaactgggacgccgatcgagaaccggcttgaggacttgtggtgcatcatggaccggctgacgccggggtatctcggcgacctcaaggggttcagcagcacctatcgcgaggaggacgcggaccgcttgcgcgccctgaaacgcaagctcgacgagcccgtcggcgctgcgcccccggtgatgctgcgtcggatgaagagcgacgttctcgaaggcctgccgcgcaaggacgaggtccgctaccccgtgatgatgcccgccccgcaggcggaagcctatcggcgcatcgtagcgcaggcgcagcgtgctccgaccgggcgtaagcccggcgacatgctgcgcgtcatccacgccctacgcggcgtctccctccaccctgaggaccccgaggcggcacgactcgacgaagcgcgggcgttccgggactacgccgcccgctcggcccggctcggcgctagccttgagatcctggatgcgatccgggcgaagggcgagaaggcgatcgtgttcatcgagagcctcgccatgcaggcggttgtcgcgcggggtgtcgccgagctgttcgggatgccagcgctgccgggcgtcataaacggggggactccaggcgagcagcgccagcgcgtcgttgacgcattccaggctcgcccggccggcttcgacctcctcgtcctctcgcccaaggctgccggcgtcggcctgaccatcacggcggccaaccacgtgatccacctgagccggtggtggaatccggccgtcgaggaccagtgcaacgaccgagcctaccgcctcggacagacccgtgacgttacggtccacctgccgatggcgatcttcgccgatcagcccgaggcctcgttcgatcgcacgctcgacgccctgctgcagcagaagcgcgcgctctcgcgcgagatgctcgcggcgcctgtcggcgccaatgacacgcgagacatctacgcccgcacgatcggtcacgtctga

SEQ ID NO: 7374 - DNA, 1380 bp, Methylobacterium sp.
ttgagcaaggacgcacggatcatcgagatcggccccagcttcaatccccttgccccgaagcgcgacggttggaacacgatcgtggtcgatcacgcatcgcgtgaggagctgcttcagaagtaccacgaccagacgatagaccggatcgaggcggtcgacatcgtctggaccagcggttccctcgccgatgcggtcccgcccgagcagcacgggacgttcgacgccttcatcgccagccacgtcatcgagcacacgaccgacatcgtgaccttcctgcgcgccgcggaaacgctgctcaagccggatggcgtcgtgatcctggccgtgccggacaagcgcaagtgcttcgacttctaccgcccgctctccggcactgccgacgcgatcacggccttcctcgagcggcgcgaccggcacacgctgcgcacgcatatcgactacgccctgaacatggcgttgaaacccggcggggccggggcctgggccgcgaccgacatccagccggccgaaccggtcaatccgttgaccgacgcgccgcaatggcatgcggccgcccagcgcccggattataccgacgcccatgcctgggtgttcgtgccgtcgagcttcagcctgatgatcctggaattgtcgctgctcggctatctggatctcagggtcgaggagctccaggagcggcacgcgacggaattcttcgtgtggctgcgcaagggtgctgcgcggctctccgccgacgagtccaggcgtgaacgcaccgcgctgatgcagcgcgtgatcgtcgaactcgccgaccaggcgcgccagctgccggacgggccgctcagcgaatcggcagccctcctccgcgaccggctgctgagggccgagtaccgcacgcaggccctgcagagggtcctctcggcggttcaggccagcctcggccggttcggcctgaaccgccgccgcttccggcagctgatcgcgctggcgggccaggacgtcccggcgaatgcgctggcgccgatccagcaccacattctgctgaacgagacgacgaagatcctcaaccggcggaaggggcccgacgacgtgacggcagccgccgaggacgacccggccctggccgagaacgccgtcctcatcgttccgctcggcgcggcgcagttccgcgacccgctgctggccgccgaattgctgcgcgagcgccagcggtcgctcgccgtgcgggtcgtgctcgaggcggtcgtgaacagcctgcgcgcccggtcctgggacaaggagcggttcaaggcgatgatcgcgaaggccgcccgggagacgcccaccgtcgggccggaggcggtgcgccacgccgtgctggccgaggagagccggaaggtcctcggcgtgccgcgcgcctga

SEQ ID NO: 7375 - DNA, 744 bp, Methylobacterium sp.
atgaacacgatcctcatcaccggctgctcatccggcttcggcctggagacggcgcgcctgttcctcgactgcggttggcgggtcgtcgccacgatgcgcacgcctcaggcggctctgctcccggagtccgaacgcctcaccgtcctgccgcttgatgtgaccgacgccggcagcatcgcccgggcagtcgcggaggccggccccctcgatgtcctcgtgaacaacgcgggcgttgggttgctgaacgccttggaaggactgtcaatggagtccgcccgggaggtgttcgagacgaataccctgggcaccatcgccatgacccaggccgtgctgccgcagttccgggaacggggcgcgggggtgatcgtcaacgtaacgtcgagcgtgaccctgcggccgctgccgctgctggcggtttataccgcgagcaaggcggcggtgaacgccttcaccgagtccctcacccacgaactcgtgccattcggcgtgcgcgcgcatctcgtcattcccggccgatcgccggagaccgcgttcgggtccaacgcacgcacccggatggggatggatgtgcccgcggcctacggcgatctggcagggcgagtctttgcgaacttccagcaggcgacggaagagctgacccgggcatcggacgtggccgaggcggtctggcgcgcggcaaccgacccggcttgcccgatgcgcctgccggccggcgctgatgcggtcgcctgggcggcggcctga

SEQ ID NO: 7376 - DNA, 930 bp, Methylobacterium sp.
atggtcgatccgctgacccaggtggttgggctacttcagcccagcgcctcgttctcaaagttggtcctggccggcggcgcctggaccgttcggcgcgacgatcacggccagccgttctatgccgcggtgttggagggggcgtgccgcctcgcgatcgacggtgaggcggacatcgtcctcgcggccggcgacttcgtgctgatccccgccgccagcgccttcgccgcctccagcctcgtcgcgccgttggcgaagcagacgccgccgcccgtcaaggtcggccccggcgtgttccgcctcggccctcccaaggtgccacccgacctgcgcatgctggtgggacactgcactttcgcctccgacgatgtggagttgcttctgtcgctcctgcctcggttcgtccatgtgcgcagcgtcgggcgactggcgatgcttctcggcctcgtgaacgaggagacgcgggcggacaggcccggccgcgatgccgtcctggcgcggctactggaagtgctgctgatcgaggcgttcaggtccaccgcgggtccgacggcaccgtcgggcctcctgcgcgggctcgccgacgagcgcgtggccgccgcgctgcgccggatgcacgagcggccgaccgctccctggacgatcgcagccctggcccgagaggcgggactgtcgcgctcgatattcttcgaacggttccggcgcgaggttggcgtcgcgccgatggcgtatctcctggcgtggcgcatcgcgctggcgaaggatctgctcggtcgcgagggtgccggcgtggcggaggtggctgagcgcgtgggctacgggtctgccagcaccttcagcaccgccttcgctcgtcatgtcggcagaccgccgatccactacgcccgcgagcagcgcggccaacgccgcagccctgcacctctgaacgcctga

SEQ ID NO: 7377 - DNA, 600 bp, Methylobacterium sp.
atgatcgacgaagtgcctccgaaaacgcatgcgccttcacggagcaggacggtcgagtgggccgatccacgcaccatcgccgcggcaggacaggatcttgcgggcatcgacttcctacgcgcgctgctggcaggggagattccgccgcctcctgcgatccagctgctcggcatcgagttcgtctcggtcgatccgggtacggcctgcatgcgcatgcaggccggagagtatctcttcaacccgctggggtccgtccatggcgggtccctcgccacgctcctcgatagcgtcatggggtgtgccgtgcattccacgttgccgttcgggcgcggctacacgacgcttgagttcaagatgaatttcatgcgcgcggcgaccgggaggtccggtctgctgaccgcctcaggacaggtcatccactccgggcggcagcaagccgtggccgaaggccgtcttagcgacgagtccggccgcctcgtcgcgaccgcgagtacgacctgtctcgtgttcgatctgcccggggccgtgaaacagagacggccggctgaccgagcaaaagctttgacgcccacagtccacgcgcgcgaattccaccgatga

SEQ ID NO: 7378 - DNA, 426 bp, Methylobacterium sp.
atgggctcgacggttaacatcctgctggtcgacgacgacgaggtcgacgtccaggggctcaagcgcgccttcaagaagagcaagatcggcaatccgatcaccgtcgcccgcgacggcatcgaggccctggagatcctgcgcggcgagaacggacgtgagcggctgccgaagccgcacctgatcctgctcgacctgaacatgccgcgcatgaacggcatcgagttcctggaggcggtgcgcgccgacgaggacctgcgctcggcggtggtgttcatgatcaccacgtcgaaggcggacgaggaccggatgcgcgcctacgggcacaacgtggccggctacatcgtcaagcgcgatccggccaacaccttcatggaggcggtggcgttgctggagcactactggaaggtcgtcgagtttcctgcatag

SEQ ID NO: 7379 - DNA, 1053 bp, Methylobacterium sp.
atgacggcctcacccgccctgaaggatccgcgccgctacttcgaggcgatcggcgccgaccgcgcctccgaggccgtagcgccgccggtctgcctctatttggaggtcacgaaccgctgcaacctgctgtgcgagacctgcccgcgcaccttcgagaccctggaacccccggccgacatgagctgggatctgttcacgcggatcgtcgaccaggtgccgaacgtcgctcgggtcgtgctccacggggtcggcgagccgatgctggtgaaggacctgccgcggatggtccgctacctgaaggaccgcggcacctacgtcctgttcaacaccaacggcaccctgatgcagccgaagcgcttccgggagctgatcgataccgggctcgacgagctgcgcgtctccctcgacgctgccgaccgggcctcgtaccgcagggtgcgcggcaaggatttcttcgaccggatcgtgcgcgacgtcggcaggttcgtcgcgttccagaaggcgtccggcgccacgacgccccgggtctcgctctggttgacgggcctcaaggagaccgtggaccagctcccggccttcgtccgactcgcggccgagatgggcgtgaccgaggtgcacctgcagcgcctcgtcttcgacgaggccgggtacggcatggcacgcgccgacctgtcgctgttcgagagcgcgctgaccgaggaagctgcggcgatcgcggaggccgaggctctgggccgcgcgctgggtgtgacgctcgacgcctcgggcgcgaccgagcccgggatcagcctgaagcggcaggaggaccgtgcctgggccacctgccggcgaccctggtccctgatgtacgtcaccgcccacggacgggcgctgccctgctgcatcgcgcccttctcgatgcgcggctacgccaactacacgctgggcgacgcgacgcagtccacgctccgggagatctggaacggcgcggcctatcgcgatttccgctccgaactcctctccgacgcgccgccggcgccgtgccgcaactgcggcctgcgctggagcctctga

SEQ ID NO: 7380 - DNA, 915 bp, Methylobacterium sp.
gtgacctatccggagcgcgtgcgcatcgtcgaggtcggcccgcgggacgggctgcagaacgagccgaccaccatacccacggctgccaaggtcgcgctgatcgaggcgctggccgatgccggcctgaccagcatcgaggccggaagcttcgtgtcgccccgatgggtgccccagatggccgacaccgcggcggtgctggcgcagcttcggccccggccgggaatccgctacccggtgctggtgcccaatctccagggcctggagcgcgcgcgcgcctgcggggtccgtgaggtcgccgtcttcgccgccgcctcggagagcttttcccgccgcaacatcaattgctcgatcgcggagagcctcgagcgcttcgccccggtcgtcgagacggcgcgggccgccggcctccgggtccgcggctacgtttcctgcgtgctgggctgcccgtacgagggggcggtcgcggcggcggccgtcgcgcaggtcgccgaggctcttctgggcctgggctgctacgagatctcgctcggcgacacgatcggcaccgggaccccgctggccgcgcggcggctggtggagggcgtcgcggcggccgtgccgctggaacggatcgccctgcatttccacgacacctacggccaggcgctggcgaacctcctcgcctgcctcgatctgggcgtgtccgtgatcgacagcgcggtggcgggcctcggcggctgtccctatgcgcggggcgccaccggcaacgtcgccacggaagacgtcgcctacatgctccgcggcatggggatcgagaccggcatcgacttggaagccctggtcgatgcggggctctcgatcacccgtcacctgaaccgggagccggcgtcgaaggccgcgcgcgccatcctgtcccggcggcaggccgcgtcctga

SEQ ID NO: 7381 - DNA, 624 bp, Methylobacterium sp.
atgatcgtccgcggcgtgctgccggcgggcgcacccctggtcgagaaggacctctcgatcgcgcttggggtttcccgcacgccgttgcgggaagccctcaagctcctggcggcagagggtctggtcgagctgcatcagaaccggagcgcgcgcgttccggactgggagccggaagaggtcctcgaactgttcgaggcattggcgggcatcgagcggctgaccgcggaactcgccgcgactcggatctccgacgccctcttggacgaactgcgcgagaagcaggcgcagctcgattgcatgcaccgggacaaggtgctcgacgcttatttcgccctcaaccaagagatccaccggacgatcgtgaccgctgcttacaaccggccattggccgaggctcacgcgccgctccaggcccgggcccaatgggcacgcctgcgggcgctctcgactggcagccgttgggcggaatcggctcgggaacaccgcgatctgttcgcggctctcgacgcgcgcgatgccacggaagcgggcgccattgcctatcggcacgtgctgcgcaccggtgtcgtcatcgccgataccctgagagcgcagcgcgcgaaggccccatccgcaagaacgtga

SEQ ID NO: 7382 - DNA, 807 bp, Methylobacterium sp.
atgcggcgcgacttcgactggttcagtttccacgctgtcgtgctgctgctcgccgggctctgcctcatcctgctcgcggcgccgaccgtgatcgtcgtggtggtctcgttcaccagcggcttctccctgcgcttcccgccgcccggctactccctgcgctggtacgcagcgctcactgaggcggagcagcttcgggccgccgcctggaacagcctcgtggtggcggggtggacgaccctgctgtcggtggtgctgggcaccgccgccgcgcttgccatcgcccggtcgccgcggctctcagcgcggctcctcgacagcctgttcctgtcaccgctcgtcctgccggccctggccttcgggctcgccgccctgatgctgttcagcctcgccggcatcccggtctcgccgttgaccctcgtcctcggccacaccgtggtctgcgtgcccttcgtggtccgcaccaccgtggcggccctgtcacagatggacttggtgctgctcgagagctcgacctctctaggcgcgtcacgcctgtacacgttccgccgggtgacccttccgctgatccggcccggcatcctcgccggcggcttcatcgccttcatggcgagcttcgacaacgtcccggtctcgctgttcctgcgcgacgcggccaccgacatgctgccgatccggatgtggcaagatctggaggggcgcctcgacgtcacggtggcggcggcttccagcctgctgatcctggtcaccgtggtgctggcggtcgttatggaacgggccgccggcctgtcccgccggttggccggctaa

SEQ ID NO: 7383 - DNA, 906 bp, Methylobacterium sp.
gtgaccgcggtcttcgcgccgatggcgcctgacccggtcgcggcgccgggccgcccgggccgtccctggatggcggcctacgacatccgcctcgcgctgccgcttggggcgttcttcctcgttttcttcctggcgccgttggcgctcttggtgctggtaagcttctacgccgatccagtcatgacccgcttcggcctcgaccaatacgcccggttcctgctcgacccgttctccctgcgggtgctgggcgcgaccctgtggctcggcgtcgaggtcacggcgctcacgctgctgctcggtctgccgctggcactgctcctcacctgggcgcccgcccggctgcgcggcctgctgaccttgatcgtgctgctgccgctgcttacgagcgtggtggtgcggaccttcgcgtggatcgtgatcctcgggcgtcagggcatcgtcaacgcgagcctcctggccctcgggctgaccgacacaccactgaagctgctctacaccgagggcggcctcgtccttgcgctggcgcaggtgcagatgcccctgatggtcctgccgctggtgactgccctgtcacggatcgacccgaacctcgccgacgcctcggcggcgctcggggcgggggcgtggcgcaccttcctccgggtgacggtcccgctctgcttgcccggcatcgtggccggctgcctgctcacctacgcggcggcgatcaccgccttcatcacccagtcgctgatcggcggcgggcagatgctgttcatgccgatgtacctgtaccagcaggcctcgtcgctcaacaattggccgttcgcggcggcgatcgcgatcgtcttcctcgtggcggtgctggcctgcgtgaccgtcttcaacctcgtgggccgcctgtcgcgcggctacgcgcaagcctga

SEQ ID NO: 7384 - DNA, 1044 bp, Methylobacterium sp.
atgatcctgcaccgccgcagcctcctcgccggcgccttaactctcggcgcgacgcaggccttacccggcctgtcccacgcccaggcccgcaagctcgtcttcgcgaccttcacgggcagctgggaagaggcccaccgggcggtgctggtcccggccttccgcaagagcacgggcggcgacatcatcctcgatccgatgctttcggtcgatcagatcgccaaggtccaagctgcccgcaccaacccgccgatcgacgtgatgctgcacgatcccggtcccgcactcacggcgatcgcccagggcctcgtcgagccctatccggtggcccagtccgcccactatgccgacctgatcgcggatgcgcaggagccgatgggcccggccccgtttttccagattgttgggctgacctacaatcctgagaaggtgaagacgccgccgacctcttgggccgatctgtggaaacccgaatacaagggccgggtcggcatcactaacctgaactcgacgctcggcaccggcttcctcgtggagatcgcccggatgcacgggggctcagagaccaatgtcgagccaggcttcaaggcgctggaagcgctcaaacccaacctcgccgccgtcgccgccaatcccggtgccctggcggcgctgtaccagcaggagcaagtcgatatcgggcctggcaatttcaacgctatccagatcctgaaagcccgcggcgtgccggtggagttcgccgcgccgaaggagggcatcatcgccttcaagacgacgatccacatcgtcaagaacacccccgtgaaggatctggccttcaggctgatcgaggccgccctctcgccggaggtgcaggccaagctgatgcagagcccctatctgatcgtcccgaccaaccggaaagtggcgatggacggcgaggtcgcgaaggttctggccaaggacgccgaagatctgaagcgcaaggcggtgttccaggattgggccgcgatcaaccacagccgcgcagcctggatcgagcgcttcaatcgggagatccgggtgtga

SEQ ID NO: 7385 - DNA, 294 bp, Methylobacterium sp.
atgagcgaacgcatcggatcttcttttgagagcttcctcaacgaaacgggaagcaaggaagacatctacgcggcggcaaccaagcgtgttctggcatggcagatcgagcaggccatggaagcgcagaacatgtccaaaacgcagatggcgaagaagatgaaaaccagccgtagccagctcgaccggctgctcgatccaacaaatatggctgttcagattgataccatccaaaaagcggcagaggctgttggacgaaagctggtgatcgagctgcgcgaaccagcgccggtctaa

SEQ ID NO: 7386 - DNA, 1776 bp, Methylobacterium sp.
ttggatcactgccggcagatcggggcatccatcgatgccgaacatcacatctacatagaccgcaaccgctccggcagaaccacgtccggacggctctccctgcacgcactgctggccgcggcccgagaccggcttttccacatcctgatcgtgcagggtttggaacgtttgacgcgcagcatgaccgatgcagtcgcgattcaggccgaactcgaaggtctgggcatcgccatacacatcgccggccggggacctgtttccgccagtgagatccttctgagttcctttcagcaccagaaggaactcgatgcactcgtcgagaggatcaacgacggtcgtcggcgaacagcccgtagcggctccatgatcgggaaacgggtgccttacggctatgatcggcttgccgacgggtcgggattgatcgtcaacaccgaacaggcttcggtgatccgcaggtgcttcgagagcatcgatggcggcgtcagtcgatcccaactcgtcaggaccctcaaagacgaattcgtcctcggtcccggtggtcggccgtggcaattcgaacaattctacaagccggatggatacggtcggcttcaggatccgatctataaaggcgtctggacctgggcgcgggggaccagcaaccccgtcaccgtcgaggtcccgcatctcgccatcgtcgacgggggattgttcgaccgggtgaacgccaagttgcgggcttccaaaggtagatcctggaagaccggcatcaaagcggggctcctgaccggtctcgtgagatgcatgtgcggaagaccgatggtgcggggcacgaaccacatcctctgttctcggcgcccgcacatggatctctgcagggcaggaacgacgatccgattgatcgatgcggagcggcaatattatcggtttctgctcgacgaggttctggatccgacgcgcttcgccgattggcaggccgtccgggcagccaatttctcggagatgcagcaagccgcagctcgcgagagcgcacgcatgaaggggcggctcgacgagataaccgtcgagttgaacgcgttcgacgatgatgtcggggacgatcagatcttgtcggccattgccggaccgctcgaggtcgagttccacgatctatgggagcggcgggagcggctgagctcgctgcaggctctgcggatcgatcgggcggaagccgacgaattgcggtccatgatctcccggatgatcctcagggtaccgtataagccgaccgatccgcaggagatcgcggctgtcgcgcgcatgcacgaactcgttccgcggatcgtcgtggagagacgcggcgaaggaatcgtgctgcggttcctcctcggcgtcctcgttgcggggacggagaagcagttgccgcaggccggatccgacaggtggatcgaacgcccttgtccgaaatcgcgacgaggcgcgatgcgacgaccggaagccatcgttcggcatcaccgggatgcggaggcaggacgtttcgccttcacggatcgcgagtgggcgaccgttgccgacctcttcgaaccgaccggtagggtgaacggcggccatcggctctacgccgaggcgatgatcttcgtcgcccggaccggggtgccggcagacatgctgcccgaacgctacgccagatcgcgcctggacatggccccgatccggaagatgggcatctggccacgcctgctcgccgcattggacgctttgggttccgacctcgttcgcgacatcgaccgggaccgcttcgcggcgcgccatcgataa

SEQ ID NO: 7387 - DNA, 1431 bp, Methylobacterium sp.
atggcccagcagcattaccgggaccagatcgcctttgacgaggagatgcgccaggcggacagccgatatgcgcagggcttcgtggacgagttctacgtcgacgatctcaaacgtgccgtctccggcgccgcgagcaacgaggagttgcgagctgtcctgggtcgcatcgtggaccgattccaccaacacgggcacacgacggcccagcccggcgacaccgaatttcgcaaagttgcgatggcgcttgcggtcgcggaattggagagcctgaaggtatcggcggcgcgcgatgagggcgactcggttgcagctacagcgcacccgcttctcatcaaggaacagcccgagctcggccgcgccctgacatcccagaggatcctggggccacaaagcacgcaaccgctctcagagctcatacctatgctggcggaagagaaaggcgcccgcccgggtacgatcaacgagtataaagttgcagcacgaatgttcgaagagtttatgggcgagcctcgtgccgcatatgcgattacccggcaagatgtcattggctacaagcgcgctctgatggagactcccgcaaactacactaagaggtttccgaacaaaacgctcactgaggcgatcaagctcaacaaatctcgcgcagcaccgttccccgcgctgagctcgaaaacgatcaatgacaagtggctcacgcatttgcgggcaatattaaactggtgcgtcagaaacgatgtgatccctgatagccccgcctctggcgtgaaagtggagcaagtaaaggccacgtccgcggcacgccttcatttctcgccgggtgacctgtcgaaaattttcgcgccgccactcttcggttcggcaaaggactacggcgagcgtcagtggatgttgctgaccgcgctcttcactggcttccgagcaagtgaaattgcgcaactccggcttgatagcatccggcacgagcgtcgtgtcctggttttcgcagtggaggaggagacgaagaatcaagcctccaagcgactgacgccggtgcatagcacgctcctacgtctcggcctggaaggccgggtggcgaagcttcgcgcagctggggagacacacctattcccagagtggttcaaggctgcccaatctatgcttacggccgaggatggccgcgacgtgaaccagccgtactcgcagtttctcccgcgctggttcaaccgcacttacctaccaaaggtaggtatccacgatgaacgcaaggtgtttcacagcttccgacacacgctcaagactgccatcgctagagccggcgtgccacgctcggttagcgatgagattactgggcacgacgacagaacatctggcgcaaggtatgttcatgaaacctcgattgaagtcatgaaggaggccctcgaaaagattcattttgatgggttcaacttgtaa

SEQ ID NO: 7388 - DNA, 870 bp, Methylobacterium sp.
atgttcgcctgggacgacgtgaggttcttcttggcgtttgcggaaagcggcaccctttccggagccgcccgcatgctgaaggtcgaccacgtcaccgtcgcccgacgtgtcaccgggctcgaacaatccctgggcgagactctcgtcgatcgcgtctccaaacgttggagcatgaccgatgcaggccgcgagatcgccgatctggccttggccatgcagtcccaggcctatgccctcgagcgcgcggtgcgggcccgcaaggtcggatcgtcggcagtggtgaccgtgagcgcacctcctactctcgccagcaccttccttgcaccacgcttcgcggaattgcgcgcccggcaccccgagctcgagctgtcccttctgggcacccccgcgacggtgtcgctgagccgccaggaagccgacgtcgccgtccgcctcgcgcagccgacggagatgagcagcgtcgcccgcaggatcggacgaatcgcctacggcttctatgccgctcccggatatgtgcagatccctccagagcaatgggagttcatcgcctacgacgggtcgctcgaccacgtcccccaacaggaatggcttcgcgccttcgcgggcgggcgccgcgtcgtgttctcaagcaacgatctgacgagtcagctcgccgccgcgcggcaaggcgtgggcatcgcggctctgccgagctttctcgccgcgccggacgcgggagtggttccggttccggccgaaacggcacctctggcacgcgacatatacctcgtcgtgcacgccgatctgcgacgcaaccacgccatccggatcgtcatgaacttcatttccgagcagatcgggtccgctcttccgccggacgcggggcgatga

SEQ ID NO: 7389 - DNA, 873 bp, Methylobacterium sp.
gtgggtgccgcgatggaatggagtgacgtcaaaatctttctcgctatcgcgcgatccgggacattcggcggcgccgcgcgttttcttcagacaagccacccgaccgtcggcaggcgtctgcgcgcgctcgagcaggctatcggtcacacgctcttccaacggactacggacggccttgtcctgaccgaagagggccacgggatcatcgcgctggcggagcagatggaagaaggcgcgcttgcgatggagcgccggcttgcggggcaggagcagaacctaaagggaagtctgcgcatctcatcagcggactggtttggggcctatgtcctgcctcccatcgtggcggatttctcgaaggcctaccccaatgtcgacgtcgaaatcctgaccggcacgcgcctgtttaacctcgcccagcgggaggctgacgtcgcttttcgtatcgttccgtttaacactgccgatgtcgttcagcggcggctcttcaggctcgaatacggcgtctacatcgctgaggaggcccttgatcccaaatacggcgatgggactggtttccggctgatcacccatgaaacatccacaggtcacttccctgacatcacgtggctcattgagagtttccccaacgcgagaccggtcctacgatcgaataaccgcaacgtccaagggcgcatgtgcaagcaaggcgtcggcatcgcggtcctgcctcgcgcagtcggcaatcagatcccgggcatccgcaggctggaaatgcccacgcagccgccagcgcgagatatctggatcggataccaccgggatttacgccgtcttcggcgtcttcgtgcgttcatctcgaccgtatcggaccatctcgtagacgcagccgtatga

SEQ ID NO: 7390 - DNA, 1608 bp, Methylobacterium sp.
atgccgacgctggacaccacgctggatctccgctccgccgaggcccggaccaacgacgcgcatatgcgcgggctggtggcggatctccgcgcgaccgcggcgcgggtccgcctcggcggcgggcagacggcgcgcgagcggcacctgtcgcgcggcaagctgctgccgcgggatcgcatcgcggccctgatcgaccccttctcgccgttcctcgaagtcggccagctcgccgcgcacggcctgtacgggggcgagattcccgcggccgggatcatcaccgggatcggccgggtcagcgggcgcgagtgcatgatcgtcgccaacgacgccaccgtgaagggcgggacctattttccgctgacggtgcagaagcacctgcgcgcgcaggagatcgcgcagcagaaccggctgccctgcctctacctggtcgatagcggcggcgccaacctgcccaaccaggacgaggtcttccccggccgcgaccatttcggacggatcttcttcaaccaggccaccatgtcggccgaggggatcgcgcagatcgccgtggtgatgggctcctgcaccgccggcggcgcctacgtgccggcgatgtgcgacgagtcgatcatcgtgcgcaatcagggcacgatcttcctcgccgggccgcccctggtgaaggccgccaccggcgaggtggtcagcgccgaggatctcggcggcgcggacgtccacagccgaacctcgggggtcaccgaccattacgccgagaccgacgcgcatgcgctcggcatcgcccggagcatcgtcgcgagcctgaataccgtgaagcggccctcgatggcgctgcgtaagcccgtgccgccgcgctacgccgcggaggagctctacgcggtcgtgccgtcgaacctgcgcacgccctacgacgtgcgcgaggtcatcgcccggctggtggacgacagcgcgttcgacgagttcaagcggctctacggccagaccctggtctgcggcttcgcgcatgtctggggctacccggtgggcatcgtcgccaataacggcatcctgttctcggagagcgcgcagaagggcgcgcacttcatccagctctgcgcgcagcgcggcatccccctggtgttcctccagaacatcaccggcttcatggtgggcaagcggtacgaggccggcggcatcgccaaggacggcgccaagatggtcaccgccgtcgccacggccgcggtgccgaagttcacgatcatcatcggcggcagtttcggggccggcaattacggcatgtgcggccgcgcctacgcgccgcgcttcctgtggatgtggccgaacgcccgcatcggcgtgatgggcggcgagcaggcggcctcggtcctggccacggtgcggcgggacggcatcgagggccgcggcgagagctggtcgcaagaggatgaggaggccttcaaggcgccgatccgcgaccagtacgagcggcagggccacccgtattattcgagcgcccggctctgggacgacggcgtgatcgatccagccgacacgcggcgcgtgctggcgctgggcctctccgccagcctgaacgcgccgatcgcccagacccgcttcggcctgttccggatgtga

SEQ ID NO: 7391 - DNA, 615 bp, Methylobacterium sp.
atgagtcgcatcgctggacccaaggggctgcgcaccgccgcggcgatccggcgtgccgggttgaagctcatttatcgccacggcttcggcgccatgagcctgcgcgacctggcatccgaggtggggatacaggcgtcgtcgctctacaaccacatccgcaccaaacaggatctcctgttcgatctcatccgcgagcacatggaggccctgctggcgcagaccgatgcggccctcgcggcggcgcccgacacggccaccgaccgcctccgcaccttcatccgccatcacatcgtctaccacctcgagaagaagcaggacgtcttcatcgccaatttcgagctgcgctccctggatacgccgcattacgcgacgatcgtcgccatgcggcgcgcctatgaggggaagctgatggcggtgctcgatgccggcgtcgccacgggcgagttcgacatccacgacacgcggatcaccgcctatagcatcctcgcgatgctgactggggtgtgtacgtggtacaagcccgagggaagactatccaaagccgagatcgtcgatcttcacaccaggatggtgctgcacggctgcatcgcgcaacgcgagcacgccctcccctga

SEQ ID NO: 7392 - DNA, 333 bp, Methylobacterium sp.
atgacgggcctgtccatccacgccgtcgatgccgcaaccggccggccggccgaaggcctgcgcgtgcgcgttctgaccgtgggcgcgcgcagtgcggtgatcgcggagggcgagatcggggccgatggcacgctcgcgcatccaatcgtgcgaacgcggctcgtcgccggtctctatgaggtcgcgttcgacatcggagatttcctcggggaggctggcgacggtttcctggatatggcgtcgatccgcttccggatcaccgatcccgctagtcattgccatttgcccctgaagttcaccgcgttcggcatagctttgttccgcggctgctga

SEQ ID NO: 7393 - DNA, 189 bp, Methylobacterium sp.
atggtgctcgtcgattcccgtgatctgatccgcatgctcgaggcggatggctggatctggcattcaaccaccgggagccatcggcatttcaagcacccggtgaagcccggcaagatcacgatccctcacccgaagaaggatatgcatcccaagacggtgagatccatcctccgggctgccggcctgtga

SEQ ID NO: 7394 - DNA, 705 bp, Methylobacterium sp.
atgggcggcagctcggccaacatcgaggcgctcctcgtcgacggcaacgacccggacaacccgacgccggggcagctgccggcgatcttccgcgacatcgtcggacgcctcgacgcgggcggttacacctatgccgtgctcggccacgtcgcgctggcgctgcacgagcggccgcggttcgtgcgcgcgatcgagattgtcgcggacctcgacgcggacgggcgcgagcgtggcgcggaactcgaacgggcgacgcgggcgcgatttgcagcccacctggacccgagcctgtgcgcgaagccgatcagcctgatgctgcggccctgcgtgtgcccgcttgaggcggggctgctctcaggggcgatcacctgcccatggtttggcgtcccagcgcggctggcgagcgcggagcacctgctttggctctggtgccgctccgacgcaatcaagcaccacgtggacgccgccgcactgatcgcgggcggcaccgtcgacctctaccgcgtgcaaggcctgctgcgcgagacggacgaccttgcggagacggggcagacgcgactgcggctggcgatcggcgatgcggtcctgtcgacgacgtcctcgttcagccggtacatggacgaacggcgcgctcggctcgacccgagatacgtgccggtctggcgccgagtcctcgaagattgcgacgaggcaaagccgcgctga

SEQ ID NO: 7395 - DNA, 912 bp, Methylobacterium sp.
atggataagcttgatgcgatgcggacgttcgtgcgcgtcgtagagaacgggagcttctcgcaagcggcgcgcgacctgggtgtcggccagcccaaggtcagtaagcagctcgccgcccttgaggcgcacctcggcatgcagctcctcgcgcggaactcccgtactcttgccgtgacgcctgcagggcaggactactacgaggcgacggtccgcatcctccaggatctcgacgccgtcgaggaaaggctcgtcgaagggcagtcggccccctccgggctggtgcgcgtgaccctctcgccggccttcgggaggatgctcgtcatcccccggctgccggacttcagggaccgtttcccggacgtcgcggtcgagatggaggtctccgggaggcacgtcgacctgatcgaagagggcatcgacgtcgcgatacgtatcggccggctctcggactccgcgctcgtggcccgccgcatcggcgacatgcggatgatcaccctggcctccgccgcttacctcgcccggcacggctcgccgcggacgctggacgacctgcgcgcccaccagcgcatcggctacgtccaccagggcgacctcgtcgggtggggcttcgacgtggacggccggaaagtcacggtcgagggcgggggagcgttccggacgaacgatgccgagcatgtccggggcgcggtcctcgccagcctcggcatcgcgcaccacgcgagttggctgttcacggacgccttggcctcgggcgaggtcgtccgggtcctggaccggtacgcgcccccgccgtttcccatcagcgcggtcacagcagccggacggcgcatgccctcccgggtgcggcggttcatcgaattcctggccgcgatctgcgcttccgagccggagctacgggtcggcgaggcttag

SEQ ID NO: 7396 - DNA, 1173 bp, Methylobacterium sp.
gtgacgaacccgacccgcatcctcctgatcgacgacgatgcggtcgaccgtgcggccgtccggcgggcgctcgccaagtcggggctcaagcataccctgaccgaggcgtccggcggcgaggaaggccagcgcatcgcctccgaggcgaccttcgactgcgtgctgctcgactaccggctcccgggcatcgacaccttcgcgctccttaggaccctgctggcgtccgagagcgaggcgcgggcggtgctgatgctgaccggcgaggccgacccggagctcgcgacccggctgatgcgagccggcgcgttggactacctcgacaaggccgaggtcacgccctcaggcctcgcccgggcgatacgcttcgccgaggcgcgtcgggcgttccaggacgagctcgccgccgcgcggcgcgaggcggaggcgaagtcgctcgaactcgacacgctgaacagacagaagtcgctgctgttctcgatcatcgcccacgacctgcgcaacccgttccaggctctccttggcctgtcggaggttctcgggaaagctgtcgcggcgcgcgagcccgcctccatcgagcgtcgggcgaagggtatccacgaggcggcgacgcaagcctacgccttgctggaaagcctgttctcctgggcgagcctgcagatggatacgatggcggtcaccctgaccgacgtcgacctcgatgcggtgaccaccgaggtggtgcggggcgcggcggaagccgtctcggacaaggggctgaccatcgaggtttcctgcggcgggatcatcgtccgtgcgcagcgggacatgctgaccacggtgttgcgcaacctcgtcggcaatgccgtcaagttcacgctgcccggcgggaccatttccgtcgcgggccgccaggatggggacgacgtcgagatctccgttacggataccggggtcggcatgccgccgggcaaggtcgacgacctgttccggctggacaggcggaccactacgaacggcacggcgggcgagcggggaagcgggctcggtctgctactgtgtcgcgacctcgtcgagcgacagggcgccgtgctgaccgtgacgagcgccatcgaccggggcacgaccttccggttccgtctgcctgcaccgctcgtggccagacaggttcccgcctccgcggcgtcggcttcctga

SEQ ID NO: 7397 - DNA, 633 bp, Methylobacterium sp.
atgcccccggtcgactaccatcgcaatgccctgcgcatcctcttcatcctagtgaagggcagccggtcctattcaggggagccagtcgcaggcttcgaccgcgtcttccgaggcgagaccaaagtgcaggcgctcgatttctgggtacgctatcccgactacctggccgacgagctactctcacttttcgagctgacgggcgacaggcagcacctcgacgcagcggatcggatcttcgccgacgaggagccggacctgcgcagggtgccgatgctgcgccgctacttcggcgcctacgagccgctcgacacggtgctgggtatcctcaagagccgaggtctggtgcttccgcggtcgcgccagatggagcgcggcaccgacgagcacgacttcctggtcgcgaccaaggccagcgagctcattccccgggtcgttgccgacctgcccgaactgggctggtacgaccgaagggtggacttggtgttggatgtcgccgcgggccgtggcggttacgcactcaaggagcgtcagcaccgccagaaggagtaccacgatgccgcgaccggcgacttgatcccgacgacggcagaacgggttcgcacgcggcttgaaaccttaaaggaaagggcgtga

SEQ ID NO: 7398 - DNA, 450 bp, Methylobacterium sp.
atgccgaagcgaaatgtcgagcccaaactcacgaccgcacagctacaggacctgatcaacctggcacagaagacgcgcgaatccatgtccaccatggacgggcccaatcaggcgctcatgctcctgcgcacattcaacatggcagaccgcgtctacggtctctggccggactcgtcacgtccgtgcggatacgcctacaagatcatgaagggtgaactcggcagcgctgccatgaagagggtcgcaaggaatgccgagatctccgtcgcgggggtcttccaggagagtgaggaccacgccgaactcacgcgggagatctacgtcgggctcgaaacgagtggcgatgcctacccagagacgtacgcgcaggccttcaatttctggatggacatcgtgcctgcccatttcgaggacacgaaggcgcgcatccgagtccacatcctcggctga

SEQ ID NO: 7399 - DNA, 459 bp, Methylobacterium sp.
gtgtgccttgccagggctggtggcatcctcctcgaaggagccaccgacatgttcgacgagacaagctacatgctggccggcctgatcgagcagatgcccgaggagattcaccttgaccccgagcccgtgcgcgcgcccgagaccgggtcggcgcgcaccgcgcgtgagcgcagggaggcggctgagcgcaagcggagggagcgtgcgcggcgcaaggctgagggcatgccggaccccgccctcgtcgaccgcgccatcgcgacggccgtcggggatctatcccggcgcggggacatgcgggcccgtgtgaaggaccggaagagcttcgtcggcctctcctatggtctcaccgatgtcgtcgggcaggccatggaggaactcgtcgagcgccggggcgtcgggcagcctcaggccaaggccgccctcatggcccgcctcgggctgacccggcagggctga

SEQ ID NO: 7400 - DNA, 717 bp, Methylobacterium sp.
atgtcccgaacctttctcgtgaccggtgccagcaagggcatcgggctggcgctggcccaccgtctcgccggcgacggccaccacgtcgtcggccttgcgcgcggaggcctcgacgacttccccggcacgctcgtgccggtcgacctcgccgacggcgacgccactgacgcggttctcgcggacctgaccggacgcttcgccttcgacggcgtggtcaacaatgtcggattggtccggccgcagcggctcgaggcggtcgagatccccgcgctggacgaggtcctgcacgtcaacctccacccggcgcttcaggccgtacaggcaaccctgccgggcatgcgccggcgcggctggggccgggtcgtcaacatcgccagcctgaccgtcctcggcagcgtcgagcgcacggcttacgcggccgcgaaggcggcgctggtcagcttcacccgctcctgggcactcgaactcgcaaccaccgggattaccgtcaacgcggtggcgcccggaccgacggagaccgagctgttccgggccaacaacccgccgggcagcccgggcgagatgcgctacctcgccggggtgccgatgggccgcttcggacggccggaggagatcgcggcagccatcgcgttcctgatgtcggacggggcggcgttcatgacggggcagacgctctacgtcgacggcggtgcctcaatcggccgggcggcgctgtag

SEQ ID NO: 7401 - DNA, 273 bp, Methylobacterium sp.
atggcgcgtctggccgagaagcgtcccgcgcggccgggtcccgtccgcccgggtgatgccgggcgcaacgccgcctccgcgcgggcccggcgttacgtcctcgcgctgcagccgctgatcgagacgatcgcgcgggagaccgggagaacggcgcaagggatcgcgtcggagatgacgcgccgggatatcggcaagccccgcggcggaacgatctggacgccggccgacgtgcgccggctcctgcgccgtctcggctcggacgtcgcgcgttga

SEQ ID NO: 7402 - DNA, 579 bp, Methylobacterium sp.
atggccagggtctcgcgggaacaggcgcgcctcaatcgcgaacgggtcgtggaggtcgcctcgagactgtttcgcgaacgcggctaccaaggcatcgggatcgccgatctcatggcggaagcgggcctcacgcatggcggcttctacaacaacttcacctcgaaggatgcgctcgcgggcgaggcttgcgcgtacgcgttcggagacaccgacttcgatctcgccgtttcagctggaaagcaggagccgggatcgctcgcggccctggtggatgcctacctgtcgccgtcccatcgcgcccgaccgggaaccgggtgcccgctgccggcactcgcggccgatgcagctcgcgagccccaggggagcccgctgcgccacagcttcacagcaggcttgacggccatggtcgaccgtgtcgcggcagtccttccgacggcgacgaaagcccgccggcgcaagcgcgcgctcggctcgatcgcgacgctggtaggagcgatcgctctcgccagggcggtcgacgacgatgatctggcggacgagatcttggaggcggcacgcgctgcagccataccgggctga

SEQ ID NO: 7403 - DNA, 933 bp, Methylobacterium sp.
atgagaacgacgacttggctgatcctgacgatgcttttcggcggctcaccggccctcgcgcaggagccgctgccgacggggcggatgaccaagcccgatgtcagccccgagcaggctacggtccgcaagctcaacgcgtatgtcagcctcctcaaccggaccctgcgggcgcaggagtcgctcgatcgctaccggagtcgggtcaacatgaagaccggcccaaccggccgcgagcgcatcatctacggtctctacggactctacgacgtgcgcggtgagatcgtgaaggcggaagccgcgatggcacaaccgcccgcgatgccggatctcgacggcgtcatgaagagctatatcgccgcctaccaagtgctcgccccgacgatcaccgaggcggacagctactacgagcggcaggattatcgcacggataagatggagcagggcagggcgctccatgccaagctcgcggtcgcggggccggccttcttggctgagcgcgccaaggtggatgcattgtttcgcgttgagaaggagaagagcgacgcggctgaactcgccgcgatcgaggctcgggaaggccgctcagcgcgctggcacgccgcgaacgtgatgaccgaggcgcgcaaggtcatggacctgctccccaccgacgccaagccggtcgtggccatgccggccttcgaagctgcgctcgggcgctacgcggccgctgtcaaagacatggacggatatagcgccgccaacccgaacgccttccacgtgttcgagagccagccgcgctcgctcctgggcaaattgcgcgaattcgatgccaagctggtcaaagccaagggcgacgcccgccggggcgccgggcgcgacgtgacctggatcgtcaacgactacaacatgatggtttcgaccgcccagacggccaccgccttttcacgatga

SEQ ID NO: 7404 - DNA, 2031 bp, Methylobacterium sp.
atgttccgcaagatcctcgtcgccaaccggggggagatcgcctgccgggtgatcgacaccgcccggcggctcggcatcgccacggtggccgtctattccgaggcggatgccggggcccggcacacgcggctcgccgacgaggcctggccgatcggtccggccccggcgcgccagagctatctggtggccgacaccatcctcgacgctgcccggcgctccggcgctgaggcgatccatcccggctacggcttcctgtccgagaacgccgcgttcgcgcaagcctgcgccgaggccggcctcgtcttcatcgggccgcccccggccgcgatccgggccatgggttccaaggccgaatccaaggccctgatggagcgggccggcgtgccgctggtgcccggctaccacggcgaagcgcaggacatcccggtgctgcgcgaggctgcggcgcggatcggctacccggtgctgatcaaggcctcggccggcggcggcggcaagggcatgcgcatcgtcgcgtcggcggacgacatcgcggccgcgatcgagggggccaagcgcgaggcggcggcctccttcggcgacgaccggatgctgatcgagaagtacctcacccgcccccggcatatcgagatccaggtcttcgccgacacccagggccggaccgtctcgctgttcgagcgcgactgctcgatccagcggcggcaccagaaggtcctggaggaggcgccagccccgggcatggaccctttgcgccgcaagcagatgggcgaggccgccgtcgccgcggcccgggcggtcggttacgtcggcgccggaacggtggagttcatcgcggagggcgacgccttctacttcatggagatgaacacccgcctgcaggtcgagcatcccgtcaccgagatggtcacggggctggatctggtcgagtggcagctgcgcgtggcggcgggcgagccgctgcccctcggggaagaccgccttgccctgcgcggccacgccatcgaggcgcgcatctacgccgaggacccggaccgggatttcctgcccgccgtcggcacgctcgtccatctgcgccagccgcaggacgtgcccggccgggtgcgggtggataccgggatcgtgcagggggaccagatcaccgcgcattacgatccgatgatcgccaagctgatcgtctggggcgaggatcgcccggccgctctccggcgcctgggcgcggccctggccgaatacgcggtggtcggcgtcacgaccaatctcggcctgctgcgagccatcgccggccacgacgccttcgcggccggggagctggataccggcttcatcgcgcgccacgcgcccgacctcctcgggggagcttcggccggcccggattccgacggttcggagaccgccgctctggcggccgcggccctgtcggtggtgagcgaccgggcggcggagaatgccggacaggcacaggccaccggtgatccgtggtccccctgggccgcggtggatgcctggcggatgaacggggaggccgctcaggacctgcgcttccgccaggatgacgcgcccgcgatcaccctgcgcgtccatccgctggccgacgggtcttaccgtctcgcctggccgggccgctccgtgcaggcggcgttgacggccgacgcggcggggccgcttctggcgatcgacggcgtgtcgcggcggttgcgggtggtctggcacggcgcggaatgcacggtgatcctggcggggcggaaccacaccttcgtccgcgaggatccgctggcgccaccccggaccgaagcggccggcagcgatcgcgtgacggccccggttccgggccgcgtgacccacgtgctggtgcggccgggcgatgtcgtggagaggaacgcgccgctggtgatcgtcgaggcgatgaagatggagatcaccctgcgggcaccgcagcggggcaccgtcgcgcaggttcgtcacgccgtggacgacatggtcgaggagggaacggagctcgtcaccttcgcggccggggagccggggccgtga

SEQ ID NO: 7405 - DNA, 1593 bp, Methylobacterium sp.
atgaagcgacggacgctgttgcagggtgcgggcgccgtggtcgccaacgcggttgcggctccagccctggtccgggcggctaccgcctcgaccctgcgcttcatcccgcagcaggacctcgtgaccctcgatccggtcacgaccttcgcgtacatcacccgcaaccatggctacatggtcttcgacacgctctacggcatggacgcctctttccgcgccacgccccagatggtcgatggccatcgtgtcgaggcggatgggcgccgctgggatctgaccctgcgcgacggcctcctcttccacgacggaacccgtgtgctcgcccgcgactgcgtggcctccctgcggcgctgggccaagcgcgaccccttcggtggctcgctcctggaggcgacggacgagttgtcggcgcccgatgatcggaccattcggttccacctcaagcgcccgttcccgctcctgccgatcgcgctgggcaaagcctcggtgccggtctgcgcgatgatgccggagcgcctcgccgtcacggacccgttccaacaggtgcccgaactcatcggctccgggccgttccgcttcaaggcggacgagcgggtgcccggtgaccggaccgtctacacccgcttcgagggctacgtgccccgcaaggacggcccgctcacctggacctcaggtccaaaggtcgctcactacgaccgagtcgagtggcgcgtcatcggcgacacctccacggcgacctccgcgctgatcgccggcgaggccgactggcaggaatacgcctcgcacgaccaactgggtctgctgaaagcggccaagggcgtgagcacccgcgtactcgattcgaccggcttcgtgacgatgctgcgggtcaaccacttgcagccgcccttcaacaacccggccatccggcgggcgctctggggggcgatcgaccagacctcctgcatgcagggcgtcgtgggcgccgacgatcccggcctgttccacgtgccgctcggcttcttctgtcccgacacgccgatggcctcgacggacgggctcgcgccgctcacgacgccacgcgatccggcacaggtgcgcgccgacctcaaggctgccggctatgccggcgagaccgtgctgctgatggtgccttcgaactcggcgccgctcctggcactcggccaagtcgccgccgacctgctgcaacgcgtcggcatgaatgtcgaggtctacgcggtcgagttcaacgcgatgctgcagcggcgcaaccgcaaggggccggtctccgagggcggctggagcgccttcgtcacgaactggtccggtacggattggctcaatcccgccggctacatcgccctgcggggaaccggcgagaccggctatgccggctgggccacgacgccgcggatcgaagccctgcgcgaggcgtggttcacggccccggacgaggcggcgcgcgccgccctctgccgggacatccagctccaggccatggaggacgtgccctactatccccttggccagtacctgcagccgaccgcctatcgctccggcctcaccgggatcctcgacgggtttccgactttctggaacgtgcggcccgcctga

SEQ ID NO: 7406 - DNA, 693 bp, Methylobacterium sp.
atggccaaggcgccgcgcagcggccgctccaagacgcggctgtgcccgccgctgacgcccgaccaggccgcactcctgagcggtgccttcctgcgcgacacgaccgccaacatcctggaggcggcccgctccgcgccgatcgccgcctacgcggcctacgcgccgcgcggcgccgaggcgctggtcagcccccatctggtcatcggaacacagctcgtcccggcggacggcgacatcccggccccggcggcagtcgagggtttcggccgctgcctgctgcaggccgtcggaggcatgctcgcggagggccatgcagcggcttgcgtcctcagcgccgacatcccgacgctgccgacgcgcctcctcgtccaggccgcccggatcctgctggcgccgggggacagggccgtgctcggcgcctgcgacgacggcggctactacatcctcggcctcaagcaggcccatgcccgcctcttcgccgacatcgcctggagcaccgataccgtcgcggccacgacccgcgcccgggcgcacgagatcggcctcgccctcgtcgaactggacccttggtacgacgtcgacgacgcggcctcgctcgcgcagctctgcgccgatacgtccggctacgcggcgccggcgacgcgcgcggtgctggcgcggctcacggagacctcggaagccgtcccggcatga

SEQ ID NO: 7407 - DNA, 699 bp, Methylobacterium sp.
atgcatccggtcagcatcgtcatcccgaccctgaacgaggccgaggcgatcggcgtggtgatccgcgagatccccccggcttacgcgggcgacatcatcgtcgccgacagcggctcgaccgacgggacgcaggctattgcccgggccgcgggcgcccgggtgatcgaggccgtgcgcggctacggccgggcctgcgcccttggggcggccgccgccgacccggcctcgcgggtgatcgtctacctcgacggggacggtgccgatcgtggcgatctgatcgaccggatcgccgggccggtgctcgccggcagccacgacctcgtcctcgcctcgcgcacccttgggagccgcgagcccggatcaatgctctggcaccaggtgctcgccggccgcctcgccggcctcggcatcggcctgcgttacggcgtccggtacaccgacatgtgcgccttccgcgccatcgaccgcgccgcgctgcggggtctcgacctgcgcgagctgacctacggctggaacatcgagatgcagatgcaggccgcgcgtgcgggcctgcgcatccgcgaggtgccgatgccctaccggcgccggctgggtggatcctcgaaggtcgcgggctcgctcggtggcacgctgcgggccgccacgcggatcggcgcgacctacctgcgcgtcgccgcagggccagtgcggggagcgtga

SEQ ID NO: 7408 - DNA, 909 bp, Methylobacterium sp.
atggcggcaggcttaggcccggtcggcgccgtcgcggcggaaacgcggccggccgaggtcgcagaggtccgccacggcacggtccgggccgacggcgtggacgtcttctatcgcgaggccggccggcccgacgccccggtgttcctgctgctgcacggcttcgcgaattcatccttctacttccgccatctcatgccgaggctcgcggaccggtttcgcctgatcgcgccggatctcccgtccttcggtttcacggtggtcccggacgaccgcggctacgtctacgacttcgcgtcgctgtcgcgaacgatcgaggccttcgtcgacgtcctcggcctccggcgctaccggctctacacgttcgactacggggctccggtgggttgggacctggcgctcgcgcatcccgaccgcatcgccggcatcgtgtcccagaacggcaacgcctatctggaggggctcggcgaggtggcctgggcgcccctcagagcctattgggaaaagccgaacgaggccgccgtggaggccctccgcgcccgcatgaccctcgacggcgtcaaggcaccctacttccacggggtgcccgacccgtcggtcattgagcccgagtcgtacacgctcgacgccgccattctggcgcgaccgggcaatgcggaccgccaagtcaagctcaagctcgactacaagcgcaacctggaacgctacccgctgatccaggccttcttccgggagcgccgcccgaagctcctcgctgtctgggggcgcaacgaccccttcttcatcccgccgggagccgaggcgttcaagcgcgatatcccggacgcacgggtccgcttcctcgacaccggccactttgcccttgaaacgaacggggacgacatcgcccgagagatccgggcctacttctga

SEQ ID NO: 7409 - DNA, 3726 bp, Methylobacterium sp.
ttgggggcggtcgcgcggatcgctgcctccgacctgttcgacgcagagtggtaccgggcgacccatgcgcccgcggtggcactggaccaagccgcacggcactacctgcaggagggcgccgcgcggggcctgagccccggccccctgttcgatgggccgtggtacctccgaagcaacgccgacgtcgccgccgcgggcttgaaccccctgctgcactatctcgacagcggccgcgcggaaggacgtccgatttgtccggtcgccgacccggaggcggtcgcgcggatcgcgggctcggagctgttcgacgcagagtggtaccgggcgacccaggcgcccgcggtggcactggaccaagccgcacggcactacctgcaggagggcgccgcgcggggcctgagccccggccccctgttcgatgggccgtggtacctccgaagcaacgccgacgtcgccgccgcgggcttgaaccccctgctgcactatctcgacagcggccgcgcggaaggacgtccgatttgtccggtcgccgacccggaggcggtcgcgcggatcgcgggctcggagctgttcgacgcagagtggtaccgggcgacccaggcgcccgcggtggcactggaccaagccgcacggcactacctgcaggagggcgccgcgcggggcctgagccccggcccccagttcgacgggccgtggtatctcaggaccaacaccgatgtcgcggacgcgaaccagaaccctctgctgcattacctgaacgatgggcgcgccgaaggacggccgatctgcccgtttgccgatccggaggcactggcccgggtcgagggctcggagctgttcgacgccgaatggtaccgggcgacccatgtccccgatctgtcgccggacttagccgcgcgccattacctccgcgagggcgcggcgcgcgggatgagccccgggcccctgtttgacggggcgtggtacctcggcaacaacgccgatgtcgccgaagccggcgcgaacccgttgctgcactacctggtgagcggacgcgcggagggacggccgatccgcctcgccgtcgctcgcgatgccggcgcaagccggatcgagacccaacccatcgtcctgcgcgagagcacgcccgcgcgtattgtcgtcgtcgtccacgccttctacgtcgacgtgttcgaggagctcttgcctcacctcgtgcggggaatccctcggttcgacctgctggtttcgaccgatcagcccgacaagaaggcggcgctcgaggcggcggcggagcgcgccggcctcgcagaccgctgccgggtcgccttggcgcagaaccgcggccgcaatttcgggccgctcgtcgccgtgctcgggcaggacatcctgcgctacgactacgtgctccacgtccacaccaagaaatcgctgttcagcggcgccgagcagacgcgctggcgcgacgagatctatcgggcgctgttcgcgaacgccgcctgcgcccgcctcgctgtggccctgctggacgaggatccccggatcggcctgttcttcccggagaccagcaagcacatcgtctattgggcgcatacctggctcgccaatatcggcgccggccacacgctgctcgcccgcctcggtctgccctatgacgggttcgacgagtatctcgattaccccgtcggcggcatgttctgggcacgggtcgacgccctgcgcccgctcctgaccgccggattggccccacacgatttccccgaggagcacggccagaccgatgggacgctcgcgcacgcgatcgaacgggcgatccccatcgtgtgccgatcccagggctacaaagccgtctgcttcgattacgaccgcgggctcgcccgcaccaacagcagcgcgcgcaattggcaccagtacagcgcccgcacccaggaccaggcgctccaggcgctgcaagatgtcgacctcgtctcgttcgatctgttcgacaccctcgtgagccgtccggcccggcgcccggatgcggtgctcaagctcgtcgagcaccggatttcgtcggaggccggccggccgatcccgctcttcgtcgagcgccgggccgccgagaaccgggtgcgggcccgcaagcgccatcagggcgacgtcaacctgtcggagatctatgcggagcttaccgcctcggggccgatcccgggcgacgtggtcgcgcgggcgcacgccctggagaagcggatggacctcggcgccctgcgcccgcgcacggaggtcatcgcggtcctcgaagcggcgcacgcgctcggcaagcggatcgtcctgatgacggacacctattacgaggaggccgacatccgcgcgatcctcagcggtgccgggatcgccgaccgtttcgccgccctctacgtgtcgaacgcggtgggcgcccgtaaggaccggggcgacctgtggcgccacgtcgaggaggccgaggcggtgccgcgcgcccgctggctgcatatcggcgacaacgagcactcggatattcaggcggcctgcgaccgccgcatcccctacctgcatgtcgcccatccggccaagatcctcgcccagagcgggttcgtccgggacgagggtgatctcgcgcggacttggccgtccgatctggtggtcggccacgccatgctggcgctgggccgcaatccgttcctcggccgggcgaccagcccctacctgtccctcggctccagccgagagatcgggtacgcggtgttcggccccctgatgctggtcttcatgtcctggctgatccgccatgaggccttggcccgggtcgagcggctgtacttcctggcgcgcgaaggcgacgtcctcgtccggatctaccggctcatccgggagcgctacggctgggatcacctgcccgaggggcgctacttccacgtctcccggcagacggcgatcgccgccgccctcgcccaagaattccgcccggagctggtgacggcggccggacgctacgtgggcaatgtgcaggggctcctgtggaacagggccgggttcacggccccagcgcatctcgagctcgaccgcgtcgcggtgcggcttccgggcgatgtcgaggttgtcgagcggatcatgaccgaccttgagccggagatcgcggtgcatgccgcggacatgcaccggcgcctcctggcctacgctcgacaggaggggttggacccggatgtcgcctgcggcgtcatcgacgtcgggtactcggccacgatccagcggatgatgcagacggcgctcggccggcccttggtcgggttctacctggcggccctggacaaggcgaacgccgtcgcggcggagggcggctccgccttcggctgcctctgcgagaacgtcgcgaccttgaccgcgtcgatgcccgcgctgaaccactccctctccgtcgaagccttcctgacggccgcccacggacaggtggtgggctacgacacggcgggtgatcgggtcgagccgctgttcaaggcggatccgcggacgccggaggagcacgccatcctggccgagctgcatgccggcgccgagcaatacgtgatcgagaccctcgacctctacgggccggagctgctgcgggccgagatccccctgatggcgccgcaggaattcctgcgcctgctgatggaggccgcgatcgccacgccctcggaaccgatcaggaagctcggcgtcgaggacgatttctgcggcttcccgctgcataaggtctacgccgcggtgtag

SEQ ID NO: 7410 - DNA, 1047 bp, Methylobacterium sp.
atgaccgcggaagcttacgcgacggtgatccgcgcaccagcgcgcgaccgcctcgatctttttctggccaccgcgaaccggctcggcgctcctatcggcaacgtcgaaaaggacttctgggtgtgctggacgctggaggcgctctaccatcgattgcccgccgaccggcctcgcctcctattcaaaggcggcacatcactctccaaggcgtacggtctgatcgagcgcttctccgaggacatcgacgtcacggtcttccgcgacgatctcgaacaagccgcgagcgttgaagagctggaaagcctctccggcaagaagcgccgagcacgcctcgacgcgatccgcgatgcctgccgcgaatatgtcactgggccgctccgggaaagcctcaccgcactgctcaccgatgcgaccaacggcgccggccgcatcgaggtcgacgacgccgacccggacaggcaaacgctgctcgtctggtatcccgaggtcgagccgcgtgacgatgcctatgtccgcccggccgtgcggatcgaatccggcgcgaagtccgcgctcgatcccaaccaatccgtcaccctgcagccgtacatcgccgacgaaacacccgatttggacctctccgtcccagatgtgaccaccatcgaagctggccggaccttctgggacaaggtggtgatcgcgcatgggcttcggcgctggtacgagcgccgtggcgagctacgccaggagggccagcgcatttcccgccactattacgacctccatcagctcgtccggtcagaaatgggccaagcggcgctcagcgacgtcgaattggcaggggattgtgtgcggcacgcgcgcatgttcttcgaccggccagactatgacttagcctcggcccagccgggcagcttcgcgcttgcgccggtcgcggggatgaccgacgcgcttcgccgcgactacgtcaacaccgccggcatgatctttggagaacctcccacgttcgacgccattctcgattctatgcggcagctcgaagccgccgcgaataataaatccgcatga

SEQ ID NO: 7411 - DNA, 375 bp, Methylobacterium sp.
atgacggaccccagcaacatccttctctacgtcaccgacccggaggccagcgcacgcctctacgcgcgcctgctcggccgggagccggtcgaggcgagcccgaccttcgtactgttcgcgctgccctcggggttggcgctgagcctctgggcgcggaacggtgtcgtgcccgcccccacgcaagcgggcggtggcggcgagatcggcttccaggtggacacggccgcacgcgtggacgcgatccatgccgcctggcaggccgagggggccgagatcctcctgcagcccacggatctcgattttggccggagcttcgtcgccgtcgatccggacgggcaccggttgcgggtctacgcgcgcgccgaggcacaataa

SEQ ID NO: 7412 - DNA, 591 bp, Methylobacterium sp.
atgcgcgtcgagacgatgatccccgccagctcgtggctctggacgacgatgctgacgcccatgagcagggccgtcgttgtgcgggacccgatccatccatgccgccacgagcgcatcgacgggcggttcatgtccctccacgacctcgactacccggaggggacggtcctgatgacgacggacgccggactcatacagcgccacggcacatcattcgtcgtcctcaatgatcgactgcagcacgtctgggagcacgaggctcaggacctccttgagcccgccggggcgaccgagcgcctctatgagcgcctccgccggtacgcggggctcgatgaagtgtcgcgccgtttccgattccccgacggtctcgacatgaaggccggcgagttccgagtgcggggcggctggtacgccgtcgtcaccgcagtgacgacgcgccaagcctggatgcgcgcggcgacgacgaacgagatcctcgcggcagggggcgtcctgcccgtcgcaccgttgggtgccgacctcctcgacgccatccggatcgaggctgcccaagacgccgccgaggcggccgccgcccccgccgcagcctga

SEQ ID NO: 7413 - DNA, 426 bp, Methylobacterium sp.
atgcgtagcctcgtagccctgatcctcgcgctgctcgttgcatcccctgcctacgccaagctttggccgacgggttcgacggggtggcggtatgccctgacggtgccgtcgggcccggggcgccagcgctatggctacgtcgacgccgccccccggccgcccggcgggtggctcgtcaccatcacatgtggcgaggagagcacgcgcgacgggcgggtgctctcccgggtcgtcgggcatggcctgagcacgaggggcgcatcgcccggcttcggcgggaactgggactgggacgatggacgccggggcgggagtttcgtcgtcacgcaggacctgcgcacgcccgaggccctccgcctgcccggcgagttcacggctccggaatgtccccgccgcgggacgggagatctctctaccggcgactga

SEQ ID NO: 7414 - DNA, 891 bp, Methylobacterium sp.
atgttcatgccgtcggtcctagcgcctggcacgcacagcatcgccgtgaacggcgtggctcaacattatcacgtctccggcatcggaccctattgcatcgcgcatgccggtggccccggcatagacgccagctacttgcgattgcctctgctcgaagagagcctgaccatggtgtatctggacccgatcggcacaggatcgtccggacgcctcgcgacccatccccaggggtacagcgtagaccgcttctccgaacagctgctcgcgttcatcgacgcggccggtatccccgatccttaccttctcggtcattcgcacggagccttcgtggtgctggaggcagcgctcaagcggccaggaggactcgcgggtctgatcatgtatgccggagctgcctacacaggcggcgccttcatggccgatgcgagcgctgagatcgccgccttcgtggcacgccacgcggggatggcggaagccaaagcggtcgagagggcctgggcctcgatccccaccatccgcacagacgcggcctataccgcggcgctgagcgacctccttccggcctatatgtcggacttccggcgctggcccgacatgctcgcgaccctgcagcggcggctccaggcgaccctgttggtcggcgatggccaagtcttcgacgttcgtgaccgtctcgccaccttgcaggttccggcgctcgtcgtcaccggaaccgacgacttcattctcggcccgcgccacgcggcgttgctggctgatctgctaccgcaggcgcaaatgagaatcttcgagcagagcggccacttcgcccatatcgaggaggcctgcgccttcgcggaggccgtccttcgcttcacgggacgtccgggccgagcgttgtccggcatatga

SEQ ID NO: 7415 - DNA, 789 bp, Methylobacterium sp.
atgaccgagaccatcctggaggcggtggatgcgcgcggcgtcgccaccctgaccctcaatcgcccggatcggcacaacgccttcgacgacgccctgatcgcggatctcaccgcggccctgcaccgcctgggcgaccagcccgggatccgggccgtggtcctggcgagccgcggccgcagcttctccgccggggccgacctcgactggatgcgccggatcgcccgccagtctcccgacgccaaccgcgccgacgcggccgggctcgcgcgcctgatgcacacgctggaccggctgcccaagccgaccctggccctggtgcagggcgcggcctacgggggcggcgtcggcctggtcgcgtgctgcgacgtggcgatcgcctccgagcgggcgagcttctgcctcagcgaggtgaagctcggcctgaccccggcgaccatcagcccctacgtggtgagcgccatcggcccgcgctgggcccgccgcctgttccagaccgccgaactcgtcccggccgcgcgggcgcgggagatcggtctcgtgcacgaggtggtcgccgaggaggagctgacagcagcgggcgcggccgtgctccaggccgccctgcagggtgcgcccggggctcaggcggacgccaaggatctcgtcttcctgtgcgagggccggccgatcgacgccgatctcatgggcgagaccgggcggcgcatcgcgctgcgccgcgcctcggccgaagggcaggagggtatcgcggccttcctcgagaagcgcccgccggcctggcggcaggattga

SEQ ID NO: 7416 - DNA, 1359 bp, Methylobacterium sp.
atgacccggcttctcgccagccccgcgcaccggctcgcggccctcggcctcgggctgctcgtcgtgaatgtcggcgcactcgcgatccacgtgccgggcgccgacacggtcggctccgtggcccgcgccaacgtcttcgtcggcgtggtcgcggttggtctcggaatctacctcctcgccgtgcgcttggtgctgcgggagcggctgccgcccgcggcccggtggacgatcctcggcttcgccgtggcgatgcgggccgcgctgctgccggggccgccgttcctgtcgagcgacatctaccgctacgtctgggacgggcaggtccaggctgccgggatcaacccctaccgctacatcccggccgatccggctctcgaacggctgcgcgatgcggcggtctacccgctgatcaaccgcaaggactacgcgcgcacgatctacccgcccgcggcgcagatggtcttcgccgccgtgggccaagtctcgcacggcgtcaccgggatgaagctggcgatgctgggcttcgaggccctgggcgtgctggcgatgctcgcgatcctgcggggcgccggcctgccgtcggcccgcatcctgatctacgcctggaacccgctggccctgtggtccttcgcctgcgacggacatgtcgatgcgatcgccatcggcctcctcggcctcgcgctgctggcccgcacccgccgtcggtacgggctcgcgggtgcgctgctcggcgcggcgacgctggtgaagctgctgcccgtcgcggtggcgccggccttcgtgcgcggtggccggctatggcggcccatgctcatcggggcggccgtgatcgccgtcctctacctgccctatctcggcgccggccgggacgtgctcggcttcgccgggggctacggggccgaggaagggtacgagaccggcgcgggctactggctgctcgccgggctcggccatatggggctcagtcccccgggcttgctgcggacctatctggtctgcgccggcctgacgctcgccgcgatcgcggtccggatcgccttcggcagtgaccgggcacccgcgcccgacgcggtcgcgctgtgcggcgatgccgggctcctcgccgccctcaccacctgcgcggcgagcccgcactacgcttggtactatccctggctggcgctgcccgcggtggtcgctccggccccggccctgatctggctcggcgcggcgccgatcctgttcctgatcgatccgttcaacgaccgcttcctctggccgtcgctggtcttcgtcccggccctcgtcctggccgtccgcgcgctgtggcagacccgcaccgcgcctcaggcctccctcccgcaaggaaccgcccgatga

SEQ ID NO: 7417 - DNA, 1308 bp, Methylobacterium sp.
atgaagatcctcctctgctccacgcccgcgacgggccatctcaacccgatactggccatcgcccggatgctggccgacgagggccacgaggtcatggtgctgtcgggctcggccttccgcgaccgcatcgaggcgaccggcgcccggttcgcggcgctgcccggcatcgccgatttcgacgggcgcaacctcgtcgcaatcgttcccgagctggcgcggaccccgcccggcccggactggctgcgcgtcgccatggagcggatcttcatcgagcggatcccggatcagcatcgcggcctccaggacgcccttcgggctttcccggccgcggtcgtgatcggcgacgacatgttcttcggcgtcctgcccctgctgctcgggccgcgatcgaagcggccggccatcgtcctgtgcggcacgtcgatcctgcattgctcacggcccgacagggccccgatcttcctcgggctgccgccggccgagaccctcgagcagcgggacgcctatgcgcggatcgcgcgggcgcacgaggcggccgtcgaccggcccgtcgcgcgccgcctggcgggcgtgctggaggagatcggggttccggccccgtcctggaccctgttcgacgcggtggtgcagctcgccgacacctacctgcagctcaccgtcccgagcttcgaatacccgttcccgctgccgccggcggtgaccttcgtcggcacgccgccgatcgtgccgggtcaggcgccgctgccggcctgggcgaacgatctcgacggcgtccgcaaggtcgtgctcgtcacacagggcaccgtcgcgaaccacgatttcggcctgctggtcgccccgaccctcgcggcgctcgccggtgagccggacatcctcaccgtcgtcacggccggcggacgcgcgcgcgatgccatcccggggccgatcccggccaatgcgcggctcgccgactacctgccgttcgagtggatcctgccgcggatcgacgcgatggtaacgaatggcggctacggcagcgtcaaccaggccctcagctttggcgtgcccctcgtcgccgcgggcctgaccgaggacaaggccgacgtgaatgcccgcatcgcctggtcgggggcgggcatcgacctcggcacgaacaatccgaccccggaggcgctccggcgcgccgtgcggaccgtgctcgacgaacccggtcaccgccgggaggctcggcgcctcgccgccgaattcaccgcctacgatgcccgggcggggatcctgcaggtcctcgcacggcacgccgaacccgggcgggtgcgcagcgccgcctga

SEQ ID NO: 7418 - DNA, 366 bp, Methylobacterium sp.
ttgaccttcgtcgccgctcagccgctggatgccctcttcgtgagctgcgtaacgttcgcagaactccgtttcgggatcgagcggctccctgacggggcccgccggatcgaactggccgattggctcgcgaaccggctgaggccgatgttcgagcgacgcatcctgcccctcgatgaggacgtgatcgtgcgctggcggttcctggtcgaagagggccggcaacgcggacacacgttctcgcagccggatctgctgatcgccgcgacggccctggaagcgggactgacgttggccacgaggaacacctcggactttgcgcagacccgcgttccggtcttcaacccatggaccgactcgctcgcgtga

SEQ ID NO: 7419 - DNA, 408 bp, Methylobacterium sp.
atgtttatcgacacgtccgccgtcgtcgccatcctggccgacgaacccgaggcggctgcctttctcaccaggatagaggccgctgagcgtcgagagaccggcgcgcatgttcggctggaggcgacgatcaatctcgcacgcatcctcggccttgcggtgccggatgcccaggaaatgtacgatgcgtttctcgcggcggccaggatcaccgtggtcccgatcagtgatgtgattgcacgccggtcggtcgatgccttcgcgatttacggcaaaggacgcggccacccagcccagctcaactttgccgattgcttatcctacgcctgcgctgccagcagttccgtaccgatccttttcaaggggcgggatttctcccggacggacctcgtgtcggcgctcagtctctga

SEQ ID NO: 7420 - DNA, 3954 bp, Methylobacterium sp.
atgatcgaccacacccgcctggatgacaccgcggaatggctcaactacctccagccggaggggctcgtcgtcggtgcaaacgtactgcgcgagcgcgagctctcgcccgtccgccagaccgcaccggacaccgatgaggccgcacgggccctcggtctgccatcgggcgccgagcgcgaggacgatcgacacttcgtactcgccgatccctggcgcttcttcgagaaggtcttgggctggcccgcgaagctggtcgcgggggcgccaggtgggcccgccctcccagccgacctcgctcggacggtgcccgagcacggcacgttcctcgaacctgccatggcgctgctctggaacggaccgggcgaggagggcgtgccggctcaagcgctagtggcgctccacccggacctcgacccggacggccgccacttgtttggggccggcgagtgggaggcgagcccgcatgcgcggctggaacggctggtgcgcgagaccgggatcggcgtcggcgtgctcgtcgcccgcaactgcctgcgtctgatctacgccccgcgcggcgagacggcgggctggctcacctttccgctcgcggcgctcggccgcgtcgagggccgcccgatgctcgccgggctaaagctctgcctgggacgctcggctttcttcaccggcgcgcccgagacgcggctgcgcgccctcctcaaggcctcgcgggaggcgcaggacaaggtctcggaaaagctctcgggacaggtgctcggcgccctgcacgaactcatgcgcggcatgcaccgagccgacccggaaagaatcgaggcgctggccgagaacaggccgcaccatctgtacgaggggttgctcgcctgcttgatgcggctcgtctttctgctctacgcggaagaccgcgacctgctgccgtcttcctccgagccgcgcctgcgccagctctgggagagcggctactcgatccgcacactctacgcgcggcttctcgccgatgaggcgctcaaccccgatacgatggatcagcgccgcggcggctggggccagctcctcgcggtgttccgcctcgtccacagcgggcatccgggctgggtgacggggcgcggcggcaagctgttcaacccggacgccttccccttcctggagggccgcgccccaggcgaaaaccgcagcgcggcgagtgtgctgccgatctccgacggaacggtgctccgcatcctgcacgggctgatgacggtagagggccgcagcctcgcaggccagcgcatccgcgagcgtttgtcctaccgggcgctcgatgtggagagcatcggctcggtttatgagaccgtcatgggctttacggccctacgcgcagaggagcgcatgatcgcgctccgggatgagaagcgtctaccgactttcgttgggctcaacacactgctcgcccagaagccggccgagcgccagaaatggctcaaggagcaagcggtcaagctctcgggcaagcagcagaagggcgtgcgggaggcaaccgacacaacggcgctgctcaccgccctcggctcagccatcgacgagcgcgcctcgcctgatgcggtgccccttgcgcctggctcaccctacttgcaaccgacggaggagcggcgccgctccggctcgcactacaccccgcgctcgctcaccgagccgatcgtgcgtcacgccctcgaacccgcctttacgcgtatcggcatcgaggccgcgcccgaggcggtgcttgcacttaaggtgctggacccggcctgtggttcgggcgccttcttggtcgaggcatgtcgccagctcggtgccaggctcgaacaggcgtggacgatgcaccctgcggagaagccacaaatcccggccgacgaggacgaggccacccacgcgcgccggcttgtcgcccagaaatgcctctacggcgttgaccgcaacccgatggcggtggacctcgcgcgcctgtcactttggctcgcgacgctggcccgcgagcacgagttcagcttcctcgaccacgcgctgaagagcggcgacagcctcgttgggctaacccgtaaggagatccaggccgttcattgggacgcctcgaagcctggcctgccgctattccgcggcatgatcgaccaggccgtcgcgcgggtatccgaaggacgcgaggcgatccgcaatgcagccgacgacgtgacgctcgcggtccagactgctcgccaccgtcgcgtcgaggacgaggtcgagccggcccgcatcgtcggcgatgccgtggtcgctgccttcttctcaggcgacaagccgcgggcgcgggagactgagcgggcgaaagtcgagagctggatcgccgcgaaaacgagcccggattgggtacagcttcgggcggtcgcactagactttctagagcgccagggctggcggcccttccactgggacattgagttcccagaagtattttcgcgcgaaaacccgggcttcgacgtaatcgtcggtaatccccctttcgctggtaagaacacgatcagcgcgagctcagggcctttctacttatcttggctccagaatctccacgatggagcgcacgggaatgctgatctagtcgcgcatttcttccgtcggtcatatggcttgctacggaagaatggcgctttcggattaattgcaacaaacactgtcgggcaaggagacacgcgccaagccggacttgctgcaatactttctctaaatggccaaatatttcgcgctgtgaggagatatcaatggccaaacgaaggggcggctgttgtagtttcaattgttcaccttatgaagggccagtcagtttcttcagcagtgttgaacgaaaaggtcgtgcgtcgaatttccgcatatcttgtagaggggaacttcgacgacacgccttttagatttttcaggaattcgcgccttacctttcaaggcacaaatcccgtcggtgccggatttatgttttcggatgaaggcgcgcagcgtggcgaaacagaatctatatctaccaaagagaatttagtagcttacaatccggatatagcaaagttcatcaagccgtacgtctcaggagaaaacatcgcaaactcgatccatcatatgcatgagaggtacataatagattttggagatctcaaagaaaaagaggccgaaactgctgcgcctgagctatttaatatactcaaaaacctcgttgagcccattcgtcagaaggataatcgcgaacacagaaggcgtaattggtggttgttcggagagcctcaaaaaggtctttacgcgaaaatagagtcattgccgcatattattgcggccccacaaacttccccgcatctgcagttggcgaagaggcctaattttggcgtatatgcttctactataattgtattcgctttttacggcgaagcgccttttgccgtcctacaatctcgcgttcacgagatttgggcgcgtgtcttctcgtcctcaatgaaggatgacctgcgctatgctccgtccgactgcttcgagacctttccattcccacccggctacgagaacgatttggcgctcgaaacagcagggcaaacgtaccacgatcatcgcgccgctcttatggtcgaggcgaacgagggcatgaccaagacctacaatcgcttccacgacgcggaggagcgccggcctgtcatcgcgaggctacgcgagctgcacgacgcgatggaccgcgcagtgctgcgcgcctacggctgggacgacctcgccgataccctgcgaccggaattcctgacaccggaatccgaggacgaccacacctatcagggtcgctacttctggccggcgggacagcgcgacctcgtcctctcccgtctactcgcgcttaacgcagagcgacatgccgaggaggtcgcggccaggattgcgcccgcgcgtgggcggaagaccgcggcagaggccgagggccaggatgctttcgacctcacataa

SEQ ID NO: 7421 - DNA, 1188 bp, Methylobacterium sp.
atgagcactcgtgaagtcgtcctctgccatcccgtccgcaccgcgatcggcgcctatggcggcagcctgaagggcacgcccgcgaccgaactcggcgccgcggccgtacgcgagaccctacggcgggcgggcctcgatcccgcccacctcggcagcgtcgtgatgggcaacgtcgtccaggccggcaaccgcatgaacccggcccgccaggcggcaatcggcggcggcgtgcccgtctccgtgccggccctcacggtcaaccgcgtctgcggctccggcgctcaggccatcgccaccgcagccgacgagatccgcctcggccaccacgcggccgcggtggcgggcggcatggagaacatggaccgggcgccgtacctgatgaccggcggacgctgggggtaccgcatgggcgccgccgagatcctcgacagcatgctcaccgacggcctgcacgatgccttctcggacgcgcattcgggctggcacacggaggatctcgccgcgcattcacagatcggtcgcgcggcgcaggatgcctgggcggcccgctcgcaggcccgcttcgccgccgcgcaggcggatgggcgcttcgcggccgagatcgcaccggtggagatcaagggccgcaagggagccgagaccttcgcgcgcgacgaggcgccccggccggacacgacggtggagatcctcgccaagctgaagcctgccttccgccccgacggtacgatcacggccggcaacgcgcccgggctcaacagcggcgccgccgccatggtggtggccgagaggggcttcgccgagacgaacgggatcgaggcgctgggccacctcgtggcgtacggcgtcggagccgtggaacccgggatgttcggcctcgggccggtgccggcggtgcggcaggctctggagcgcgccggctggcgcctgggcgacgtcgagcgcgtcgagatcaacgaggccttcgcggtggtgccgctcgcggtggcggccgagctcggcctgccggaggagatcgtcaacgtcgacggtggggcgatcgcgcacggccacccgatcggcgcgaccggcgcggtgctgacgacgcgcctgctgcacgcgatgcggcgcgacggcgtgcggcgcggcctcgtcaccctctgcatcggcggcggccagggcatcgcgctggccttggaggcatgccgatga

SEQ ID NO: 7422 - DNA, 285 bp, Methylobacterium sp.
atgaccgaagccgaccgctctgacatcatcttcgagctccacctcgccgacggcgaggccgaccggaacgccaccctggtccgcctcgtccggacctacccctacctccgcgaggacctcgtcgaccactggtgcgagatcgtgctgatggagctccgggcggccgcctacctggagccgccgtgccagccggtcgacgaggatgtcgcggcccaggcgctggcacggtttcgagagcgggaagctgccctcgcgggccgttgcgaaccccaccgggttccctga

SEQ ID NO: 7423 - DNA, 6216 bp, Methylobacterium sp.
atgaatctcgtgcgccccaccgccgccttcgacaccctcgatcgagtggcagaacgctcgacgtccgctgtgctgggctggtcggcgctgcgctcgcaggcgctgcgttcccacctcctcagcgccatgccgacgagcggtgatcccaacgcctttctcgccgaacccgtcatcgaggcggcccacggctgggccacggcgcccgagaccttcggaagcctcgcgggctcgttgctgagcgagagcgtggtcgcggcgctcgacggcggcgactggccggatctggatgggcgtgagcgctatcgcttgccgcgcgaccgccacccgtacacccaccaattggaggcgtggcgtcaacttctcgacgagaccccgcgctccgtgctcgtcacatccggcacgggctcaggaaaaaccgagtgcttcgtggtgcccttgctcgagcatctagcccgggccgcacgcgcccgcgccgcgccgttgcgcggcgtccaagccttgatgctgtaccccctgaacgcgctgatcaacagccagcgcgaacgcctctcggactggacgagaccgttcaacggcgacctgcgcttctgcctctataacggcgaaacacccaaggaccttccgtcggccgagcaggagaaggcacccgaggaggttcgctcgcgctacctcctgcgccgcgacccgccgccgatcctcgtgacgaacatcacgatgctcgaatacatgttggtccggagagaagaccaatccatcctgcaacgctcacaggggcagctgcgctacgtcatcctcgatgaggcgcattcctacgtcggctcacaagctgccgagctctccctgcttctgcgacgtgtcgtgcgtgcttttggggtcgacccggagcaggtccgtttcgtcgccacctccgccacgatcggacacgccgacgatccgagcacgcacgagacgctcgcgaagttcctctccgacgtagccggcgtgccccgcgccagagtttgcgtcgtcgaggggcatcggcgaccgccgaatcttccacccacgcgccccgacctcgccctaccgacgctcgaggagttgcatgcgagcgatccgacgaccctgttcgaccggttgggggcgacgcccgcattccgccgcgggttcgagcttctcaagaccagtccccgtaccgccacgcagtggttcgagacggtcggtgtcgagcgcgcctacggcagcgctctgttggcagcggccgcccgtgcgcagacgacgctaccggatcagagcccacagcttctgcagccgctcaaagtccacgggtttcatcgcacgcaaggcggcttgtgggcgtgtgcggacgcgggctgtgtcggtcgaagggagacgccgctcgacgcgccggattggccgttcggccccgtgttccaggagcgtctcgaccgatgccctcggtgtgagggcctggtattcgaggtcgtattctgctcgcaatgcggggagaccgccctcgacgcgctgcgcgaaacggataccgaaggcgtcgagcgcctgaccgcggcgctgtcaccgctcgccgaggacgagttcctgtccgaactcgtcgaagccgcgccggagagcgggggcgacgaagagcccacgggccgacagaccgtcgatcccgaccgtgtccttctcgcatccccggacgggcggatcgcgcgtgcggtcccaatagcccgcgcgaccggcgtgatcctcgacgccggcgatccggacgccctctcgctcaccttgggcgatcccggccagtgcccgcactgcggggtgccgttcgacggaaggggtatgcgcttacagaatttccgcgtgagcggaccgttcctcctcggcagcatcgtgcccgagctcgtcagcgacgcggagccaatgcgggcggatcgtgggaccgttgggccgctcccggccgatggccgccagatcctgaccttcacggacagccggcaaggtaccgcccgcctcgcagccaagctccagcgcgacgccgaacgcaaccacgtacggacgctgctctaccacgccgtccaggctcagccgttcatcacggccgaccagcaagctcagatcgacgagcatgccgcaaaactagcggagatcgacgcgacgatcgcggcaaaacctgaatttgccagcatgctcgctctcggtcgtgagacgatcgccggtaagattgccgcgctacaaccgagcgaaaggcggctgtcttggagcgacgctctgcatctgctgcaaaaggacgaaacctgccgccgctggatccgggacgagatctgggcggaacgcgaagcggcgttcacgaacgagacggccttcgcgcgcttcctcgtcctgcgcgagatgatccggccgccggcgaaggcgaacagcctggaaacgatgggcctcttgcggctgtgcttccgccagatcgatgagacgatcacgcgattgcccaacgagttcgaacggcacggaggtacgctcgcagattggcgcgacttcctgaccatcgcgctgacccgtgtttttcgcggcaacgtcgctgtcaatacggatcgggagaccctgcattggatcatgccggacattccggcgcgtttcatcgtgccgcccggaaccagcaccttcggcgacacgaagcgtctgagttggccccagccgagaccgaattcgaagcgtcccgcgatcatcttggccctgctcgccgcaggtctcaaactcgatctcgacaacccgacgcaccgcgacgacgtgatcgcatgcatgggccgggcctgggaggcgatctggccggtcttgaaaactgacgcggtcgccggcactcagctcgaccccgacaagatcatcctggcgcccgtccgtgatgccttcgtatgcccagtcacgcggcggattatcgaccgtacctttcgcggcttgtcgccaaacccgcgtggggcagggggcgccttccttccggccgagccgatcaccctgccgcaattcccgttctcctttggacgcagcggtccgcacggcgtcgaaccagaggcgatcgagacgtggctgcgcgaggattctcaagtcgtcgagctacgccagcgcgggtattggagcgacctacatgaccgtatcgcccgcagggacacgttctaccggtcagcggagcattccgcgcaacaggccgggcgcaagctgcgctcctacgagaaagcgtttcgccgcggacacatcaatgtccttaattgctccacgaccatggagatgggggtcgacatcggcagcatcggcacggtgctgatgacgaacgtcccgccgtcggccgcctcataccgacaacgcgtcggtcgcgcgggtcggcgtggccaagccgtcgcgctgtcgctgacgctctgcaaacatcggccgacggaattgtcggtgttccgcaatccgctgtcgctcctgacccggaccatcgcggcaccgtctgtggcattggacagcgcggtgatcgcccagcggcacgtgaatgctctgttgctcgcccgattcatcagcgcgagcggcgcggagctgccaaagctcgaggcagggtacttctatggcttgcacgccgacggggagcgcctcgaagacggccaatctcccgctgagcagttcatcgcctgggtggacgcgccaacgacgcgcgcggaacccagtctgattgccgacttgcgtgtcctcgtcagaggtaccccgttcgagaatcgcgaggcgatcgcgctggacggcgcccgcgaccaattgaaggatctgcgcacggcgttcgagcgggaatgggacgtcgtgcgtgctgatctgctcgtggctgccaaggaacgggcggcggcggaaactgcgctgaagatcgccatgcggcgactcacgggcgagtatctcctcacagaactcgcctcgcacggcttcctacctgcgcacggcttcccgaccgacgtggtgccgttcgataactcgaatgctttcatcaaggagcggcgctcacccgatcaagacgacgatgccgccaagcgaacgcgcttccgcgaggctccgtctcggcagctcgacctggcaatccgcgattatgccccgggctcggagatcgtactcgacggggtcgtgtttcgatccgccggtgtgcggctcgactggaagcgtccggcaagcgagacgagtgttcccgagattcaagcgctgcgctacgcgtggcgatgtgagcggtgcggagccacagacaccgctcacaggcaaccggaggcctgttcgagttgtggcgaggcgggacgggcgctgacgtggcaccgctacctgcgcccctccggcttcacgtgcgatcccgtgacgaagcctcattccgatatcgaacgcgtcgcctttgtaccgccacgcctcccctgggtcgcagcgcgcggcggagcttggacgacgttctccgacgccagcacgggtcgcttccgcgcgagccgcaatgggatggtgttccactacacctccggggccacggagcacggctacgccatctgcctatgttgtggacgggcggcgccagaatctggttcgcgtgatgcagcgcctcctttgccaggcgatctgcagcaggttcatcgtcccttgcgcacgagccgcaaggagcagccagtctgtgacgcgcaggaccgcccattcgcgattcagcgccatcagttcctcggtcacgagacgatcaccgatgtcctcgaattgcagctgaccggtctcaagggacccgcggtcggctacccgatcgcggcggctttgcgagacgcgctggcccagaaacttggggtcgagccgggtgagatcgggttcggcattacgcagacgcgcgatgctgaaggcgccgatccccggtggtcgatcttcctgttcgaccgcgcagccggaggggcgggcttctcggtatgggccgctcctcgccttgtcgagcttcttgaggcggtccgtcgcatcctcgactgccggcacggggatcactgccagcatgggtgtgtcgactgcgtcctctcgcgggacctagagaaccagacgattgatcggatcggggcgctggcgttcatgaccgaggcggtattgccacgcttgtcgatcccggcagcggaccgcctgttctcgccacaaccgacactggccgagatgcagccgctcgcggacgcgatcatgcgcgagatggagaagcccggcgtcggcctcacgctatggatagggggcaatccaagggactgggacctggaacggtgggcggcggtccagctcattcgacgattggtcttgcgcgatcgcactgtcgaaatcatcgcgccgagcgcggtggtcgagggtgccgacgcaggactgcgcgtgtccatgtttgggctcctcatgaaatccggagccgccgtgcgccaggccccagatccactccgcgtcggatctgggctcgccctcgcctatgtcggcgacgataaggagggcgtggtctgggcgagccggtcgccggaagcgatcatccccagctctgattggggaacggcctcggccggttcgatcgtccgcggtggccttgacgaggcgttcgaccacggggtggttctagagcccgggtccttcctgcagacatcacccgacactgtgttgatcgacgtgggcccggagctggatggtccgatcagcgctttcggcccgaacttctggaggctgctcgctgcccgcgccccgactctagcggctcggatgacggacaagaccccgctcacggcgctggcgtattcggaccgttacctgctggcaccgttgccactgcgcctcatctacgagctcttggctcacgcgccaggacgcaccaaacagactgaattgaagctggagacggcgttcggcggcggcaacaggcacccgtcatcaccctacacgatcgagcatgactggcaatatgatccgcactgcgcccaagtgacggacgcgctgatcaaaagtctcgcgaaggcgagtgtacatcggatcgataagcgagccctacctcacagccgaactctgatccttcgctttgctaccgggcctgcggtgcgcatcgttctcgatcaaggagtaggctattggcgtgcgaacccacgcagcacacgcttcgatttcacgcaagcgccccccaatcaagccataactctccggtcggcgctagttcggctgcaggcttcatctctaaatcgcacatgggtcgtcgtcgctaccgtgaagtga

SEQ ID NO: 7424 - DNA, 921 bp, Methylobacterium sp.
atggccttcgacggacggctccttgccggcatgagcgtgctggcggctgtggtcgagggtggcagcttcactcgggccgcggagatgctgggcctctcggcgtccggcgtcagccgtgccgtcgcgcgattggagcggcagatcggcgtgcggttgctcgaccggacgacgcgctcgttgagcctcacgagcgagggcgcgcggctctacgagctcgcagccccgcacctggaggggatcgaggccgcggcgaatcttgcatcgggaacggccggcaccgtccgcggcacgctgcgggcgagcgtcaacccgatcttctcgcgccatgtgctggcaccgaggctgcccgagttcgtcgcgcgcttccccgacctgacgaccatcatcgtccagcagcctgacgcgggcgacctcgtcgccgagggtatggacgtcgcgatccgcttcggcccgcagccgccgtccagcttatcctcacggctgctcctgcgcacgcgcgtccttaccgtggcggcgccggcctacctcgagcggcgcgggcggccatcgaccccggctgcacttgccggacacaactgcatccagttcctcgacccccagcggcgacgcccgttcgcctgggagttcctgcgcgatggggagacgctgccagttgcgacccagggaccgctgacgttcgccgacgtcgatacgatggtcgccgcctgtgtggcaggcgcgggcgtcgcgcaggtcctcgcgcttggagtcgagagcctgctcacgagcggggcgttggtcgagctgttccccgactggccgggcgagaccttcccgctctacgcgatgcggccgtcgcggcggctgtcgccggcgaaagtcgaggccttcctggacttctgcgaggcggtcgcacggcccgacgcgtgttccagcgactag

SEQ ID NO: 7425 - DNA, 933 bp, Methylobacterium sp.
atgccttacgatggccgactgctcgccggcgtgacggttctgatggctgtggtcgaggccggaaccatgacccgagcggccgaggccctcgggctcacccagtcgggtgtgggacgcgccatccagcgtctggagacccgcgtcggtgtacggttgctcgatcgcacgacccggaccttgcggctcaccgacgagggacgtcgcttctgggagcgggtcggcccgcatctcgacgggatcgaggaggcggccctggaagctgcgggcagcgcgtcgacggtgcgcgggcgcctgcgggtgaatgtcgatccgtttttttcgcgcctcgtcctgtcgcgcgagctgacgcgcttcctcgcgctccatcgcgaactgcggctcgaactgatcatgcgcgatcagatcggcgacctcgttgccgacgggttcgatatggcgctgcggttcggggatccgccggtggcgggcttcaccgcgcgcaagctcctggaaacgcggatcctgaccgtcgcggcgccggcgtacctggctgcgcacggccgccccgcgcacccgcgcgaccttcgcgaccacgcctgcatcgactatcaggatccgctgacgggccgccccttcgcgtgggagttccgccgcggcgacgaggtcgtgccggtgcggcagccggcgcgcctgatggtgtcggacgtcgagacgatgatcggcgcctgttgcgaaggcgcggggatcgcgcaggtcatgcagctcggcagccggaacttcgtcgcgagcggcaagctcgtcgagatcttcccggattggcccgacgagaccttccccctgtacgcgatctacccgtcgcgccagcatcgcgccgcgaaggtccgcgccttcaccgaatggtgcctgcaactggtcggcggcgacaacgagctcgatgccgccgcgacacggtga

SEQ ID NO: 7426 - DNA, 774 bp, Methylobacterium sp.
atgtcgcgcatcttcatcactgggtcgtccgagggtctcggactgatggccggccggctccttgccgaacatgggcacgaggtcgtgctccacgcccgcaacgcggcacgcgcagaggacgcgcgccgtgggttgccggaggcgaaagcggtcgtcgagggcgacgtcgcgacgctcgccgggatgcacgcggtcgcggacgaggccaaccggctcggccgcttcgacgccgtcatccacaacgtcggtatcggctaccgcgagccgagacgcatcgagacggcggacggcctcccgcacgtcttcgcgatcaacgtgatggcgccatacgtgctcaccgcgctgatcgagcggccgcggcggctcgtctatctctcctccgggatgcaccacggcgtgcgcccggcgctggacgacctgacctggaccaagcgcccttgggccggtgcgcaggcctacgccgagagcaagctgtacgacacggtgctcgccttcgcggtcgcgcggcgctggagtgacgttttgtcgaatgcacttgaaccgggctgggtgccgacgcggatgggcggtgccggcgcgcccgacgacatggaccaagcccaccgcacgcaggcgtggctcgcggcgagcgacgatgcggcggcacgggtcaccagtggctacttctaccaccttcgccagcgcgagccgaacccggcctcgcgtgacgaggccgcgcaggaggcgctgctcgcagcctgtgcgacgctctccggcgtcaccctgccggcgtga

SEQ ID NO: 7427 - DNA, 771 bp, Methylobacterium sp.
atggcccttatcttcatcaccggatcgtcggatggcctcgggctcatggcgggccagcgcctggcccgcgagggccatgatgtcgtgctgcatgcgcggaacaccgatcgcggcgaggtcgcgcgacgggcgcttccgaacgcggcccagatcgtcatcggcgatgtcgtcacgatcgccggcatgcgatccgtggccgagcaggccaacgcgatcgggcgcttcgacgccgtcatccataatgtcggcatcggctatcgcgaagcgcgctggctggagaccccggatggtctgagccatctcttcgcaatcaacgtcttggcgccctacgtgctcacggccttgatggagaagccagaccgcctcgtctacctgagctcgggcatgcatccaggcggtgtcccggacatggacgatctacaatggaccagacggcgctggagcggatcgcaggcttacgcggaaacgaagttcctggatgtcctgctggctttcggcgtggcacgacgctggcccgcggtgcgatcgaacgccctcgaaccgggctgggtacccacccgtatgggcggtcccggtgcgccggatgatatggccgccgcgcccgtgacccaggcatggctggcggtcggggacgacccagcgacccgtgtcacgggccggtacttctatcaccagcgcgagaaattgccggagcccagcacccgtcgcgtcgggctgcaggaggctctgctggaccggtgcgcgacgctgtccggtgtgccgttgccctag

SEQ ID NO: 7428 - DNA, 1725 bp, Methylobacterium sp.
atggcacaccaaaatcgggtcgtcgacgtcatcgcggatggtctcgttcgccatggcatcgagttcattctcggacagagcgtgccgagcgcgctcgtcctcgcctgtgaggatcgcggcatccgcaacatcacctatcgcgaggaaaatgcgggaggcgtcatctgcgatggtttcgcacgtgtcgccggcaaggtcgccgtgatgatctgccagaacggcccagccgcggcgttggcggtcgcacccttcgccgaagcgatgaaggcaggcataccaatcgtcgcgatcatgcaagaagtcgatcgcgcgcatatcggacgcaacgcttttcaggaatatgaccacaagacgctgttcgcgagcgtgaccaaatggtttcggaccctcgaaagcgtggatgggatcaacgatcatctcgatcaggccttcatcgctgccacgagcggcaagcccggaccggcggtgctgatgctgccggtcgatctgcataaggcgcaggcagggacggctgcggatcggcgtgatcggctcaatacatggccggtcgatcgcccgcgaccgtccgacgccgctatcgcagccgcggcggacaagcttctgaaggcgcgatcgccgatgattgtggctggcggcggtatccacggatcggcggccagcgcggcgcttgctacgcttgccgaacggatcggcgcgccggttgcgaccaccaacatgggaaagggcgcggtccccgaaacacacccgctggcggcaggcgcaatcggcaatctgaccgggccgggcagtcttggccgccacaccaaggccatggtgcaggatgccgacgcgatcctgctggtcggcaccagaaccaacgaggacgggaccgacaaatggacactgctcccgcccggtatccccatcttccacatcgatatcgatccgcaggaaatcggtcgcaactatgaagccgtccggctgctaggtgacgcacgcgagacgctcgcggcgttgacgacggcgatcggcgacagaacgccggccagcgaccgcaaagcggcggaacggcgggttgcagccgcctgggcgaagtttgaggaagagcgtgcgcccttcctcgcggatacggcgccgatccggccggaacgaattctggccgcgatccagcagcgccttggatcggatagcgtgatcgtggcggatgccagctattcctcaagctggatcgtcggacagttgcgcacgcatcacgccacaacccgcatcgtcagcccacgtggcctcgccggtcttggctggggcctgccgctggcgctcggcgccaaactggcgcgaccggccagcgaggtgatcgcggtcgtcggcgatggcggcttcagccatgtctgggcggaaatggaaacagcggtcaggagcggcatcgtcgtgaccgtcgtggtgctgtccaacggcgtgctcggataccagaaggatgccgagcatgtgaagttcgggcgatatacctcggccgggcatctcggccgggtcgatcatgccgcgatcgcgcgcgcggtcggcgcgaccggactgacgatcaccgtgcccgatcagttgggcgaggcactggcgcaggcggctagcgcgacgaccctgacgctactcgacgtcgacaccgaccccggcgcgcacccgccgatctcgctctatgacggcacgctggatatgatccgggatggtgtcgctacccagttggcggtcgcgtga

SEQ ID NO: 7429 - DNA, 714 bp, Methylobacterium sp.
gtgaccgccgaccgcgcttcgcggtccggcgaggtcgaggcggtgccattgtcggcgaacgagcagatcctgcaccagctgcgcgaagccctcgccagtggcgccttcaccccggggcagaagatcaagatccgcgacgtggctgccgcctatggcaccagcatgaccccggtgcgggcggcgctctcgcgtctcgtcgagcagggtgctcttgaggatgacggtggcaagtcgctgcgcgtgccgttgatgacgctcgatcgctggcacgagatcctcgacatgcggattgcattggaggggctggcgatcgaacgcgctgcgagccggatcgacgcagcggcgctcgccgagctgcgtcacctcgcgggcgaactggccgcggcccgtcgggcaggtgacgtagagcgcgatcgtactctcatcgcgcgctttcaacttggcgcctattcagcttccggcgcgccgctcctcgtcaccacgatcgaacgcttctggttgctgacgggaccgtacctcaatttgatctttcccgattatgttcagaccgtgccgcacggatggcgcgagcggctttgcgacatgttgcaggcgggcgaggccgcggccgccagggccgagatcgagcgcgacctgcgcgacgcccgcgatcatgtggcagggcttgccgatccggacggcctcatccgcctgaagagggcgacgccgggatga

SEQ ID NO: 7430 - DNA, 696 bp, Methylobacterium sp.
atgctgatccacaacgattaccgtcagcgccgcaatggtggcccgcgcccgaccctcaccgccctgcaggccctggtcggctcgagcgcgcggcagaccgccgccttcgtggcgacactgaaggccgcccggttggtcaccgtcgaggcggttcccgaagacgcccgggtgcggtgcctgcgggcggctccgccgctcgtggccgagatcggcaaatcggcgcgcctgttcgtcgccgccatggaccgcctcgcgcgccgtgctccgggccgagccgccgcgctcgacgatccggaccggctcggcgcgctgatctaccggtcgggcgcccacatcctgcagcacggcatgctgaccgcgccctttcagcggatcctcagcctcaccgagcgcgattgtggctatccgctgctggcggccgtcatgggtgcccactacgccgccacggtcccggacgcccccgcggcgctgccgctgagcctgcgcgccttggcggaccgcctgggcgtctcccgcgcccatgtcggcaatctcttgcaggaggctgaggcggacggctggttccggaccgaggaacggcggctggttcagctcgatccgactctcgtcgatgagttcgagcactgggcggcctgccagatggtcttctacgacgacctcgcggcggagatctgcgcggaggcagcgggaccgtga

SEQ ID NO: 7431 - DNA, 579 bp, Methylobacterium sp.
ttgattgaagatttatccggcagcgacaggctgcgccacgccttcgctttcatgatcgaggaactggtcaatccaagtcttggtacgcaggaggtgacgagtgcgctgatgaagcagtgcctgacgatcctgcttcggatccatctgaaggagaaaggcgctgaatcgccgatcttcgaagcgctgcgtgatccgagactggtcccggcgatcgcggctgtcctcgacgcgcctggggcgcagcatacggtcgatagtctggctgcgctctgtgggatgagccgctccggtttcgccgagcgcttctccgccacattcggcgagggcccgatcgagtatctgcagcgggcgcgactgcaactggcagccaagctgctgacgtcctcgcccatgcccgtgaaggtcatctctgagagcgtcggttacgccagccgcagttacttctcgcacgccttcaagaccgcttacgggtgcgatccgagcgcctaccgcgctcaagccacgaacctggtcagatcgctggagccacaatccgacctcgggatcgacggcgcacggcggaagtccgaaaggccttga

SEQ ID NO: 7432 - DNA, 531 bp, Methylobacterium sp.
atgagtgcccgcgcgatccggtgcgcccggggcgtcgtcctgctgacgctggccctcgccgggccggcgcaggcgcagacggccggtcccccgccggcccccgaccacatgccgaagcccggcatgaccccccccgagatggcgggtcgcgcggccggccggtttccccagcctgtgcgcgtcggcgatctccccggccgcctcctgcttcagccggaggaatcacagcccgtgctcggccgcgtgacggggctcgtccgccgcaacgacggcggcgccgacgtgatcgtgcgcctcgacggcgtcctcgggctgacctggctcggactccagccggtcgcctggagcggggtcggatcccgcctcgtggccgtgccggtcgaagcggtggcgctgctcggcgagcacgtcgccctcatgggcctgacgccggagcgcctgcgcgcgctgccggccttcgcgccgggctcggccaccgcggttcaaccggacgagacgctccgcctcgggatcgtccggcccttccattga

SEQ ID NO: 7433 - DNA, 1233 bp, Methylobacterium sp.
ttggcgatggcgctcgaagatgacgccggaccgggcctgtgggccggcacccggacggaggaggtcggcctcgacacagggcaggattacgggatcgctacgtcgcgtacgttcgctttggcggcgtatctggaccgctggtcgggctgtgcgcaccacgccctcgccgcatccgattcggaaccgctgacgctcaccgcgttgctgcaccttgccggcccggaggatcgtctgcgctggcgggaggccgatctcggctacgccgaaccgcgcggcgcctcctggctgcgcgccgccatcgccgcccgctaccaccggctcgaggcggacgacgtgctcgtcagtgcaggcgcgcaggaagcggtgacctgcgtcctgagcgcgctcctcggtccggcagaccacgcggtagtggtcgtgcctatctaccagccctcggaactcgtcgtgacgcggctgtgcgcggccgatggcatcgctcttcaaccggaccaaaactggaagctcgacctcaaccgactcgcggcggccattcgaccgaacacccggctggtgctgatgaatttccccaatagcccgaccgctgcggtgctggatctgacgaccctggacggtctgatcgagctctgccgccggcacgggctctggctcgtcaacgacgaggtctaccgccagacggagctcgatcaagagcgcgccgtcccgcccgtcgtcgacctgtacgagcgcgggatctccatcaacgggctatcgaagggattcgggcttccgggcctgcgcgtcggctgggccgcctgtcgcgaccgcgtgctgctcgaccgcatcctcgcggccaagaatctgctgtcgagctgcctcgccgtgccgagccagatcctggcacatgtagcgttgcgggccgaaccgcgcctgaccggccgcgcccgcgcaattgggcacagcaaccatcgccgcctgcggacgctgctcgaccgctatccggacctgttcgatccggacgagccgaccaacctggccttcgcctgtccccgattccgcgggcgggagggggcgaccaccttcgcccgtaccctcgcgtccgaggacggcgtcctcgtgctgccctccaccttgtggcactcggcattggcgtcgatccccatggaccgcctgcgcctcggcctcggccgcgtcggcagcagcgcggcgctcgggatcctcgcggatcacctgctgaggcgcgccggccgatga

SEQ ID NO: 7434 - DNA, 1695 bp, Methylobacterium sp.
atgaccgaccaggtgttgagttatgtccatggcgcggccgatacgccgctgctcggccagacgatcggccaagccctcgcgcgtgcagccgcggactgggcggaccagccggccctgatcgcgcccgcccagggcatccgatggacctggcgggagctgagcgatcgcgccgatgccttcgcggcaggcctgctcgccctcgacctgcaacccggcgatcggatcggcatctggtcgctcaaccgcgccgagtggacactcacccaattcgccgccgcgcgggccggcctgatcctggtcacgatcaatccggcctatcgcctgtccgagctggaattcgcgctcaacaaggtcggctgcgcagccctggtcacggcgaccgcgttcaagaccagcgactatctgggcatgatcggcagcctcgcccccgagctcgccgcctcggttccgggccggctcgccgccgcccgcctgccgcagctgcgcagcgtcatccagatcggcgggccgccggctccggggacgatcgccttcgaggaggtggcggccctgggcggcgcgggcgaacgcgcgcggctgcgcgggctcgccgaccagctgcagttcgacgacgcggtgaacatccagttcaccagcggcaccaccggctcgcccaagggcgtgacgctgacgcaccacaacatcctcaacaacggcttcttcatcggccgcgccctgcggctcggcgcggcggaccggatctgcatcccggtgccgctgtatcactgcttcgggatggtcatcggaaacctggcggcgctcacccatggcagcgccatggtctatccgggggaggggttcgacccgcacgcgaccctcgaaaccgtgcaggccgaaggctgcaccgcgctctacggcgtgccgaccatgttcatcgccgagctcgaccacccggatttcgcacgcttcgatctcggcacgttgcgcaccggcgtgatggcgggcgcaccgtgcccgatccaggtcatgcggcgggtggtggagcgcatgcacatgcgcgagatcaccatcgcgtacggcatgaccgagaccagcccggtcagcttccagagcgccgtcgacgacccgctggagcggcgcgtcgcgacggtgggccgggtccacccccatctggaggtgaagatcgtgaacgcggaggggcgcgtcgtgccccgcggcgaacccggcgagctgtgcacccgcggctattcggtcatgctcggctactgggacgacccggcgaagtccgacgaggtcatcgacgccgcgggctggatgcacaccggcgatctcgccaccctggacgccgacggctattgcaacatcgtcggccgcctcaaggatatggtcattcggggcggcgagaacctctatccccgcgagatcgaggaatatctctaccgccatccgaagatccaggatgtccaggtcttcggggtctccgatccgaaatacggcgaggagctctgcgcctggatcagggtgcgcgacggagagacggtgtcggaggacgaggtgcgcgccttctgccggggacagatcgcgcaccagaaaatcccgcgctacatccacttcgtggaatctttccccatgaccgtcacgggcaaggtccagaagttccggatgcgccacatcgtcgaggaccagctcggcctcgcgcgcgacggcacggcctga

SEQ ID NO: 7435 - DNA, 684 bp, Methylobacterium sp.
atgctgcatatttcggacatgtcttcgcctgccgttcagccatcctccgacctgcgcacccgcctgcttgcccgcattgcgggacagccggatgaggtctggacgccaagcgacttcgccgacctcgcgagccgccatgctgtcgacaaatcccttcagcggctggcggccacaggcgagcttcgccgcatagaccgaggcctctacgaccggcctcgcatcaacagcttgaccggccgtcctaccgttcccgattaccgggctgtcatccgcgccgtcgcccggcgggacaaggcccgcttcgtcgtcgatggcatgaccgccgccaacgacctcggcctcaccacggctgtaccagcccgcatcgagatgctcgtcgatgctcgcctcaagcccatccagctcggcaagcaggagatccattttaagcccgccgccgcaagccggctctactgggccgggcggccagccatgcgggtggtccaggctctgcactggttgcaggacgtgttgacccatgaagacgagcgcacccgcatcgctgatacccttcggcgcctgttcgctgaccctaagcacggtccggcgatccggggcgatctgcgcaatggcctatcggcgctaccgatctggatgcaggattttctccgcccgctgatcgtcggcaaggcgccgcccgcatga

SEQ ID NO: 7436 - DNA, 1737 bp, Methylobacterium sp.
atgatcaaagcccaggaccgcacgctcgaggaatggttcacgcgcatccgcctagggcaactgcggcttccgcggttccagcgggtcgaggcgtgggatctcgacaacgtggcgggcctcgtcgactcggtgctggccgagttgcccgtcgggtcggccctggtgctcgaggtcggagtcgacgagcctttcgtgacgcgccgcctcgccggcgcgcccgagccgcgggagcgctgctccgagcaactcctcgacggccagcagcgcctgacggctttgtggaagagcacccacgacctctacgaggactcgattttcctggtgcgactcgaggagccggcggccgacgaggaggggacgaccccaccgcgcacggtgcgcatcacccgctggacgcatcgggacggccggcgcttcccgctgtgggtcgaccaacccaccgaagtcctcgggcgtggcttcgtgccagcctcattgttgcagccgtctgacgtcgcaggccggcgcctcgaatggtgccgtgcggcgctcggcaacgatttcgagaagatcctcgagatcgagggcaagatccgcacgctgcacgagcgcgtcaagcggttcaatattccgctcctgcgccttgatctgacgacgccaccggcgaccgcgctcgacgtattcgtgaagatgaacacttcggccgtggcgcttagcgcctacgacatcatcgtggcgcagttcgaggcgcgcactggccgggccatgcacgacctcatgcgtgacctgcgcgagcaggttccggccctggaggcctacaccacgccggagcagctgatcctgcaagcggcagcgctccgggcggggcggcccccggtgcaggcgagcttgcgcgatctcgacctgaccgtcctcgacaccgactgggagagttttgtcgccggcgcccgctggatggttcagttcctcgagcaggagggcgtattcgacgagcagcgcttgccgacgacgatcgtgctccccgtcctgacagcgctgcacgcggacgtgccggatcgcctcgacgcggccggcaacgcggcggggttgctgcgcgcatacctgtggcgcgccttcgccacgccacgctacgagtacacgtcggccggccgcgcgctgcaggatttccggggcttgcgcgacgtgctgcagggcaaggccgagcgcgccagcgtgccgatcttctcgcccgagtgggagctgcccagcgttgagcgccttatgcagacggggtggccgaagcggaaggacaccctggcgcgcgcggtgctggccgtatcgctgcgcgagggggcgttcgacttcgcagaccagcgccgggcggaccgggatagcctgcgctcgcgcgagtaccaccacctgttcccggtggcgctcctgcgcgagtacggccgaattgaggaccgcgagatcaaccgcgtcctcaactgcgcgctcatcacgatgagcacgaaccgcaacgtcggggccaaagaaccgatcgcctacctctctgagcgcatcgcccgcgccagcttgggcgaggcggagatccgtgaccgactgcgcacacaccggattccgttcgccgaactcaatgtcggcgggtacgacgatctcggcattgaacgcgccgatcgtgtccagtccgactacgccgcgttcctccgcgcgcgcgcgatccacgtcgaggcggcgctgacggcgctttgcgcggggacgcagccgcaatctatctaa

SEQ ID NO: 7437 - DNA, 2085 bp, Methylobacterium sp.
gtggacgccctcgacgccaagatggaagagctgctgacggccgggcgaatgccgtcggccgcggatttcggcggcctcgaccagatcctgggcgaggcgcaggccgtcgcgcgctcgcattacgcgccggagttcatgtctctcgtcctcgacgggagcgacgacggcgacgcctccgccatggccttcgcgagcgaactcgtcgaacggctggacagcgacctcgccatcaacgccatcgtcgactgggccgctggccggccgccgttgccagcggcgacggagcgccgcttcttcaagcgctggttgtccctggccgacgaccgggacgcggccaccagcgtgcggacggcggcgttgcgaggcgcccttctcatgaagcggcgggacgaacgcctcgcgctccagctggccggctttgttgccgcgagcgaactggatgacgagcccgattacctcgcgcatgccgcgagggtcggcgggttcctccacgcggagagcccgcaccccgggatcgtcaggttcctcgaagacctgctcgccgtgaccgatgccgccgacgaggcagccttcgagctcggcatggaccgggtgggcttggcgctgcggacttcggacggtccccaggtcctttcccggttgcgcgaggcacgcgcacggtttgataccgcctcagccggccgggaggcacgttccgacgcgcgggtgctctcgctggccatcgcgctgctcgacgacttttacggggagcgatccgacggttggcccgagaggctgcaggagctcgccagggaggccttcgcgtactcggcctattacgggcagggggacgacttcctgaacggcgccaagaccgcggaggtcgccgcatggggggcgctcgcggtccgccttggcagcctcgcccccgatcttggcaagcccgcttggtgggacgcggcgcgcatcatcgagggcgagctcctcgcggtctactcggccagtcggaccatcttccggcgaggggaggacggcgggttggaatgggtggtccgaccccgcatcgaggaatacgtcagccagcaaaggcagcagctctacgtgctgcgcgactggctgggcgccaaccccctatccgagcacggggccgctgcaaccgagctcatccgccgcgccgaggccgccctgggcatggagggctcctcggaccctcagccggcggcggccgaaggctcaacggtcgccgccattcttgagcagggggagctcccaatcgagctccaggaaaggatcgtccgcgagaccctcgccgacgtcaacgccttcgagttccgtcaggtgtcgccgcccctgatggaggcggtgacggccgtccatctcaccttcaaagggctgcagtactacgagcagccgaaggtccgggcgatcgtgcggtcgctggtctacaagaccctgctgtttctcgaagaccgcctcgaccttacggcgggcgtggacccggcagtggcctacctcttcgtcgaggagggtcaacccaacccgcacgagaaggccctgcagcaggactatatggcatccctgcgccgctccaggttcgggacggtggacgaggtgcgcggggtcggcggcggacgggccgacgtcgcccatcaggtcgacggcatcaggttcgtcaccgaggtgaagcgcgaggagaaggacgcgtcgttcgcgaacctgctggcgtcctacggcgaccagaccgcactctaccagaacacgaacatcccggtcggcatcctcctcgtgctcgacctcaccacgagcgaggggctccccggtcatatccggaccctctaccatcccgaggtgggcgaactgtttggggacgggatgctgcgtggcgtgctcgtcgtccgtgtcccggcgcgcaagatcccgccgagcgcggcgaccgagagggccaagcgggcaatctcggcggccagggcggagaagcgacgccaggaacgagcggcaaagaaggcggcagcaggcgcggcaggagccaagggccaagggcggaagcggcaggcggccgagcccatcctcaagcggcccgacggcggatccgacgagggcggctga

SEQ ID NO: 7438 - DNA, 1944 bp, Methylobacterium sp.
atggctgacgatccgaagttggtcgacgctgcttccctgctcgcggagatcgcggacaagtcgggacggaccgtggatgaggttcgcggcatcctgagccgtcacggcgtcgcgtataggccgtccatcgccgtccccaagcacctctgcatccggtcgctagccttcaccggggagaaactgggcgagaagtccggcccgatctcgtttgcctgggagaacctcgggcccggcctgatggccatgctcagcgacaggaacttccgagggaagtccaccctcctgggcatgatgaggtggtgcctcacgggccgccgcgaaaacaacatcccgacagagatggcggaatggttcgacgccgtgaggatgacgttcacgctcgacgaacaggcgtacgaagtcgacatctcggacgcaatcacgcctgcgggtaccctttggagggtcgagggcgacaagcggctcgtgcaggcgccgttcggatcccatgaagggttcgaggcggtgatgtcggactttttcatgggccagctcggcctgcagacgatggtcgtccacgtcgagcagggcggcaagggcatcgaccaagcccatcactggccctggctctccggggccttggtgatcgagccgagcccgaagcaccttttcggctcggcccagcaccttcgcgtgcgcatgatgcagatgtaccttggcgttccctgggcggacgccacgagcgatgtgctgtcggcgaagaacaggatcggcaccgagacacgacaggtgacggcggagatcgagcgcacgcgcgcccggcgcaaagctcggctcgccgaactggatgccgaactctcgtcgctgcgctcgaagctggcgaagctgccacgcgaggaagacaagcggttggccctcaggcgcgcaaaccgagaggtcgcggccgccgaggctcggctgcgcgcaggtgagagggcgctcgcggcggttggggaggatctagacgcggcgaaggaggcccatgcggaggcgaggcgggacctaaatgacttcagggacggccgcgcagcgcggcgggtgttccggtccctcgaccctttgagttgcccccgatgtgaggaggtctttgacgaggaacgcagaaaggagacccgtgagcgtcacgtctgcgtcgtctgcggtaccgacgagatccctgagggcaatccggcggcccaggaggctggcttgaaggacgctgccgcccgtgcggctgccgagctccaggcgcagaaaactcgccatgagaaggcccaggaagccgtctcgcaagccaaggctgatggcgagaggtttgagacagagtgccgccgcctggaggccgcgctcgccctgccgtccggagcgggcgccctcgaaatggagatcatgcgcaaggaggcgcgaaaggaggagctggagggcgaggacgtgccggccccggagaccatggacgatacggccgtcttggagatcgccgagaaggtgaccaagcaggccttcaagccgttgcaggaagagctcctcgacgaggtctcggagcttgcccgggactatgccgtccggttcggtgtggagagtctccaaggggtcgagttgcgcggcaactgcaccatggccctgcagaagggaggggggactgcgttcttcggcacccagacggacggcgagcgtgcgcggctcaagatagccacgaccattgccatcatcacggtggccgagcgccgcgggctggggcgccatcccgggctgctgctgatcgattcgcccggggcgaacgagatggtcggccaggactacgccagccttgtcgccggcctagcggagctcgtcgacgagataggtcacatccaagtgttcgtggcggccgtcaacaacgacacgatccgcgggcatgtctctggcaacaacctgcgctacgcttccggggacgaatatctctggtga

SEQ ID NO: 7439 - DNA, 222 bp, Methylobacterium sp.
atgggcggcaaccagcgctcgcatgccatggcggtacatgccgaccggttccggcaaacctacgaggcgcagcccgcgctgttcctccacgtgctgcgcgcgcggctagccgatcgggacctgcggatcggggtgagcagcacgtcccgtttcttcaagcgccacggcatcacgtggagaaaaacaccggccacgcagctgaccagaaacgcgaagacgtga

SEQ ID NO: 7440 - DNA, 2229 bp, Methylobacterium sp.
atgacccagtacctcgtcaggcgcgccaacctcctcgtgctcggtgtcctcatggccatcgtcgccctggtcggcgcggtgacctgggagcgcctcaacgcctcgcgcgcggcccgggagtggtcgcagcacagctaccgcgtcctcagcaccaccaaggacctcgccatcgcgctgcgcgacgccgagcgcggccagcgcggctacgtcctcaccggccgggacgagtacctcggcccctacgacgccgcccgtgaccggctgggcctgctgcagggcgagttgcagaagctgaccgccgacaacctcacgcagcaggagcgcatccgcgccctggcgccggccatccagcacaagctggaagagctcgcccagaccttacaggcgcgccgcgacggcgggctggagaacgccttgcgcatcgtcaacggcgacgccggccgcaaccacatgcgggaagccgaaacattgctcgacggcatgctcggcgacgagcagcggctgctcgacgagcgcctcgcccagaacgacgcccgggccgcctgggtgcgctggatggtcatcgccggatcggtgctggcggtcctgacgctgctctgggcggcccggctcctgaaccgggcgtggtcgcgctcctacgcgaccgaggccgagcagcgggctctggcgcttcgcctacgcaccaccatcgacagcctcagccagggcgtcgcagtgttcggtcccgacctcaggctcgcgaactggaaccactgcttccaggtgttgctcgacctgccgaaggcgatgctgcggccgggcaccgcctacggcagcttcgccgagcacaccggcgaacccggccgccccgccctggagagcgaggaccagatccgccacggcagccgaaatccccgcgaggcggtcacctacgagcgggaaggcgcggacggacaccacctggagatccgccggacgccgatgcccgacggcggcttcgtcctgaccatttcggacatgaccaagcgcgcacaggctgaggccgtgctgcgcgaggcccagaagatgcaggcggtcgggcaactgaccgggggcatcgcgcacgatttcaacaacctgcttcaggtcatcctcgggaacctggagtttgtgcgggccaagctcgacggtgatgcccggctacagcaaaggatcgagcgcgcggcgtgggcggcccagcgcggagcgaccctgacgggtcaactcctcgccttcgcgcgcaagcagccgctcgccccggcgcccgtcgacctcgccgcgacgatgccggatctgatcccgctcctgcggcgcacgctcggcgagcacatcgaggtccgctacgtcgagaccgccggtctgtggccggcgatggccgatccggcccaactggaaagcgccgtcctcaacctcgcgctgaacgcccgtgatgcgatgccgggcggcggtcggctcaccatcgagctcggcaacaaggtcctcgacgaggcctacgcccgtgacaacgccgagatcacgccgggcgactacgccatggtcgcggtctccgacaccggccacggcatgactccggacatcgttaggcgcgtgttcgagccgttcttcacgaccaagcccgacggcaagggcacgggcctcggcctcgccatggtgttcggcttcgtcaagcagtcgggcgggcacgtgaagatctactcggagcccggcgagggcacgaccgtgaagatctacctgccccgcgcggttggtgccgtggccgccgcgccgctcacgggcgcgcccgtcgaattgccccgtggctcggccacggtgctggtcgtcgaggacgaggcgggggtgcgcgagatcgcctgcgcgatcctctccgacctcggctaccgggtgctggaagccgtcgacggcgaggacgcgctccgggtgttcgggaccaacgcggcgtccgtcgacctgctgctgaccgacgtggtcctcccgggcaaggtccgcgggcgcgagctcgcggaacgggtgcaggccctgcgccccgaggtgcgggtactgttcatgtccggctacacggagaacagcatcgtgcaccacggccggctcgacgacggcgtgcacctcgtgggcaagccgttcaagcgcgagcagctcgcccgcaaggtcgccgaggtcctgggaagtgtcgcagcggcgaaggaggctgcgaacgtcgtgcctttgcgcccgctgagggacgcaagttcctga

SEQ ID NO: 7441 - DNA, 345 bp, Methylobacterium sp.
atgaaccgctacgacctgacgaacatgtcgcccacgaagatgcgggagcacatccgcctcgcgaaggacaaccgcagggccatcgaggcgaagcccgatcccgaggccgagctcggcgcgatggtccgcgtctgcgacgtcatgtgggttgtctggccggacaagggcccgggcacgcggctcggccatggactctgcatcgtcaagggaaccttgatgtttgaggctatcgtctcggccggcagcggcgttgccgtcatggagacgacgcaatggttcccgtcgttcgaggctgccttggacgccttcgaccaggacggcgacggattcctgctggctgcgtag

SEQ ID NO: 7442 - DNA, 249 bp, Methylobacterium sp.
atgacgcagcaggccatctatgccgcgctgacgcagatcttccgggacgtcctggccgacgacacgatcgagcttcgtcccgagaccacggccgacgacgtggaggggtgggattccgccacccacatcaacatccttctggccgccgaggagcggttcggcatccggatgtcgagcgccgagatcgagaagctgacgcgcatcggcgcgctggccgacctgatccaggccaaggccggacgcatctga

SEQ ID NO: 7443 - DNA, 1068 bp, Methylobacterium sp.
gtgacggcagccatcgaatgggcgcgcgctcaggtacgtcgtctcgacggcgaaggggaggggggtgttaccgaggtcccaagcgtccgcaccgcagtcgaagcttatgtcgccgcccgctcagcgcgtgctcccgcggcggggagggacgccgagaagcggctcggcaagcacgtcctctctgatcgggtcctcgctgatacgcacctcgcgaagctcaacgcggggaccgtccgggcttggcgacagcgcctatcgggcgagttgcaacccaccaccgtcaaccggctgctgaacgatttgcgcgccgcgctcaatgcagctgcggaacaccaccgtcgcgcactgccggccacgctcgccgccgagatccgcgccggcacgaaggcaaacgcagcagggtcgagcgcgcgcaagcaggtcctgcccgatgccgagatccgccgcctcgtcgatgcggcctttgccgtcgacgacaccggcgatttcgggcggctcgtgctggtcatggcagccacaggggctcgccattctcaggtggccaggatcaccgtgggagacgtgcaggccgcgcgtggtcggatcatggtatcaccctcgaacaaggggcgcgccggcaagcgcccgacgccgatcgctgtgccggtcggagccgacgtgatcgagcggctccaagtcgcccttgccggccgtcgagggcacgagccactcttgttgcattggcggcatcgacaggtcgggcccgttacctgggagcgggtcgatcgggcgccttgggccacagcctcggcagcgctgcgcctatgggacagagcccggactcgcgcagaggcgcctcctgggacagtcatgctgtgcctgcgccatagctcgatcgtacgggcgctgagtgccggcgtgccggtgagactcgtcgcggcgttgcacgacaccagcgtgcagatgatcgaagcccattactctgcctacatcgtcgaggcgacggaagagattgctcgccgcgccgttacgcccttggcaccaagcaccgttgccgcccttcgctccgttgacgaagctgcagcatga

SEQ ID NO: 7444 - DNA, 315 bp, Methylobacterium sp.
atgaagacgatttcgacgacgacgatgatggtcgcaggtctcgcgctcgcgacgctggccggcggtgctgccagcgccgacgcccgcgggttcggtcacggcggcttcggccatcagggcggttttggccatcgcggattcgggtacggcggatttggccaccatcgatccttccaccaccgtggattccgtcggcgcttcggcgggttcaactgggattatcccgcaggcagctacttcctcagctcggatttcggggattgccgcttcgtctacaaccctttgttcttcggacacgagcgcgtctgcagctga

SEQ ID NO: 7445 - DNA, 288 bp, Methylobacterium sp.
gtggcggccgtcttggtagccggtggcggcatcggcgtctcaccaacttacatcgctgctccgtacgtcgagcagggcgtgctggtgccggtcctgcaggaattcgttgtcgagcgttccgtaatcacggcgctatggccggagagccggcgcggcaacccgaacgtgaaagccttcctggttttcctcggggaggtgtttccgtccccgacaccttgggacaggttgctctccgcacgggtcggagacaagcaggatgccagcccgatgggcgcgaggcccgcatga

SEQ ID NO: 7446 - DNA, 210 bp, Methylobacterium sp.
atgcgtctcatcgccgtcgcgttcatcggcttggtcacggtcgcgaccgtaccggcccgggcaagcggcggcgacgcggcccagcgcatgctcgacgccatgacccgccacgacctctgcgcgcgcgacgacgcacagttgcgcaagctgaaccggtctctggccgcgacgccgatccgccatccggctgccgggacgcgagcacagtag

SEQ ID NO: 7447 - DNA, 846 bp, Methylobacterium sp.
gtggacaacccgacggccagcactgcgaccatccccgtgaacatccgaccttcgccccccatcgacggcaacctgctgctcgaagccctcgacgcggccgaccgcgccctcctggcaccgtacgccgaacgccgagaggtccggcgcggcgacgtgttgttccgtgccggcgacgacgtcagtcacgtcaccttccccgcgcatcattgcgtcgtcaccttgttggtgccgctcatggacgggaagtccgtcgagaccgccacggtcggtcgcgagggcgcgatgggcggggtcgtcagccacggttacctaccggccttcgggcaggcggtcgtccaggtcggcggcccggtcatccggatcgacgccgcgcgtctgtcggaggccaagcaggcctcgaagggcatccgcgacctgttcgtgcgctacgccgactgcctgctggcgcaggtcctgcagtcggtcgcctgcaacgccgcccacaccatcgagcggcgctgcctgcgctggctcctgaccctgcaggaccggatcggcacgcccgaactccctgtcacccacgagctcctggccgacatgctcggggtgcgccgcgcctacctgaccgaggtgctcgggcggatgcagcgcgaccgcctgatcaccatcggccacggacgcatcacccttccggacagggagcgcgccgaggccggctcgtgcgagtgccacgccgccgtgcggaagcacttcgaggaggtgatgggcgccgtctacgccccgagcggccgcatcgtcgccgtcgacgtcggcgagccggaacggctgcgtcccccgtccgtgctcgtgaaggacgcgaccccgtga

SEQ ID NO: 7448 - DNA, 528 bp, Methylobacterium sp.
atgcccaccatccgccggccctcgtggcgcgcccgcaagatccacggctacgacgtcgagtcgttcaagacgcacgacaaccgcctgctggaagtggacgatcagttcaggatggcaaacctgacgcctgaggctagagccctgtttctgcggatgcggctggacatctacttcatccgcaggccgaagggccagcaaatcgcgaccttgatcaagatcgacgccaaccatcaggagacatatgacctgctcaatggcttcgacagcaagaacgctcctctagtacacatcacggcagacaataaggatcgtccatggaatagccgcccacggggtgaggggtttggggtgatcatgtatggcgcataccattactcattcgtcagtggacacgtgaagtcctacatgaacggaaaccctgagtggctctgggatgcggtgaagcgtgcgttccgctggcacgacgcttccgagcaggacaagcgggccatcgatgccgtcgcggacgcgtttcgcgcggaactgtga

SEQ ID NO: 7449 - DNA, 1485 bp, Methylobacterium sp.
atgaggctgaatttgatgctgacggaggggctcgccttcgcgtcggccaccgaactggtgcggcgcctgaaggcgcgggagttcacggcgcgcgcgctgctcgagttccaccttgagcgcgtggcgcggctcaatcccgagatcaacgcgatcatttacaccgaccttccggccgcgcgggaccgcgccgacgcggccgacgccgccctggctcgcggagaaatctggggaccgcttcacggactcccgatgaccgtgaaggaaacgaacaatgtcgtcggttggccgacgacctatggcgatcccgtcctggcggaggcgatcccgacgcacagcgccgtcatcgttgagcgactgcaggcggccggcgcgatcatcttcggcaagaccaacgtgccgatcaacgctctcgactggcagagctacaacgcgatctacggcacgacgcgcaatccctgggaccgcgaccgcacgccgggcggctcgtccggcggctcgagcgcggctctggccgcggggctcgtgcccctcgaactcgggagcgacgccggaggctcgatccgcttcccggcccatttctgcggggtctacggccacaagccgacccccggcatcgttcccgtcgccggcaacgagcgcggggcaagcctcctcgacaacgacctcgtggtgagcggcccgctcgcccggacggtggctgacctcacctgcgcgctcgatgtcctcgcgggaccggcggggccggccgccaaggcctggcgcctagacctcccggcaccgcgggcgacgcgcctcgccgaattccgggtggcctacgtgaccgactcgcccgtcgccgaggtggacgagccggtccgggccgcgatccgggccctggccgagcgcctcgcgggcctgggcgcccggatcacggccgacgcgctccccttcgacgatcacgccgcgcatcacgcgacctatctccagctgctgcgcggatcggcgtcggcccgcctcccgcaggcggtgtacgaggaggccgtcctgcgcctcacggagccgggtacgaacgcgacgccctacgtggcgcggatggcgcaggcgcacgcgcagcgccaccgcgactggatcctggccgaggagcgccgggccgcgctgaagcgggattgggccaccttcttcgagcgctacgacgtgctcctcgcccccgtcacggtctgcgccgccttcctgatcgacgaggcgcggccgcgggaggagcgcgtgcttcagatcaacggacacgcggtcgactacaacgaccagctgttctgggccgggctggcgacgctgccgtccctgccggcgacggcggtcccgatcggctatgacggccacctcccgatcggcatccaagtgatcgggccacatctcgaagaccggacgacgctcgctttcgcggccgaactcgaacgtctgcatccgttcgcgccacccccgcgctacgcgccgtccactggccggtga

SEQ ID NO: 7450 - DNA, 795 bp, Methylobacterium sp.
atgacggccgcgcccgcttccgaccatgtccgcctcgaggccgtccgcttcacctatggcgggtcggccggagcgcccatcctcgagaacctatcgctctctgtggaggagggggccttcgtagcgatcctcgggccgtcgggcggcggcaagtccacggtgctgaagctcctgtccggcctggtccggccgcagggcgggaccatccggatcggcggcacgccggtgaccggcccgcgtcgggacgtcggcatggtgttccagaagccgatgctcctgccgtggcggagcgtgcgcgacaacgtcctgctgccggccggcttcgcgcgcgcggcctctgcgcgcgaggtcgcgcgcgccgacgcgttgctggagacggtcggcctgtccgacagcgtgaagctctatccgggccagctatccggcggcatggcgcagcgggtcgggctggcgcggatgctgctgcacgatccgcgtctcctgctgctcgacgagcctttctcggccctcgacgcgatgacccgggagcacctctccctggagttgcagcggctctggatggaggagcgccgcacggcattgttcgtcacccactcgatccccgaggcgctgttcctggccgaccgggtcgtcgtgctcgcggggcggccgggccgcatcctcgccgacatgccggtgcccctgccgcgaccgcgcaccctcgagacgctcagcggcgcgcagttcgggaccctcgcgctcgaactgcgccggctgttcgacgaggccgcccggcccggagcccgcgccgcatga

SEQ ID NO: 7451 - DNA, 1089 bp, Methylobacterium sp.
atgtgccgcaagtccccgccgctgctccgagcagctgctgcgacggtcgccctgagtctctacctctcggcgccggtgcatgccatcgaaagcgtcaaggtcggcctcgccataccgccgacggtcaccgacggcagtgtccaggcgatcgccgacgaactcgggttcttcaagcaagaagacctggacgtcacctatgtcgttcttcccggggccggcgcattgctgccgcagctgctgcagaagaccatcacgatcggcctgccgctgcccgagaccctgcttgccgcgcacaaggccggcgagccgccgctgccagtcgcctacttctacaatgccgggccccgcaacacgctcgaactcgccgtccgggccgattccggcatccgcagcctcgccgacctgaagggcaagcggatcggcgtcggggccctgacctggggcacgatcccccagacgcgcgcactgatgcgctcggtcggcctggagcccggacgggatgtcagcatcgtggcagccggggtgctcggggccggcttccacgcgcttcgtgaggaccgggtccaggcgctcaacttcaacagctcctggatcgatataatggaggaccagggcattccggcgcgccggctggactatccgcccgtcttccggcgcatggtcgtcaacgggttcctcgcgcaccggtcgacgctggagcagaaccccgcgcttctcgagcgcttcgggcgtgcctggacgaaggcgctcatcgtctgcgacctcaacccgaaagcctgcatcgaggcattctggcgcaagactccgtccgtggctccgcaggcggaccgcgacaaggccctggatgcgagtgcccggctgctcaggcggtggatcgagccggtgatgcgggacgagtccggcgccgcccgcgtaccgggtgccttcgacctcacgctcatcgccgcctatgtccgcgagatgcatcgttacggcgagttcgcgacggccgacctgcccctggacgcctatttctcgaacgccctcgcgccgggcttcgcccggttcgaccgcgcggccctcgcggcgcaggcgcgcgcactgcaatga

SEQ ID NO: 7452 - DNA, 165 bp, Methylobacterium sp.
ttggagccgaaggacatccgccggacgatcaagggctggcggcccgaggaacactaccgggtcacctcgggcttctacgactgcgacatcagcctgcgccgggcctaccagctcgctgccgccgtcgggcttaagcggaccaagacccttccctggagcctctga

SEQ ID NO: 7453 - DNA, 1482 bp, Methylobacterium sp.
gtgcgggccgtgctcgaagccgagatcgtcaccctcgatccctatttcaccacggcctacatcacgcggaccttcgggttcatggtctacgacacgctgttcgcgccggacgcgaagggccaattcaagccgcagatggtcgacacgtggtcggtgtcggacgatcgcctgacctggcgcttcaccctgcgcgacggtttgcgcttccacgacggcacgcccgtccaagccgccgactgcgtcgcctcgctgaagcgctgggcggcccgtagcgcgctcggcggccggctcatggacgtggcggccgccctcaacgccgtggacgacaggacgttcgtgctcacgctgcgggagccgtacggcctcgtgctcgacactcttggcaccacgtcgagcccgacgcccttcatcatgcctgcccggctcgccgcgacgccgcccacgacgcagctcacggaggtcatgggatccggtcccttcgtctacgaccgcaccgtgcacatcaccggcgaccacatgctgctgcgcaagaatcccaactaccggccgcgttccgaaccggccgatttcctcgccggcggcaaggtcgtgaaggtcgacgccctcgacatccgcgttatcccggacggtgcgaccgccgtcggggccctcggcgccggcgagatcgatctcatgcagtacgcgcccttcgatctgatcgagcagatcgagcgcaacaagaatctggcggtgatgaacttcaccggcccgcaccgtttcacggggcattacaggatcaatacggcggccaagcccttcgacgacccggcgatccggcgcgtgctgctccgcctcgtggatcagcgcgaagtcctggacgggttcggcctcgacccgcgcttctcgcagacctgcgacgccttcttcatctgcggctcgccctacgagacgcatgtcggggccgagctcctgcacgatccgtccgtcgcggcggcgcgggctgccctgaaggcgaccgcctacaagggcgagccggtgatcgtgatggcggccaacgacctcgaggcggcgcgcgtctcctccacgatcctggccgaccggctgaagcaggccggcttcaccgtcgatctccaggtcatggattgggcggccctgcttgcccgtcgcaccaagaagaccggctggagcgttttcggcattcacgccctcggcctcgatctcagctcgccgctgacgaactcggcgatcaacttcacctgcaaggatgcggcgagttccgggttcatgtgcgacacgcgcatggtcaggttgttcgatcggttcgcccgcgagccggatccggacaagcggcgtgacatcgccggcgagatccagtccatcgtctacggcgaaggcctggtcgtacccttcggccagttcgcccagccggcagcctaccggacctccctgaccgggctgatcccgtccgccatcccgctcttctggaacgtcgagaagccatga

SEQ ID NO: 7454 - DNA, 225 bp, Methylobacterium sp.
atggcaagaaatcgcgagccgaccattgccgagatcgagcgcggcgtcgtcttcatggcctacgtcgtggagacctatggcgagcggttcgcgccgatcctcgacagcctgatcgttgacctagagggcgccaagcgtcgcgatagcccgcatgagcgagcacgtcggatccttgatcaggctgaagccgatgggatcgtcgtcccccggcggtcgaagcaatag

SEQ ID NO: 7455 - DNA, 906 bp, Methylobacterium sp.
gtggaccggtatcaggcgatggccaccttcgtgcaggtcgtggaatcgggctccttctcgggggccgcccgactcctgaatgtcggccagcccgccgtctccaagacgatcgcgcagctggagaaccggctgcaggtcagcctgctcgtccgctcgacgcacggcctgagccccacggaggcgggcctgcgcttctacgagcgggcgcgggcggccatcgcggaggcggacgaggccgagcgcgccgcccgcggcgcgggggccggtctctcgggacggctgcgcgtctcggcagcgaccaccttcgcccggctccacgtggtgccgatgctgccgcgcttcctcgccgagcacccggacctcgacattgagatcgtcctcgacgaccgggtgatcgacctcgtcggcgaggggatcgacctgtccctgcgcatggggactttgccggactcggccgccgtcgcgcgcaagctcgccaccgggggccgttcggtgctcgccacgcccgcctatctcgcccgcgtgggcgaaccgcgcagtcctgcggacctcgccgggcacgaggcggtggtctacagccggcagcccgatgcctggtccttcacccgggacggcgccgagatctcggttgcggtgcatggccgcgtccgggtcagcgcggccgaaggcctgcgtgcggccgtgctggccgatatcgggctcaccatcgcgtcggactggatgttcgcccccgaactggagagcggcgcggtccggcggctgctgcagctctgggcgttgcccatgatcgatctctgggcggtcttccccaccggccgcatggccagcgccaaggcgcggctcttcgccggcttcgtcgaggcggtgatggccgagacccgggagccccattccgcgacggcataa

SEQ ID NO: 7456 - DNA, 891 bp, Methylobacterium sp.
atgacgaagtcgatgatgctggtgacgggggcgacgggagagaccggtcgctgcgtggtgcgggaactgtcggatcgcggccacccggtccgcgccctcgtgcggaccgaggatgaccgtgccgcagcgctcaggagggccggcgccgaagtcgtcgtcggcgatctcctgaaccacgacgacgtcatccgcgccgccgacggcgtggaaggggcgtacttctgctaccccgtccgcccgggtctggtcgccgcgaccgcctatttcgccgaggccgcgaagcgggcgaacgtcaagctgatcgtcaacatgtcccagatctcctcccgcgaggactcggagagtcacgcggctcgggatcactggatctccgagcgtctgttcgactggtcggaggtacccacggtccatctgcggccgaccttcttctcgcagtggttcctgtatccgttcgcgcgcaagacgatcgtcgaggacggcgtgatcgacctgccgtacggcgaaggccgccatgctcccatcgccgcggaggatcaggcgcggctgatcgcgaccatcctcgcggctccggacgggcacgccgggaagacctacacgctgcacggtcccgtcgagctcggtcaggcggagatcgcccgtgccatcggcaacgttctcggccgcgacatccagtatcggccgctcacgatccccgcctaccgcgagcggctggagaagttcggcctccccgagcacctgatccagcacttctgcgcgatcgccgtcgattaccggaacggcatcttctccgggaaggacggcatcatcggcgagctgactggcaaacctccgatgaccgtggaggagttcgtcctcgcgcaccggcaggccttcgagaggacgcccgcctga

SEQ ID NO: 7457 - DNA, 543 bp, Methylobacterium sp.
atgacctcgaccgacacgaagccggcccgcaaggccggctccgccagggccaccgccaagcgcggcacaccggcggccatcgagatgcgcaagccgaaggtgcacctcgatgcgattgataagatgaaccgcgaggaccgcgcccgcatgatcggactcggtcagctgatctggggcgaccgctggcgcaccgagatgaccagggctctcggcgggcagttgggcaggaagatctcccctgtgcaaatggctcactggatcagcgggacgcggcctattcccgacaaggtcgtggcggtgctgtctcgcgtcgcgagaagcatggtgaacaccatgcagagccgggtcgacatggtcgctaacaacgactggtacttcgccgtggaatgcgacgacgaaagcgtcgtcgttccggcgcgctgggaaaggcgcgtcttcaatgaggccccggatgggcggacccgcgtcatcaccggaaaccacttcgaggacacctggatcgacctgaaggcgaagcctgcaacgggggatggcgatgcgtaa

SEQ ID NO: 7458 - DNA, 897 bp, Methylobacterium sp.
atgatcgagcgggaggacgtggactttccggccgaggatgggatcaggctgtcggcatggctgtaccggccccaccgcgccgccggacccgcgccggcgatcacgatggcgcacggctacgcaggaacacgtcatcacggcctcgactccttcgcgcgcgcgttcgcggaggcgggtttcgtcgtccttctgcacgaccatcggaatttcggtgcgagcgggggcgagatccggggcgacatcgatccgtggcagcagatcgcggactggcgtcgcgccatctcgtttctggagacgcgaccggaagtcgacccggcccggatcggtgtgtggggaacgagctacgccggtggacacgcaatcgtcctcggcgcgaccgaccggcggctacgggccgtcgtcgcccaggtcccgaccatcagcggcttcgagcaaggccttcgacgcgtcgcacccgatgccgtcgcggccctggaacgcgtcttcgcggacgacgagcgcgcacgcttccgcggcgaaccgccgagacgacaggcgatcgtttcggacgaccctgccgtcccggcctcgtaccgtgcgcccgacgccgtcggcttctacctccagcccgtgccggccggagcctgggagaactcggtgaccgtcaggtcgacccgggccgcccggatgtacgagccgggcgcatggatctcccgggtctcgccgacgccgctgctcctcgtcgtcgccctggaagacaccatcacggtcacggatctcgccctggccgcctttgagcgcgccctgcaaccgaagaagctcgtgaccatccccggtggccacttcgatccctacctgtcccggttcgacctcgccagcaacgccgcggcggagtggttccgtgagcatctcgcctga

SEQ ID NO: 7459 - DNA, 864 bp, Methylobacterium sp.
atgacccgcccccagaaagtgaacctcctcgccagcttttcccccgtcatgcgcgcggtcacccgcgccctgctcaaggggcacgccgacaacaagacccatgccaccaacgtcgtccgtagcctgtccaagcaggacacatcgggattcgtgatgacccgccatctcgacgaggccctggcgctcgccaccgcctgtcggaagcgccaccgcgccaagccgggatacggcagcggccgaggcttctgctcaatcagcttatacggcattcgcccgaggctgcagcggaacgcggactacacgcgatcccatgatcgcgtgcggctcgcgctgcgcctgcagaagccgatccggactcggctgaaggacctgcgtgacgagatggtcatcccggcggccaaggccgtcatgaagcatggcgcgccgggcggcaccgtattcctcgtgaatgtcgagcccgaggccgagtaccgggtcgagacggaaaaggaatgggcccgcgtcaacgcgggtaaggacacctgggctcgcctcgctgacacccattacatcgccgtcaagccgacctggattggagccgttcggaaactcggcaccgccaccgtcgaccgattcttcatcctcgatgcgacgcccttcgtggaggcgcccggccggtccgtctggaccgcgctcttggcccgcaccggacgcgggtaccgagcggtcaccgagcaggcgttcccctcggtctacggcgcggacatcaccgtccacgggactttgcagcgggccttgagcgccaagcctcctgccgagcccgtccaggccaggagcccgatcccggccgaggatctcgaagcccttgacatcgccttcgcctaa

SEQ ID NO: 7460 - DNA, 657 bp, Methylobacterium sp.
atgcggctgatcgcaggacgggccgccctcgtggtgatcgatccccaggtggatttcatgagcccggaaggagcggcatgggccctggtcggcgagagcgtgaccgagcagggcctgatgtccaatctgacggcacttttcgaggcggccaaagacgcccggatgccggttttcatctcaccccactactactacccccacgaccacaagtgggagttcgagggacctgccgagaccgtgcagcacaagctctgcatgttcgatcgacgaggccccctcacgctcgagggctttgccaactcgggggccgagtacatgccggagttcaagaagttcatcgaggacggggagaccatcgtctgcgcaccccacaaactgtatggaccgcagggaaacgacctcgtgctgcagctgcggaagcggcgcatcgatcagatcatcctggtcggcatggctgccaatctctgcgtggagtcccatctgcggcatctgctcgaacaaggcttcgaagtggccgtcgtgcgggatgccgtcgccgcggccaaactgcccgacggagacggctacctggcagcgctcataaatttccgcttcctcgccaatggtctctggaccacgtcggtagcgcgggaacgcatcctgagtctcagatcctga

SEQ ID NO: 7461 - DNA, 621 bp, Methylobacterium sp.
atgttcgacaacctcatcaaggcctgtcccgacgaactgttccttgacctaggctgtggctaccggcagcgcatgttcgagaactgcctatacctagaggtctatccctcccgctcggccgacctaatcgtcgagccgaactgcctctatccaatccggtccggcaccttgtccggcatcggctgcttcgccgtcctcgaacacacccgcaagccctggctggtggttgaggagatggcgcggatgctcaaaccgggcggcagggccttcatcgactggcccttcctgcagccggttcacggctacccctcgcatttcttcaacgcgacacgagagggtctggtcagtcttttcgaggacaacggcttcacgacggaccaggctttcaccggcgcacaccagaccgctgcctacacggtccaatggattctggcccggttctgccatcatctgtcggatccgaagctgcgccgccaattcacccgcatgtccgtgaggcagctggtcacgatggaccggcaggacccgctgtggtggaagttcctgaacgcgcttccgccggatgctttttccgagctggcctgcggcaacatgctcgtggccaccaaggtggcttcgtag

SEQ ID NO: 7462 - DNA, 144 bp, Methylobacterium sp.
gtgatctccgctgaagagttccgtcggctcaccggagcggcgacgggccagtcgctgatcgatgcgctgcaggcctcaccccaccgggatatcgatctcgaacccgaatctgtggtgatgccggtccgcgacgtcggcttgtga

SEQ ID NO: 7463 - DNA, 675 bp, Methylobacterium sp.
atgaccctgcaatccaagctcgacgcgttcaaagccgatttcgaggccggcaagcccccctacaccgtcccgccctcggtgatccggacgatgcaccgggccaccgcggaactgatcgccaccggcgccgcgacccgtgccctcagggccggcgaccgggcgccggcgttcacgctcaacgacccggaggggcggcccgtctcctccgacgcactgctggcgcgcgggccgctcgtgatcagcttctaccgcggcgtgtggtgcccctactgcaacatggagctccgggcgcttcaggaggcgctgccacaattcgagaagctcggggcgagcctcgttgccctctcgccgcagacggcggccaacagccggaagtcggtccgccagaatgcccttgaattcctgatcctgtcggacctgcacaacgccgtcgcggccgcgttcggcctgcgcttcgcgctgcccgattatctggtcgatctctacatgagcctgaagaacgacctgccggcgttcaacggcgacgcgagctggaccctgccgatgcccggacgcttcgtcgtcgggcaggacggcgtgatcctctacgccgaggtgaaccccgactacacccgccgtcccgagcccgaggacatgctgccggcgctccgccgcgccgcctccattcccgcctga

SEQ ID NO: 7464 - DNA, 636 bp, Methylobacterium sp.
atgttcgaggtctatgccttcgccacgcccaacagcatcaaggtcctcatcgcgctggaggaactcggcctcccgtaccgcctccacggcgtgaacgtgcgtcagggcgagcagaaggcgcccgaattcctggcgctgaacgcgaacgcgaaggtgccggtgctgatcgatccggcggtggccgatggccggctggtcctgaccgagtccgcggcgatcctggtctacctcgccgagacgagcggccgcctgatgccgccggacggcgaaggccgggcgcgcgtgttcgagcagctgttcttccacgcctccgggctcggcccggccttcgggcaggcgggcttctttcaacgccaggccgcggagccgcagccgctcgccatcgcccgcttctcggcggaggcgaaccggacgctcggtgtactcgacggggtcctggccgaacgccgccacgtcgccggcgacgccttcacggtggccgacatcgcccatttcggctggctctggcgacgcgacttcgcgggcgtgagcttcgagaacacgccgcatgtcgcccgctggtacgacgcgatggccgcgcgtcccgctgtccaacgcgcgatcgagcgggtgaacgcgctcgtgccgcaggcctga

SEQ ID NO: 7465 - DNA, 771 bp, Methylobacterium sp.
atggcccgtttcgagacctaccgcgacgcgttccccaacgcccgcctgacccggaagccgaacggcgtgctggaggtcatgctccacaccgagggcggcaagctcgtcttcaacggtcacacccacgagcagttcgtcgacctgttccacgcgatcggcgaggaccgcgacaaccgggcggtgatcctgacgggggcgggcgacgccttcatggacgcgatcagccccgagggcttcgatttcttcacgccgcggggctacgacaagattctgcgggagggccgcaaggtgctcagcaacatcctcgacatcgaggtgccgatgatcaccgcgctcaacgggccggtcctgctgcacagcgaatacgcgctgctcaccgacatcgtgctggccacgcccgagacggtgttccaggacaagccgcatttcgagttcgggatcgtgccgggcgacggcatgcacatcctgtggcccgacgtgatcggctcgatccgcgggcggtacttcctgctgacgcggcaggtgctggatgcccagacggccaaggattggggcgtggtcaacgagatcgtgccgcaagaccggctgctggcccgggcgcacgagatcgcagacgacatcgccgccctgccgccgctcaccggccgctacacgcggatcgcgctgacacagcgcctgcgccggctcgtcgaggagggcaccggctacggcctcgccctggagggcatcagcgccgccgacgtggcccggaccatggccgcccagaactga

SEQ ID NO: 7466 - DNA, 159 bp, Methylobacterium sp.
gtgcccctccgtgatgtcatcgggcgtgcgggattctgcgcgctgctgctcgccgccgccccggcgcgcgccgccgatttcgacggcccctacgcgccgcacggttatggcggcccggccgagagctacgagcgcgagcggcggcccccgcccccaccc

SEQ ID NO: 7467 - DNA, 123 bp, Methylobacterium sp.
atgagcccgcacgactatacgtggctcctattcgccacccccgccgccgtcgccgcgatcggcgccctcgtctacttcgtggccatccggcaggatcggcctgggagccagcacggacgctag

SEQ ID NO: 7468 - DNA, 465 bp, Methylobacterium sp.
atgctgctctccgcctttctcgccggcctcgtggccggttcgcgcgccctgctggctccaaccgccgcgagttgggcggcctcgttcggcttcctggatctctccgacggatggctcgccttcctcggctatcattggacgccgtggatcctgagcctcgcctgcgtcgtcgaactcgtgaacgacaagctgccggccacgccaagccggaaggtgccgccgcagctcggcacccggctcgtcatgggcacgctcgcgggtgccgcgttcgcgggcgaaaactggcatctcggtgcgctgctcggcatcgtcggagccctcgtcgggacgttcgcaggtgccgccgtgcgcgggtccatggccacggcgttcggaaaggatctgcctgctgcgctgatggaggacctggtggccatcgtgctcgccgtcatgctcgccgccacggcaggccacgtcgtcgcctga

SEQ ID NO: 7469 - DNA, 771 bp, Methylobacterium sp.
atggccacgcgcaagccggacccccgacaaatcggcttcgagttcacgatgcccgcgctcatcacgccggtgcctgcatgggtgcgtgagatcttcaagcccgaggcgctcccatcctatccgcttcacatccccagcagcgccgaggaggccgaggccatcgctgccatcccgttcggccagcgctgggagaaccacgttgccgtcggcgccgtcccgttcggccagcgctgcgagaaccacgttgccgtcggcgccgtcccggagcgcatcgaggtccccctgccgcggaagaacaggctagatttgagcatcaccgggacgcgtctcggttggacggcgggctatcacctgacattccgccgaccggtcgggcccggcgcgaatcctagggccggaaccggtcagttcggcgagggctgcggcggggggcttcacgccgacgtcaacgagcacggctactttctacggacgtcccgcgacgcagctctgcgcacggccgcccatcgggcatggtgggcgtgctggaagctggacgagaagatcgcaggcgaggtcgagcgcgccgtgctgagagctttcgggttctccaaggttcaggccgccgggcacgaccacaggcgctggctcgtctcgcgcgccgacggggacgccagcctcgaacagcggaggtcccagccgcgggaggacgtcccggagagccctgccatcgacgagtaccggcgggccgcgggcctcagcgataccgccgcttggagtgccgccgcatga

SEQ ID NO: 7470 - DNA, 1872 bp, Methylobacterium sp.
atggccgaaatcacccagagcttcagccagctgctcctgacctatgggccgggcgccatgctggacttgcccgatcacgctgttgttgtcgccgggctccagggctggcgatatgccggcggctgggacgaactgcgcgaagaccggctcgtacccttgctgcgccagcagctcgctgggaagatcagccccacctttcacggcttgcgccgcccgcccgcgcaggacgaggagcgccacgatccgaacgcacctggggtcgaggtggtgctgttcccgacttggttcaccgccgacgaaggcgacgccgccgagccagccgagggcagtggacccgcccgcgcggagaagcggcggcgcatggtgacctattccgaccttagcgtcacccaaggcggcaagctctcctacggaggaggaggccgcaaaagtcccgtcaacccaattcgtttcgttgctgcttgcccgcgcggccacttgcaggacatcgactggcgcttcctcgtccaccgcgggcgcgacggcacctgtcggaaggagatgttctgggtcgagcggggcgtgagttcggatcctgccgacctcttcgtgcgctgtacttgcggcgcctcggtctcgctcggcgatctttacaagccaaaattcctagggaggtgcggctgtcatagcccctggcttcagccgaggcggcttgcggaggaggtctgtgagaccgacctccggttgctgccgcgctcagccacgaacacctatttcgcccagactgtcacggtgatctcgctcacaagcgagcacagccgggtgcgggaggtcattcagcagcacggggcaatgattgagagcctgcggcctctcccgaacttcctcacagtccttcggacactcccggctactaaggaagccttccaagagttctccgatgacgacatcacgcgggcgctcgaggaaggcgacgctggcgcagcggcctcagccccgaacccccgcatcgcagagttcgatcttctagcctccggtaagccaacgatcggcgaagaccgggagggatccttcctattcgctgaaaccctcgaaagggaccggctcgcgctcaccccgccctggagcgagcttctgcacggggttgcgcgtgttcaccgcctgcgcgaagtcacctgcctctacgggttcacgcgcttggagccgccgccgaccggtgctgagagcgagctcgatgagatccagctttctgtcgatggcgccgacctcgcgcgcgacgtggagtggctgcctgcgatcgagcagtacggcgaaggcatcttcctccacttcaagccggacttcctgaaagcgtggctggcgcggccggaggtggccgatcgggcgcaggtgctgcgggatggcgaggcccgcgatgctcgccgcttcaaccgcgagccccggcacctagggattgcctattgggcgctacactcgctctcgcacgcattgctctccgaactcgcgctcgaatgcggctatccgctctcgtccctgaaggagcgcatctatgccagcggtaccgggcaagccaaccgattcgggcttctcatctacacctcaaccgcgggcggccagggcacgctgggcggcctgagcagcatggccgagcaggtgccgcatattctcgaacgagccgtgaggcacctcgtgctgtgctctaacgacccgatctgcgccgagcacgggcccgagaacgatcacgacgaccgccccctgcatggggccgcctgccacgcctgccttctcgtgccggagacctcctgcgaggcacgcaatacccggttagatagaggtcttctcgtcgaaactgttgttggggctgactattcgatgttcgatgtttcgagatag

SEQ ID NO: 7471 - DNA, 3444 bp, Methylobacterium sp.
atgcgtcgcgacctcgtcggcccgcaccccgactgcgatggcgacctagcgcgcgaggtgctggccggcatcagcccttcgacgtggtacctcactggttatctcgggccgcgccggggcatgagggcgcccgcacccatgaagggcgctgcagcagacgaggaggcggccgaactcgggctcgcggcgcagcgcgccagcgagggcatggagcagggagcgcccggtcccggcgcagcggcagatgacggcgccaccgagcgcccgccggcccgctccttcgagccctcttccctcggtctcacggtgcttctgccgcgggacataaaggaggtcacagcgcgcgtcacgtggggcgattacgtcaccgagccgccactcgacctcgcggtggtcgtgccctccgcccggatcgccgctgcagcaacgggcgagctcccgaagactccggaggccggtaagctgcactggcggcgcatcccgcgtgaggcgcacatcccgatccgactcgacgtacaccggaacggcgcaccgcagacgataactattcccgagagcgccgccccgcaggtgccgggcggcgggctgcagcttgtcgtctcggctcggccgacccgcacagccggcatcgacggggtgcaccgcgacctcacggctttgtcggtgttcctggtgaacgccaggtccgaaacgctgcgccgcttcggcgatgtcgccttctgctttcaggctcggctggaactgagctgcgagcagggcttcgccgcgcgagacgaccgggcgtcctactcggcggaggaattcgacgagcgcctcgccgacctacactaccgggacgtctgctccttcgcagtgggccacaatacctcgggcgattgggcggagccggacgaagacgggcgggtaaggcgggtcttcaccaatccgcttccggtgcaggaagttgagaaactcggcgccgacattgacctgcctggggtgacgcgcggcatggaggcactcgcgcaagccgcgggcgactccgcaacgctcagcgcggccctcgcagctcttccggacgagtacgcggtctgggcggcgggacaggccgcttcggtcgcggccatcgaaggccagcgccgtcaggcggttgcccgcgagtgcctggagaacatcgcaacggcgcaggctcgcatcgcgggtggtctcgcacatctgttgagcgatcccgtcagccgcgaggccttcgccatcaccaaccaggtgatggcccgcgccaaccgccaacgcggcatgacgctgaatggcaagccgccggccgagcaacgggcgccgacgtggcgcctgttccagctcgccttcgtactcctcaacctcgaagcgctcgccaagcccaaccatccggatcgacctgtggtcgacctgctgttcttccccaccggtggcggcaagacagaggcctatctcggccttgctgccttcgcgatcgcccggcggcggctcagccaccctgggctcgacggggccgggctgtcggtggtgatgcgctacaccttgcgcctccttactctcgatcagctgcagcgtgcggcaggtcttgtctgcgcactcgaattggagcggcgcgcgagcggacggctcgggacgtggccgatcgagatagggctttgggtgggcggcgctgcgacgcctaatacgctgggtagctccaagaacgtcaaacctggcacagcggtacattggcaccgcgagtaccgcgccaaacgcggcccggcacctgctcctctcaaggcctgcccctggtgcggtacctcgctgaagccggaaagcttctatctctacccgaatggcacggcgccgcagcggctcgatatccgttgcgacgacgtcgactgcgccttctccagcagcgagcgcctgccgatagtggtggtggacgatgagatctaccgccgcctgccggccttcatgatcgccacagtcgataagttcgccaatgtaccctgggaaggccgtgctggagccttcttcggccacgtagagcgagccgacgcgacgggtttctacggcgctgccgagccaggcggtggcactccaatgagcgcgcccttgcgcccgatcgaccttgtgatccaggacgagttgcaccttatctcgggaccgctcggaacggtcgcgggcctctacgagactgccttcgatcttctcgcctcgcgaaccatcgatgaggtacggcgcggaccgaaaatcgtcgcctccaccgcgacggtacggcgggccgaggcacagatccgcagcttgttcggtcgcgctcgcacggcgatctttccaccgcccggcccgagccgccacgactccttctttgcgaagaccgatcaggagagcccatcgcggctctacacggggatcgcctcaccggggcgagggccgaagctcgtcttcctgcgcacgctgcagactctactcgccggcgcacaggcgctgtcgtccagcgccgagtccgacccggccgacccctatttgacggccctgtgttacttcaacgcactgcgcgaactcggaggcgcccggcgcatcgtcgacgacgaggtgcgcactcatctggccacctacggggtgcagcgtgtgcggcttgagccgccgggccagcccttcgccgaccgggctctgcgcgagatccaggaactgacctcgcgctacagcaccgaccaggtctccgaggcgcgcacgcggctcgggcgacccgcccgtgccaaggacgcagttgacgtcgcgctcgccaccaacatgatctcggtcgggctcgacattggtcggcttggcctgatggtggtgcagggtcagcccaaaaccgccgctgagtacatccaggcgacttcccgcgttggccgtgagcccgagaagccgggtctcgtcgtcacgctgctcaacgtccataagccgcgcgaccgcacgcattacgagcagtttcgctccttccacatgagcttctaccgggctgtggaggcgacgagcgtgacgcctttcgcggcacgcgccctcgatcgagccctcgctgctactctggttgccgcggcccgccactttgagccagaccttactccgagaagcgccgccaatcggatcgctcgaaacggccacgccgccgcggcggtgcgcgctgccttcgaagagaagatgcgagtagctggtgttgagacggccgcgatcgaacgctgcctcgcacggattgatgctcttgcggtggcttgggccgagattgccgatcaccagacagctaacggcgaccagttcgtttacgcgaacgaagagcctgtgcggcgcttgctccaggatccgctggacgacccacccaacatggcggcgaaccgcgcatggttcgccgccgggcgctcgatgcgggacactgagccggtcgcgctcctgaagctgcgcggccccgacggcgcacccctcagcaagtga

SEQ ID NO: 7472 - DNA, 609 bp, Methylobacterium sp.
gtggtccggaccatcgtagatgccggcggcagcgcggaagcggttgtgaccgacgtgacgcaagaagaggcggtcggcatcctcttcgaccgcgcctttgcagcggccaaagggcgggagcggccggatctcgtcgtctacaatgccggcaacaatagacggatgaacttcctgaatgtcaccgccgccgagttcgaggcgttctggcggatcggttgcttcggcggctttctggtgggacgcgaggcgatgcgccgtctgctgccgctcgaacgcgggacggtgatcttcacgggcgcttccgggagcatgcgcggcaaggcgggctatgcccagttcgcggctgccaaggcgggcctacggatgctcagccagagcatggcccgtgaattcggtccgaaaggcatccacgtggcgcatgtggtcgtcgatggagggatcaacggagaccgcctgagagcctcgcagcccacgcgcgtcgcggagcagggagaaacgggcctgctcgacatcgacgcgatcgcgcaggcgtactggttcctacacgagcagcatccgtcggcttggacccaggagatcgacttgcggcccttcaaggagccgttctga

SEQ ID NO: 7473 - DNA, 309 bp, Methylobacterium sp.
atgtcgaatcgggctcccacgccagaaaacaacgtcatcctccggcagatgtccggcatgcgccgcgacatgtccgagatctcggtgacgaatgcccgggtcatcgaattgctgggccggatgaacctgcgcctggacgaaatgtcggagcggttcgaccgtcggcttcgcgagttgcagggcgatatggtcctgatggagaatcgcgtggttacggcgatcacggaggtccgaaacatttcggcccgtctcgatgacgatcaggcggatccatccctgccgcatgggaacgagcggacgccaaagtga

SEQ ID NO: 7474 - DNA, 126 bp, Methylobacterium sp.
atgggcgtgccggagatccggcggttgaagcagctggaggacgagaacagcaagcccaaacgactggtggccgacctgacgctggaccgctccatgctgcaggatgtcctcaagcaaaagtggtga

SEQ ID NO: 7475 - DNA, 789 bp, Methylobacterium sp.
atgccccatctccggtacgacgaagacgatgcgatcgcctgcatcactctggcgaatccgccgcagaaccgcctctcccctgagatgatcatggatttcgaagccgcgctcgagcggctcggcgagagtagcgcgcgctgtctcctcgtttgcgccgacgggaacgacttcagcttcggcggcgacatcgttccttggaactacatggagttccgcgagctgcgctcgctgttcgaccggtacatggcggcgttcaaccggttcgagcggctcggcatccccaccgtcgctgccgtgcagggtctctgcttcggcggcgggctcgaactcgcgatccgcagcgacgtcatcttcgccggcgaaacctcgcgcttcggccatcccgagcagtctctgggcatcgtgacgcttctcggaggcatatatcgggtcgccgagcgcgccgggcgttcgaaggccatggaatgggccctgacctcgacccaggtgccggccgccgagatggagcgccacggcgtggtgaaccgcgtcgttccggatgcggacctccgcgaggcggcggtggaattcgcgagaaccgttgcccgcgggcctacccgggcgcatgccgtccacaagacccttctgcggatctgggccaccggtgggaccgcggctgccgacgaggcgatgtgggagagcgcgatgccgctgttcgagacgcacgacacgcgcttggccttgccggcatcgattgaggccttcaaagccggtcggccgaggccaaacttcgacttccaggggtcctga

SEQ ID NO: 7476 - DNA, 717 bp, Methylobacterium sp.
atgatcatcgaagccgacaccttggatgccacgcaggcctacaagctcctgatcgccacgatcgtgccgcgagccataggctgggtgagcacactctcgaccgacggcgtggcgaacctggctccgttctcgttcttcacggccgtcggccgcaaaccgccgatggtgtccatcgccatgcagcaccgctcggacggggtgaccctgaaggacagcttcgtcaacatccgggacaccggcgagttcgtcaccaatctcgtgaccctgccgctggccgatgccatgcacaaatccgccttcgagcatgcaccggagatcgacgagttcgcagtgacgggactggagaaggcgccgagctccgtcgtacggcctccgcgcgtcgcgaacgctcccgtcgccttcgagtgcaagctcgagcgcctgttcaccgtcggcgatcacgacgaccacgtcgtctggggtcggatcgtcgcctttcacatccgcgacgacctgtaccttcccgggggaaggatcgacacggctgcgatcccggcggtgggacgcctcgcggccgagtacacgcttgtggatacggtcttcaccacgcccgtggacccggagatcctcgcggcgcgcgacggtcgccggatgcggcggctggacggccatcccgacgatttctcgccgatcgacggcaaggggtggtcgccgtcgggcagcgtcctttcggaatag

SEQ ID NO: 7477 - DNA, 672 bp, Methylobacterium sp.
gtgtggagaggcgtcgaggccggcctgaagaaggacgggtatcggaccgtcagcgtggatcttcccggccggccgagcaatccccaggctccggaccggatcaacctcgcaacctatcgcgacgtggtgctcgacaagctctcggacgaagctcggccggtcgtcctggtggggcatagcttcggcggcatcgtgatctccgacgtcgcggagcatgcgccgacgaaggtccgtacgctcgtgtacgtcgcagggctggtgccgcgcgacggcgattccctcgcgtccatggcgcagagcgacggcggctcgtcggccggcaggtacatccggttcctgcccgagaagggcatcgccaccgtgccggtcgaggcccgcggagatctcttcgccaacgacggcaatcccggtcagaagcgggccgtcagcgaggcgatcgtcgacgagcccctggcaccgctcgccgaagccgtgcacgtcggcgcccggttcgccgcggtcgacaaggcctacatccgcaccactcaggaccgcgtggtgagtcctgccgctcaatcggcgatgatcgccggcgcctcgatccggaagagctttaccgtgaagagcggccacaccccgttcgtgaccgcgggccccgccctggtcgccgccatcgaggcgagcgcgaactga

SEQ ID NO: 7478 - DNA, 1242 bp, Methylobacterium sp.
atgtacaaggcggtgatcgcgtcctccatcggcaacgccctcgagttctacgacctgaccctgtacctgtatttcgcggtcacgatctcgaagctgttcttcccgagcagcaacccgaccacctcgctgctgctggcgctgggcagcttcggcatctcctatctgatgcgtccgctgggtgcgatcgtgctcggcctgtacgccgacagggtcggccgcaagccggcgctgatgctgtcgatcctgctcatgatggtcggcaccttcatgatggtggtgatgccgtcctacgagtcgatcggcatcttcgcgtcgatcggcgtgctggccgcccggctgatccagggcttttccgtcggcggcgagttcggcgcctcgaccgccttcatggttgagcacggtccggcgcggaaagggttcttcgcgagcttccagttcgccagccagggcctggccagcgtgatggcggccctgtccggagtgatcctgagcgccacgctcagcccggaccagatcgcctcctgggggtggcgcctgcccttcgcgttcggattgctgatcgggcccgtcggcctctacatccggcgcaacatcgcggagacccccgaattcgaggactcgaccgaaggggaggcgaccaactcgcccatgcgcgacctgttcgtgcagcaatggctgaacatcctgctggcgaccgggctcgtggcgacctccacggcgctgaactacatgatcagctacacgccgacctacgcggtcaaccagctcggcctgccctcctggatcggcttcgtcgcctcgttcgtcggggccgtcatgctgatgacgttggcgccgctggtcgggcattggtcggacaacatcggccggacgccgatcatgcgggccgtggtgatcgcggtcttcgtgctgatgtttccggccttcgcgctgctgatcagctatccagcgctcctcgtcctcgtaccggtgcttgcgctgatcggcgccctcaaggcgagctacagcgcggcgcttccggcgctcatggccgagatcttcccaacgcgcacgcgcagcaccggcatgaacatcagctacaatgtcggcgtgacgctgttcggcggcttcgcgccgttctggatcgagagcctgatcgcgatcacccacacggcgctcgccccgagcttcttcctgatgttcgcggccagcgtcagcctgctctgcatcgtcttagtccggcggacattcgggctgcgctag

SEQ ID NO: 7479 - DNA, 2877 bp, Methylobacterium sp.
gtggcggtcggctacaacaacagcgcgggcaatccggactacaactcgaccgcgatcgggacgagcaactccgccaacggagcgtacggcgttgcgatcggctacggcaacacggcggatggccgttcgacgctgtcgctgggcaccggcaaccaggcgtcgggcgatatcgccatcgccctcgggcggcaatcctatgccgtcggtgacttttcgttcgcgcagggcttcatcgccagtgcctacggccaggatgcgctcgccatcggccgtctctcggtcgcgggcgagaaaggcgctagttcgacggctagcaacatcgccatcggtgacaacacgtccgcccagggtggctcggcgctggcgatcggcagcggcgccaaagcgtcgtcgaaacgggcggtcgcgatcggctcgaacgccatggcgttgcgcggaacgatcagcggcatggaggcgtatagcggcacggcactgagttcggccaacacggaattctcggtcggcgattccgggaccgagcgccagatcaccaacgtcgcgggcggccagaaagacaccgacgcggtcaacgtgcgtcagcttaggggcctcggcaacaccctgggcaccacgctcggaagctcgttcgaccagacaaccaacacttacacgccgccgaaatattcctacgcgaaacgaaattacagcacgatcccggatctcgtcgggtcgatcgacagccttgccttgcgctacgatacggatggtggcggaaagcgtctggcgagcatcgatctgacccgcagcggtgacctcggatcagccgtttcgatcaccggcctggctccggcgacgaccgatagcggcgccgtggccctgtcacagatgccgctgcgctattcgaccgcgagcagcccgaccatcgcgaacccggccgttccgtcgaacgacgtgacgctggtcggttcgaacgcccgccagacggtccttctccacaatgtcggccccggcgatatcaccaccagcgactcgacggatgccgttaatggaagccaactctatacgaccaaccaaaaggtcgctgcgctccagaatggcagcctcggtctcgtccagcaggatcagaccacccgcaccatcagcgtcggcaagggcaccgatggaagcgccgtcgatttcaccgggaccgacggcgcccgccgcctgatcggcgtggccgtcggaaccagcgacagtgacgccgcgacgctgggtcagctccgggcgaccagcgacgcgctgggcggcggcgcgggctacgacgctacgggcgtcttcgcgaagccgagctacagcgtcggtggccagatctaccgcgatgtcggttcggccctcgcggcgagcaacaacctcgcggttcaatacgtgccagacaggaatggcaatccgaccaacgttgtcgatctcgccaagggtggcaccacggccgtctccctgcgcggtgtcgcgtcgggcttggtggcagtaggctcgaccgaggcggtcaacggtggtcagctctacgcgatcagcaacagcgtcaccgatctgcagaacgggacctccggtttggtgcgacaagacccgacctcgcgcgccatttcaatcggcggcgccacggacggaacggtggtttccatcgccgacctgaacggcacggcgcgcacgctgaccggggtcggcacaggccaaatcgcggccggcagcacgcaggcgatcaacggcggccagatctacgcggtcggcgcctccgtggcctcggctctgggcggcggcgctgggatcgccggcgacgggacgctgcgcgcgcccagctatgcgatccagggggcgacctacaacaccgtcggtggcgccctcggcggcctcaacgcggcggtgacgacgctcagcaccaacggtagccgctatgtggccgtgcggagcacgggcgctgcggcgcaggccctcggcgccgattccgtcgcgatcggtcctgcggcgtcggccagcgcagatcggggcgtcgccctcggggccggttcggtcgccagccgagccgggatggcgggggcggccgaagccttctcgggagccgcggtgaactcgacgcagggggcgatctcggttggctttgagggcggcgaacgccagatcaccaatgtcgccggcggaacgcaggataccgacgcggtgaatctgcgccaagtgcgcgctctgggtggcaacctagcgggtgcgctgggtggtggggctcgcttcacggcagatggcggcttcacggcgcccagctacacgatcggcggccagacctacgccagcgtcggcgcagccctcggcgccgtcgacaccttcggggtgagatacgacgtggacccctccaccggcggccgcggtcagtcgatgacgctggctggcggcgatccgaaccagccggtaatgatccgcaacgtcgcggcgggcgtgctggccaccgatgtcgccaacaccggacaggtggcacaggccaaagccgaggccaacgcctataccgatcggagcgtcgcggtggcttcggccgccagcgccgcctacactgatgcggccgtggcccccctgcagaagcagatgagcagcttcggcagccagttgctcgatctcaatcgacaagtcggcgaggttcgcgcggacgcgcggcgcggagcggcgatcgggctggccgccgcggccctccgtttcgacgaccggccgggcaagctcagcgtcgccgccggtggcggcgcctggcgtggcgaggctgctgcgtccttcggcgtcggatacaccctgccggacggcacggcccgggtgaatgccaccggtgtcgccgcaggccgcgatttcggcatcggcgccggcgcaagcttcaccctgaactga

SEQ ID NO: 7480 - DNA, 288 bp, Methylobacterium sp.
gtgcgagactggatccttggcctgtcggctgacgaccggaagattgtcggtactgacatcgcgatcgtcgagttcggctggcctgtcgggatgccgacctgcaaatcgctcggcaatgggctttgggaggtccgcagcgatctgaccggcgggaagattgggcgagtcatcttcgtcatgcatcagggtcagatggtcctactgcacgggttcgtgaagaaggcgcagaagaccccgttgtccgacatccgtatcgccaccaagcgccagaaagagcttcagcgatga

SEQ ID NO: 7481 - DNA, 255 bp, Methylobacterium sp.
atggacatgaagacccccaccatcccgggttcggccgcaagcccccgggccctggggaagctccaagacctcgccgaggtgctcggctgttcgacggatctgttcttcgcggcttctgacgggccttcgaccggccagacggctcagcttctccagatgtggctcgcgatccggaatcccgaggatcgccagacggtgttcgcctgcgtccgcgaagtcctgaaggcgcagtccgacggtcatcgcgaacgatag

SEQ ID NO: 7482 - DNA, 123 bp, Methylobacterium sp.
ttggccttcgccagcatcacggccgagaaacagcagagcgcgagggccgcgacccagagcacgcctctcgcagttcggatcgttcgcttggacatgagcccgaaggtggggggcttcggttag

SEQ ID NO: 7483 - DNA, 432 bp, Methylobacterium sp.
atgaccgataccaccgaggccgacatccgccacatctacgaacgctggcacgcgacggtgcggggccgcgacatcgacggtctgacggcgctctataccgaggacgccgtcctggagagcccgctggtctttgccgaatcgggcggcggcgcctccgggatcctgaggggcaaggcggcgatccggggcttcttcgatgcctcgctgcgcaagcccgggagcgtactcggccgctggtaccgcaccggcactttcttctccgacggccgacagctcgtctgggaatatccccgcgccacgccggagggcgatcaggtcgatctggtcgaggtgatggatctcgcggccgggctcatcgcccgccaccgggtctattggggctgggtcgggttccgggcgctggcaccgggcctgaacggaccggtcgggtga

SEQ ID NO: 7484 - DNA, 555 bp, Methylobacterium sp.
atgatgcggaccacactgacagccgcccttctcgcctccggcctggccttcgcagcgccggccttcgccgagacagcccccatggtcggcggcgccccgatgatggccgacaagaccatcgtcgagaacgcctcgaaggccagcaatctcacgaccctggtcgccgccgtgaaggccgccgggctcgccgacacgctcagcggcaagggcccgttcacggtgttcgcgccgacgaacgcggccttcaagaagctgccggccggaacggtcgactcgctcctgaagcccgacatgaagaagacgctgacggccgtgctcacctaccacgtcgtgccgggcaagctcgacgcgaaggagttgatggccaaggcgaagatgggcggtgaagccgcgaacctgaagaccgtcgagggccaggtgctgaccgtgaagatggacggcgaccggctggcgctgatcgaccagaagggcgggggcgccttcgtcgagcaggcggacgtcaaccagtcgaacggcgtcgtgcacgtcatcgacagcgtcctgatgccgaagtaa

SEQ ID NO: 7485 - DNA, 138 bp, Methylobacterium sp.
atgggcgaggggtgggtcactaccatcgaggtgccggaagggtcagtccacggatacctgatctacgacgagacgggcgtcgaagtgtctaactggactacgctggatgtcgccgtcgagcgtgctgccaagggctga

SEQ ID NO: 7486 - DNA, 858 bp, Methylobacterium sp.
atgatggtcgaggccgaggttcccgctcacggcgacgccgaggaggaaaactatttcatctcgatgaccgacatgatggtcggagtgctgttcattttcatcatcatgctgatgtcgttcgccctgaatttccagaaacaggcagatcggcaggaagacaaaatctccgtggccgaggaggtgggacgcaagcttgaggcgctggagcagcgtgtcagtcagcgtctcagcgagatccgtgaggcggcgagcgcacgtgcccagctgcttcacgatctgcgcgacgcgctcagccgcgagggcttgaacgtcacggtcgacgaggccaatggggtgcttcgcctctcggaggacgcgatcctgttcccggtcaatggcgccgaccttgtcggtcgagcacgggacaacgtggacaagctcgcgcgcgttctagcccacgtccttccagtctacagcccgtgcccggcggtagtcgaaggcccatgcctcagtcgcagtcgcgcttacgtcgagactgtgtttatcgagggacacactgacagcaccggcattgacgcgaacaactgggatctctcgaccaagcgtgcggtcaacactttccgcgaactcatcgtcgcagctccggatttgcggcgcatcctcaacggccgcggcagtgagaccctatctgtgtccggctacgcctcgacgcgcggtatcgatccagacaagacccccctcgcctactcgcgaaatcggcgcatcgatctgcgcttcgtgatggaggtcgacagcgagagcggtctgcgtgagatccaaacgctcatcgacggaatgaagggcgagatcgcgcagcttagccggccggccgtcccatga

SEQ ID NO: 7487 - DNA, 660 bp, Methylobacterium sp.
atgccgagcaaaggcgaccaggcgctcctcctcggctttttgacgcctcgcttcggcgacccgcgggtcaaggccggtaactggatcggcatggaggccgccgctggcatcgtgaagcgctggcttactgaaatcgccctgcgccagttcttcgacgtcgtcgataccatcgcgcctgagcgcatgtggcggtttcgccgtgcgttctggagcgcctaccacgcgcgcgacgcgatcctgaacgcctgggtggtgttcggccccgacggcgcgcgcgaggcaaggcgcgccttcggccagggcatcgccttcggccaattcatgaagggtggacgcaagcagctcctcgaggggcatgccgtgttgctgctcgatctcggccgatgcatcgtcgccgactggagtcacaccggttattgcaacatctggtccaccgacgacccggacaagccgcgccacctcaatgccaacagctacaccaccgatgacgtgcggcggccggtccccgaagatcgttccgagcgcagcctgaccgcccatgacatctacagtcatggcggttccgacaactatgtgtggcaacaccgggtcgcggcccggattggcgagctgacaggcgtccggctccgggcaggcgagttcgcggcgggtctggagtga

SEQ ID NO: 7488 - DNA, 291 bp, Methylobacterium sp.
atgggcgcggccggccttctcggcgtcacgcgccaatcgctctccgatctcctgaacgagaaagctgccttaacggccgatacggcttttcagatcgaggcggccttcggatgtagcatggaaatgctgatggagatgcagaaacagttcgacatcgccgtaatccgcaggcgtgagcgcagcgttcggaatgcagcgtttgcaaaggcgtggtccaaggtcgccgtgacacgccttcaggctgcccaaaaacgatcgaaggttccctcacaaaagcagatgggtggctaa

SEQ ID NO: 7489 - DNA, 1038 bp, Methylobacterium sp.
atgcccttcgtgcaggcggcacccgccatgcagaccatcttctcgacggccggcatggcgccgaaagatcggtttcgccgatggcgggatgtcagcgaagaccgcatcgtcccgatggaacaggcgtatctcggcgaggaggcgttcgacgcgacgatcgatgccgcccgcgtcggcggcgtggatttcaccaagttctcgtttcgcaatctcagggcgtcgacgacgccccgaacgctccggcacgagaaccacaggacggaccatctcttcatcagcatggtcctgtccggcacggtgcgggcggaccagaacgatcgatcgagtacggacaaggccggcgacttcgcggtccgtgacacgaacacgccctggacgatcgagcataacgggtacagcgaagtgctggccatcgcggtcccgcgggagcggctggagaccgcgctgggctcggcccggaccttcgccggcctgaccgtcgacggcgacctgccggcgacgctcctggcccgctcgttcctggccaatctgctccgcgagggcgatcggctgccgcctcacagcgccgagcgcatggtcgggatcgggatagacctcatcgtcgcgtgcctcgccgagcgcctcgcccaagacgcgccccggccgatgcacggcaccctcgtgatccagcgcgccaaggcgttcatcgaggcccatctcggcgatccgaccctcgatccgcccctgctcgcggcggcggtgggcgtgtcgttgcgccggctgcaggagctgttccacgagcacggccagcacatcgcggactggatctggcaacgccgcctggaggcggccgccgcgcgcctcgccgatccgggctgcacgcatctgtccatcggcaccctggcctatagctgcggattcgcgaaccaagcccacttcgcccggcgcttcaaggcgcgctacggactcgtgcccagcgagcaccgtcacgcggcactgatgagcacggataaggtccgaaggcgctcgcgccagctttcccccgcgtgtggttcgtga

SEQ ID NO: 7490 - DNA, 351 bp, Methylobacterium sp.
gtggaagcgacgcttcagttgatagacggaaaatggaagggcgtgatcctgttccatttgctcatggggccgatacgcttcggcgcgttgcgacggatcttgcaagattgtacgcagcggatgctgaccaaccagctgcgggatttagaggcggacgggctggtcgatcggaaaatctatccgcaagtgccgcccaaggttgagtacagtctgaccgcccgcggccggacgctcgagcccgtgatcctggcgctgaagacatggggcgaaatgcacggggttgcgtcgataccggacgctgcacgaagggacgcgggcgcgatgtccccgctcggcgctggagagctctga

SEQ ID NO: 7491 - DNA, 315 bp, Methylobacterium sp.
ttgtcgccggagatcgaatggcgggtgctggagagctttccttcgggcgggatctatcgtgggagaaacgacgtcctcgatcgcttctttccatccgtgaaagcgcatttcagcctctatgaaacgcatccgaaaacgttcatggccgacggcgaaactgtcatcacgaccggccactatcgcatcgccagcaagttcggcgtcccggccgaagcggatttcgcgcatgtttggacggtccgcgacgcatccatcgtggcattccgacagattgcggacaccgccgcgatcaatgcgcgtttgggaagaagctga

SEQ ID NO: 7492 - DNA, 795 bp, Methylobacterium sp.
ttgctcgatcccgccgccctcgacccatcctcgttggtgctcgatgcccgcgccgaggaggactatcggcaaggtcactggccgggagccgtccgcgtgccggtctcggactgggaggcggccgccaaacaggcggacaccggtctgtccgaagaccggtattggcgcacgctgatcggcgacctcggggtcgatggacggcggcccgtggcggtctatgacgacggccggatgaccgaggccgcgcgggtttggttcatcctgcagcacttcggggtgcgggccgctgtcctcgatggcggcttgcctgccctgtccgaccgtcccgacgcccatatggatcgcacgccgatcgtaccgacaccggtgcccctcgatccggtgccgaccagccacgttccggtcggactggtcacccgtcatgaactccgagatcggctcgacgacggcacgcggatcttcgacgctcgcacggccgccgagttcgccggcgaggatctgcgcaggaacgcgcgcggcggccacctgctcggtgcgcggcgggtcggccatgccgacctgctgacggccgatgggcgtatgaaacctgccggggaactgcgcgccatgctggaggccgcgggcttcagaccgggcgacaggatcgtcacccattgcgacggtggcgggcgcgctgccctggccgctctggccgccgtgcaggccgggttcgcacaggtggatgcctactacctgagcttcgccgattgggcgatggacgagagctgtcctgtcgtgcccggtacggcaacctag

SEQ ID NO: 7493 - DNA, 246 bp, Methylobacterium sp.
gtgctgcagaagggccgacactacgatcccaccgacctgttcctgcgcaagggcgacaccatcaccttggtcaacggtgacgacagcgtggtgcatcacgccttcatcgaggccgatcggttcgcgttcgacgccggtgaccaggagccgggcaagcaggccacgctgaccctgaaggagcccggcaacttcatcatccagtgcggcatccacccgaagatgaagctcaccatccacgttcagtag

SEQ ID NO: 7494 - DNA, 885 bp, Methylobacterium sp.
atgcagatcggattcatcggtctcggcagtatggggtcagcaatggccctgagcttggtgaaggcaggccatgaggtgcgagcctggaaccgtagcatggtcgcccaggatcgcgttcacgggataacgctggtccaactcgcggcggatgcattccaggctgacgcagtctttacgatgctgtccgacgatcatgccattcgggaggtcatccttgatgccggtttgctcgcaagtgcgcgcccagggctgacccatgttgtcacatcgacgatctcggtcgctttcgcgcgagaactggagttgctgcacgaagaggcggacctgggctatgtgtccgcaccagttctcgggcgaccgaacgtagcggcgagtggccagcttaacatcctggcgggcgggaagggtggtgcagttgccgcagtcgaaccattgctcgcttccctcagcaagaaggtctggaagctgggggatgatcccgcgtgcgcgaacgccgccaagatcgcctgcaacatgatgatcgccatagcgattgaggcgatggctgagggtgtcgtgctgaccgagagtgtcggtctcgaccgtgcggatttctttgagctcatcctgggcacccttttctcgggccgcgcctatgagagctacagcgcgcagataacggaacggtcgttcgagcccggtttcaaagccaagctcgcgctcaaggacatgcgcctggcgaccgaggctagcagccagatcggacgcacgctcccgatgcttgaagctgtccgtgagaagctcgcgaaagctgtctcagcaggcctcggggagaaggactggtcgatcatggccgatatgacggttcgcgacatcgcgatcgccatcgatctcgaccggcgctga

SEQ ID NO: 7495 - DNA, 381 bp, Methylobacterium sp.
gtgaccgaaacgatcatcccgctacggttgaagcgcgacgaggcatccgcgctcgccggtttcgacgtgctggcggcggagctgctggccgaggggcaggccccgaacctatcggccgcgcggctcgatgccattctgggtaaattacgcgaacagcagacccagctcgccgtgatcctggctgatctagaagaccgtgtaccaagttgcgatgcgcggatcgaagccatcaacgcagacctttgccgctttccacgtgagggactgactcagatcgacctgtacattcagcaagccatgagttgcagaacgaaggttgagccgacctgcatcaccgagtcaggagcattgccgttcgccatgggttatcaggatcactga

SEQ ID NO: 7496 - DNA, 1968 bp, Methylobacterium sp.
atggccaaaatcgtcaaagcgaatgcttggtgcaacaacgaggtgggctatctcgcgtggcgcacggacggtccgatccaggactgcctcgggttcatgatcacccggatccactccgatctgaatgggaacgaagtcgagcgccgcatcctccctgcctgggttgctttcaagtcccagtcgaacccgaaaggcgaagagcaggacacgagcgtctggcccgtccagaaattctcctggcgcgacctcaccctccgcagaagccgcaacgagacggtactgcgcgagggcgagttcaaggctcggtacgagatcgtgccggttggcttggccggccacggccgcatgcccgttccgtcctcgccaacggccccctaccgggacgcccacggcgaaccccgctacaacggcgatcctatccagctcttcttctgcggcaagcccatcgagacaaacgagatcctcgtcacgaaccgcttcggcgcggcgaccgttgccttcaacaacggcatcctttcgacccaaaacctccgcaagcaactccagacgccggatggccgggcgcccggcaagaaggaggtgctcgatcgcatggcggatcccaaggactcgcttcgccggtttctcagcggagacgccatcaagatcttccgccgcttcttcaaccgggccgtcgagctcgacgccaatatccacctcgccctctacgaattacatgacgacgagctgatcgcgctgatcgacaagcactgcgcgcgtatcagccttatactttcgaccgccggcaagtccaaggacagcaagacctgggacacgaccaaccacgacgcgcgagaccgtctcggcaaacgtcttggtaagcgcctgcagaaccgcatgttcaataacagtaaacatatcggccacaacaagttcggcgtgctcgtctcaaggacgggcgagccgcttgctgtcttgaccggcagtaccaactggacttccacgggcctctgcggccagaccaacaacgcgatattcatcgaggatggcgatctcgccgccgcctacctggaatactgggggcgcctgcacgacgaccttctgcccgagcctgaccccttgtcggcccccaacaaggtcgatcaaggcgcggccttgagggaggcagacgcggagccgaacaggttgagcctggacagcgtaacggtaggagccaaagcgtcggtctggtgctcgcccaatacggagaaggttgccgtccctcgcacgaatccggcgacgccgcccgatatagaggaagtgtttgcgctgatgcgaagtgcgaaggacgcgctgcttttcctgagcttctacccggcccagcaaggtcgaaacagcatcatcggcgaagccgtgaagatcgcacagggtaagcccgagctcctggtcctcggtgcgatcagcgcgccgcaggcaatgcccaactacgaggcgccgatgcgggatgacgacgaagacgaccaggaagacggcgagaaggtgcccgcgccctccatctacacgctgaagcaggctccgcgggtcctgatggtccgggcgagcgctgtgcgcgacctgatcggcgacttccagcgcgaactgctgaccgcggggaccgctattatccacgacaaggtcgtcgtgatagaccccctttccgagaccgattgcgtggtcatcaccggcagccataacctcgggttcaaggcgtcctacgccaacgacgagaacatgctgatcatccgtggtgccccggcgctggcggcagcctacgccgtccacgtccttgatgttcaggatcactaccgtttccgtgcagtgcttgaagagcagcgccgccggcgcatcctgagcagatcatctacggagccgtccagtgtgggttccggcttcctccatgtcaacgacgaatggcagacgccttatttcgatggccgaaaaggggacgagctccgctattttgcgcgctga

SEQ ID NO: 7497 - DNA, 807 bp, Methylobacterium sp.
ttggatgccgggctgccggtgcgcgcagttgtgcgagatgcggacaagggcgcggcctggaaggcgcgcggatgcaccattgcggtcgtgcccgacgccgcagatgccgaggcgcttacggacgccttcgcgggcgcagcgggcgtcttcctaatgaacccaccgaactacgatcctgcgcccgacctctcgggtagccgccgtgcggccgcggcggccgcgcaggcgatcggcaaggctcttccagggagggtcgtgctgctctcgaccgtcggcgcccaagccaccgcgttcaacctgctgaactgggcgggtatcttcgagacggcactcgtcggcacgggccgcccggtcgcgctgctgcgggcggcctggttcatggagaacgcagcctgggatatgcccgcggcgcgcgagggccgcatcgcaagctacctgcagcccgtggaccgcgccatcgagatggtgagcacgcaggatgtcggacggactgccgccgatctcctgcgcgaggattggaccggtacccggatcatcgaactggcgggcccccgcaagtacagccccagcgatgaggccgccggcttcgccgccgcacttggtcggcctgtcgaggcggtcgcggtcgagcgcgagagttgggaggcacgcttccgcgccgagggcatgcgacatccagaggcccgcatcgccatgctcgacggcttcaacgagggctggatcgacttcgcgcgggagggcactgagcgtcgcaccggcacggtcgccttcgagacggtgctgcgccacatcgtcgagcgcgattga

SEQ ID NO: 7498 - DNA, 813 bp, Methylobacterium sp.
gtgggtgtccagcagcaggtgcaggccgtggtcggcaccggcctgcaggtcgtgccgaccccggactgggtcaccctcggcaagtcgaaggagtgggcggaccagtggagccgggtggtccggaacctgttccgcaactggtccagcacctccgactgcgacgccagccggcaggagtccctcggcttcatggcgggcgagctcctcacctcgaccgtcatctcgggggctggcgtcgtcgtgccctacttccagcccgggaacggcctgacgcagttcggcacctgctatcgcatcgtcgaggccgaccgcctctgcaacccgaacttcgggcccgaccgggacgaccttcgccgcggcgtgcacatcgaccccgagaccggcgccccgctgggctactggctctgcactcgccaccccggggacttctacggccagcttgcccgcggcgtcccgcgcgactgggtctacatcccggccttcacctcgtgggggcggcgtcgcctcatccacgtgttcccccgccgccggccggagcagaccgccggcgtatcggcgctcgccaccgtggcgggggacatccgggacgtgaccgagagccggcgcgccgagctccggcatcaggccgtgaccgcgggcctcagcctgatcgtgaactcggagctcaagcccgagcagggccgaccccacccgctcgacgagatcctgcacctgacagtcgaaccgcgcgccgtcgatggtgacgccgaacttcatggccgtcagcttgcccagcgcccttgcaccggaccacacatgccgccgggacggtga

SEQ ID NO: 7499 - DNA, 405 bp, Methylobacterium sp.
gtgggccaggcggcattccccttcctcgccagccgcagccatgccaaccactctggcgagacgatgcggatgatgttggtgtcgttgcggaagccggtgatctggcgctcctcgacggtcagcaggccgaggcgagcagcctcgcggatcgcgttcttcacggtcgaacggcacacgccggtgacagcggccatgttctcgatcgacaaccggcagtccttccggcgcgccacctcggcggccacgagggagagaacggcctgctcagtcagggtgaaccgggcgacgatagcctgcggcatgcggccagaagcggcccagcggcggcggcgctccatgctggcgtccgtgtgccgtggtcgggagccaacgccgggcctcctggagctgctctggcgatcctga

SEQ ID NO: 7500 - DNA, 93 bp, Methylobacterium sp.
gtggggttcgacgcgcggggcatcttgcgccttctgccggaccgaggcggccggatcacgctcgatacgcaagctccgcgcaagccgctgtag

SEQ ID NO: 7501 - DNA, 186 bp, Methylobacterium sp.
atgtcttctgtcgttcgcgtcacgctttccggcatccttgccggcctcgtcgccgccagcctcgccgcctgtgcgagcgccccggccgccgcccccgacctcaccccgccgccgcgccggccggtggatgccaagacgcagctcgaatacggcaacccgcccccgccgccgcccggccgctactga

SEQ ID NO: 7502 - DNA, 1380 bp, Methylobacterium sp.
atgtcgcttcaggcggccttgcttcttcgcgtcgaccgccaagcggaattgccgacgccgacccacgaaaatccgaacccatcgttccgcaaggaggcgctcatggtccgcagggttgtcgtcaccgggttgggcatcgtctcgccgctcggatgcgacctcggaaccttctgggatcggctcgtcgcggggagatccggcattcgacgtctgcccgacgacctcgtcccggacgtggaggcgaaggtcggggggacggtgcccgcgcggagcgaggatccggcaggcttcgacgaagccgccgtggtcgtcgccaaggaccgcaagaagatggaccgcttcatcctcttcgccctggaagccgcccgacaagccctcgagcaggcggattggaggccggcatccgacgacgagagcgggcggaccgcgaccgtgatcggatcgggcatcggtggcttccccgccatcgccgacgccgtcagaacggtcgacaacaggggagcgaggcgcttgtcccccttcgtcgtgccatcgttcctcgcgaacctcgccgccggacaggtctcgatccgccacaacctgacggggccgatcggcgctcccgtgacggcatgcgcggccggcgtccaggcgatcggcgacgccatgcgcctgatccgggccggcgaggcggacgtggccgtctgcggcggcgccgaggcctgcatcgatcgcgtgagcctcggcggattcgccgccgcgcgcggtctgtccacgggctacaacgacgagcccgcccgtgcatcgcgcccgttcgatcaggaccgcgacggcttcgtcatgggggagggggccggcatgctcgtgatcgaggcgctcgagcatgcggaggcgaggggtgccgagcccctagccgagatcctgggctacgggacgagcgcggacgcgttccacatggctgccagtccgcccgacggcgccggcgcgcaacgcgcaatgcggcgtgcgctcgccatgtccggtctaccgcccgacgccatcggctacgtcaacgcgcatgcgacctccacccaggtcggcgacgcttcggaactggccgcgctccgcgccatcttcgggacgcgtgtcggcaccggcggccccgccatctcatcaacgaagtccgcgaccggccacctgctcggcgccgcgggcgggttggaggcggtcatctccatcctggccctgcggagcggtgttctgccgccgacccttaatctggagcgtccggacgctgcggcggcgggattggatctcatcggacccgaggcgcgccggagcgccgtcgaacatgttctctcgaatgggttcggcttcggcggcgtcaacgcgtccctgatgttcggcgctgcgacacgatga

SEQ ID NO: 7503 - DNA, 1515 bp, Methylobacterium sp.
atgacctccaataccgcaggcaccctgaagcgcttgactgccggaatggtcgtcccgctgggcggggatcgggcggcggtggtcgatgccgagctcgccgaacgcttccgtcccggcgaccatctcctccttctcagggagcatggcgagcttctgctcgtcccctccgtgctgaagggtgagatcgacaggatggttgagcgggcgcatggcgccttccgggagctcggcagacagaccgacgacgcgatctcggcgttcttcgaggctttcgccgcgaacctcgaggaccagaccacctggggcgccgtcgcggcggcaaacctagaagattgcgagcgcgcccgagccgccagtcgctcgacgacacgcctcgtggcgacggagcgggctcggcgggacatgatcgacggtctccgcgtctggcgggaccgcgcaccgatgcgcggccgcacgctcgagcgcgtcgtacatgcggggctgacgatcgagcagcagggagcgcctctgggcgtggtcggtttcgtgttcgagggacgtccgaacgtcctggcagacgcggtgggtgttcttcgcgacgggaacacggcggttctccgtatcggcggcgacgctctcgggaccgctcgagccctgatgcgatacgctctgcatcccgcgttggagcgggccggtctgccgaccggctcggtggtcctgatcgaccgggccgagcgggaagcggcctgggccctgttttccaatcccaacctgtcgctcgccgtcgcccgcggttcaggagccgcagcggcgcgcctgggcagcatcgcgcgccagaccgggattcccgccagtctccacgggaccggcggggcgtggctggttgccgacgtgtctgccgacgtgcagcgcttcgaatctgcggtccgcaactcgctggatcgcaaggtctgcaacacgctcaacgtctgctgcatcccgaagacccgcgtcgacgacctggtgcctgcctttctcgacgtgctggaggacttggggcgcgaactcggccacggctgcaagctgcatgtcgtcgacggcgatccgcgcgtcgtgccctcagagtggctcgacgcggaaatcaacatccgtcgcaccgacggacatcgccgcgagccccgtgtcggcatcgtcgcccagaccgagctcggacgcgaatgggaatgggatgaggctcccgaggtgacgctgaagatcgtggacgatctggagcacgcgatccggctgttcaacagctacagcccgcgcttcgtcgcctccttgatcagccgcgatccggacgcgcaccgtcggttccatgacagcgtcgaggcgccgttcgtgggagacgggttcacgcgctgggtcgacggacagtacgcgctcggccggccggaactcggcctttccaactgggagaccggcaggctgctcgctcggagtgcgatcctgtccggcgacagcatctacaccgtccgcagtcgcgccatccagacggacccggatctgcaccggtag

SEQ ID NO: 7504 - DNA, 360 bp, Methylobacterium sp.
ttgggcgttccgctggtcgtgcccgcctccggggcggccgtgctgccggcacccgcggactttgcggcggcgttcgaaaccgttgcgctcttcgcggatgtggccttggcagcgggcgtcctggcggatgccgtcctgggagcggcgctcggtgcggtcgcggccgttgcgccctggtcggccgtcgtcctggccggggcgcgcctcacgggggcgcggcgttgcggcggattggtcgcgtcgggccgacggggctccgcggcctcttcggcggcgtcgcgatccatgggcttctgcgtcgattccattccgattcctgtccttgcccgtcgcggcgcgtttagcattctacacccgtag

SEQ ID NO: 7505 - DNA, 1701 bp, Methylobacterium sp.
atggccgatcaccacatgctgaccaaccctggcaccaagtaccgcccgttcgtctccccgatcgacctgacggatcgcacatggccgtctaagcgcctcgtggccgcgccgcgctggctgtccacggatctgcgcgacggaaaccaggcgctggccgacccgatggatgtcgctcgcaagctgcgtttctacgacctgttgctcgacatcggcttcaaggagattgaggtcgccttcccctcggcctcgcaaaccgatttcgatttcgtccggatgctgatcgagggcgatcgtatccccgaggacgtgacgatccaggtactgacgcaggcccgggccgacctgatcgcccgcaccttcgcgtcgctcgacggcgcccgccaggccatcgtccatctctacaacgccacggcgcccctgttccggcgggtcgtgttcggtatggagcggcacgaaatcgttgccctcgccgtatccggcgtgaccgcgatgctggaggagagcctgaagcggcccgacacgctttggatcttcgagtactcgccggaaaccttttgcttcaccgagcccgatttcgccctcgagatctgcgagcgcgtgctcgacgtctggcagccgacacccgagcacccggcgatcttgaacctgccgacgacggtcgaagtggcgatgcccaacatctacgccgaccagatcgagtggttctgccgccgcatctcccggcgggatgccgtgatcatcagcgtccacccgcacaacgaccgcggcaccgccgtggcctcggccgagcaggcgctcttagctggcgccgaccgggtcgagggctgtctgttcggcaacggcgagcgcaccggcaacgtcgacatcgtgacgctggcgttgaacctgtacacacaggggatcgacccgaaactgtccttcccggcgatccgcgaggtcgtgaagaccgtcgaacattgcaacggcctgccggtgcatccgcgtcatccctatgcgggcgagttggtccacactgccttctcgggctcgcaccaggatgcgatccggaagggcttcgccgcccatgcgcgtcgcaacgacggcgtctgggagatgccgtatctgccggtcgatcccgccgatctcggcgagacctacgaggctgtgatccgggtcaacagccagtccggcaagggtggcgttgcctgggtgattgagcaggatctcgggctcaagctgccccgagccttgcagatcgacctgagccgacgcgtgcagatcgtggcagaccggacgagccgggaattgtcagccgccgacatcgcggccaccttcagggaggcctatcacgtcgatgacaccaccattttcgcgctgaacgatgacgggggcggcctgcgccgccatgcgggcgcggagcggatcttcagcggccggatccgccatcgcggtcaggacgtctcggtgtccggacggggcaacggcctgatctcggccttgctcgcagctctgaacgacgcgtttgggatagccctctcggtggtggactattcggaacacgcgctccggcacggttcggatgcccaggcagctgcctatctcgaatgcacccgcggcgacggtggccgcgtcttcggcgtcggaatcgacgacgacgtggcgaccgctaccgtgaaggccgtgctgagcgcggcgagcggcgccgcgtcgctcgcgcgatga

SEQ ID NO: 7506 - DNA, 399 bp, Methylobacterium sp.
ttgccgctcgccatgacggatgccccggacgcgaagaaggccttggtggtcgaggacgagatgctcttccacctggaggtccgcgacctcctcgaagcgaagggctacgccgttgtcgaggccggaaacgccgcccaggcgctggaacgtctggacggcacggtcaccctgatgatcaccgacgtgcgcatgccgggcacgatggacggcctggcgctcgcgcgcgaggtcatccgccgtcggtcggacgtggccgtagtcgttgtgtcggcacaagtgacgcctcgcccagaggccttgcccgggcacgttcccttcgtcgaacgcccattcattgaaagccgcttccacgccgccatcgaccgggccgtgtcggcgaggaccgaaagccgatcatga

SEQ ID NO: 7507 - DNA, 1380 bp, Methylobacterium sp.
ttgacgaagcgcatcgtgtcggtggcggcggtccttggggtgctctgcgttggcgtcaccctgccggaggggctggattggcccgcccgggccgcgctgttggccttcggcggggcggcggtcttttggacgctgacggacctgagcggcgcctacgtcgccgtcgcggccgcgttgttcctcgtggcagtccggggggtcgagcagcaggcgctgatcgacggcctgggctcgaaggtagtctggctggtcatcgggaccttcgtcctcggcgccgcggtcgagaggagcgggctcgcggggcggctcaccgccctgatcgcggggcgcgggaccacggtcgggggcctgatgtggcgcctgacgctcggcatcgtcccgctcgccttcctgatcccgtcgacctctggtcgcgccaccgtgctgctcccgctctatcggaggctgaccgaggctgacgaggacgaacgcgtcgccaaggcggtcggcttgctgatccccgccgtcatcgtcgtctcgacggtctgcagcctgacgggcgcaggctcgcacctcgtcgccgtcgacctcttggagcggctttccggacaaaccatcgggttcgggcgatggatgctctgggggcttccgttcggtctggccgccagcctgacgacgaccttcctggtcagccgactgttcctcgacggcgagacccgcgcccgggccataggcgaggtcgacgctcctgccggaccgctctcgcccgcggaatggcggaccggagcggtcgtcgcggcgatgctcggcctgtggctgacggaggggtaccacccgttcggcattgcgaccgtcgcggtcgcgggcgcggtcctgctgacgatgccgggcctcggcgtcctcgactggaacgagggcgtggaggccgtgaactggtcgctggtcctattcatcgccgcttctctcgtgctcggtcgcgccctgatctcgacgggcgccgcgaagtggctgatcacctcggcgttgggagcgagcggggtcgacggtgggagttcgcccttcctcgtcatgttggggttgctggcgctcggcatgacggcgcatctctacatggtgtcccacaccgcgcgggtggccgcgctcctgccgccgcttctcctgctatcgcaccggctcggcctgaaccccgtcgcggtggccttcctggcgaatgtcgggatggactattgcctgaccctgccggttagctcgaaagcgctcctggtcttccaggacggcgaccgaccgacctttgccgctcaggatctgctcaggttgagcgcattcctggcacccgcctacgcagccctgttcgtcttcgcctactacgctctctggtcgcagaccggcttgagactatga

SEQ ID NO: 7508 - DNA, 324 bp, Methylobacterium sp.
atgagggagaccgtgacgggctgctccgtggagcacgcgatgcacctgctcggcggccgctggcggctgctcctggtgtcctacctgatcgacgggccgaagcgcttcaacgagctccggcgcgacatgccgggcatctcgcagcggatgctcaccctggatctgcgcgccctcgaagccgccggcctgatcaagcgcaccgtgtatccgacgacgccggtcaaggtggattacgcgctgaccgaggacggcctgcgcctgaagaaggtcgtggccgtcgtccaggaattcggcttgtggctgaagcagcgtaacgcggtctga

SEQ ID NO: 7509 - DNA, 258 bp, Methylobacterium sp.
gtggcgagcccggacaacctgacaccacgctccggcaacgtgttcgacgtaacgccgcaatcgggcgacccgcgggtcaacttcgccaacgtcggaggccgcggatccatccagtcgaactcgctcgaggattccaatgtcgacctcggcaacgagttggccacgatgatcgcatcgcagaccggctacggcgccaattcgaaggtgttccagaccggcaccgagatgctcgagactctcgtgaatctgaagcgctga

SEQ ID NO: 7510 - DNA, 765 bp, Methylobacterium sp.
atggcgatgcgtaacaacccgtaccagctgtcgctgttcgatgcgaaagggcaggccccggcgccgccgcccgcggccatacccccggctccggccgagggccgggagcccctgtcgctccacgtcggcgacacgttcctgaagcgtgtcgaaggctaccagttcggtgaggcgtcgttctggcagagcgtggccgacggcgccggcgatggattcctgcagcacgactgctacgtcctcgtccgattccatcaggatccggatgccaagatctaccgccggaaggtacgggccaaggacatcgagcgcgacctcgactgggcgatcgaggtcaccctgttccacgaggcgcaatccttcttctatctcctcaccggcaacgcaacgccccggcgcttgtccgatcgcgacctgcgcgaccgggtcccgccggctacgatccgcgctgtggagaagccggccgcgctcgtgcgggtcaagggcggccccgcgccggaggagctcgcctacgtcgaagcggcgatcaaggatgccttgcccgcgggctacccctcctacgcggaggagatcctcagcatccgcaagaccaacggcatgcgcatcgtccggatgcgcctgttcgacggcgcgatcggcgtcctgcggctctccgggcgacccggcgcgcatgggtatgggtgggatgtcggcgaggtggatcagcgccccttccactacgacgaggccgcgggcgcctgggtccgggtcaacgagcccgaggcctag

SEQ ID NO: 7511 - DNA, 3318 bp, Methylobacterium sp.
gtgtacgccgtcgtcgcacgcccgttcgcttggtatggtccggttcgcgcaattctgttcttcatcaccgcattcgccgcaggcgcgctgctagcgcggattacccccttttcaaatttcggcgtcatcgtcgacgttgcccacgagatgagccacggtacctatgatcgggtcagcgatcgggtcttcgccttcgcgctcgcctcgtttgtcgtccaggtcgcgggcgcactcgcaatcacgtatttactgcttcatgtcgttctcatccgacttgccctctcggcggcgcgtcgcgatctgcgacgtgtgggtggtccgcgagagttcgccgagcgcttcgattcagtccgcgccaacctcgagcgtaatgctctgatcggtcatgcgtggggagagttcgccgagacgctcgtcccagagccgcgggcggtgcgcaacacgatgcggccccagaccttcatcaacatcggtgcagcgcgcgagcgactgttcggtttgaagatgatgggcgcggttccaggctacttcgtcgggctcggcctcctgctaacgttcattggtctcgtcttcgctctcaataaggccgcgggaagcaccgcggccggctcggccgaggagatgacgcgatccttgagcgagttactctcggcggccacgttcaagttcggtacctcgatcgccggactcggttcttcgctcgcactcgccctgttcttcaagagctacgcgatcagcattgaggcaggcttcgaccgcctgtgccgcgatctcgaagatcgtctgctgttttacccgccccaggctatcgcggccgagaccaagaccatcctcgaggcacagcgcgatcagctgaaggagatcaacagcgagcgcttcttcacgcggctcggcgataccgtcgcgcctggtattgagtcggctatggcggcggccgtccagccgatgacggaaagcctccacgcggcggtcgggcaactcacgcagacgagccagaacgggctcgacgaaatgctccggcgcttccaagacaaccttcagggcagcgctggcgccgagctcaagcagctcgctgaaacgcttgcggcgatgcagggagcgctcgagggagtccagcgcgatctgtccggatctggacaggatttctcgcgtcagctctccgaggccgccggcaacctcgaccgtctcgtcacccaggccgggaccaatctcggcgcttctgctgacgcgagccgcagcctacttgaagacgtggcgcgcgagctgcgcgccgccttcgagatggccaaccggcaagtgaccgagaacctcgcggcctccacccgcggcgcggccggactcgtcgaggacgcgatgggccgggtcctggagcggctcgagacccagaccatggccttcggtcagtcgatcagcgcgcttcaagcgacgctcgccgatggtgtcgcgggtagtgcgcgctcggcgcagacggcgagcgagtcggccagccacgccacccagcaggcggccgaggccgctgccgccgcgatgcgtggcacggtggacgcgctggcggcttcggcggctgggtcggcggcacaggctgagcggctcatggagcagatgtcggcgcgcttggatgcacagatgaccgcgatgactgccgcggttgagacgctgcaacgttccttggctaatcaagccgaggagtccgcgcgcgcagctcgtgaggccgggctcgccgctaccgacagcaccacgcgtgccgcagaagttgcggcccgggccatggagggcacgatcggcgacgtctcagcttccgtgcgcgcctccgcggcccaggccgaggacgccatgacgcagatggcgacgcgcatggatgcgcagatgcgggccctcgtcgacgtcgtcggcacgttgcagcgaaccgttgaggcgcaggctcaggaaagcgcgcggacagcgcaggaggcgagtgcggcagcgtcccagagtgcaacgcagtccgccgaagccgcaaccagtgcgatgcggggtacaatcgacggggtttccgcctccgtcctcgcgtcggctgctcaggccgaaggcgtgatgaaccaagtggtggtgcgcatggatgcgcaaatgcaggctctgacggagcttgccgcgtcagtgcgacagtcggtggaggctaacgcccacgacagcgcacgagtcgcgggcgaggccggggtcgcggcgtcacgaagtgcagcgcagtccgccgaagtcgcagcccgggcgatggagggcacggtcggcgaggtctcggcctccgtgcgtgcgtcggccgctcaagctgagggcgccattgcgcagatggccgaacgcatggacgtgcagatgcgggctctcgtcgacgtcgttggtactttgcggcagaccgtcgaggcgcaggcccacgacagcgcccgcgccatcgcggagtccagtgccgcagcctcacgcagcgcaacgcagtccgccgaagccgcagcgcaagtggtggctggtaccgtcggcgacatatcgcggtccgtctcgagcgcggcggctgaagccgagcgcagcctagggcaggtcgccgcgcagctcgggtcacaactcgcgagcttcaacgacaccgtcgcggccttgcagcggagcgctgccgcctcggcggaggatgcagcgcgtgcggcgcgcgaggccggcgcggcggctgcggcatctgcttcgcaggcggcgcgcgaggccgctgaggcgatgcgcgtcacgatgaacgcgatcgtggccgagatgcgcggttcggtcgatgcactctcgggcacgctgcgcgccgttgagacggcgttctcgggtcagatccgacaggtcgacggagtcgcagcccgttcgcgtgagactgcggatgccttctcgcaagcctcccgggcgatccaaggcgctagccagccgcttctacaaacttccgagcggattgccggggctgccgagaccatggccggatcggtgcatgtctcagctgacgctctgcgcgccggtcaaggcgcagcgatcgcgttggccgagcgtctcgagcgccacctcgagcgggcagggcagtcgctcgaggcttatgaacagcgcttcgcacatgtcgacgctgagctcggccaggcggttggccgcttcgccgagcaggtgcgtcagcagcaggatcgtgtcgccgacttcgtcaccgagatcgatcggcatctaagcgctaccaccgataagctagcgcgcatggtcgacgatctctcgagcagcaacgaggagctcggcgccgcactgtccaccctcgcccgcccgattcgcctagccgcggcggaataa

SEQ ID NO: 7512 - DNA, 2397 bp, Methylobacterium sp.
atggcgaagcgcgtttgcaccgatctggaattcttgtcagatccgccgcggaccctccgcagccacatcgtctacgcgtacgatcccagatcgaaattgatgcgcaacgatctcgaggcgcgcgcaaaatttctgctggaggcgcagaccggcaagactttgacctcctggaggctgagatccaaatccctcgcccaagaggtgcagcagccaacgttgcttggaccgagactaatcctctgcgatgcggaagccctgggactgggcaaggacgccgacgatgagctgatggtcctctccgccggccgcagcgagaacgtcgagtcccacgccttcgtgagcatccctatgggccggagcgtgatcgcgcgcttgaagcaagacgagaccgccaacaccacaatcgtcgaagaaacgacgatcacggatgtgactttgcgacctgccctggtttttttcatggcccgatccagcctgtacgatttcagcttgctttgcaatcgacaggaattcctagccagctttgacgattttattcatgcgaggccgcgtccgctggtagatttattgcggcgttttgaggacgcgacgctaactgggatcaacgtggaatcgaatcggttcgacacggcgcgccatgcaggacgacgtattgcaaagtccggcgcactgtcgctcgccgctcgcgtcagctcattcctgcacgcgcccgccgaccggtgggcgatcctgggcttggtgcgtgaactcgacagacggcagaaccagttgggcgtccggccagcggtcctagtcacgcaaatctaccgtgcgacggccggcctcatcgcgggaaaaggaggccgtttgccgccagacctagcgatctactgggcggtgttgctgctcgggtgggaggagcggctcgactccggaccattccccgtaatcttcgacggtctctggcgcgccctgcgctccggcgccgctcgactagacgcggcacgcgagctcgacggttgttggggcgccatcgcggagcgcgtcgcgatcaccgtgcctgaaccagttggtaggcgagaccaggcgcgcgctcaactcatcgagacgatcgagcgccatccggcgctccagaaccccgctcccgacgcgccatggctccgacggctccacgcgattctagccgatccgcgccgcggttccacggcgacctggctcggcgaggacggggcggcttcgtctaggccgcggggagtgctcgccgagtctcctccgaaacgccctccagcggcgaccttgcctcggtgggcgagttcggaacccgaacgcttcgacgccttcctcggcaatgatgccgccgtgcaggcgctgaccgcccgcgtcgcgtcgggcgacaccaacaggcacgtcgtgtttcacggcccggccgggaccgggaagtccgccgtcgccaagctgtacgctcgagcgctccgctgcgagcgggtgtcgccgtcaggctcagcctgcggggtatgccatacctgcaagatcagcgcggcggaccaagatttcgagttgaggaccgtcgatctgtcgcgagccacagcctcggcagagcgcataatcaatgcattcgcaaaacttgatgacagcactcgcttcagctcaacggatgcaagacctcgcgttatcgtcgtaaaacacgctgagttggcgactccagtggccgcagatcgcattctcaaaaccatggagagaccgcgtcaagcggtctttgtctttaccaccgcggacttcggtcggttgcggttcgcgatccgctcccgctgcgacgtctacgccatcaagccgctgcgcccatctcaagcccgcgcccgcgcgctcgaactgtgccgcttagccgggctgcgattcgagccggctgcgctagcggtggtcgccgcagcggcgagccacaaagccggtaccctggcgacgcatctcgcgcggatcgcgcaagagggtgacgttacgttcgaccgaactcgtgcggccttgggattaacctggaccgacgcaggccttgctttctgggaggccgcgctctctcccgatctctcgaaccatggggcgtcgttcgaacggccctcggtggaggcgttgggcggtgcgccggaagcaattgctcggatgcaggctatcgcccacatgctggaggtccttgcgtccgggaccaagcctgtggcggatacggcggtccaccccgcgctgctccacctcccgcgtgaggcctgggcgcacctcccggagcgactgaacgcatgcgcccgccggcggggcgtcgaccccgatgcactgtggggcgacatccttcggttctgggcggcctgcgacgcccgcgagccgatcggtttctcgtccgcgttgcgcacatttgaggagatggtgaccggatag

SEQ ID NO: 7513 - DNA, 501 bp, Methylobacterium sp.
atgaacgagatccgcttctaccgggccagcgacaagccctacggaccgttcagcaacctctaccggcggtctatcgagttcgagggtgaggagttcgccaccagcgaacatgcgtaccaagcaggcaaggcgcggaagcctgcggtccgccgctggcttatggaggcgccgtcgccggcactactggctatggctgcccatggactctactactgggacgtggcgccgggatggtcgacttccaagtttgaccggatgcgcgccgtgctccgggcaaagttcactcaacacacagatctgcgcgatcttctcctctcgacgggcgacgcacgccttgtcgagagcgcgacagtagacaacgaggtcaaccggctgtggggcgaggtcaacggcgtcggccgaaacatgctcggcgttatgctgatggagttgcgcgacgagcttcgtttcgaaaacggcgaggaggcggctgagacgcaattcactgtggccgccgagtag

SEQ ID NO: 7514 - DNA, 213 bp, Methylobacterium sp.
atgagcctctctcgattcgtctctgagctcgccgcgctcgacgcccgcgagacccgcgcccgctacgccgccgtcctcaaagccgcgaaggcccgcgccgggacaggcaggtgggcggacgagcgcctgcagatccacgtcgcgaccgcggaggcgagcgtcctcatgtccgtgcggttcgccatcgcctccatcgagcagtcgatggcctag

SEQ ID NO: 7515 - DNA, 138 bp, Methylobacterium sp.
atgcgtgctgcgggctaccccgacgtgcgggtggtttttaaggatggtgccgtcatcgttgagcctgcgctgaaggacgacagcacgcatcaaggccctgtgccgcctgcggatcaggaagagttcgacatcctgtga

SEQ ID NO: 7516 - DNA, 213 bp, Methylobacterium sp.
atgcggatcgaacgcaccggcgcgcggccgcgcaaggacgcccgcggccgcgtcctagcatccctcaacgatgagcttgccacggccacccagatcgccgggcgcgccgggatcccgggccgggagaggaggcgggaggcggcccgggtgctgtgtcggcttgaggcggatggcctggcgatcagagagattgatcggcaggtgccccgatga

SEQ ID NO: 7517 - DNA, 147 bp, Methylobacterium sp.
ttgtcgggccaacactcgtccgacctcgaacagcgcggcatcaatcagcttgcgcaggactggcgagccaatctcgtccaccagcggtcgaacagcgatcagagcgtctacgacacgatcgatggtgtccatctgctgatcggctga

SEQ ID NO: 7518 - DNA, 546 bp, Methylobacterium sp.
atggaagcctggccggagatcgagctcgacctcgatttcaccgaccggctggtcgacgtgatcgacgaggggttcgacgcggtgatccgcaccggcgaggcccgggattcccggctgatgacccgggtgctcggcagctacgacctgaagctggtcggcgccccggcctatttcgccgcccacggaatcccggaatcgcccggggacctcgccgggcatcgctgcctgcgccatcgcttcccgaccaccggccggctggaggattggctgccggatccgggcgatccgatcgagctgcgcaccgcggcgacgtccaacaccatcgagccgctggtctgcctggccgagcgcggcctcggcatcgcctgcctgccggatttcgcggttcgcgcgcagatcgaggccgggacgctgatgagcgtgctggacggtgcggtgcatcgctgcggcaccttccgcatcctctggccgtcgagccgccagctcgcgccgaagatccgcgtcttcgtggatttcatggcggagaacctgttcgcgccgccgtga

SEQ ID NO: 7519 - DNA, 252 bp, Methylobacterium sp.
gtgcatgccgccgtactcgaggaggctcggcgagccgggctgctcgatggcgaaaagtcggagcacgtgagcttccgcgtgccgcccgccctggtggatgccgccaagcgcgaggcgggtatcacgtcgacagccgagctcggcatggtcgccctggcgctcctggcgcaatccgatccggtcgctgatttcctcggccgcacggcggggcggctcggaccggaccacgatctcgataccggctcgcgttga

SEQ ID NO: 7520 - DNA, 564 bp, Methylobacterium sp.
gtggatctgcgcggcgcgcttcggcggcgcaagccggacaagcgaagcgcccgcctcgttccccgtccacgccatgaactggcggattgggcggcctacggcgagtcggcgcccgtggccctcgtcctcgacacgggcgtctatatccacagtgcggccggcaggatgcccaaggcgctgcagcagctcatcgagcgcgccttgctgttccactgcgtggtcgctcttgcagaattgtcggtcgggatcgccgccgccgatccgcgcagaccgaactgggcagcgttgcgcgatcactatgctgaactcttcgcccagataccgcacacgcgcctactgacgcccgacgcgcagaccttcgcggatgcgggtctcgtcgctggaactctcgcgcgcctccaaggctatcagagtcatcagcgcacggcctgccttgccgatgcgctgatctttctcaccgccgcacgggccggccttccggtcctgacggccaatcgcgaggatttcgatctcatccagcaattggcgccggagggacggtttctcgcctacgagcgcgagtga

SEQ ID NO: 7521 - DNA, 141 bp, Methylobacterium sp.
atgccccagccggagccgatcagcaccaccatcgccacggcgttcgtccagtgcatgatccgcaccggccatgggtgcaagcgacgcctggatctgatcgcgttcatcttcatgatagcgggcgcccttcgtgtgttttga

SEQ ID NO: 7522 - DNA, 123 bp, Methylobacterium sp.
atgagcgacgggtttctgtccgctgccatcataaccccgctgatgctcgcggcgaccgccggcttcgtcgactggttcacgagccggcaggatcggcgcgatgcttcggagcacgagcgctag

SEQ ID NO: 7523 - DNA, 837 bp, Methylobacterium sp.
atgatcaagaagcttcttctcgcgagcgccgccacggccctcctgaccggcgccgcctcggccgccgacctgccgcgtcgcgccgccccgccgcccgtcttcaccccggtgcccgtgttcacctggaccggcgcctatttcggtatcaacgccggctacgcgttcgacgccagcagccgctcgaacaactccaccttcggcgtgcccttcccctacgccgcccccggcaccaccgccaccttcagcaaccgcagccaggacggcttctccggcggcgcccaggtcggctacaacgtccagttcaccccgggctcgggcgtggtggtcggcatcgaggccgacgcccagtacctcgacttcggtcgcggccggaacaacgccttcgtgagcggcgccgtggccccgggctactacgtcaccgacccgcgcggcctgtcgagcctcgactacttcggcaccgtgcgcggccgcctcggctacgccttcgaccgcaccctggtgtacggcaccggcggtttcgcctacggctcgggcagcgctgaccgctcgttcggcggctacgccggcaacgacagcttccgtaccggctacgccgtcggcggcggcatcgagtacgcgctccccaccgactcgttcctgaacttcttccgctcgtcggccgtgacgctcaaggtcgaaggcctgtacgtcaacctcgaccgcaacacccgcaaccagggcgcgctggtggtcaacgccgccaacaacttcccggtcgcctacagcaacgtcggccgccgcgacgacgagttcgccgtggtccgcgccggcctgaactacaagttcggctcgtactaa

SEQ ID NO: 7524 - DNA, 837 bp, Methylobacterium sp.
atgatcaagaagcttcttctcgcgagcgccgccacggccctcctgaccggcgccgcctcggccgccgacctgccgcgtcgcgctgctccgccgcccgtcttcacccccgtcccggtgttcacctggaccggcgcctatttcggtatcaacgccggctacgcgttcgacgccagcagccgctcgaacaactccaccttcggcgtgcccttcccctacgccgcccccggcaccaccgccaccttcagcaaccgcagccaggacggcttctccggcggcgcccaggtcggctacaacgtccagttcaccccgggctcgggcgtggtcgtcggcatcgaggccgacgcccagtatctcgacttcggccgcggccggaacaacgccttcgtgagcggcgccgtcgccccgggctactacgtcaccgacccgcgcggcctgtcgagcctcgactacttcggcaccgtgcgcggccgtctcggctacgccttcgaccgcaccctcgtgtacggcaccggcggcttcgcctacggctcgggcagcgctgaccgctcgttcggcggctacgccggcaacgacagcttccgcaccggctacgccgtcggcggcggcatcgagtacgcgctccccaccgactcgttcctgaacttcttccgctcgtcggccgtgacgctcaaggtcgaaggcctgtacgtcaacctggagcgcggcacccgcaaccagggcgcgctggtggtcaacgccgccaacaacttcccggtcgcctacagcaatgtcggccgccgcgacgacgagttcgccgtggtccgcgccggcctgaactacaagttcggctcgtactaa

SEQ ID NO: 7525 - DNA, 879 bp, Methylobacterium sp.
atgatgcggactagctcgtgccgggacaagccggaggcgaagatggttcagacgtggttcatcacaggtgtgaacagcggcttcggtcgcgagatggcggtgcaactgctcggacgcggtgagcgtgtggcaggtacaacgcgccgtccggacgatatcgctgacctgaaagctaagtacggtacgagcttctggaccgcacagctcgatctgacggacacagcagcagttgtggacgtggtgaaccgcgcattccacgatctcggacggatcgatgttgtcgtgaacaacgccggttacggccagtttggagcggttgaaggtctgagcgacgagcagatcgcgcggcagattgataccaatctgatcgggccgatccacgtggtcagggcagccctgccgcacctgcgcagacagggcggcggacgcctgatcgccatgtcgtcttacggcggccaggctacccatccgggcgcttccctctatcatgcaagtaagtgggggctggagggtttcttcgactcgttagcggccgaggttgcccccctcggcatcggcgttacgattatcgagcccggtgccgcacgcaccgcattccggaagacggccggaacgctgttgggcgtggacgtcgacgcgtaccggaacacgtcgatcggcgcgatgcgtgcgatgctctcggatcccggcgccgtcgcgaagggtgatcctggcaagatcgttcagattatgatcgacagcgtggatctatatcctgcaccgaagcggatcgcgttgggcggagatgcctacaccatgattaagcgagcgctggtcgagcgcttggccgctttagaggcgcagaaagatgccgccttctcgactgacgtggcacgctga

SEQ ID NO: 7526 - DNA, 879 bp, Methylobacterium sp.
atgatgcggactagctcgtgccgggacaagccggaggcgaagatggttcggacgtggttcatcacaggtgtgaatagcggcttcggtcgcgagatggcggagcaactgctcggacgcggtgagcgcgtggcaggtacgatgcggcgtccggacgatatcgctgatctgaaagctaagtacggcacgaacttttggaccgcacagctcgatctgacggacacagcggcagttgcggacgtggtgaaccgcgcattccacgatctcggacggatcgatgttgtcgtgaacaacgccggttacggccagtttgggccggtcgaaggtctgagcgacgagcagatcgcgcggcaaattgataccaatctgatcgggccgatccacgtggtcagggcagcccttccgcacctgcgcagacagggcggcggacgcctgatcgccatgtcgtcttacggcggtcaggctacccatccgggcgcctccctctatcatgcaagcaagtggggcctggaggggtttttcgactcggttgcggccgaggttgcacccctcggcatcggcgtcacgattgtcgagcccggtgccgcacgcaccgcgttccggacgacggccggaacgctgttgggcgcggacgtcgacgcgtaccggaacacgtcgatcggcgcgatgcgtgcgatgctctcgaatcccggcgccgtcgcgaagggtgatcctggcaagatggttcagatcattatcgacagcgtggaaatggaccctggaccgaggcggatcgcgttgggtggagatgcctacaccatgatcaagcgagcgctggtcgagcgcttggccgctttagaggcgcagaaggatgccgccttcgcgactgatgtagcacgttga

SEQ ID NO: 7527 - DNA, 507 bp, Methylobacterium sp.
atggacaggaacggtcagacctataaaggtcgtcggaagctcgatgcggagacccgcctcgacgcgatcgacttcgtcaaccgggtcaatttctacttcgatcggtgggagaccgaaaatcttctggccgcgttcgacgacgacgtcatcgtcgaccatccgctcggcagaagcgtcggcaaggacgaacttcgcaagttcctcgtcgactacgagccgatcactctgggagtcaggcgtcacaactgcaaccacgtcgtcgacggtctcgacaacggcgaggtgcagattgcgtactacatccttctgatccgcatcgcgccttcggccaaagcgggggacctgaagacgaagcccatggagatcatgcattacgacgagcatctgccgaagctgatctcctacgcgatggtcaccgatgtgctgacccggtcggacacggtggattggcgggttcggcacaagagagtggaaaacgtctccgaagatcgcgtcttccacttctag

SEQ ID NO: 7528 - DNA, 543 bp, Methylobacterium sp.
atgagcttctttccgaaaatcaaaccggccgcagagatcagtcccgacatccgggccgctgccgtggattacgtgaaccgcgtcaactggctgttcgagacatgggatctcgaagccatggtggacgccttcctacccgatgcgcgtgtctttcatttccatggttctctcgacggagagaagcagatccgtacctttctcacggaaacgtacccgtacctcgtgcccggggtgagccggcatgcgtccaaccatatcgtggatatcgaggagagcggcctggtagcggtccggtaccagaacctcctggtgcgccacgccgaacccgaggctgcggccaccctcggagccggtcaggtcatcgagacacgggagttgccggctctctggctctactcgcccatgctcgaccgcctgaaggcaaccgaaagcgggtggaagatcgccgaacgccatatcggcggatcggctacgaacgtcaggtacactcccgccgacacgtcgcgcgcggcgatggagccgttcctgccgaagatctcgtga

SEQ ID NO: 7529 - DNA, 405 bp, Methylobacterium sp.
gtggtcgaagccccacagcgagctttccgcgacatcgcgatggatggcacggtattgtgcttcgtcgaagagctgggttgggacgatctgctgccccacgccggtggtgaggaaatgcagaagcgggacggtgtcggacggtattgtttcgcctgcggcctcgaccgcgcgccggtacgctgtgccatcgaacagggggcctggatcatgaccggcgaccgcgcccaccgtcaggaagtggatgatccggtcgaacggatctgtatcggcttcgagcgcgccggcaccatcatacagcagcgggtggaacagcccgaacagaaggtcgaggccctgtgcgccgagtttggcggtccagggccgcgtggcctccagcaggcgatcgaagccggcgggcacgtctga

SEQ ID NO: 7530 - DNA, 405 bp, Methylobacterium sp.
gtggtcgaagccccacagcgagctttccgcgacatcgcgatggatggcacggtattgtgcttcgtcgaagagctgggttgggacgatctgctgccccacgccggtggtgaggaaatgcagaagcgggacggtgtcggacggtattgtttcgcctgcggcctcgaccgcgcgccggtacgctgtgccatcgaacagggggcctggatcatgaccggcgaccgcgcccaccgtcaggaagtggatgatccggtcgaacggatctgtatcggcttcgagcgcgccggcaccatcatacagcagtgggtggaacagcccgaacagaaggtcgaggccctgtgcgccgagtttggcggtccagggccgcgtggcctccagcaggcgatcgaagccggcgggcacgtctga

SEQ ID NO: 7531 - DNA, 2733 bp, Methylobacterium sp.
atggacgcgaccacccctgagggcggcagcggcaatcggccgacgattgatgccggggcgcccgcgcccaaggtcgctgttcccgcccaaccgccaacgtcgtccctaccgcaatgggagacggaagcggcagtcgccttcctgatcgcgctgatcggctcagggctcatcgcggttgcggcgatccatccagaggcaggcggctgccacggggcgaccttcgcgctgccggtccagcgcgaggccctgagccagtggatcgaggcgcgccagggcaagtacaacctgtactacacgctgaacgaaccggtcccgccggagaagcagcagggcaagaacggccgggtgtgcaaggccgacatcgtgcgcatccgcggcgtggcgatcgactgcgacccacagttcgatccggaggctgccgacggcggcttggccaaggagcgattgaggctgttcgcccaggcggtcgaatggcgcaagcgcgacgcggtcagcgcggccatcgacagcggcggggggtaccaggggatgtggctgctgcgggaaccgctaccggcgacccccgcgaacgtcgccgccgccgaggcgcaggcgcgcggtctggcgcaccttaacgacggcgacaatacccacgacgtctcacacctgttccgcctccccgggacggtcaatctgccgaacgcgaagaagcaggcgtgcaagcgcgtgccggccgccgtgcaggggaaggtattcgacgacccgcggcgcctgcacacgctcgaggatctcgcgatcctggcacccccgatcgccacgcggcaagccgccaaggcgcggcgcgaattcgaactatcggcggcttgggaggcccgcggtaagccagaaaagctgcccccggagctgatcacgcgtctgacggcagcgcgcacaacacagcctcagctcgacaagtgcctgaaggaggacacggtccagggcgatcgctcgaagcgcgacttcgccgtggccgcggccgtcatccgggccggttttctggagccccccgagatcgccgcgatcgtggcggcatactcgccggagaagttcgaggcggaggccgaagcccgaggtggcggacgggccgagtactatctgcgccggacggtcgcgaacgccctggcgcaggtcaagccggatgccccgtcgcccgggcgcaccaagccagctgctcagccgagcgacttcttcgagatgatcgaggacatcacggccgagccggctgaggcgatcggcgagccggtcgacctgttcggcgaggatgatccggccgatctgtcgaccccgccccccaacagcctgccggacgtggtcgaggcgttcgcgcgcacgatcgccgtgcagatgggcgtgccccagagcttttccgcggtcacgacggtggccgccctcgccggcgcgatcggcaacgcgttgcgattgcaggtgaaccagcacagcaccgacttccgcgtgccggcctcgctggccatggtcctcgtcgctcgaccgggccggaagaaatcgccgactatcgacgcggtgctggcgccacaccgcgccttggatcgcgagctgcacagggcgtccggtcaggcgcgctccgcgtggcgcgcggcgcactgcacgccgaagggctcaccgaaggtcggtgcaccgccgccgccgcccgaacgtcaaatcctggtcgacgatgccaccctggagaaacaggtgcgcatccacgccgacaatcccgccggcataattcgggcgccggacgagctgttggcgttcctcggcagcatgggtgcgtacaagcgtagcagcgagggcgaccgcggcacgatcctgaagatgctcgacggcagcgccgtcaagatggaccgcgtgtccggtacggttcgggcggacagcgcgctcatggggctgatcgcctcgacgcagccggacaagatccgcaccctgacgcgcgatctcggcagcgacggtttcctgcagcggctgatcttcatcaccgacgacggcctcgatcggctgcctcgggacgtccccgtggatcgtggcgcagtcgctgaatatgagcgcgcggtgcgggcgatgttcacacttcgctcgagcagctgtggcctggtccagctatcgccggaagcccgtgcgatcttgtcccaaacctggagtcgggtgcgagccctggggcggctcccgggggcgtcagaagcctgggcggggcacatctccaaatgggaggggatgacctaccggatcgcgctgacgttccacgcgctcgacagttgggcgtgcacgggcggcgtgccgacgggccccgggacggatgtgaccgccgcgaccgcgcggcgcgcgtcccggttcatcaccttcctggtgcggcatgcgctgcgcttctacggggaattctacgagccctcggagcatacggccgaggcgcgcgaggtggccgggtatctgctgacgcggccggacatcctgtccgtgaccgcccgggacatcgagaaggtgcgccgcccgctcgcgggcaagcggtcgctcacccaggccgcgatgcgcgagctcgagcacctgggatggatcaccgtggccgaacgcggcgcggagggcccgtcaagatggacggtcaacccgaggatccacgagcggttcgccgcgcacgccgcgcgcgaaaagctgcagcgcgcgcaagctcaggcacagatcgcagcggcgttgtcggcaaaacaggggcttcgagatgtgtga

SEQ ID NO: 7532 - DNA, 675 bp, Methylobacterium sp.
atgagcttcgagagctccgccctctactaccggatgatcaacgaggcggtgcgcaagcgcctgggcggctggcgctcggccgacctcctgatgcactcggtcgacttccagcccgtggtcgacatgcagcgggagggccgctgggacgatgcgggacgccacctcgccgaggcggcgcgggggctggaggcggccggagccgagtgcatcgtcgtgtgcaccgtgaccatgcacctcgtcgccccggccatcgaggcggcggtcggcgtgccgtttctccacgtcatcgacgttaccgccgagcgcctcaaggcggccgggcggcgccggcccctgctcctggcgacccgctacacgatggagcagggcttctaccaggcccggatggcgcgccacggcatcgaggtggtgacccccgacccggacaggcgcaggctcgcccacgacatcatcttcgacgagctctgcgccggtaaggtgctcgaccgctcgcgcgacgcgctggtcgacctcgtcgcccgggcgaaggccgagggcgcggacagcctgatcctcggctgcacggaggtcggcatgatcctcgatccggacggcacgccgctgccgggcttcgacagcaccgccatccacgccgccgcggcggtggacttcgcgctgggcggccacgtcgcctga

SEQ ID NO: 7533 - DNA, 348 bp, Methylobacterium sp.
atgtccctgatcctcggtgccctcctcgcctgtgccgccggcctcgccggcatcgtgctctgccctgacgactctacccggcgctcgcgcctgccgctgctggcaacgttcctgctgggcggcctcgcctggcacgcccccgccagggcggccgagcccctgcgcggcccggcccgggtgctcgacggcgggaccgtcatggtcggcccacaccgcgtcagcctctacggcatcgcggcccccaatgccgaccagacctgctcggacgcccagaaccggccctatccgtgcggcctggcggtgcgcgatcgcgcggagccggcctgcgcggccgccgatcgggcctag

SEQ ID NO: 7534 - DNA, 171 bp, Methylobacterium sp.
atgaccgaccgcgccgccctcgacgtggtgatcgtcaactggaacggcggcgccctcctccgcgcctgcctggcaagcctcgcatccgtccgggaggccgcatccgtgcaggtcatcgtggtcgacaacgcctcgcaggacggctcggcggacgacctgcccgccctgccc

SEQ ID NO: 7535 - DNA, 180 bp, Methylobacterium sp.
gtggtcggcgtgcccgaactctccttcgtggcgacgcaggtgaacaaccgcgccatggtctacccggccgagattttcctgtttgtcggcgccgtctacggatgcctctgcctgctggtcgaccggctcgcggcgctgctggcgaggcagcgtcgccgaccgcgcgcgggcagggcctga

SEQ ID NO: 7536 - DNA, 135 bp, Methylobacterium sp.
ttgccgaccatcgccaccccacgccgagcggccccacgatccctgttccgcagcgggatcggcccgcgcctcgccctcgccgtggtgctctccaccctggtctggctcgtgatcgcctgggcgctcgcggcatga

SEQ ID NO: 7537 - DNA, 420 bp, Methylobacterium sp.
atggggcgcagcgtcggcgatcagtgcgtcgcgctcggcagcgagcagcgcgacgaggcggcccgccatgtggtccgacggtcgacccttcgggccgatcagcaccgtctcgatgggcaggcatggttcgaacggccgcagcacgatcggcagatgcgcgagcgcgcgtgccggaaccggatcgacgatggcaagcccgagaccttccgccacaagaccgcagcgggccgccgtgtactgagccatgaacggaaagcgcggcgcgatcccggctcctgtcaaaagacgctcgaattcgccctgaaaagcgcccggcgcccccgctatcagtgtctcgccggcaagatcttggatcgtgaccaccgcccggcgcgccagcgcatgatgccgggggagcgcgcagacggcatcgaccgatag

SEQ ID NO: 7538 - DNA, 393 bp, Methylobacterium sp.
atgtaccgccacgcgagcgcccggaagctcggcactcaagcgccggatagcccgcggaagcagcgacgccgcgagcgaaggctggcacgcgatacgaagcgggccggtcccgacatcgcgaatctcgcgcgcgacgtcgcgcagatgttcaagtcccgcataggatcgctcgaccttgcgagcgaaagcctcgccctcacgggtgggcgtcgcgcttccgtgacctcggacgaagagatcgaacccgacatcggcctcgagctgcgcgattgcgcgactgatatggggctgcccgataccgagtgcggccgccgccttcgtcattccgccatgacgcaagacggcgcggaaaaggtcgagatgaccggggttcatcatgccccttacgcatga

SEQ ID NO: 7539 - DNA, 141 bp, Methylobacterium sp.
gtgctggaaaacgcggaggcgccgcgttcgcggatcggccgccgaaccggatggaacggcctagccaagctgctggtcgagtcgatcacccatccggcctacctcgattggcggattcggcccggcaccgcgcctcgatag

SEQ ID NO: 7540 - DNA, 210 bp, Methylobacterium sp.
atgtctaccgatactgagaagcaccgcgccctgctgggcgccctcaaggacgcccaaggcaagggcgatggctccttcgagacggctgccgtcgcagccttcgaacacgtcttcgagcacttgggtcgcctcaacgaccatgtcgcgcagggcggccccgatggtgaggaacgacgcctgaaggacggggaatccgccactttacgataa

SEQ ID NO: 7541 - DNA, 486 bp, Methylobacterium sp.
atgtgcggtgccaaggcccgctcaaccggtgagccgtgccgacagacgcccgccaagggccgcaaccgttgccgcttccacgggggcgccaccccgcacggcgacgggccggccggctggcacacgccggggttcccggacggcctgccgacgggcaagccacgcagcgacgcgcacaaggcgcgcaaacgccggcagcggagggccgagatcgcggcgatgaccgcggacgagctggcgcggctggaggcgtggcggcgcatgaataagcctggcagcggccgcgatcgggcccacgggcgtcacgcccgggaggcgcgtcggtggctggaggcgatcatgcacgaggctcccgccgcgccgacgccggatcggatcgagctggacgcgctgcgtgccaggcttcgggcccacctggcgcaactcgacgccgagatggctgaacccgtcgaggatgagccgctcgtcggcggcctattcgactga

SEQ ID NO: 7542 - DNA, 1008 bp, Methylobacterium sp.
atggcgggaacggaagcaaaggtgccggtcactgtcctcacgggcttcctgggatctggaaagaccaccctcctcaatcaactgctcgctcaaggcgaggctgaggggacggccgtcatcgtcaacgagttcggcgaggtcggcatcgacggccaactcgtcgtcggcgccgacgaggacgtgatcgagctcaacaacggctgcatctgctgcacggtccgtgcagacctcgtctccacgatcgggcgccttctcgagcggccaaagcctgtctcgcgcatcctgatcgagaccacgggcctcgccgacccggcccccgtcatccagagcttcatgctcgacgagcatctccgggcacggaccgagctcgacgcgctcgtgaccgtcgtcgatgcccgccataacccgctctggctcgccatgggcgaggagacggaggccgcgggcggggagaacgtcgcgcgggagcagatcgccttcgccgacctcctcctgctcaacaagacggacctggtggacgaagcggccctggaagcctgcgagaccgagctccgccgcatcaatccgctcgcccgcatccggcgcatgcgggacgggtcagtcccggccgcggaagtgctcggcatcggcgccttcgacctgaagaacgcgctggccatcgagccggaactcctgtcggacgtggaccacgagcacgacgacgcgatcgcgagcgtcgcgatgcggtccgagggcgatctcgatccgacgacgttcttcaagtggctgaacggcttcgtacaggcgaagggcgccgacatcctgcggatcaaaggcatcgtcgccttcgtcggcgaggcgcggcgctacgtcttccacggcgtgcacatgaccctcgacggccgtcccggccgaccttggcgcccgggcgagccgcggcggggcgagatcgtgttcatcggccgcaacctggacgcgcaggagatcgaacgcggactcgcgcggagccgcgcagcggaagcagcctag

SEQ ID NO: 7543 - DNA, 735 bp, Methylobacterium sp.
atgaagcttcagcacaccctcggcggtctcgaaggcctcgaccccgtccagcccgagctccgcgtcttcgtcgagccctgggaggagcggatcttcggcatccacaccgccatgatggcgctcagcccgccgctcaacctaccgcagacatcgagcaccttccgcacggtctggacctgggccgacctgcgcaagggcgccgaggcgatgaacccgttcgattacttcaagtaccgctactacgagaaatggctgggcggcatctcgggctacttcgtcgcaaacggctacatcacgcaggccgagctcgacgcgcgcacggacgagtacctcgccgatccggccaagccgctgccgtcgggcggtacgccggaggtcgacgaccgcatccacaagtacctgatggacggcgactcgccctggcaccggtgggcggacaagccgcgcttcgccgtgggcgatgaggtgctggtcgccgacccgccgacggtcgagcacacccgcctgccggggtacctgcgcaacaaggtcggggtcgtggagaccgtctacgacgatgcgttcagctacctgtgctcgaccgggcccgacggcatcggcccggccatgccggtctactgcgtgaagttcgacccgcagcacctctggcccggcaacgccgagcccggcttcttcatctacgccgatctgttcgacgcctacgtacgcccggtccaggaccgggccgccgcgtga

SEQ ID NO: 7544 - DNA, 624 bp, Methylobacterium sp.
atgaccgaccgcttcgcctatccccaggaccgtgaggcgcgcaacgcggcgcgcgtgcgggcgctcgaagccctgctgatcgagaagggcgtgatcaccgatcagaccgtcgacaaggtcatgcagaccttcgccacagagatggggccgttcaacggcgccaagctcgtcgcccgcgcctggaccgacgacgcgttcaaggcgctgctcgtgaccgacacgatggcggccgtcgcgcagcttggcctgcccacgggggcggcgggcgcggagggcgagcacatgcgcgccgtcgcgaacacgccgcaggtccacaacctcatcatctgcacgctgtgctcctgctatccctggccggtgctggggttgccgccctattggtacaaggacccgtccttccgtgcccgtgcggccagggagccgcgggcggtgctcaaggagttcggcctggacgtcgaacccgcgaaggagatccgcacctgggacagctcggcccagatccgctggttcgtcgtgcccgagcggccggacggcacccagggcatgagcgaggacgacctcgcgaagctggtcacgccggaggcgatgatgggcgtggctgtcgccctgccgaaggcggcctga

SEQ ID NO: 7545 - DNA, 321 bp, Methylobacterium sp.
gtgcagacgagcttcgagcacttcgccgttgccagcatgatgggacagcccgacacgccgccccgcgccaacggtagcctctgcttccatcagccctgggagcggcaggcgttcggactggccgtcgcgctcgcccgggacggccacttcgaatgggaggacttccggcaagcgttgatcgcggagatcgcggcctgggaggcgacccattcccgcgacgaccccggctgggactactacgagtgctggctggccgccctcgaacgtgtgacgcaggagcatgtcgcccccggccgtgcggtcgaagaacccgccccatag

SEQ ID NO: 7546 - DNA, 630 bp, Methylobacterium sp.
ttggagtacgaggctacggtcctggcttcggtctgcggggccgtccgcctcggtcgccacgaagagcttcggagtttgctcgcgcgaagggaccttggagaggacgccgtttcggcgctccggttccgggaggccgacttagagtacggagtgatccttccgaccgagcgcacgtggaatctgcctcggctgcagggcccgacgttcgatgtcggctttgagatgtccgccgccggccatcggatactggtggttccgccggcggacgtgaggctgcagccgcgcctcggcaacgctcaacacgtctttcatgcgaagaaggcgccggcctgcggcgatctggacgtgctgatccgccggatcgagacgcagggcggcgaagccccgctcgacgcttgcgtggccgcgttggacagtccgggcgcgcgagagcgcatcttcggcctcgtgttcggtggccacctctcgttggatctcgcgtcgacgatcacgaatatgagcatcgtccggctcgggtctcggtgtcggatgtccagctgggacaagctcgggtggcacatcctccggaccgatcgggcaccggccagcacttcgccggatgccgcggagttggagatcgggtcggcctga

SEQ ID NO: 7547 - DNA, 117 bp, Methylobacterium sp.
gtggactcgatctgctcggacggcgtcaccggcaatgccggattgtccttcttgctcgggacggagccggtgatagcgcaggatacgactgtgggtttcatccgctcactcatctaa

SEQ ID NO: 7548 - DNA, 618 bp, Methylobacterium sp.
atgatcgttcagttttcgacgggcggccgggggcgagatccgtccgagcgcagctcggccctgtacctcggccccgacatggcctccctatcgaccggatcggtgaatttcccgacggtcgtgtaccagaaccccacgagcctcgtcgacgatctcgccggcaagatgcgggattacggcattcggcccgagatcgagatcttcgatctgtcgcatctccacggcgcgcgccggcttatcgagaaggggctgatggacgatcgcccgcacgtccagttcgtgatgggcgtccagaacgcgatgccggctgatgagcacctgctcgatcttctcctcgcggagctgcgccgggtgctgccccacgcgacatggacggcggccgggatcggtcgcgcccaagccaccgtgatggaatgggcgctcgcccggggggcggacggcgtacgcacgggattggaggacaacatccgcgtgacgcgggataggctggcccgcagcaacgcggaactggtgcaattggcggcggatgcgatcacgcggcacggcgggcgggtggcaacgcctcaggaggcacggcaggttctcggactccgcccggcggcagaggccgttcattga

SEQ ID NO: 7549 - DNA, 276 bp, Methylobacterium sp.
atgtctgcggctatcgctcaccaaatcgaacgcgaggacggtagggtccgcttgacggtccatcgtcatgagattggcttctttttctacaccgaggacagcttcgaggcctgggacgacacgcctgcggtttggcgagaagcataccctccttccggtctcttcgcgacggcggaggaggctatggctgaggccagagctattataccctggttgcaggccgcctccaccaaagggcacgcaccaccccagccaaagtcgtcggacgatgactga

SEQ ID NO: 7550 - DNA, 270 bp, Methylobacterium sp.
atgtcgggcgacgatgcggctctcgcccagatggtcgatagcttacgcgcgcatctcccgaaggcgggtctcgatcagggcgagatgcagcaggtcggtgcccgcttgccagcgagcctggtccggcaagcgaagaggcggacgggcctcagctccaacacggatctgctgattgtcgccctcgccaacctggcccttgaggacgccttcgcggatgcgttcgaggcggcgcacgggcaactggaccccgagctcgatatcggtttttga

SEQ ID NO: 7551 - DNA, 132 bp, Methylobacterium sp.
atgaagatcctcgtcgtctcagcccatcccgatccggcctcgctgaccaacgcgttgcgcggcgtggcggtggagcaattgaaagcggacggacacgaggtccgcgtcaccgacctctacgccgcgggctag

SEQ ID NO: 7552 - DNA, 678 bp, Methylobacterium sp.
atgagtcttgagacccgaagcgaccgccgcgcagcgcccctctcaaaagcacagatcgtcgaggccgcgatcggcatcctcgatcaagagggcgaggatgctctcactttccgcgctcttgccaagcgcttggcgacggggagtggcgccctttaccaccacgtctccagcaaggatgatcttctggcagcggccaccgacgacctcatcgcccatgtggcgaggcgagcggcggccgaggcgacacccgacgaaaggctgcgagccctcgcagggggggtgttcgacacgttggagcttcatccttggatcggaagcgcgctgtcgcgaaacccttggcagtatgcggtggtgcgactgatcgagagcatcggccagcaaatccaggcccttggggtccctggcccggcgcagttcaacgccgcgaccgccgtcatgagcttcattttggggctcgctagccaacacgcttctcgcgcaaggctgttcccgcgggaagccgatcagacggcgttgagggaagcggcccttgaagcgattgcggcgcggtggatgacgcttgacccatccgagcaccccttcgttcgccaggtggcggaaatcctacccaagcatgacgatcgcgagcagttcttaggaggcgtagatatcatcgtgagaggtctacagtgcctttga

SEQ ID NO: 7553 - DNA, 636 bp, Methylobacterium sp.
atgatcacgctttacacttggtcgaccccgaacggccgcaagatcccgatcatgctggaggagtgcggcctgccctacacggtggtgccggtgaacatcggcaaggacgagcagttcgcccccgacttcctgaaggtctcgcccaacaacaagatcccggccatcgtcgacgacgaggccgagggcgggccgttatccgtgttcgagagcggcgcgatcctcacctacctcgctgagaagaccgggcgcttcctcgccccctcgggggcttcccgctacaaggcgctggaatggctgcactggcagatgggcggcctcgggccgatgctggggcaactcggcttcttcgcggtacgctccgacgagaaggcgccgctggccatcaagcggttcactgacgaggccgaccgcctgctgcacgtcatggaccggcgtctaagtgaggggccgtacctggcgggagcggactactccatcgccgacatcgcctgctacgcatggacgctcgcggccacgtcgttcctgaaggagccgctcaaggacacgctcggcggcatcccgaacgttcatgcatggctcgctcgggtcggtgagcggccggccgtacggcgtggcatggaggtcccgaagacctga

SEQ ID NO: 7554 - DNA, 828 bp, Methylobacterium sp.
atgtcatcgccaaagcgaaaacatgttgtcttcgtcggaaattgcaatgcctcagatctggcttcgttcttctcggaaataaactctctgaaggatgactttgcgtttcaccccctcgcccttcacataacgccgaccccgtcgcccgagctgcaggcgatcgtcgatacggcgcacgccgtcttcatccagggtattgccgaagccgagagatacgagcgggagtcggtcccaccgggtgttgcgcgctttggctatccgaacctcctgcggcgcgccttctggccgttcgacggcctcatctacggccgggacaggctggccgaggcggatgccgtcaagggcggtctcgtgcgcttctcggacggtctcctggccaagctgcgcgaggatatcccggacccggaagagcggttcgccgtctatcgtgatctcgacgtgcgcgggctcgtgaagaacttctcgcgcttcctcgagatggaagacgaaaccctcggttttctcgacacgacataccgctgtcatctcggcgcgttcgtccgcgagaacaccaagacccggcagcttttccattggctcgggcacccgagcggcatcctctacagggagctgatggcctattgctgcgagaagcttggcgtcgcgcccgagcttcccgatccggccgcgctcgatggttggggaacgatgcaggtgccggtgcatccggcggtggccgaccagctcggcctggaatgggcccgacccggccgccgctaccattacgtcccgatgggccacgtcacctgggaggacttcacgcggacatacatccggcatctgggctga

SEQ ID NO: 7555 - DNA, 1350 bp, Methylobacterium sp.
ttggacagcctcgcgacgcgccgctttaccgccggcgaccagtgcgccttcgcggcgatgtcgggtgaccgcaatccgatgcacatggacgccaaggcggcgcggcgcacgcaggccggacgtccggtcgtgcacggggtccatgcggtgctgtgggcgatcgacgccgccggcgacctcctgaccggagccgaggccctggcggtgcagttcgaccggatgatctatgtcggcgacctctgccggctccggcgtggccggcacggtgccgagggagcgcggatcgagatcgtgttggacgatgccgtcgtcacccgcatcagcctgcagcccaggtcagaccggtctccgccgcctcccggcgccgcggagcagacactcgttctggagccgcgggcgggcgatatcgcggcggcgttcccccgcgcctcggccgcgctcgggatcgccttcctggtcgagctcgtgggactgtcgaagctcgtcggcatgatctgcccgggtcttcattccatcttccgcggcttctcggtgatccgaacggcgggcccggtcggcacggcgatgcggttttccgtgctgcgcgacgacgaccgcttcaacctcgtgacgattcgggtgaccggcaccgcgctgaccgggcaggtcgacgcgttccggcggtcgccgccgacggcgcagccgagcatcgacgcgctgcgagggtcggtcgaggcgggtgcgttcgccggacgccgggccctggttgtcggcggctcgcgcggcctcggcgagctgaccgcgaagctgctggcgctcggcggggccgaggtcaccatcacctacgcggtcggcgacagcgaagccggccgcgtcgcggacgagatccgcgcgggtggcggtctctgcgacatcctcaggctcgacgtgcggcagccgccgatcgccggacagctccccacaggcaaagccttcgaccagctctattatttcgcgacgccgttcatcttcggcaagcgtggcagggaactcgacgccacgctgctcggcgagatgatggcgttctacgtccacgccttctacgagatctgcacctgcttacgtggcggcggcgcgcacgacatcgacgtgttctatccgtcgagcgtcgccgtggcgcagcgcccggccggcctgaccgagtacgcgatggccaaggccgccggcgaggttctgtgcgcggacctgccgcgtctgctcaagggtgtccgggcccatgtccggcgcctgccgcgcctgcagacggaccagaccgccaccgtgcagccggtggaaattggctcggcggtcgacgagatgctggccgcgatccggagcgtccagccccgttga

SEQ ID NO: 7556 - DNA, 900 bp, Methylobacterium sp.
gtgaaggaatcgtcgaagaccggtcataagagggtcctcgacgtgctccgccgggccgccctgaccgcgaaccaccacggcatcggcttcatggcggcgggggtcgcgttctggagcgcgctcgccttgttcccggccgtggccctgctggtctggctcgcgcaccaccttctcggggtcgccgacgttcgcaacacccttctcacggtcacccatgtcatgcccgacagcgtcggggacatcgtcgcgcgggcgatccaggcggcgtccgacgcaaacccggcggaccgtgggaccgacctcggctggccggtcggcccggcgttcggacttctggtgagcctgtggagcgtgaccgtcgcgatgcaggccctgtttcacgccctggaccggactttcgagacggaaaaccgccggtcgtgggtacgcctgacggcggtgagcctggcctttaccctgggggctctgatcgtcatggcctgcgcccttgcggcgacggttgcgctctcgcaagtgctcgcatcgctggacggggcgctacccgggatcattctgcgctgggggacggtcttcgtgacctcacttttgaccgtcgcggtcctgtaccgtgtcggcccttcaggccgccgggagggctggccgttcgtaacggtgggctgcgtggccgcggcgatcatcctcgtggcggattgcagcctgtttacctggacggtcggccacttcgccaccttggagatcacctacggctcgctcagcacggtggcggccttcctgctctggctgtgggtatccgtggccattgtcctgtcgggggcggaactcgacatggccatccatcgcgtgatggattgttacggaggtcggagtgtaggcggcaggatgagactgactgtccgatag

SEQ ID NO: 7557 - DNA, 912 bp, Methylobacterium sp.
atggaagcagcgaggacggaagggctgccggcgcgtctggctgcgcagatcctcgactgggcacagagccaaggcctgtcgaccggggcgcacttacgagaacagaccttggcggacaccttcaaggtctcccgcaccccggtccggctcgcgctgaacctgctccgcgacgcgaacgcggtcgagcaacggccgaaccgaggcttcttcctacgcgagcccacgggagtacttcctcagggagcggaagggcggggtcccgtcgtggatgatccggtctacctgcgcatcgcggaggaccggcttgctggcaccctcgccgagcgcgtgaccgaggttgaattgcagcggcgctacgccgtcacctccgcccgcctacggcgcattttggcgcggatgacagatgaaggctggatcgaccgcctaccggggcggggttggatcttccagccggttctcacctcgaccgcagcctacgagcaggcctaccgctaccgcctgctgatcgagccagccgccctgcttgaaccgggctacgtcgtcgacgcggaggccttcgcccgcgttcggtcgcagcaactcgcgatgctggatggcggcatagagcggttcccagatagcgagacttttcgcatcggcgcggagttccacgagaccctcgtcgcctgctccgggaacgtgttcatgcttgaaggtttgcgccgagtgaaccgcttgcgccgcctcatggactaccgagcacatcgtgaccgcagacggctaccacatgaatgtcgggaccatctcacgatgctcgacatgatcgaggacggtcgaatggggcaggcgtccgaccttttacgggttcatctagcgaaggtctccgtgctcaaggcgagacttgtagatgtcgtcgactttcaagaaagctga

SEQ ID NO: 7558 - DNA, 285 bp, Methylobacterium sp.
gtgttctcgtcctgggcgcagcgcgtctcggtggacgcgatgcggatgtcggccacgaagaagagttcgtggcctatgttccaggtgtcaccgtgcacgaccgcgacttgcgaaccctcgaccgaagcaccctgggcgagcaggcctgatgccgacccgaccaaggaagacatgacgaccgcgcgccgcgacggtcggggcatcgaaactgacatcggcagcaccttaggcttcgaggacgtcacttcgtgccaggcctcgccagccgcgccgaacgaggcctga

SEQ ID NO: 7559 - DNA, 108 bp, Methylobacterium sp.
atgtcggcacggtccctggaggcctccttcgaggcctccgctgcgcttcggcacctcaggatgagggggttggatcggatgcaggtctcgcgttcggcggcgccttag

SEQ ID NO: 7560 - DNA, 777 bp, Methylobacterium sp.
ttgacagtcatcgtgggagcgctgtgttccgatggtatcgtcatcggggccgacagcatgtcgacgtcggggaacggccggaacccgctgatccaggtccgctccgacgacaagatccggatcatagacgacaaggtcattgtcgtgggcaccggcagcatcggccttgcgcagcggttcgaggctatcgtcgagcaatcctggcggggcgaggtgttcgagcgcggctgccatgaatgcggtgcatccatcgccgcccatgcgcgccaggagttcaccagcagcggggtccacttctcgtccagcgcagggctggattttggcgccatggtcgccgcgccgatccacgacgcaccggaactcgtcgagttcaacaccttcgacctgcagccggaacggaagacgcgcaggcggcactgggtagcgatgggagccggacagaccctcgccgacccattcctcgccttcgtcagccgggtgctgtgggacggccgggagccgacggtcgcagcggccactgtcggcctatgttgggcgatcgagcacgccattcactacgcccccggtggggtaggcccgcccgtgcggctagcagtcttgcggcgcgaggctggcgaatggcgggccacgctgttggaggacgacgcgttgcaggaaccgaggcagcacatcgcggagatcgagaagcgcattggcttctacgctgctgatggcctcgcaatcgcgccgccgcccccgccgcccgccccagtgaccgagacccacgaacacggctaa

SEQ ID NO: 7561 - DNA, 444 bp, Methylobacterium sp.
atgacccgacgcgatctactcctgtccattctggctgcagccaacgggcaaccgtacgagccggtgcaggtccagaaggcgacgtttctcgtgcttacgaacctgccctggctgctggacgaggggccggccttcgcgttcgagccttacgattacggtcccttcgatagggccgtctacgccgaagccgagcaacttgcgcgcgacggccttgccgtcgtccgtccatctgcgtccggccgctggaagacctatgccgccagcgagatgggggtcgcccgcggccgcgaggtccttaacggcctcgccccgcagttcgcccggtacatcgacgacatcgcgcgctgggtccgcgcgcaggagttcggcaacctcgtccgctcgatctacgtggcctatccaagcatgagggccaacagcgtgttcgtggaccacggccattga

SEQ ID NO: 7562 - DNA, 474 bp, Methylobacterium sp.
gtgccggcggtgcgcaccatcgaagacgccgacaccgtttcccggcacgtctacgcgccccgcatgctcggggcggccgacgagttcgtatggcacgaaatcttccagttccccagcgaccgcggcatggccgagagcgtcgccgtccgcaacgtagtgcccgcagacgcagacgtgcatcggctagggtgcgagaagcaggacaaggatcgcgagcgcgagcgtgcgaagggacggactggcccgacctaccgcggatgtaccgacgcgctcgccggagggatccgtaggcagtcatcgaccaggggacacggcttctccgtcacccatgagccagccgaaggcgactggcacggccacgtcaccgtcctcctcgccgcgggctgcagcaagctcagcaagtcggacaaggacgacgtccgcgagctgatggcgggagtattcggacccctaaaaccgcacgcctgtccgtaa

SEQ ID NO: 7563 - DNA, 450 bp, Methylobacterium sp.
atgaatttcgcccgagcgagcttcgcggacgcgatgcccgtcatgtccacgggcacgccgttcgaactgtattcggacctcgatttgaccgccgacggcgcgtccgagcggcagcgccgcgcgcatctcctcgatgcgatcaggcaattgccggcctacgcggacgccttgggatacccgaaggtgaagccgatgaccgtccgcctggcacaggacttcgtcctacgcctcccgcacaaccgtgcgctgcccaaggttgccgtcgacgacgagggcgatatcctgatgcggtggtccggcccgaccggccgttgcgcgttgaccttcgaggggtccgtgctgcacatgacggttaatcccggcgccacctcgcagcacgtcgagcccaccatctacaatggcggacatatcccccccgggctcctcctccacatccccacccgcggctga

SEQ ID NO: 7564 - DNA, 777 bp, Methylobacterium sp.
gtggtctgcggcgtctacttccagtccctcgacgacctgcaggtcgcccatgtcggtgccctttgggagcgtctaagacgggacttcccccgcacggagacgctgccgcccctgccgcccgctatcgtcgcgaacgggttggcggacttccagatccagttccagttcggtccgattgaggcgagcccattcccgcgcgtctggttcgtgtccgccgacgacgccaccctggtgcagctgcagcgcgaccggctcatcatcaactggcggcgccgtgccgaggacagcccgtatcccagctacgacgccatcgtcgccaggctgcgcaacgtcctcgggctactggtcggcttcctcgaagagcagtccctcaggacgccggacctcgtcggcgtggagctggcctacgtcaatgccctccagttcggccgcgacctcgacggcccggcggacatcggatcggtcgtcccgttcctcgcttggcgccccccggcaggctccctcgaccgcctggcgctgtctgggctcagctggaacgcacagctcgacctcgcggacggcgaggggaacctccatatcgggctcaacacaacccagcgccccagcgacgggcaggggctggtccgcctggatctgctcgcgcgcaaattctcgccggcactgcaaactcatgctatatggaactggttcgatctcgcgcacgcttccatcgtgacaaccttctcggacatcacaagccgggacgtgcagaacaaggtctgggagaggcacacatga

SEQ ID NO: 7565 - DNA, 204 bp, Methylobacterium sp.
atgaatatgcccgaagatatgacgtccgctcacaagggcgcgttcaatttgaaggagttcctggcctggtccgggatcgggcgtaccaaagccttagaggagattgccgcccgcaaactacaggccgtcaaggtcggccggcgcctgctgatcccggtcgatgccgccaaggcgtggctcgccgatcagccagccgcccgctga

SEQ ID NO: 7566 - DNA, 1119 bp, Methylobacterium sp.
atgatcaacgcgctggctctcaacctcatcgcggacgtcatgaactgggacaccgaggaagccacgagggagtatgcgtggctacgccttatgtctgcggtcaagtatgacggctattcagacttccgggcgggtgtgcgcttcctcgagagcttgtccacctggctgcgccagttcacgcctgctgaccgtcccgccgcctacgatttcgtgaaaaccaggctcgtctacctttcacaggccgagatgcagcggattattgaggtgttcatccccgagacagtgacgccacacctcaggaaggctgcggcggccgaggttgggatcagggcctgggaggtctggggaagcgcagacggggtagcagccttcaatcgccttctccgccgcagcctgtttgtcggcctcagtgacggcagccgcatcgacatacttcgccgcgccaattcgcctcgcctcgtacaagaccagtttgtgccgatgctcgacattggagacgagaagtggctcgacctcggcaaagagctctcgaaggcgcaaggcgaggatgcacggttcgataatgtctacctgattgatgattttacggcatcgggcacgacttttatcaggcaggtcgatggtgtttggaagggaaagctgaacaagttcaacgaactcgtgttgaaggcgcgagtctcacttggcgaccggtttccagtagcagataaatatgtactgcatattcatcactatatttcgactgatcaagcacgacgtaatcttgaggagaggatcgatgacgccaagtctaacctaagtaaccgatcgtttaacgaggtcacgattacagagggattgcgcctgcccgcaagtctcaagatgaccggaggaaccgacgcagcgatgctcgacctttgcgaacgctactacgacgatcatctctaccaacgcttgaagaaacattgcgacgaggcaggacagagcgacatgaagcgaggttacgcgaactgcgccctcccgatcgtgctagagcacaacgcgcctaacaacgcgatcccgctgctctgggcggagacctccggccgtcaaggccacgcaatgcgcccgctcttccgtcgccgtgatcggcacggctga

SEQ ID NO: 7567 - DNA, 1113 bp, Methylobacterium sp.
atgtcgcgcgcgcactggagcaactgcatcactcacttcgacgacgaggtcaggagcttcgtccgcgactattttgccgacgaaggcaggcgctgtctgctcgttgccgcagctggcttcgatccccggtcccaagtcatcgcgcgtatgcttgccgggacgctcggcaaccggctcagcgcgctgttcatccgcgaggagcgaggaaggcccgatgccaacctcgttgcggatgccgacgcgaacgaggctgctctcgccgcgatcgtgcctaactgccgggtcgaacgcgtcgacatcttcggcgatgacggcgccgccgttggcgggtcaaacgttgcggccatgctgtcgaaggttggcatcgatcctactaccaccgacgtcgtgctcgacatgagcgcgctgtcgatcggcatcggtttccccgttgccaagctgctgctgggcgattgtgaggcggccggcggccgggctttccacatccttatcgtctcgaacccggaactcgacgaccggatctcgagcgagccctccgagcgtgctatgccggtgaaaggcttttcggggcttggcggcctgtcccagaccctcgaccaggcacgcatctggatcccccaactcgtcaagggccgcaaggccgcgctcaccaacatcagcctctcggtcggcgagtgttataagatctgcccggtcctcccctttcctgcccgcgacccgaggcgggccgacgcgctcatcggcgaatacgagaacgagatcgttaacgaatggcaggtcgatccgcgcgatatcgtttatgtctcggagaggaacccgctcgacagctaccgcatcatatcaacgctcaaggaacgctacgatcaaacggtcgaaggcacgtacgagcccttggtcatcctctcgcctattgggagcaaggtcatggcggccggcgccctcatggccgccctcgagcacgacctcgccgtgcagtacattgagaccgcccgctacgaattcgacggttcggatcctcgcaacgacgatccacccgaaatgattgtgcacgtgctgctcagcggaccggcatacggcgactacggggcgattgcctccgcggactccgaatga

SEQ ID NO: 7568 - DNA, 1941 bp, Methylobacterium sp.
atgatgccgatctttaccgagaagctagatgccctcgatggcacggtccgcctgctcgagaccttcgacgtcgcgtcgatcgcaggtgggctcgctgatggccgtggccactattcgattgcggtcggctcaggcggatcggcgattgccgcacgcttcttcgcgcgctgccgcgaatcgctcggtctcggcccaacaagcgttgagacgccaatggaagtggtgctcggcacccacgacatctccggcaccgatatctggctgttcagcgccggtgctgagaacgcggatgtcgccgccgccgcgaccgcggcgtttcagcggcggtgccggcggcttcacatcatgactcgaggaccgtcaggcgccgcagcggtcgccgtcgccaacagcggcggccgcatccactccgtgcctgtcaccaccgaccaagacggctatctcgccacccactcgatgatcgcaacgatcggtgccctgctacttgcctcggacgccgttggccacgaggcgcgcggccatgccaaactcgtgcaagagctgtttggacgattgaggaaggtccgcgatccggcccgccggtcggcgacggccgaacgcttcgcatcacttggacaccgtgacacggtcatgctcttggccgatccacagctgcgccctgtaacgaccctgctcgagacatcgatctgggaggcatccatctgcaccgtgcagagcaccgacttcaggaacttcgcccatggccggcacggctggctgcaccaccgggccgacgagacgctggtgctggcgctgactgggttggagacacaggaggtgtgggctcggattggagcggcgttgccgccgacaatccgtacgatcgcactcgacctaggcgacagtggacgcctgtcgaacgcgctcggcatcatcgacgggcttggtatcattgaggctatgggccaggctgtgggcatcgaccctgctaagccgggatacggtgagttcggcccggtcgtctacaacgataggtcgttggaagccgtcacgtccggactgccgccgagcatccgccataaacgtgctgccatggcgcgatccgacgagcgaggctcttcgcccgatcctctgccagttcaggcccgcgcacggcttgataggcttgcgtctgccacgatcggcggtctggtgttcgactacgacggcacactcgtcgcgaccgccgaccgctactcgccgccgaggccggagatcgttgagcaattgatccggctagacgcggcgggcgttaggctcggagtcgcgacgggacgaggtaactccgcaggcaaggaccttcgcgcggtactgccgcccgagatgcactcccgtattctgatgggctactataacggcggccacctcgcactccttaatgtcgacatcaagaaggaaccgcccaccgaagatccggctatttcggagacggtagaatggttgcgatcgcacggcgaactattcgtcagtgctgaatacgaggttagcccgctccagattatgattaacgccgagcttttgcaccaaccctaccgcttccgtcgcgatatggccgagtgcccggcggtcatttccggtcgggtcagggtgactggatccggacacagcttcgacatcgttcccgcggcagcgaccaagctgcgggtcgtggaggcggtcaggcaggtgatcccaagggaaacggaggtcctctgctttggcgacagcggctccttgatcgggaacgatcacgcactcctcacccactcgtacgggatcagcgtcggtgaggtatgcggggcgccgaacggttgctggtcgctgttcggtgaccacccgaccgggcccgatgcgcttcttaacgctctgcgtgctctggtgtcctcccaatcagtgggggaaattcggctcgatgtcagttcgatggcgctcgacaggccgtga

SEQ ID NO: 7569 - DNA, 900 bp, Methylobacterium sp.
gtggctggcaccggcttcacggtcctcgaccgcatctatacgaacggctgcctcgcagacgagagcctaggcggctcgtgtggcaacgtgctgctttcgttggcgatgctgaatcggcaggtagcaccggttctcgtgctcggggacgacgttgagggcgaccagctggtgggcgagttcatcagtgccggtgcgttgacccactacatccatctaaggacggatctgcgctccccgatcctagctcaggagctggacaccgcgtcaggtctgcacgacttcagtttcgtgtgtccagagacgagcgctgatctaccccgatatcaacctatcggcgagacagagcttgaatccgcgctgcctgtcctcgctcgctgctcggtgttctacgcggacaggctatcaaagagcattcttaaggcgatgaagactgcttggtcagccggcgccatcatctttttcgagccctcggacatcgacgatgaagctatgttcggcgaggcaatggggatggtctcagttctaaaatattcggccgaccggcttggcaatctcctgtccgatggttcttcccagtgtgtgcgtattgttactcacggcgccgccggtctggaggtgaggcacggcgagggcacccactggtgccgcgccgtgaacgccccagtcgtgctcgacacctgtggctccggggacatggtaagcgttggtatcatcgactggatgatctcgaagaggatagaacctgaccgactggacgcggccgatctgatcggggggatcgtcgccgggcagcgccttgccgccgagaattgcgcatacgcaggcgctcgtgggctcttccgcatgcggggcgcaggctacgtccggcgtatgctcggcggggactcgtccaccccctga

SEQ ID NO: 7570 - DNA, 246 bp, Methylobacterium sp.
atgcgcagactcctccttgcaggcgcggtcctctcatcgctgtgctgcgtgccagccttcgcctttccgggcggatcctacgcggcgagctgccgccgcatccacatggaaggcccttacctcacggcgctctgcggtgatgggtacggtggcgctcgctggagccggatcttcgcgcgcgaatgcggcgggacgggcgtcagcaaccagcacggccacctcgtgtgcggcggctactaccgttag

SEQ ID NO: 7571 - DNA, 207 bp, Methylobacterium sp.
atggtctcctggccggacgggatggcgatcagcggtgggcggacggaatggtcggtcccggccatcaggcggctcgacccggaacaggagggcggcagccttttcggcgcacctgggcccgacatgatcctcgccgatccccacaggcccggccgccgtcgtgcgcgcgccgagcggagcgcctggacccggcaggatagggcgtga

SEQ ID NO: 7572 - DNA, 171 bp, Methylobacterium sp.
atggcaatttttgaggttacgaaagtggacgacgtgatttcgactgcgcggccgacgaggatgtcgggcccccgcccgccgctgccgctggtcgtagcctccgtcctatccgccgcggcgatttgggtgccgatctataaccttgcgggccgcgtgatctggttctggtga

SEQ ID NO: 7573 - DNA, 123 bp, Methylobacterium sp.
atgatggcggaggagcgcgacgacgaggctggcggctaccggctgctcatcgtcaaggccgaggggggtgccgccgtcgatgcggccctcggcctgatcaaggccgccctcggcaaggcttga

SEQ ID NO: 7574 - DNA, 369 bp, Methylobacterium sp.
atgccggcctggcgaattgagggggaggtgaccatgctgccgacccccaccgccgcgaccatgctgcgcactaacaggcttatcctccgctcggccctcgaccgcgccgccggagacgcccgcctcctcgccgagggcgtcctctatgtgtcggacctggaggctcgcgtcgccgccggggacctcgacgccgaggccgccgtagcggacgcctcccgcgtcgcccgggcccttacccagatgggcacgcatcgggagcgtcgccgggcgccccgaccgcccgagcccacgccggtgcagatccgccgagaggactgcgtcgtgcgcgacccgggcggcccctggcgcccggtgacggacacgcagtga

SEQ ID NO: 7575 - DNA, 228 bp, Methylobacterium sp.
atgacctgcatcgcgatcctgctcgaaaccccgcaggggatacgcttcctcgtcgccgccacaccgcgggaggctgcgctaaaggccgagtccgttattgccaccattccgcaaacccagttgcccgttccagcttgggtcgcaggagctagctctggcacggccgatcgactgatgaactacctggccgacgtgcagatggagcgcgtgctggagggggccctataa

SEQ ID NO: 7576 - DNA, 1068 bp, Methylobacterium sp.
ttggccttcctcaaaaaaagcataggcggcaacgtcgtcgtaatcttcgggttcagcctgcccttgctccttggtgctggggggctagccatcgactatggcaacgccgtgcgcgtccgagccgtcgagtccagcatcgccgatgccactgcactgcttgtcgctaacgcggatacagtcgcggcagccaccgagggcctgcgcctcgccaacgctcaactcacgtctcgactcggcttgggtaacacgtctagcgggtttcaggtcaacggtacgtgggtcgatggttccaactatcgagtgacgatcacgacgacgctgaagaccagtctactacatcttctgcccggcatgccccggcagatcatggtcagcaccgcgaccaccgtcaaccgggtcgcaccagtctaccagaccgccccaccaacggtcagccagctttcgcctgaggccgccgactacaaccggatctatatgtattgctactcgtccgatccgaagaggcaggctgaagccgacaaggggcgccggggcatggtcgccgtcgccgataatggtagcccgccaaccgactactccaaaaacaccatgccggtctgcggagccaacgaagcaccgagctacatgctgcgcaacgtccgcaatgcacgcgacacgcgctctgcttgggacgaaaagaaccaagagatctatcaatactacaccgacaccaccatcgataccgggctccgcatccagtcgatgagcatgaagggctatcgcgtctacgcgaatggtagcctgaattctcttgatatgaacgccaatccaatcttagagacaattgtctgcgacaactccaaccagtgcaagaacaagtcgagtggcggcatcctgcccaacagccacacgacgcataatcccgccacggcgacaacgagttgtagtgacgggaagtacatgtactacgggtgggaggatcgcccgccaaacgcgggcagtgaccgcgactacgacgatattcgtgtcatcgtctcctgcccgacgctcgtgaaagtctccgacaagaagcttcggatcgtcgaatag

SEQ ID NO: 7577 - DNA, 168 bp, Methylobacterium sp.
atggctctccggctcgagaaagcattcgggttcaaaatggaagccatgatggaaatgcagaagcagttcgatattgctaaggttcgcaagcgtgagatggcgcggcagagtcagctccatgctcaaacgaacgcttcggagaaaggacggcttcgcgccttcggctag

SEQ ID NO: 7578 - DNA, 204 bp, Methylobacterium sp.
gtggcggcgcgtagcgccaccctcgaaggagccctccagaggccgacgcgatccctggggggctccttcgaggccgaacgatctgcgatcgcccggcacctcaggatgagggggatgggtgggatcgggcggttgctcgaatgctacctcgatggcggcgatctcaacttccaggctccgagggtgacggcatgggcagcctga

SEQ ID NO: 7579 - DNA, 438 bp, Methylobacterium sp.
atgaacgtcgtggatgcgaacatcatcaagagcggtcttctatcgcgcaatggcgcatccaacgtcgttctcctagggatgctcgagggcacgatcccgttcgcggcctcaacagcgatcatcttggaatatgaggatgtcctgatgcgcgagggggagcggagtgtcctgccgctgctcgggagtgacggtgtcgccacaattctcgatgcgctctgccggatgtgccgcaggacctccatcttctaccgcttccgccccttcctggccgacccgaaggacgatctgtacatcgagcgtgccttggcctcgcaatccgacacgatcatcacctttgacggtcacttcagacattgtgacctgcgcgctttcggattgcggaaggcgatacccaaagacatattgaccgagatgggcctggcgaggacaccgtcatga

SEQ ID NO: 7580 - DNA, 81 bp, Methylobacterium sp.
atgaccgagatctcccggcgctccatgatcgccgccgccggcggtgcgatgatggcatcccccgccctggcccagaccgcc

SEQ ID NO: 7581 - DNA, 225 bp, Methylobacterium sp.
atggaggatttttctactgaagacgcggtaattcaatggattctttcccctttcaaggacgaaaccgaacgaggccgcctgaaagcctatcttgacaccctcacgcaggacgatgtctcggacgaggaactgcgaaagctgtggtggtcgtcggaggcagacatcgtgttctacgatggcgccgaactcagagccttcctcaagagagtgcgagacagattgtga

SEQ ID NO: 7582 - DNA, 138 bp, Methylobacterium sp.
gtgttggcgatggcgggtgtggtgtcaaccggcgccgggttcgagcagctttgcacgcgcatcccggggcgggatttttcggcggcgcagttgtggtggcgggtggtgagtcaggccgaggcgcgcacggtctcgtga

SEQ ID NO: 7583 - DNA, 891 bp, Methylobacterium sp.
atgttgtatgacacttcgctcagcgaagacgcgaaattcatctatcccttcacggatcccgaacatctcgggcatcatgatctcgccgaaacgatcctaagatcggatgcccggaagctggccgaattatcttcgaaaatccgaagcactgacaaggcgtgtgtgctttccagcgaggagttttgctatctcccgccgagcgcgctgaagacattcggtgattatttgcagcctgcagatgtctcaatcgtgtattatgtgcgcgatttcctgacaagcctgcatccctggtggcaagagcaagtcaagcacggcggcacgcaaacgttcctggaattcgccctcggctgtttggcgcagccgcatagcctgcatctgctcatccccgatgtgatgctgacgaattgggcctccgcttttggcctagataacataaaaatctttcggtatgacgcgataccggatgtggcgcggcaatttgccgacgatatgctgaatcttgcgcttccgctcgacagttttacagcggtgaataaatcctatacttatatcgaaaccgagatggtgcgcttctggaaccgtttgggagttcgaggagaggatttgatccagtcgccgaacgtcggcggattgtcggcggatatcgtcacggagtcgcgcgatttcatccagaatttcagcctgagttacgcgatgcccagttttgctgccatcgaggaaatcttgctcacgcgctggcgtgatcggattggcggttcgttcgggcaatatctttttgagacgcgggagcggacgtatgcctacgtgcatccggatttttgggttgtgcgttccgatcttgccgagcgcatgcgcgcgtttgcgtcgggctggccccccaagagtcgctga

SEQ ID NO: 7584 - DNA, 141 bp, Methylobacterium sp.
tcgcccgagcgcgacggcatccgcgtgtccctcggcatgttcaacacgcccgcggacatcgaccggctgatcgaggcgatccgcgcccgcaacgtgcggtccacgccggccagggcggccgtgctgtccaatcccggttag

SEQ ID NO: 7585 - DNA, 120 bp, Methylobacterium sp.
cgcgacctcgtctacgtctccaacgcgcccttcaccgaagtctcgaaggtgctgacggcgttcagcggcgtcaccggaccgctcagctccgccgccacggcttacgcctacgcgaaatag

SEQ ID NO: 7586 - DNA, 141 bp, Methylobacterium sp.
tcgcccgagcgcgacggcatccgcgtgtccctcggcatgttcaacacgcccgcagacatcgaccggctgatcgaggcgatccgccaccgggagaaccccgccgcctcggaagcgcgaacgagcgccctggccaagctctga

SEQ ID NO: 7587 - DNA, 540 bp, Methylobacterium sp.
atgaggccgatctgccgcgtgctgccgatcgccccgtcaacctatcacgcccatgccgcgcggcgggccgatcccggcaagctgccggctcgggctcgctcggacgcggcgctcatggtcgagatccggcgcgtgttcgaggagaacttccacgtctacggagtgcggaaggtctggcggcaactcggtcgagaagggatcgcggtggaccgttgcacggtcgcccggctgatgcgggtcatggggctgcagggcatcgtgcggggcaagaaggttcgcaccaccatcccggacccggccgcggcctgcccgctcgaccgggtgaaccgccggttcaaggccccgcgtcccaacgccttgtgggtcggcgacttcacctacgtcgcgacctggaccggctctgtatacgtggccttcgtgatcgacgcctatgcctatgaatcggcgtcgaagcatgaccccggcaaaaactttgctaacgcactctctgatctgcgaaaatcgagatcggggtggggtcacgatcggcgccgatcgtga

SEQ ID NO: 7588 - DNA, 909 bp, Methylobacterium sp.
atgcggtatgatgcgatcatcgtcggcggcagcttcgccggcctctccgcagcgctctacatcgcccgagggcgccggaaggtctgcgtcatcgatgccggcgcgccccgcaaccggtttgccgccgcctcgcacggcttcttcgcgcaggacggcgagaatccgctggcgatgatcgcgacagcccgcgcgcagcttgccgactacccgaacgccaccttcgtgacgggggaggcggtgtcggcgcgagccgcaggcgacggctttgccgtctcgctggccggagggcaacgcctcgcggcgtccaagctcgtcctcgccttcggcatcagcgatatcctgcccgatcttcccgggctggcggagcgctggggcgcgagcgtgctgcactgcccctactgccacggcttcgagttttccgggcgcgtcctcggcgtgctgtcggccggcgccctatcggtccatcaggccgaactggtcgcggaatggggcccgaccacgctcttcctgaacggacacccggcgcccgacgcggaggcctgcgcccggctcgccgcccgcaacatcggaatcgaacccggcccgatccgggcgcttgcgggcgaggggcgggccctctcggcactcgttatggcggacggtcggacgctcccgctggaggccctcttcgccggcccccgctaccgcctgaacagcccgctcgccgaacaactcggctgcgccgtggatgagggcatgctcgggccggtgatccgcaccgacgcgatgaaggagacgacggttcccggcgtctacgcggccggggacgcggcacggtctccccacagcgtggcctgggcctcggcggacggcgtgaccgccggcgtggcgctgcatcagacgctggtgtttccgcgcctggcggcgtga

SEQ ID NO: 7589 - DNA, 558 bp, Methylobacterium sp.
atgaccgcgaccgccgccaaggaaatcgtccagaccttcgagaaggtgttcgagccgatcgatcgtgagcgcctgcacgccctctccgagaagggccgggccgatccgagcgtggtcaagaccgtgcgcgcccgcaccgtcgccgagggccgccgcttccgccatctcaactacatccgcagcctcgacccccacatcgtcgacgagccgccggctctgctcggcgacgacaccgcgccgaacccgaccgaggcgttgctcgccgcgctcggcacctgcgtcgcggtcggcctccaggccaacgcgatcgcccgcggctggaccgtgaagggcatcgaggtcgagtcggagggcgacatcaacattacctcggtctggggcaccggcgacctgtcggagaagccggtcgggctcaccgccgtgcggctcaaggtgcatctcgacgtcgagggcgcgactgcggctgaactcgacgaactcgtggcccatgccgggcagtggtcgccggtgctcaacaccgtcaagaaccccgtctccgtcaccctggcgcgggcctga

SEQ ID NO: 7590 - DNA, 534 bp, Methylobacterium sp.
atggcgccgacgcctaccgacaagccttcgctagacccggtgatcgcagaaggtaaaccagatccggcggccgtccggatcctgcggtgcaagacggtggcacagggtcgcctcaaccaactcaactacatccggggcctgccgccgcagccagtgatggaagacgagccggagggtctactgggtgaaagcgttgcgccgaacgcctccgaggctttgctcgctgccctggggtcctgcctttccatcggcatccacgccaacgccttggcacaaggcattccgattcggtctctggaactcaatgtcgaggccgacatcaacatgacgtcactctggggcagcggtgacctccatcccaagacgattgggttcgagagcatccgcgtctccgtgaaagttgacgcggatgcctcccgaaaagccctggcgacgctcgtcaagcacacggttctatggtcgccggttgcgaacacactgcataacccggttcatcttgacgtggctctggcgagatccgtcgtgctggcatga

SEQ ID NO: 7591 - DNA, 10758 bp, Methylobacterium sp.
atggccgttaagctcaatcttcaagatctgaccttcatcctgaagcagatcaagatcgccgaagcgcatgcgagcggcatcaagctcacggaactgcgcctcgatgccgccggcacgcttctcacggatcgggggctctacgacgccaccggcaactggctcggcgatgccgcggcgccgaaggcgattgcggatccccacgtgccctacgggctgcgcacggtcgacggcacctacaacaacctcgtgcccggccgcgagacctggggctcgtccggccagccgatgccgcaactcttcgagccgacctacctcaacgacgcggacggggacacgatggcgctcggaccgggcgctccggtcatcacgaacaccaattacgggctgcccggttcggtcgccgatgccgacccgcggatcatctcgaacctcgtggtcgatgccacgctcgacaacccggccgccatcgccgcggcgcttcggatcgccggctcggagaacgtcatcgccgatcagcgcgccatcacggcagcgcacgaggccctgaaggccgcccaggccgcgaacccggccggggatcacgcggtcctgcaatcgaacctcgatgcgctgctggagcagaccggcgtcaccgtcaccaacggctccatcgacgtgctcaacgtctcgcccgacgaggggctgtcgaagccgttcaatgcctggatgaccttcttcggccagttcttcgaccacggtctcgatctgatctccaagggcgggaacggcaccgtctacgtcccgctcgccgccgacgatccgctcgtgctcggacaggacggcctcgccggcactgccgacgacctcgcgccgcatctgcgcttcatgacgctgacgcgcgccgcgcaggtcgagggttcgcagcgcaatgtcacgacacccttcgtcgaccagaaccagacctacacctcgaacgcctcccaccaagtgttcctgcgcgaatacgcactcgtggacgggcggcccgtcgcgaccgggcgcctgctcggcggcgcggacggaggcctcgccacttgggcggacgtcaagttccaggcgcggacgatcctcggcatcgaactgacggacgccgacgtctcggccgtcccgcaattgctggtggatgcctacggcgagttcgtccgcagtgccaacggcttgccgcaggtgatggtcggggtggggcctggggggcaggccgtctacgccagcggcagcctcgccgagccgctaaagctctcggcgatccagcttcccgtcggcaccgtgctggtgggtcccaacggcgcgcagaacgtcatcgaggccggtgagacggtcgcagcggcccgcaccttcaacgcgttcctcgacgacatcgcccacaacgcggtgccggtcgccgtgaacggcgtgctccggcccgatgccgacgtgctcacgggcaatgcggttcagatgaacccgcagaccggccgcaatctcgaatacgacaacgagcttctcgaccggcacttcgtcactggcgacgggcgtggcaacgagaatatcggcctcactgcggtccaccacatcttccattccgagcacaaccggcagatcgacgcccataagctcacgattctgcagtcgggcgatctcgcctttatcaacgattggctggcaaccgacatcgcggcgctgccgggcaacttcgcgcagatgacggcgctgggtcagctcgcctacgccaatacgctgtcctgggacggtgagcggctgttccaggcggcgcgcttcgccaccgagatgcagtatcagcacctcgtcttcgaggaattcgcccgcaagatccaaccgctggtcgatccgttcgtgttcaacccggtgaccgagatcgacccgtcgatcttcgccgagttcgccaatacggtctaccgcttcggtcactcgatgctgaccgagaacatgccgcggctcgggccggacgggcaggcgctcgacgccgacctcggcctgatcgacgctttccttaatccgttggcgttcgacaacgacggcggcctgtcccacgacgagagcgcggccgcgatcatgcgcggcatgaccatcgaacgtggcagcgaaatcgacgagttcgtcgtcggtgccctgcgcaacaatctgctcggcctgccgctcgatctcgcggccatcaacatcgcccgcggccgcgatacgggcacgccgacgctcaacgaggcgcgggcccagctctacgccgcgacaggctcgaccttcctcaccccctacacgagctgggtggagatggcggccaacctgaaaaacccgctctcggtggtgaacttcatcgccgcctacggcacccacggcaccgttgtcgccgcgacgacgctcgcggccaagcgcgacgcggccatggccctggtcttcggcggcgagggcgcaccgacggatcgcctcgactacctcaattcgcgcgggagctgggccgggcgggaaacgggcttcggcgcggtcgatctctggatcggcggcctggccgagaagcagatgccgttcggcggcatgctgggctcgaccttcaacgccatcttcgaagcccagatggagaacctgcaggacgccgacaggttctactatctcagccgcgtccaggggcagaacttcctcaacgagttggagcagaactccttctcgaaaatcatgctcgccaattcgagcctgtcgctgccggggcctgacggcatccgcggcacggcggacgacatcgtgccccgccatatcggcgtcgatgccttcgccgattacgacttcgagctggaggtgaacgccgccaaccagctcgaccagaacggcgccgcccccgaccgcgacccgaccggaaacgaccccgtgctggaggcgatgggcctcggcaaggtcgtgcgcgacgatcccggcaccgcggccgacgagggcgcgagcggcttccacgcctcggtcaacgccctggtccggcgctacggcgcggacgggagccagacgggcgcgctcgtggacggcagcgaggatggggtcggcggcgccggcagccccgtcacctgggccgatctcaaggcgaatgcggccaagctcggcatcgcgctgacccaggcggacatgctggacgcgccggtgctccggatcggtgccgatgggcgcctcgccttcgctcccggctcgtccgtccccgaggcggtggcggtcgccaacggcagcttcgagggcttggcactagtcgccggtcaggagggcgtgatcctcgacggcaacggcaactacaccacgacgaacccggccggctggaccatcgccgggggcgtcggcgggctctttgcgccggccgacgcggtcgtcgaccccgccggccgcgatggcgccaacgtcgtatggctgcggggcggcgcgacgctctcgcaggagggcgggacgaccctccaggccggcgtcggctacacctacagcttcaaggtcggggaccgcactgacttcacctggccgggcgccgaggcgcgcctcgtggcggtcggcggggcgaaccccgtgaccctcgggacgctgaccctgacggagccggccgacgggcagtggggcactgtcaccctcgcaacgggcgtcgtcccgtcggcgcttgcgggccttcagcttcgcctggagatccgcaacaccggcagcggcgatgcgcagatcctcgtggacgacatcgaactcgtgcggacggcgccggcctaccggtccgatctgaccccggcgcagacgcccggctacgatccggccgccgacccgttcctgcgcgatggcgccggcaacgtcctgcgcaccgggcagtccatcgccagcccggccgccgacctcgacgcaaccgtcgtcgatccggccgcgctcaatcagccgttcgccaccgggcactacctccgcttcaccggcggcgagcacgtgctggtgggcggcaccgacggcaacgacaccatcatcaccgatttcggcgatgacggaatctggggggatgcaggcgacgatcggatcgaggcgggcgcaggcgtcgatctcgtgaacggcggggcgggcgacgacatcatcaccgattccggcgataccggcgacttcctcaagggcgaggacggcaacgacgtcatcgccaactccaacggcgtcgacatcctgatgggcgggcgcggcaaggacgcgatcttcgtcggcgtcgatgcgaccgaagtctttgccggcgagggcgacgacttcgtgatcggcggcgacgacgccgaccttctgatgggcaacgagggcgacgactggatggagggtggcggcggcttcgacaccaccgccggcgacaactcggaactgttcttcaactcggccatcaagggccacgacgtcatgtttgccgggggcgacgagcatgatttcgacggcgagtccggcgacgacatcatggtccagggcgagagcgtgatgcgcaacgagggcatgttcggcttcgattgggcgatctacaagggcaaccagatcgcggccaatgccgacatgcgcatcccgatcttcaccaccgaagaagccgacatcctgcgcaaccgcttcgacaagacggagggtctctccggctggcggctgaacgacacgctcatcggcgacgaccggaccgcggccgccaacgcggatgccgaggcgcctgccggcgcgccgatcacggcggcaaacgagggcgtgttcttcaacgacgggctcgacgcggccggcatcgctcggatcgcgggcctcgaccagatcgtgtcgcttgcttccgggcagcagttcttcgaggccggcaacatcctgctgggcggcgcgggcagcgatacgctccagggcaacggtggcaacgacatcctcgacggcgaccgctggctgaacgtgcgcatcagcatccgcaatcctgcggatgctggccaggagatggcgacggccgacagcctgaagcacgtcttcgacgacagcgccgccaatcaggcgcgcggctgggccggaaagtcgctcttcgagctgatgatcgaccgggtgatcagcccgacccagctcgcaatcgtccgcgaggtgatcaccaccggagcgacggcggcggacgtggacaccgccgtgttcaacgacatccgggcgaactacacgatcacccgcgcggcgaacggcacgctcaccgtcacccacaccacgctgaccaatcccaccgtcgatgacggcacggatacgctgcgcaacattgagaagctgcgtttcgcggacggcacggcggacgtcgcgctggttctcaaccagcccttcgacagcctcaccatcagaccgttcgacgcggacggcgacgattcctcgacactcgtcgcgacgctggtgaaccgtgtgaacgcgaccacccggcccgtgaccctgcaatggcaggtgctggccgacaacgggcagtggcgcaacgtgacgggcgcggacggccaggtcacgaacgggggcaccttcttcacgccgaccggagcgacgggcgtcgagatccgggtggtcgcgaactggagcagcacggtcgccggcaataccggcctgcagcagacggcctccgtccagtccgccttcgtcggaactgccgccgccgaggacatcacgggttccgcgagcccgaacgtcatcctggggcgcgacggcgacgacgacatcgagggcgatgtcggcaatgatgccatctacgccggcagcggcgacgaccgggtcgatggcggcgcgggcgacgacaccctcctcggcaacgacggcgccgacaccctgatcggccggaccggcaacaacacgctcgacggcggcaacgacgacgaccaactctccggcgggcacggcaacgaccgtctgatcggcggcgccggcaccgacaccgccatctactcgggaccgatcgcggcctacagcttcgagcggaacgcgcagggcgaggtcgtcgtcagcgacaacctcggagcggagggcgacggcgtcgatacgctcaccacgatcgagcagatccagatgggcaacgacctcacgccctacgcgctggtcgccaacggcacggcggccgtcgacatcgtggtcgggacggccggcaacaacacgctcagcggcggcgcgggcaacgacctcgtcttcgcgggagccggcaacgacaacgtcctgtggcggaccggcgacggccgcgacttcgtcgatggcggcgccggcacggacagcttccggatcatgaacgggaccggtcccgtccagcagctcacgctggcccaggcccgggcgcagttcgcgaacctatcgttccgtgacgacacgcagaccgtggtcgtgcgcaacgggatcgtcatcgccgagctcaagaacgtcgagcaggtcgccgtgaacgccgtcgcgaccggcgcgcccgtcgtcacggacccgacgccgacgaacgggctcgtctcgccgacggagggccagccgctcggcgcgctggtcgccgcgatccaggacgccgacggtcttggggccttctcgctgcgctggcagcaatcgggcgataacggccagacctggacggacatcgcaggcaacgccgccggcacgctcaactacacgcccggccaggcccaggtcggggacgtgctgaggctgcgggtgagcttcaccgacggagcgggaaatccggaagagctgttctcggcgcccaccggcgtcgtcggtgacagcttcacaggcacggcgctcaacaggaccttcaacggcacagccggtgacgacatcgccaacggcgccgacaccgccctcttcgggatccagccgaacgacacgatgaacggtggcgccggcaacgacatcctgaacggccgcggcggcaacgatacgttcattcaagtcagtaccgacgggcgcgaccgcgtcgatggcggggccggtaccgatacctaccagttgaacggcaccgcggggcctgagaccttccgcatctacagccggtcagcctggctccaggtcgcgggcaatacggaggcgcagctcgccgcttcgaccgagatcgtgatcacccgcaacggcacgggtgccgccgcgatcgtcgccgaactcgacaacgtcgaggagatccgcgtcaacacgctccaagtgacgtcgcccggcggccagaacggcggtgccaatggcggcgacacgatccaggtgatcggcagcttcacgggcaccagcctcaacttcaacaccatcaccatcgacggctcatcgggcgacgacaccgtggacatggccgccctcacctcggcccaccgcatcgtcttccgctcgaacggggggcacgacaccatcgtcggcaccctgcggccgcaggacgtgatcgaactgccggccggctcgaaccgggcggactacatcgcggccgcgggcgccaacggcatgacgaccctctccaacgggtcgcataccatcaccttctcggccgcgggcggcatgccgcggatcacggtcgaatcaggcgccgacggaggggacggcgagggcatcaccggcgccttcgcctacacggcagccgacatcgacgggctggaggcgctggtgcgcggccagcgccctgacaatgccagcgacgacgacgtaccgacgggctaccgcgagctcagcggccacggcaacaacctcgaccacccgacctggggcagcgccgaccaagccttcatccgcctgacccaggcccgctacggcgaggccgacgccaacggcaacagggccatcaacccgatcttcgacggcctcgacgcgcgcaccatcagcaacatcctcggcacgcaggaggccggcctgcccaaggccggaaacgacgccaacatcttcttcatggcgatgggccagtacatcgaccacgggctcgacttcctgcccaagggcggcaacggctcgatcgtgatcggtgcgcccggcggcggggcaccgggctccaacaacccggccgacctcacccgcggcaccgtcatggccgtcgatgcgaacggcgtgccgcagcacaagaaccagacctccccctacatcgaccagaaccaagcctacggctccaacgcgctggtcggccagttcctgagagagagcgacggggcgcagggcgtcggcatgcggctcctggcgggggcaccggacccgtccaaccccgccttcaacctgctgccgacgctgcgcgagttggtcaaccaccactggcaggccgacaccatcttcgccggaccggccgggccgatcagcttccggacctactacacgaacttcgccctgtccgagggggtgaccggcaccctgttcaacacggagaccggcgccttcgacccgcaggtgctcacgaagctcgtcggaaacttcatgggctcgggccatccgctgctgctcgacaccaaccccttcatcagcgtcctcgaccacttcgtggccggcgacgggcgggccaacgagaacttcgccctcacctcgatccacacggtctgggcgcgcaaccacaactaccacgtcgagaagctcctcgaatccggcttcgagggcacgcccgagcaggtgttccaggccgccaagatggtcaacgaggcggagtatcagcgtgtcgtcttcgacgagtacttggagacgctgatcggcggtctgcgctcggacggcacgcacgggttcgaggcctatgatccgagcgtggatgtcgcgatcagccacgagttcgcggcggcggtgttccggttcggccactccctgatcgggcagacgctgaacgtgaagggcgccgacggcgagaccgttccggtcagcctgttcgacgccttcctcaacccgagcaacgatccctcggtgttcaccgcgccgctgccccccggctacgtgccgcagcccggctacgcccagtacggcgtcggcggcatcatcggcggcaccatcgagcaggcggccgaggacgtcgacttcaacatcgtcgatgcggtccgcaacgacctcgtgcgcattcgggccgacctgttcgccttcaacgtggcccgcggctgggatgtgggcctcggcaccctcaaccaggtccgagccgatctggcggcctccaccaatccctacatccgggacgcggtgggcttcgctggcggcgacctctcgccctacgcctcctgggaggacttccaggcgcgcaacggcctcagcgacgcggtgatcgcgcagttccggcaagcctacccggacctcgtcctcgccgccgcggacatcgcggccttccgggcgatcaacggcgacatcgccatcgccatgcaggccgatgggaccggtgtcgtgaaggggatcgaccggctcgatctctgggtcggcgggcttgccgagaagcacatcaacaatggcgtcgtcggccagaccttctgggtcgtgctgcacgagcagttcgaccgactgcaggacggcgaccgcttctactacctcgagcgcttcgacaacttcgacttctacgagaacctcgtcgacggccagggcttctcggacatcgttgcccggaacaccggcctgacggtcctgccggaacacatcttcgagctgtccgacgaggaccggccggggacggagcccggcgacgatgacgacgacggcgacaccgatcccgtgggtggcgatcccgacgaggacgaggacggcccgaccgatccggtcggcggtggcggcgatgccggtggggacgaggacgaggacgacggcgtgaccgaccctgtcggcggcggggacgatcccggcgacgacgaggacgacgggcaaggagacggggacgggacgaccgaccccgtcggcgggagtgacggcgacgaggacgggcccgggaccggtcccggcaccaatccgcccgtcaaccacgcgcccggcgtgatcgccggcggcgcgaacggagacgtcctcaacggcacggcgggggcggataccatcctcggcctggacggcgacgacaacatcctcgccggcggcggtgccgacgtggtccgggccggcgcgggcaacgacttcgtcgatgccggcgagggccgggacgtggtgttcgccggggacggcgatgacgatgtcctcagcggcggcggcgccgacatggtgtacggcgatggcggcaacgaccgcatcctcgccggagccggcaacgacctcgtgaccgccggcgccggccgggacacggtcatcggtggcgagggcgacgacctgttcgtggccgagaccggtgacggcgacgacacctactggggcgacgagatggggggcgggctgggaagcgacacgctcgacatgtcggccatcaccgccaacatcgcggtcaacctcggtacgggtctggccgggcgcggcagtgcgaccagcacccagtcgggtcgcgacgtgctctggggcgtcgagaacgtcgtcacggggtccggcaacgacgacatcacggcgagcgacgccgcgaacgtgatggatggcggcgagggcagcgacacctaccgcttcggctcggccggcgcagcgaacggtgacaccatcgagggcttccggccgggcgacaagatcgacctcagcgcgatcgacgccgatgccgggcaggccgggaaccaagccttcaccctcgcgaccggcgcggccttcacgggggtcggacaactcctggtgacgcaggagacgcgcgacgacggagactacgtcgtcgtccaggggaacacggccggcgacgcctccccggaattcaagctcgccatcaagggcaatacggcgcccacggccgccgacttcacgctctga

SEQ ID NO: 7592 - DNA, 276 bp, Methylobacterium sp.
atgaaggctctgaccttcgccctcgccagcaccctcctgctcgcgcccgcggccttcgccgccgaaggcacgggggcttccggcacaagccgctccggcacggccgacagcacggggccgaacgatgccggttcgggggcgtcccccggagcggccggaagcggcccgacttcgggtgacaagagccgctccggcacggccaacagcacgggcgccaacgatgccggctccggttcctcgcccggcgccagcggcaaaggccacgaggcccgttag

SEQ ID NO: 7593 - DNA, 345 bp, Methylobacterium sp.
atgtgggcggtcgtcgcgttccgacatcatcggcgatcggcggcggacctgcgcgaacgtgtgcagtgcaactcgcgttgggacaccatgtcgaacgacacgatcatctggacgcagggtggcatcgccgaggtgcccctgcagcgcttcaccggccgaatcggcgcgatcgaggtcgccaccgtcgagtatgacgggtcgaaccgcctctggacgtggtggagcccgctcgccgaggacatctggggccatgcacaggagccggagggggccaaacaggccgccgaactctggctgcgcgattggctcgagaatttccggccgttcttcgaggcgggccgctga

SEQ ID NO: 7594 - DNA, 1077 bp, Methylobacterium sp.
atggccgccagcgcccgcatcgcggagcccccttcgctcgacgtcgccgggatcgtgcgcgagaccttgcgcccgcgcctcggcgcgatcgatgccggggaatatcccgccgacatcctgcgggcgctcggggcggccggcgcctatgggcaccacgccgacggcacggcggcggggctgctcgccgccatcgacgcgatgacggaggcggggcaggcctgcctctcgaccgccttctgcatgtggtgccaggacgcgctggtctggtacctcgcccagggcgacgaggccggcccgcgccgccatctggccgcgatcgcctcgggcgcggcgctcggcggcaccgggctgtcgaacccgatgaaagcgttttccggcatcgagccgctggcgctccagggcgagcgcgcgggcgacggctaccgggtgcgcgggcgcctgccctgggtgtcgaaccttggtccgggccagcgcttcgccgggatcctctcgctgcccgacgggcgtcgggtgatggggctgttcgaggccggcgccgattctgtctcgatcgcggccaatgcccgtttcattgcgctcgaaggcaccggcacctacacggtgatgatccgcgacgcgctcctgtccgacgaagacgtgatcacgcacgatgctgccgccttcgtgccgcgcatccgcaacggtttcgttctgctccagaccgggatggggctcgggctcgcccgcggagtcgcggcgatgatgcgcgcggatgcccgtgggcgcgccaacgcggcgttcctgccgctcgggccggacgcgatcgaggcgcgggcggatgctctgcgcgagcgcgtcgccgccgcggcacaagcgcatgccgaggccgaccgcgcgaccttcctcgagaccctgcgtctgcgcctcgacgtgtcgtggctggccctggaggcggcgcaagccgccatgctccaggcgggcgcgcgcggctatctggagggcgcggagacgttccggcgcctgcgggaggcgcagttcgtggcgatcgtcacgccgtcggtgaagcacatcacaacggagctcgcgcggggcggctga

SEQ ID NO: 7595 - DNA, 756 bp, Methylobacterium sp.
atgtcgcgttccgttccccgtctcgccctcgcggccgtcgcctatcgctacggcctgagcccggtgctcgaccgcatcgatctcgaagtcgcggcgggcgagcgcatcggcatcctcgggcgctccggcgtcgggaaatcgaccctcttgcagattatggccgggctcgtcgcgccctccgccggcagcgtgcggctcgatggaatgccctcgcgcgggccggtgccgggctgcacggtgatgttccagcgccctgccctgctgccttgggcgagcgtgctcgacaacgtactgctgcccgctcgtctctcggggcgtctcggccgcgaccgcgcggcccgcgaggcggaggcgcgccgcctcctcgacgatctcggcctccgcgagcgcgtgggcgccaagccgcaccagctctcgggtggtcagcagcagcgggtggcgcttgcccgggcgctggcgagcgagccctcgatcctgcttctcgacgaaccgttctcggcgctcgacccggagatgcgggcgagcctgcgcgccgacgtgctgcggctcgcccaggcccgcgacctgacgctgatcgtcgtcacccacgacctcgccgatgtggccgccctggcggcgcgggccgtggtgctcgacgggcgccccgcccgcatcgccgcggacttttccttcggcgacgacgcggaggccgagttgcgccgccgtctcggttccgttgcccgcgacgcatccggcatcaccggtcgcgccgcctga

SEQ ID NO: 7596 - DNA, 1077 bp, Methylobacterium sp.
atgtccctgttcgaacgcttcctcaccctctgggtggccctgtgcatcgtggccggcatcgcgctcggccacgtcatgcccggcgtcttccacgctgtcggcgccgccgaagtcgccaaggtgaacctgccggtggcggtgctgatctggctcatggtcatccccatgctgctcaagatcgacttcgtcgcgctgcgtcaggtcgggcggcactggcgcggcatcggcgtgacgctcttcatcaactgggcggtgaagccgttctcgatggcggcgctgggctggctgttcatcggcaccctgttccgaccctacctgcccgcggagcagatcgacagctacatcgccgggctcatcatcctggccgctgcgccctgcacggcgatggtgttcgtgtggtcgaacctgacccgcggcgagccgcacttcacgctgagccaagtggcgctcaacgacaccatcatggtggtggcgttcgcgcccctcgtcggccttctgctcggcctgtcggccatcaccgtgccctggggaacgctggtgctgtcggtggtgctctacatcgtcatccccgtcgtgatcgcgcaggcggtccgccgaattctgctggcatccggcggccaagccgccctcgaccgtctgctcggccggctcggtccggtctcgctggtggcgctgctggccaccctggtgctgctgttcggcttccagggcgagcagatcctggcccagccggcggtcatcggtctgctcgcggttcccatcctcatccaggtctacctgaacgcggggctggcctacctgctcaaccgcgctgcgggcgaacagcactgcgtcgccggcccctcggcgttgatcggcgcctcgaacttcttcgagctcgcggtggcggccgccatcagcctgttcggcttcaactcgggcgcggcgctcgccaccgtggtcggcgtcctcatcgaggtgccggtcatgctctcggtcgtgtggatcgtgaaccgctcgaagggctggtacgagcgcggtgcgtcagcacgaggaacggcgctgcaatccgtttcccgcgagacccgagtcgggtag

SEQ ID NO: 7597 - DNA, 1821 bp, Methylobacterium sp.
atgcgggcgacctcgaagaccgcggaaggccttcacgcgatgaacgacgacgactggctcgaactcatccccgacgaggctgcggaagcgccgacccgagccggaacctggaccatcgcggtggtcgacgacgatccggccgtccacgagggcacccgctacgcgctcgccggctacagcctcgacgggcggggtctcgacatcctctccgcctattcggcccaggaggcgcgggcgctgctcgccgagcggcgcgacatcgccatcgtgctgctcgacgtcgtgatggagaccgacgatgccggactgaggctcgtcgattacatccgccgggagctgaaggaggagaccgtccgcatcatcctgcgcaccggccagccggggcaggcgccggagcggcgcgtcatcgtcgattacgacatcaacgactacaaggcgaagaccgaactcaccgccgacaagctcttcaccagcctcaccgcggcgctccgggcctaccagcagctgcggcggctcgacgagacccggcgcggcctggaaatcatcatcgacgccgcaccgatgctgctcgaccacaagtcgatgcagcggctcgccgaaggggtgctgacccaggtcgcctcgctcctcaatgtcgattgcgccggcatcctggttctgcgcgagagcgaggatgccgccgaccggcgggagggcggcttctgcgtgttggcgggctcggggctctacggcggctatgtcgggcgcgaccctggctggccgctcgatcccggtatccagcccctggtcgagcaagccttcgccgcgcgctgccacaacttcggcgacaacctctccacgctctatgtccagaccgcgagcggcagcgagatcgtcgcgctgatcgacaccgaccgcccgctctccgacaccgaccgggcgctgatcaccctgttggcggggcgtctctcggtcgcgttcgacaacgtgattctctacgagcggctgcagcgcgccaacgtcaccttggagcagcgggtggtcgagcgcaccgccgagctgatccgtgccaaccgccgcctcgacatgcagcgctcggacctgcgccgggccaacagcctcaagaccgagattctgggcaccatcgcccacgacctgaagaacccgctctcggtgattctgggccgctccgagatgctgaccgatctgatcggcctcgatcagggggatgcctccggcgtggagaaggcgcaggcggcgatgctgacccaggtcgagcacatccgcgcctcggccacgcgcctgatcgacatgatcgacagcctcatggccgatgccatgaacgacgccctcgacatcaccctgcggcgggaacccgtcgatctcgccggcctcgcccgcgaggtctgcgaggccaaccgtccgctcgctgagtcgaagggccagagcctggtgatggatctcgccggcccgctctcgctctgcggcgacgccgagcggctgcgcgaggcgctcgacaatctcgtctcgaacgcgatcaagtattcctatcccggcggcgcgatcgcggtgagcgtgcgggaggaggcgggcgacctcgtctgcgcggtggccgaccaggggcccggcctgtcgccggaggatgccggccgcctgttcggccgctaccagcgcctctcggccaagcccaccggcggcgagggctcgacggggctgggcctctccatcgtcaagcgcatcgccgaactccacggcggccgcgccgaagcgttttccgacggaccggggcagggggccgagttcgcgatgcggtttccgagggaggcggtgggggtgccttag

SEQ ID NO: 7598 - DNA, 735 bp, Methylobacterium sp.
atgacggcgagcggcccccacatcgccgtcgtggacgacgaggccgatgcccgcgccatggtcggcgactatctgcgcctgcacggcttcgacgtggccctgtgcgagggcggacgggcgctgcgggcgcatctccagatccgcacgccggacctgatcgtgctcgacctcaacatgcccgaggaggacggcctctccatcgtgcgggatctgaaggcgcgaagcccgataccgatcatcatgctgacggcgacggcgagtgcgatcgaccgggtggtggggctcgaactcggcgcggacgattacctgcccaagccctgcgagttgcgcgaactcgtcgcccgggtgcgctcggtgctgcggcgggcccaggtcgcgccggcatctccgcaggcggcggcgcccgaagccgcggcaccgacgcgaacggttcggttcggcacgaagtggctcgaactcgatgccctgcgcctgcgcgacgatgcgggcgtggagcaaccgctcacccgctcggaattcgatctcctcaaggccttcgccgaccatccgaaacgggccctgtcgcgcgagcgcctgctcgacctcgccgatgcccgcgatccggacgcgttcgaccgggcgatcgacgtacgaatcaaccgcatccgcaagaaggtggagccggacccggccaacccgcgctacatccgcaccgtgcgcggcctcggctacatcttccggcccgaaggcgactga

SEQ ID NO: 7599 - DNA, 2274 bp, Methylobacterium sp.
atgcgggtcggccggaagattgccctggtcggcggtgtcccgatcctcgtcgccgcggccatcgcggcggcgggctggttcctgctcgcccagggggagcgggcccgggccggcgccctgctcgccgcccgcgtctatcacgacctcaccctggcgcggatggtccgcgacgattccgtctccgcccgcgccgacgcacgcgcggcgatcgagacgcggttcttcgacctgaccgcccgagccggacgcggcctggaagcgcttcagaatcaggcccgcacccggagccaggccgagcgggccgccgcggcgcgccaatccctcggccgctacgtggcgcggatgcgggatttctccgcggtcgcccgcgagaatgacggtctcatcgccgagatgggacagcgcgcgaaccgcctgaccgaccttgccgaacaggcgcgccagcgccagcaggccgccaacgtcgatctcgcctggacgatgacggggaaggtcaaccggctgcgcgcgactcgcgacgtcgtggcggggctcaacgccgtgctggccgccgcgtggcagggcgcgcttgcccggcaacgcggcgaggaggccgcgcactccgagcgcacccgcctcgtccatgccggccgcgacctcgccgcggccctgcgcgccacctcccgcgagaccgaagcgacggaggcggaggggctgaccgcctcggagccggccgctggcgaccggctgacggagtggggcgaacgctggctcaagaccgcaacctccgagcagcgcacgctcgacgacgcggtggcgcagctcctcgcctccgcaggcgaggccaacgccaccgagcaggcgacgcagaatatcggcatcgccacgctcaagctgggccagcgcaccgccgaggcgctggcccggcgcgatgcggaggccgtctccgccatgctcggcgagggcgagcggctctcggcgagcgcctccaccctgccgatctcgccgctgatccaatccgacatgatcgaggccatcgacggctggcgcgcgcggctcgccaccacgatcgacgggctcaagcgccagaacgcgatgatcgccgaaatggacggcctcgccgccggcctgagcgaggccgcccgcgacctcaacgacgacgcggtcgaggatgccgaccggttcggcaccttcctcggccggctcctccttgctggggcggccatcggcctgttgctcggagccctcgtcgcactggccgtcgcccgctcgatcctcgtgccgctgcgccagcttcagggcgacatgatcgcgctcgccgccgacccgaaggcggaggggctctcgggcacgcagcgcacggacgaactcggcgacatcgcccgcgcgacgaacttcttcgtgaccgagatcggccggcgcgaacgggcgctgcggcgggccaaggatcaggcggacaccgccctgcacgatcttcgccaggcccaggacgacctgatccgcgtggaaaaactcgcctcgctggggcagctcgtggccggcgtcgcccacgagatcaacacgccgctcggcatcgcgctgaccaccgcgacgctggtgcgcgacgagacgcggaccttccaggatttggtcgcggcgggcacgctctcgcgctcgcgcctgacccatttcgtcgatcgggtcggcgagggcgcgcaactgctctgcgcgaacctgacccgcgccgccgacctcgtccacggcttcaagcaggtggcggtggaccgggcgagcgacgagcgccggagcttcgacctcgatatctggctcggcgaattgctcgcgagcctccagccgatgctgcgcaagggcggccacaggattcggtgtgaggtcccgcccggcatcgtcctcgacacctatcccggcgtgctcgcgcaggtcgtcaccaacctcgtcgccaacgccgtcgtgcacggttttgccggcgccgagcggcccggaaccatcacggtgcgggtctcgacgcccggagcgctcgtgcggctggaggtgagcgacgatggcggcggcatcgcgccggagcatctcgggcggatcttcgacccgttcttcaccacggcccgctcccgcggcagcaccgggctcggcatgcacatcgtgcacaacctcgtcacggccaagctccagggccgcatcgccgtcgagagcgcaccggagcacggcaccctcgtgcgcctggacttcccgcgggtgcccggcggcaccgagcggccgggcacggcccgccggccgaccggagcggacgcgcgatga

SEQ ID NO: 7600 - DNA, 858 bp, Methylobacterium sp.
gtgagcgggggcgtgatcgaggcggcgcttgccgtcgagcgggcggtcgcggccccggagccgcgccgggccggaatcggtgcacggttcggcgcctcggccctcgaccggctggccccgctcttcggccttgcggggctgctcgccctgtggttcgcgggcgggctggttctggagagcgtaccggcctacgccgcctttgccggtttcgcgccggcgcctgcgctggcctcgttcgtcgaactcctgacctccggcgaggcgtggcgggccgccgcgccgagtctcgcccggatcggacagggcctcgccgtcgccttcgggctcggcgcgccgctcgggctgctgatcggctcggtcccgctcgccgagcgcatcctgcagccgccgttccagctcctgcggatgatctcgccgctggcctggatgccggtggcggtgctcgcctttccgagttgggacggggccatcgtcttcctgatcgccgccgccgcgatctggccgatcctgttcgccaccgccgccggggtgaagcgggtcgatccggtctggctcgccatggcacgcaatctcggcgcgggccggctcgcggctctgcgcgccgtcatcgtcccggcggtgctgcaggacatcctcaccggcctgcgcctcgcgctcggtgttgcttggatcgtgctggtgccggccgagtatctcggggtcacgagcgggctcggctacgccatcaacgacgcccgcgacaccctctcctacgaccggctcgccgccctcgtcctgctgatcggagggatcggctacgccctcgacaccggtctcggtcggctggctgcccgcgcccgctggattcccgccacttaa

SEQ ID NO: 7601 - DNA, 1227 bp, Methylobacterium sp.
atgaccgcccccgacgacctctccgccctctggacgcacgaatgggcccgcgccgactggacgcgccgcaacaccctcgacgcgctggcgcgcggcggcctcgccgccctgctcggcggcggcagtctcgccctgtcgggccgcgcggtccatgccgccgaggacgacaccgtgcgcatcggctacctgccgatcaccgacgcgaccgctttgctggtggcccatgccaagggctatttcgaggaggcgggcctgaaggttgccgagccgattccggtgcgctcgtggtcggcgctggtggaggggttcgccgcgggcaagttcaacctcgctcacctgctcaagcccatccccgtctggatgcgctacaacaacaagttcccggtcaagatcctggcttgggcgcacaccaacggctcgggcatcgtcgtcggcggcaaaagcgggatcgaggacttcaagggactggcgggcaagcgcgtcgcggtgccgtactggtactcgatgcacaacgtcgtgctgcaatacgcgcttcgcgaatccggcgtcacgccggtgatccggggggacgccgggccgaacgagtgcgcgcttcagatcctggcgccgcccgagatgccggcagcgctcgcggcgggcaagatcgacggctacatcgttgccgagccgttcaatgcgctcggcgagatcaaggccggcgcacggatgctgcgcttcaccggcgacatctggaagaaccatccctgctgcgtcgtggtcgcgcacgagagtcagatcgcggccaagcccgaatgggccggcaaggcggtcgatgccatcgtgcgggcgcaggcctattgcgtgaagaaccgcgaggaggtcgcccggctgatctcgaaggagggccgcggctacctgccgatgcccgccgacgtcgtgatcaaggccaccaccgattacggcccggcctacgaggcgagcggcgcgatccgccatcgcgactgggcggcgcagcgcatcgacttccagccctggccctacccctccgccacgaagctgatcgtcgaggcgatgggcaacaccgtcgtcgagggcgatgccggcttcctcaaagggctcgacccggatttcgtcgcgcgcgacctcgtggacgaccgcttcgtgcgggcctcgctcaagcgctatcccgaatggccgggcgcggcggatgacgccgcgctcacccgccaggagaccttgagcctgtga

SEQ ID NO: 7602 - DNA, 399 bp, Methylobacterium sp.
atgctgtcagacgcgcagtggggtgagttggagccgttgatcgaggcctgccgcccgaaggccaagacaccgcccaaggagcttcggcggacgatctctgcgatcctctggcgacatcagaacggggcgaagtggcgcgccatccccgaggagttggggccctggtggcaggcggcacagatcttcatccgctgggcacgcgccggggtgtgggagcggctgctcgatcgcgtgcaggagcgcggcgtcgcgctgggcatggtcttcctcgacggcagcaacgtgcgggcgcaccagaaagcggcaggtgccgcaaaaaggggggatctgcggccgagcgagatgctcgtgaagcacttggccgctctcgtggcggctatggcaccaaggcttgcgtga

SEQ ID NO: 7603 - DNA, 399 bp, Methylobacterium sp.
atgctgaacgacgcgcagtgggcggctctagagccgctggtgcatgcctgccggccgaaggcgaagaccccgccgcaggacctgcaacgcacgctctcggccatcctgtggcggcaccagaacggggccaagtggcgcgccattccagacgagttcgggccgtggtggcgggcggcgcagatcttcatccgctgggcgcgcgccggggtgtgggagcgcctgctcgccctggtgcaggagcgcggcgtgcagctcggcatggtgttcctcgacggcaccaacatgcgggcgcaccagaaggcggcaggtgcggccaaaaggggggatctgcgaccgagcgagacggtcgtgaagcgcttggccggtctcgtggcgggtatggcaccaaggcctgcgtga

SEQ ID NO: 7604 - DNA, 3723 bp, Methylobacterium sp.
gatcagctgaactccttcgcctccgaggtggtccgcgtcgcccgcgaggtcggcatcgagggcaagctcggcggccaggcacaggtgcgcggcgtcggcgggacttggaaggacctgaccgacaacgtgaacatgatggcggccaacctgacggggcaggtgcgcaacatcgccgacgtgacgacggcggtcgccaacggcgatctgtccaagaagatcaccgtcgacgtgaagggcgagatcctggagctcaagtcgaccatcaacacgatggtggatcagctgaactccttcgcctccgaggtgacccgcgtcgcccgcgaggtcggctccgagggcaaactcggcggccaggcgcaggtgcgcggcgtcggcggaacctggaaggacctgaccgacaacgtgaacatgatggccgccaacctcaccggtcaggtgcgcggcatcgcagacgtcgtcacggcggtggcgcagggcgacctcaagcggaaactctcagtcgacgccaagggcgagatcgcggcgctggccgacaccgtcaacgagatgatcgagacgctcgccacctttgccgaccaggtgaccaacgtggcgcgcgaggtgggcgtcgaaggcaagctgggcggccaagcgcgggtgccgggtgcggcgggtctctggcgtgatctgacggacaacgtgaaccagctcgcggcgaacctcacgactcaggtgcgcgccatcgccgaggtggcgaccgccgtgacgaagggggatctcgcgcgctcgatctcggtcgaggcctccggcgaggtcgcctcgctgaaggacaacatcaacgagatgatccgcaatctgcgggacacgacgctcaagaacgccgagcaggattggttgaagaccaacctcgccaaattcacccgcatgctgcagggcgagcgcgacctcgccacggtctcgaacctgatcctgtccgagattgcatcgctcgtgagcgcccagcgcggcgtgttctacatggtggaggacgagggcggagagccggttctcgatctgatggcgagctacgccttcacggagcgcaagaacctctcgaaccgctatcgcctgcgtcaaggcctcgtcggccaatgcgccttcgagaagaagcgcatcctcctcacccacgtgcccggcgactacatcaccatcggctcggctctcggcgaggcgccgcccctcaacatcatcgtgctgcccgtcctcttcgagcaggaagtccgagcagtcatcgagttggcgtcgttcagccgcttcagcgagacccaccagtccttcctcgatcagctgaccgagtcgatcgggatcgtgctcaacacgatcgctgccaacatgaggacggaaggcctcctgaagcagtcgcagctcctgaccggcgagttgcagagccggcaggaagaattgaagaagacgaacgatcgcctggagctgcaggccgcctcgctgcagcaatccgaggacctcctgaagaaccagcgggagcggctgcagcagaccaacgaggagctggaggaaaaggcgcgcctgctcgaaatccagaagcgtgaggtcgagggtaagaaccgcgaggtctcgatcgccaagacggcgctggaggagaaggccgagcagctgagcctgacctcgcgctacaagtcgcagttcctcgccaatatgagccacgagctgcgcacgccgctcaacagcctgctgatcctctcgaagcttctctccgaaaaccgcgacgggaacctcaccgacaaacagcgggaattcgccaagacgatcaacgcggccgggaccgacctcctgtcgctcatcaacgacatcctcgatctctccaagatcgagtcgggcacggtgtcgctcgagatcggcgacgtcacgctgcaggacatcagcgagaacctgaacaggaccttccggcagctcgccgaggagcgccacctcgcctttgtgatcgaggccgatccgggcctgccgcgctccctgcggacggactcgaagcgcctgcagcaggtcctgcgcaacctactctccaacgccttcaagttcaccgagaaggggagcgtctcgctcaagatcggttccgcggagggctcgcccctgcgcgccgggacccagtggatcgccatgtccgtcaccgataccgggatcggcatcgccgaggacaagcagcggatcatcttcgaggcgttccagcaggccgacgggaccacgagccgcaagtacggcggcacgggcctcggcctcgcgatcagccgcgagatcgcgcgcctgctgggcggcgagatcgtggtcgagagccgcgtcggtacgggcagcaccttcaccctgttcctgcccttcgagccgcccgcgcaggcgctcaccggacgcgtggcggaggcatcggacgggtacgcgccttcggcgccgatgggccgccagccgaacaccgcgatggcgctctcgtcctctgcggacgaccgccacgcgattcacccgagcgaccacatcgtgctcatcgtggaggacgacgccatgttcgcctcggtgctgctggagctcgcgcgcgagcgtggcttcaaaggtttgatcgcgcaggacggagccggcgcacttagcctcgcgcaccgcttcaagccgcacgccatcaccctcgatatcggcctgcccgatatggacggctgggccctgctcgacctcctgaagaacgatccccgcacccggcacattccgatccacgtgatctcggtcaacgacgagaagaagcgcggccttcgcgcgggcgcgttcgggtttctggagaagccggtcgagcgcgagggcctgatgcgcgccctggagcgctcgaaggagttcatcacgcggccggtgcgcaacctcctgctcgtcgaggacgacgagaaccagcgcgccagcatcacagcgctcctgagcgaagaggacgtcaaaatcttcggggtcggcacggcctccgccgcgctggaagccctgacaggcggccggttcgactgcgcgatcatcgatctcggcctgcccgatatcggcggttccgagctgatcgagcagatccgtgcctcccaggatggggaggagttgccgatcatcgtgtatacgggccgggagctgacggccgccgaggagcagcagctcaggcacaccgcctcaacgatcatcctcaaggacacgcgctcgtccgagcgactcctcgacgagaccgcgctgtttctgcatcgcgcgatcaatcgcgttccagtcgaggagcagatcctcgtcgagcggaaggatgcgacgtcacttcagggctgtcgggtcattctggtcgatgacgacctgcgcaacatcttctcgctcacgagcgccctcgagcagcatgggctggaagttctgttcgccgagaacgggcaggacagcatcgccctcctcaagtccaacccgaacatcgatgcgatgctggtcgacatcatgatgccggggatggacggctacgagacgatgcgcgcgatccgggcggaggccagcttccgtagcctgccgctcatcgcggtgaccgcgaaggccatgaagggcgaccgcgagaagtgcctcgaggcgggcgcgtccgattacgtctcgaagccgatcgacatggatcagctcctcgcggtgctgcgggtgcagctggcccggcgtggcgaggtcgcacacggccccgtgcccacgctcggcgacccgacgaccctcgatcggcaaccacaatga

SEQ ID NO: 7605 - DNA, 1044 bp, Methylobacterium sp.
ttggagccgaagctcctcctgaagagccttcgtgcctttcggaagggtgacttctcgactcggctgccgctggatctgacgggcattgagggggagatcgctcaagcgttcaacgatatcgtcgagctcaaccaagggctcgctcgtgagctcgacagggtcgcccgcgcggtcggcaaggacgggcgcatcggcgagcgcggaaagcttccggccgcgaccggcgggtggaacgattgcgttgagtcggtcaacacgatgatcggcgaccttgttcagcccaccaccgaggtggcgcgcgtcatcggggccgtcgccaagggcgacctcggtcagaccatgcagatcgagatcgagggccggcccctgcgcggcgagttcctccggatcggcaaggtcgtcaacacgatggtggaccagctgaactccttcgcctcggaggtgacccgcgtcgcccgcgaggtcggctcggagggcaagctcggagggcaggcgcaggtcaagggcgtcggcgggacctggaaggacctgaccgacaacgtgaacctgatggcggccaacctgacgggccaagtgcgcaacatcgctgaagtcaccaccgcggtggccaacggcgatctgtccaagaagatcaccgtcgacgtgaagggcgagatcctcgacctgaaatcgaccatcaacacgatggtggaccagctcaattccttcgcctcggaagtgacccgcgtcgccaaggaggtggggtcggagggcaagctcggcggacaggcgcaggtcaagggcgtcggcggcgtctggaaggacctgaccgacaacgtcaacatgatggcggaaaacctgacgggccaagtgcgcaacatcgccgaggtcaccaccgcggtcgcgcggggcgacctgtccaagaagatcaccgtcgatgtgaagggcgagattctcgccttgaagctgaccatcaacacgatggtggaccagctgaactccttcgcctccgaggtgacccgcgtcgcccgcgaggtcggcacggagggcaagctcggcggacag

SEQ ID NO: 7606 - DNA, 1674 bp, Methylobacterium sp.
gtgatcctcgtggtgggcggggccggcgccttcgggtcgcggctcgtcgccgggctcgccgcgaccaccgatctccgcgtgatcgttgccggccgcgatgtcgctaaggcggaggccgtggcccgcactgtgccggacggacgcgggcgggcggtacgcctcgatgcgacggaggtggatgcagcgcagttgcgggcactcggcgcgacaatcgtggtggacgcggcagggccgttccagggcggggccccggtgctcgcccgcgcggcgatcgaggccggcctgccctatctcgaccttgccgacggccgcgacttcgtggcggccttccccgccctcgacgcggcagcgcgggccaacggcgtcgttgcgctgaccggtgccagctcgaccccggccctgtcgaatgcggcgctcgacgcgctcaccgcgggctggcgcacggtcgagacggtgcgggtcgccatcgtgccgggtaaccgggcgccgcgcggcctctcggtgatgcgggcgatcctctcctatgccgggcagccggtgcgggtgctgcgggccggaacgtggcagaaccggcccggctggggcctgctcagccggatcgcggtgccgggcctcggccggcgcttcgccagcctgtgcgagacgcccgacctcgacatccttcccgcccgtttccccgctttgcgcacggccctgttccgcgccgggctcgaactgcccctgctgcatctgggcctgagcctcgcgagcctgccggtgcgctggcggctgctgccctcgctcgtgcccctcgcccgcccgttcctggcgatcgccggctggctcgaccgcttcggcagcgaccgcggcggcatgagcgtcgaggctttgggaacggacgcgaccgggaggccggtccgcgcggtgtggagcctcgtcgcggaggccggcgacgggccgtacgttccgactctgcccgcgctcgccgcgatccgccggctcaccgatccgtccgccgcgccaattccacccggcgcccgcccctgcgtcggcgttctgccgctcgaagcgatcgaggcggagatggcacgcctcgccatccacacccgtcgcgacaccgatcaccccgtgccgctgttcgagcgggtgctcggggacggcttcgcgcggatgcccgaagcgttgcgcgccgtgcacggtgcggtgggcgatggcgcctttcgcggccgggccgcggtgatgcgcgggcgcggccctctggtcgcgctcgtcgccgcgctgttccggttgccgcccgccctggaggatgggccgatccgcgtgacgatggaacccgacctcgacgctcgctcggaacgctggacgcgcggttttccggatcgccgcttcgccagccggatgcagcgcgccggccccgacgggagcgggcgggtgcgcgagcatttcggcccgttcgcgatggatctcgcggtgagggcccatgccgacgggctcgacatggcagtgacgggctggcggttcggcccgctgcccttgccgcggctcttgcggccgacgacgcaggccagcgagcgggtcgatgcgcagggccgcttccgcttcgacgtggccctgttcctgccgttcctggggctgctggtgcattatcgcggttggctggtccgctgcgacgagagggaagaagaaacgccatga

SEQ ID NO: 7607 - DNA, 1254 bp, Methylobacterium sp.
atgctcgacttaaacacccttcaggtcgccagcatcagcagtcgccttgcttttgttctggtgttcttcgtcaccctgctgcggcatccgcgcgagatctatttcggggtctgggccggcgcgctctgctgctcgctgatcgggtcgttgctgatgctcggagatccgccgagcgtgccgctgaatgccgtcaaagggagcatcgtctacatcctgtacggggcgagcctcgccgtgtcctgggccggcctgcgcctcttccatgagcgtgcgctcctcatcccgcagaccctcgggctcgccctcctcagcggcctgtcctacggcatcctgccccagatcggggcgtcggtgacttgggcactgagcgtcgtgttcgtgtgcatcgcgctgagcacagctctgtgtatgtgggaaatcctgagaacacccgcttcgatgcgcctgtggacacagtacatcgtcctcctgggcttcggcggatacttcatcgccttcctgctgacgatcggcgtgatccatttcgcgaacgagcgcctcgcatcgccggagagcggtatctactcgctgctgttcgatctgtggtgcggcgtcttcatccaggtcggctatctcgccatggtgagcgagcgcgcgcacctgaagctcagtcgcttggccgacaccgaccccctcaccgggctggcgaaccggcgcggattgttcgcggcgttgagccagcgggccggcctgtcgccttccccgccgcgatgcgcgatcctgctggccgacatcgaccacttcaaggcgatcaacgacacctacggccatgacggcggcgacgcggccctggtcggcttcgccgagcgattacgcggcgtgatgcgcaaggatgacctcgtcgcccgctggggcggcgaggagttcctggtcgtgctcgaccaagccgatgccaccgcggctgtcaccgtcgccgagcgcctgagaaagtccgccgccgggcagcccttcaccgtgaacggagcggccgtgaccgtgaccgccagtatcggggtcgcggtcgtggccgccggcgaggagcggatcgacgccgccctgtcccgagcggacgcggccctctacgccgccaagagagccggccgcaatcgcgtgtgtctcgccccgtcaccgcctccgccggacacccgagccgtccgagcggagccgtcctccgggcttcgcgaggccatggaggccatccaggtcgtcggccagccgcgatccgaaccggcctga

SEQ ID NO: 7608 - DNA, 318 bp, Methylobacterium sp.
atgggccgaagcgatcttgagcggctgatccacagtgagctgatcgacctggtgctgcgactgcagcgcccggacaagacctcacgcacctcgtcgaagccgccgtcgacggatcgcaaggagcggcgcgagcaatccaggcctggcggggccaggaccggccacgaggaccctagccgggcgatcagcaaggatcccgaggcggtggtcgatcatcggcccgatcgctttgcgtgctgcgggggcgccctgcacggcgatctccccgccgagatcgtgagcgtctccgagcggattgagtttccgggggcgatgtag

SEQ ID NO: 7609 - DNA, 1788 bp, Methylobacterium sp.
atgtccctgtcttctcccaggcgcgcggacgttgtccgccgcgtccttgccttcgtcgtccgcggctggcgccggcgcctcggcctcgtctccgccctcgtgactgcgatcacgctcgccacgctggccgacgtgatgctgccgctctatgccgggcgcctcgtcgatgccctcgccggtgccgagcgccaagccgccctgcaggccgcactgccggctttcgccatcatgaccgcgctgagcctcgcgacggtgctgttgcgccatgtcgcctggagcctcgtggtgccgctgacgctcggcacgatgtccgacatcgcgagccagagcttcgcgcgcgtccagcgcttctcgaccgagtggcacgccaacaccttctccggctccaccgtgcgcaagatctcgcgggggatgtgggcgctcgacggactcaacgacgttctgctgctctcgatcctgccctccgtcgtcgtgctcgtgggcacgaccgtggtgctcggcctgcattggccggcgatgggcgcggtgatcgggctcggcacgctcgcctatgtcggcaccgccgtgttcctggcgacgcgggtgatcgcccctgcggcgacgctctcgaacgccctcgacacacggctcggcggcgcgctcagtgacacgatcggcaacaacgcggtggtgaaggcgttcggcgccgaggcgcgggaggacgagcggctcgcgcgcgtcctgtcgaagtggcggcggcgcacccggcgcacctggatgatcgtgacgtggagcggcacccttcagctcgggctgctgctggccttccgcagcgccatcgtcgccacggccctgtggctgtggtggcagggtcaggcgacccccggcgaagttgcctacgtgctcaccacctacttcgtggtgcacggctatctccgcgacatcggcgggcacatcaaccacctgcaacgctcggtcaacgagatggaggaactggttgcgctcgaatccgagcccgtgggcgtcgccgaccgtccgggcgcggtgccgctcgctgtgaccggcggcgcgatccgcttcgacgcggtgcgcttccactacggcacccacggcacgccactctatgacgggctgtcggtgacgattcccgccggccagcgcgtcggcctcgttgggcgttccggatcgggcaagacgaccttcgtcaagctgatccagcggctctacgacgtgagcggcgggcacgtgctcatcgacgggcaggatgtggcgggcgccacgcaggcgagcctgcgggcgcaggtcgccatcgtcccgcaggagccggtgctgttccaccgctcgctcgccgagaacatcgcctatgcccggcccggcgcctcgcccgaagagattgagcgggcggcgcggctggccaacgcgcacgacttcatcgcacggctgccgaagggctacgccacgctggtgggcgagcgcggcgtcaagctctccggcggcgagcggcagcgggtggccctggcccgcgccttcctcgcggatgcgccgatcctgatcctggacgaggcgacgtccagcctcgattcggaatcggaggcactggtgcaggaggcgatggagcggctgatgcgcgggcgcaccgcgctcgtcatcgcccaccgtctctcgacggtgcgtgccctcgaccgcatcctcgtgttcgaccgggggcgcgtcgtcgaggacggggcgcacgccgcgctgatccggcgcccgaacggggcctaccgcgccctgtttgagcggcaatcggacatggcggagaacgcgtga

SEQ ID NO: 7610 - DNA, 255 bp, Methylobacterium sp.
atgcctatcgccgcaacgttaccggccacggtcgcgctggcgctcgccctgatcggtgggagcgcggcctgggcggcggatgccgggaggccccggcccggcgcggcacgctgctcggacgacgtccgctgccgccgcccgccgggaccgccggaccgtgacatccgcccgctgatcgatccgctcgggcgcccctgcggcttccgctggcgcgagacgccgtccggcccccgccgcgtccgggtctgctactaa

SEQ ID NO: 7611 - DNA, 231 bp, Methylobacterium sp.
gtggctcggtcggcgcgctcaattccgggtcgagcactggcgtctgtacagcgatcggccggcgccgcgcgcccgagggcggcgccggccgatcgccacaccctcaccctgaccagcgcggacggacgcagccggcgcctgttcttcgcctatagctcccagaatgagccgcccgaggccgatcgcgacatgatcttcgtcggcggcagcgtgttcagctcggacgactga

SEQ ID NO: 7612 - DNA, 1830 bp, Methylobacterium sp.
atggcccgactctatcccttcgtgccgctcttgcccgacgaggccgtgaccggcttctgttctcggctggcggcgatccacaaaacgacctcggtccggacgttccttcgctatctcggccggcggttcacgccgatcgtgttcgggcaagcggcggcgctcgacgatctcgccgatttgacgggcattccgccggccgagatcgcacgtagcagtctggttcgtgctgaaggccacatcacgcatcgcggggagcttctcccgacgacgatgtctcgcggcacgcgcacgttcgtttgcccacgatgcctgacagaagatggtgagcatgcgcgccggatcccgatcgagacgagctacggccgtacaatctggcaactgacgccgatccgtgcctgccctcgtcaccacgtgctcctccgcgagatcggcgttcccgttcacgcgagtgaggcgtacgacttctcgcgggcgatccggccgcatctgagccggatgagagaatacgctgacgcggcggccgaggtgatgccgtcggccgcggaagcttatctcttgtttcggtttgaggagcagcgggaggcctcgccgttgctcgaccagatgccgtggtacgcagccgcacgggcgtgcgaagcggtgggagccgcggcgttgttcgggcctactgtcaagctcggcaacttggcactgagtgaaaagagggaggtaactgatgtcggcttcgaaatcgcccacgggggcgagccggccgtgtcgcgcttcctcgatgaccttctaggcaagcattacacccgcaatgggtcgaacgacgggcctggggccatgtacggtattctcaaccacctcctgacgcgccccggcgtcgatccaggctacgcgccgctgcgggatatcgtgtttcggcatgcactcgacgccgcgcccttcggccctggagatgtcgtcgtcgggctcccggtggtccgccgtcgtacgcactcactgacgacagctgccgtggaggcggggcagcatcccaatcgcctccgcaagattctgatcgccgaggggatcattccccctgatgctagcctgaatggggatgtgatcttcaatgccgccatcgccgcgccgatcctgcgccgcgcgaccaacctcctcaatctccatgcgatagcgaagcatctccagacgacctactcctacgcaaaaatgctggcgacaaacggcttcatcgagcccttccagagcgacatggtcggggagaaggtcatccgggcccggtatgcgaaggccgatgtcgacgcgttcgtggagaggctcgtcgaggggacagtcatccatccacggccggaacggccgctcatggacattcctcgcgcggccaagcgcacctactgcccgacgccgggtatcatcaggatgatcctagataggcagctccgttgggtcggtgtggatccggacagggccggcttccatgcgatcttggtcgacgccgatgagatcctcaaacgggttcgcggaccggagcatgacggctacaccatgcagaaactgcgggttcgcatgaaggtcggccagcgcgtagtcgaggcgctcatcactggcgattatctccctcaggtgatgcgtcccaatcccgtcaaccgacatcgagactggatcgtgctgccggagacgatcgatgctttcgagcgaacctacgtttccctgagtgaactcgccggtcggtgggaaatgaacgcgtctaagcttaagacagatcttgaccgccgtggcgtagagcccgcgatacgaagggatcaagtaggcgcaacgttctactttagggaccggctcctttag

SEQ ID NO: 7613 - DNA, 99 bp, Methylobacterium sp.
ctgatcgtgccggtggccatggaagagaagctgcgcttcgccatccgcgagggcggccgcaccgtcggtgccggcgtcgtcgccgccatcaacgactga

SEQ ID NO: 7614 - DNA, 99 bp, Methylobacterium sp.
ctgatcgtgccggtggccatggaagagaagctgcgcttcgccatccgcgagggtggtcgcaccgtcggtgccggcgtcgtcgccgccatcaacgactaa

SEQ ID NO: 7615 - DNA, 681 bp, Methylobacterium sp.
atggcggcgcgatcgagtcgtctcgcagccgtgttcggcgttctcggggtcggcctgctcggggtctccgccgcctctcaggccgccgagcccgcgatgaagacggttcccgaaagcgggctgaccgcgggcagcttcctggtccgcggccgcgtcgtcggctccatcccggtcggccagttctcccgggtcgagccgatcggcggccgcgtcatcaccccggcacgcgccctgccggatctcgacgtgacgtatttcctgtccgatcatttcgcggtggccggtcagctcggcgtggtctcgaccaagacctcgatccgcgggtcgttgatcggcgacctgacgatcggctcgacctggagcttcgccatgaccggcgcggtccagttccacttcctcccgcacggccccttcaacccctatatcggcgcgggcgcgggctacacccacccgatcgcctacgagccggccaagcctctcatcaccgagatgaaggccgacccgcaactggggcccatgcttcaggccggcttcgattatcacctcggcggcaactggtacgccaacatggagatcaagaagatcttcctgccgccgcaggtctcccggatcggttccggcaccaccaccgtgcggctcgacatgctgatcatcggcgcgggcatcggctaccgcttctga

SEQ ID NO: 7616 - DNA, 1326 bp, Methylobacterium sp.
ttgggccgaggcggaacgggcgccgaggacagggccgtctcgccgatcgcgtggcagcgctacgcgatcggcggctatgcgctcatcgccgcggccttcggcgtcgccggtgcctgggcggccaccgtccgcctggatcgcgccgtcatcagcaccggcgtcatcgtcgcggaaaccagccgcaaggtcgtccagcacttcgagggcggcatggtccatgcggtactggtgaaggacgggcagatggttcgctccggcgacgtccttctgcgcatcgatcccctacagtcccaggcgagtgcggacctgttccgaaaccagctcgacgccgctctcgtcctggaggcgcggctgcgggcggagcaggcgcagtccgacgatctgcaactgccggccgagatcgctgcacggcgcaacgagcccgtcctcgcacgcatgatcggcgatcaggcgggtcagttggccgaacggaggacgacgctgaagggccaactcgccctcatcgaggccaaagtcacccagctgaggacggagatctccggccttgccgtcgagaagtcctcggtcgagcagcaggtcggcttcatccgacaggaactggagggcctgcgcagcctgcacgagcgaaatctgatcccgctgtcgcgcctcctcgtgatggagcgggagcgcacgcgactggagggtgtcatcgggcgctccgtcgcggagagagcaaaagccgagaacgccatcagcgaggccgggctgcaggtcacccagttgaagcagaagcttcaggaggcggtcaccggccagcttctcgagacgcggcagaggatcggcgaacttcgggaaaagctcgtcgtcgcgcaggacgtgttccggcggcacgagatccgcgcctcccacgacggggtcatccaggggctcaaggttttcgcgatcgggcaggtcgtccgctcgggcgagccgctgatggagatcgtcccgacggcggacaggctcgtggtcaacgtgcaattctcgcccaacgacctcgaagccgtccatgccggcatgcgggcggagatcaagtttccgacctttcaggcccgccggacgcccgcagtcttcggaacgctcacggtggtgtcgcgggaccgtctggtcgacgaggggtcgaagcaggcctatttcgccggcaccgtggagatcgacgaacaccagcttcccgccgaggtccgacatcgccttctcgcgggcttgccagccgaggtggtggtctcggccggggagcgcacggccctggaatatctattcgcacccttcttcgacgcgatgggacgcgccttccatgaacgctag

SEQ ID NO: 7617 - DNA, 297 bp, Methylobacterium sp.
ttgtatgtccatcagcaacgtctcggctctgaggaggtgcaggaattgcgccgcgaaggtggccgcttcctgaaggaccttcgcgagaagcagggtctctcacagagacagttggctgccctggtcggtgccgagtactacaccttcatctcacagcttgagacgggacgcggccgtgtgcccccggaccggtaccggctctgggccgatgccctgggcgtggatgcgaaagacttcgtgaagagcctgatgcgcttctacgatccgctgacgttcgagatcctcttcggcgactga

SEQ ID NO: 7618 - DNA, 870 bp, Methylobacterium sp.
atgagcaacctcaatgtcgaccagatccgctccttcctggccgtccttgaaagcggcagcttcacggccgctgcgcagaccctcggcctgcagcaatccacggtcagcgggcatatcgcgcggctggaacaggcgctgggccgctccctcctcatgcgggacacgcatcgggtcgccctgacgccggacggccaagccatgatcggctttgcgcgcgacgtgctggaggcgcacgaccggcttcgcgccttcttctcgccgggcggcctgcgcggccgcatccgcctcggcgtctccgaggactacacgctgtcggccctggcccaggttctggcgcggttcgcggatggccacccttccgtcgatctgcagctgacggtcggtctcagccgggccctctaccagggctacgatgcgggcgaactggacgtgatcttctgcaagcgccgccgcggcgatccgcgcggtgaattggcttgggcggaagagctggtctgggtgggccggcccggcttcgcgcccgatccggccttgccactgccgttggtcctctatccgccgccctcgatcacgcgcaccctggcgctcgatgccctcgaagcggcggggcgttcctggcggatcgcctgcaccagcggcagcctgatggggctgcgcgcggccgtcgaagccggtctgggcatcgcgccgcactcggcccaggtgacgccaccgggactggctccgatcccggagacggccggattgccgccgatcggcgaggtcgagttcgtggtgctcggctcgggccgacagcatcccgccgcgacggcgttacaggaggcgatcctcgcaagcacggcggagcttcaagccgttcccgaagggtga

SEQ ID NO: 7619 - DNA, 1764 bp, Methylobacterium sp.
atgagcgatcgtgtggccgagtccgtcttgaaggatgggctgcgggcgatccgccccgttctggtgacggtgttcgtcttcgccttcttcacgaacctgcttctgttcgccggccccctgtacatgctgcaggtctacgatcgcgtcctctcgagccggaacgaggcgacgctcctcggcatcacgggcatcgcggccttcgcgctcgccgtctatgccgtcctcgaaatgcttcgttcgcgcctgttggtgcggggcggaatgatcttcgatcgaaaggttgccggaccggtcttcgagatcgttcacagggccgcattgctcaagccgcgcgccgggcacgaaacggtccttcgcgatgtcgatgtcctgcgtgagttcctcacgggcggcgcgatcctggcgctctgcgacctgccctgggcctcgctgttcctgatggcctgcttcatcctccatccttggttcggctggatggcgttgctcgggggcggcacgctcctcgggctcacgctcctgaccgatctcacgacccggcggcccctcgacgtggcgagccaagccgcccgtgaagcgggcgagcaggcccgcgcgaccatgcgagggggcgaggttctgcgcgccatgggcatgctcggcgccttgcggtcccggtggcgtcggcgtcacgacgaggcgattcggctgcaggcccgggcgagcgatcgcgccggcctcatcaccgcggcgacgaagttcacgcgcatgttcctgcagacgatggtccttggtgtcggcgcctaccttgccatccatggcgagatctctgccggctcgatgatcgcggcctccatcatcatgggccggacgctggcgcccatcgaggcggtcgtcgggcattggaagagcttcacggcagcccggcgcagctatgcccggctggcggacatcgtggggcgcatcggcctcgaaccgcagcgcgtgatgctgccgcgtccgcgcggtctgatcgagaccgagaatttggtcgtggcggcgccgggctcgccgacggccattctccacgatgtgagcgtgcggctggagcccggcagcgtcgtcggaatcatcggtccgagtgcggccgggaaatcgaccctggtccgcgcgatcaccggcgtctggcccatcacctccggcgcggtgcggatcgacggagccgacctccggcactgggacccgcaggcgctcggccagcatctcggatacctgccgcaggacgttgaattgttcgacggcacggtggcgcagaacatcgcgcgcttcgacacccaggacgacgccgccatcgttgcggtggcgcaacgcgcggggtgccacgacctgatccaggctctgccggacggctacaacacccggatcggatcgggcgggcacggcctctccggcggccagcgtcagcgcatcgccctggcgcgggcgatgtacggggacccgagcttggtcgtcctcgacgagccgaatgccagcctcgaccaagccggcgaggccgcgctgatgcgggcggtggcggaccttcgagagcgggggacgacggttgtgatcgtcacgcacaaggtgagcctgctggcgggagccgatcagatcctgatgctggagggcggaacgctccgcgcttcgggcccggccgatcagatcctcacccaggtttccgggccgcgcccggttccggcgctggtcgcgaccggcggtcgcgcgatgcccgagaacgagaggatgcccgaaatccaacgtagcgcgggctga

SEQ ID NO: 7620 - DNA, 438 bp, Methylobacterium sp.
atgacgcctgattccacgacgccggacgccgcggcgctcaggctcgatcactcctccatcgaggaactcaacctcgccctgcgccactaccggcgcctgatgatccgcctgcccctgatcctcgtcctcggcttcgcggcagcgatcggcctgtcgtatctcgggaccgcgctgtcgccaccctacggcgtgtacatcctggggtgggatctcctgacctgggggctgctcggggtcctcgccgttctcttcgccgaattctggtgggaaggccggcagatcgggcgggccctcaacagcgtcgagatgcagtccgcgccgatcgcctccttgctgggcggacaggcgctgatcggggagcgcgcccgcgaacacggcatgaagccgggccccttcaacggtccgctccggccgatcacgaaacgccagccgggctga

SEQ ID NO: 7621 - DNA, 327 bp, Methylobacterium sp.
atggagattcaggagtttctggacgggagcggccgcagtcccttcgcctcttggttcgacgaccttgatccccaggcggcggccaaggtgaccgttgcgctggcgcgcatggaagcgggcaacctgtcgaatgtgaagtcggtcggcgatggtgtgcaggagtatcggattgcctgggggcccggttaccgactgtatttcgggcgcgatggggatctgctgatcatcctgctctgcggcggcaccaagcgccggcaacaggacgacatcgccgaggcacgggcccattgggcggactacaggagccggaaaaaggagacgggctga

SEQ ID NO: 7622 - DNA, 342 bp, Methylobacterium sp.
atggagatcagggagtttctggacggtcgcgggggcagcccgttcgctagttggttcgatgacctggatgcccaggcggctgccaaggtgacggtggccctgacccggatggaacggggcaacctctccaacgccaagggcgtcgggggaggagtccgagaataccggatcgactggggccccggctaccgagtttatttcgggcaggacggggacacgctgatcatcctcctgtgtggcggcaccaagcgccggcagcaggatgacatcgacgaggcgcaggcgcactgggcggagtacaaacgacggaaaaaggaggagggtgatggccctgacccgtag

SEQ ID NO: 7623 - DNA, 456 bp, Methylobacterium sp.
gtgacggcctcaacgccccggccgatgccgccgaccctcgtcttcgacacggattgcgtgctctgtgccgggatgctgcgcttcgtgctggcgcatgagcgcgaccacagcctgcacttcatgggcgcgtggtcgcgcgaggggctcgacctggccgcccgccacggcttcaccgaagcggatctcaacggcaccttcctgctggttcagggtgggcgggcgctgacgcgctcggatgccgcgctcgccgtggtgcggcatctcagggcgccgtggcggtggtgcggtgtgttcgcaatcgttccgaagccgatgcgcgaccgcctctacagcctcgtcgcgcgcacccgctaccgcgtgttcggccgtcgagaggattgcgcccgggtaccgccggaccagcagcaccgcttccacggcgtgcggccgacgcgccggctcggtcggactaattga

SEQ ID NO: 7624 - DNA, 321 bp, Methylobacterium sp.
atggtggcccggccgatgtcgggatcgaccggcaacgcggtcgccgagtacgatctcagccacgcccccgaacggctcgccgagaagcagccgcccggcgctggtccctggtcatcgacgaacgctccggcctcctgtggcggtgctccgcacctcggccgcacgttccgcgaacccgcgcgtgcctccggcaagccagacggcatctggaacatggacggcagggcaggggcgatgagtgaggcttgcgaggccagggcggtgccggacaacgtgatgcgcaccgcgacgcccacgccgatatcgacaacgatgctctaa

SEQ ID NO: 7625 - DNA, 372 bp, Methylobacterium sp.
gtgatcgccgacggcgcgggccgcgccgtcgccttccgcctcgcgccgggacaggcgcacgaactgccccacgccgtgccgttgctcgaccagttgcccggcgtgccgctgtgggtcgtggccgaccgcggctactccagtcacggcttccgtgagcacatccgcgacgtgggcgccaagccggccgtccccaccaagcgcaacgaagcacccacccgctgcccggactggatctacaccaaccgcaaccgcgtcgagcgcctctgggcgcggctgaaggaatggcgggcggtggccacccgctacgagaagaccgccgccagcttcacaggcgtcctctgcctcgccgcagcctgcgattggatcaagtaa

SEQ ID NO: 7626 - DNA, 996 bp, Methylobacterium sp.
atgatttaccagcagtcattcggcgagatcccagatctcaaactccgccgcgaggcctggatcgaatcggccgccccactctatcgcaccgacatcgatcgtgacgtgccagtgggagacgacgtcttcatccggaacttcaacctcgggacctgcatccttggtaaaagcatcgctccggagatgtacatggaacggtcgctggagcagatctcgcggcagtcgctggatcatatctcctttaggctattccttagcggaacctccgacctgcacgtggatggacgttcctccgtgttgcgggcgggagacctgcagatgctcgacctatcgcaatggatgcggtcgacgtcgcacgggtctaagcccgtcatccacctgatcgtgccacgccggctgttcgagaagcgcctcggcgacgtgtccgcatttcatggcagcacgatccgtcccgacgccagcccgctgacccggctgatgaccgaccatatgcgcagcctcgccgcctgcatcgacgccgccgacgaagggcagcggaccgcactcacggcggccacggtttcgatggtgaatgccgtcctgaccaagcccggagacggcccctacgagcgggacacggtgctaggtgtcgccatgctccgcttcatcgaggacgacctgcggagcttcgatctggggatcgagaagctctgcgcccgatttgcgatctcgcgcacgcggctctacgcgctgttcgaggccgatggaggcgtggcctcctacatccgcgaccggcggctcgcccgcgcgatgcgcatcctcgccggccttgaggcgggcgaccgccggcgcatctccagcgtcggctatgcctgcggcttcgagaccgagaagatgttctcccgggcgttcaagcggaagtacggcgtgaaccccagcgaggtcgacgccggctaccggccgcaggtgcgtctcgaatacggggcgaccctgatgtcgtggatcaacgccctctga

SEQ ID NO: 7627 - DNA, 366 bp, Methylobacterium sp.
gtggacgagctcttcgccccgctcttcgcctccgggcggatcgtcgacgccatcctcgtgctggtggtcctcgaggcgctagtgctgctcggtatgcgcgcccgctggggccgcggcccggcaccgggggcgctgctgagcaacctcgcctccggtgcggcgctgatgctggccctgcgggcggcgctcaccggcacagcgtggcctggcatcgcggtttggctggccgcggcgctcgccacgcatctcgccgagatggtgatccgctttcgtcgtgacggagcggcggcgtcgccggactgtgacaagctggccgagaacaaccagaagtggcgaacgttcggtgcgcgtccgccgatgacctag

SEQ ID NO: 7628 - DNA, 1818 bp, Methylobacterium sp.
atgcggtccctcgacaccctcccccttctgcggcccaagtccgaggccggtcgcgccccttcgggcgaggatgcgcgcgcgggcgtcccgcctgatttcgaggcgatgctcggcgccttcgagaacggggcggcggagcgcgggacggccgatacgggcacggcacggaccggagaggccgcggcggaacaggtcgaggccgggacgaacatgtcgccccccctccccgccgaggccttgcccgcaaccaccctcgacgtcggcggctcggccttgcaggcgctgatggcgctcaccggtcccgcggtgccgacgatcgcggttcccccggatgccagcctggaggccatggtgcagcgggccgccgcacgcgccggatcagggcccggcccggccccggcggagccggccttgcagatgtcgatggtcggcctggaaacacatttcgcgccggtccggccccatggcgccgccccggcggaaacggccatcgagtcaggcctgaacgcgccatccgcgccgccgatgcccccgacatccggcagcatcggcgccgcgccggccgcgccggtgagcccagaaaaggcgcccgatgcgaccgtgccgtcggcattgccggccggcgggccggacggaccgctcgcgccaggaccggtcgcgatgcagcctccggcagcccgcagcgacgccagcgatccggccgtgccatccgatcgtccggcaccggacgcgcccgcgaacgcgttgacggcaccggccgccacgacacccgcgcgaccggcctcgcccgttccaggcgctgaccgccccgccgaatcgaccccggcgagccatgcaccggcaccggacgaggccgttcggcaagcggcgggcgctcccccggcacaagcggccggcgccgaagctccgcgaagccccgctgcccgcggacgcgcgacgccccggagcgatcaggccgagccggtcggtgcggcggacaacgccgctctccccgatcaaccggagggcacgagcctcgccgagccggtcgccgtcgcccaacccggcacgccggggcagacccgaggcgaccccgaatcgcggcaggatcgcccggccgccatcgcacacccggatacgatgccggagcatgccgccgtggccgtgccgcgaccgcagtctgaaggtggcgcgcgcgccgaaagggccggaagcgacgcggtgacgatcgaagcaccgcgcccggacatgccgttggcgccatccggtccgcaggagacggccggcctgccgacgccggcgccggcctcgccgctgcgccagatcgtcgacgcggtcgccgcccagttgccggcggcacccgccgcgatagcgactccatcggcccgtcccattccggcttcgaccgaggccgggccgctgaagatcctcacgctccagctccacccggccgatctcggctcggtgctggtgcggatgcgcctgcaggacgggcggctggaaatgagcctgcgcaccagccgcgaggagaccgccgagcgcctgcgcaaggagggcgacctgctcgcgggcctgctgcgcgaggccggctacgagcccgaggccgtgacgattcaatcgggcggccccggcccgggcgaatccgggccgcgcggtcagggattcgcgtccttcgccggatcgcagggcggccagcacgacagacagcctggcgcagcgacgcccgatcaatcgggccggcgcccgtccccgcgcgcggacgcggccgccacgcccaccgaggagcaggaccatgagacggattctcgcgggcgcgatcgcggcagcctgtatctctag

SEQ ID NO: 7629 - DNA, 219 bp, Methylobacterium sp.
atgccggttttcgttctcagaggcgcctgccgggctcccgacggccagatcgggccgccgctgttcgaggagacgatcacggcggccagcccgagcgaagcggtccggctcgccaacgcgcacgatctctcgaccaaggacgagcgggcgaacgccctctggctcgtcgatgcgcagggcgtcctgcactggtccctgcggcgcgcggatcgggattga

SEQ ID NO: 7630 - DNA, 1086 bp, Methylobacterium sp.
atgcgtgacgacatcgccaatcctctcgaccacttccggagcgtagcggccagagagcagcgccagcggatcgaggtcatgcagcgggtgcgcggggcgtacttccgtcatccgaagcacgacgaggtcgccgagcatgttgacgagctcattgagcatctcttggagcacaccgactcacgggtgcagtgcggcagcgaggaagcttcggggatcgccatcatcggcgcatccggtgctggcaagagtacaatgctgcgtcgaattttcctcgagcacccagccttcccgcattacggcgtcattggatctcgctgccccatcgtgacggtcaagccggagggggcctgcacgctcgatcgattcgcgatcgacacgctgcgcaagttgggaatgccggtgcaggacgttccgcgtcaggagcagcgcatggcgcacatggtacgggatcagctgcgtctgatgggggcgaaagtcctccatatcgacgaggctcatcacatcacgcagccggccaactccattcaaatcaagaagatcctcaacacgttcaagtgtttgatgatcgatgatgagtggccgattggattaattctgtcggggatcccggaactgaggcaagttctggaaggggagcggcaggtcgctcgtcggcttgccttcgtgccgctggcggggctgaccttcgcgtcggatgcgcgcaaggtcgggaagatcgcccagcaactggccggtctcgcgaagctcggattctcggcggtccaagccgatgtccttgcaccgcgcatcattcacgcgggcggatatcagctgggatgcgcgatcgagcgaatccacgaggcgatccgggtccggctcaagcgcaatctgcctcgcctctcgacggctacgccttcgcctgacccgttgatcttggacgatttcgccacggcctatgcccggaaaacaggcgtggaggcgcaggacaatccgtttctcgcgcatgactgggaggcgactgacccgttccgcgtcctgaacggaccgcaacggaccgatgacaagggtgatcgcccctcttcgcgttcgacaaagaaggggggatga

SEQ ID NO: 7631 - DNA, 942 bp, Methylobacterium sp.
atgaacacctttcctcagaacgggcttggcgcgatgccttccgatacgggcgcggcgaatgacgactcgtccgcggcgatgcgccgggaattggcccgcctgcgggagatgctggagcagaactcggactggatctgggaggtcgatgcgcaggggcgctacacctacgcctcgcgccaatgcgtcgccctgctcggccgcgagccggaggaggtgctgggtcgcacccccttcgacttcatgccgccggacgaggccgagcgggtcggccggatcttcggcgccatcgccgccgagcaacggcccttcacccagcttctcaaccgcaacctgcgcaaggacggcagcctcgtcgtgctggaaacgagcggcgtgccgctgctcggtcccgacggcgcgttgcgcggctatcgcggcatcgaccgggatgtgacgcagcgggaggcggcgaacgagcggctccgccacctcgcccggcacgacgacctcacgggcctgccgaaccggatgtatctgcgtgagcatctggcggggctactggctgccggacaacgccccggcgtgctctgcctcgatctcgacggcttcaaacccgtcaacgatcgcctcggccacgccgcgggcgatcgcgtcctgacggagatcggtcgccgcctggccgaactggcggcttcgcacggcctgttcgcggcgcggcccggaggcgacgaattcgttctgatcgtgccggacggcgtgtcggtgtcgcccgaggccgttcgcgcgatcatcgccgcacccatcgccgtcgatgccgagacggtgcggatcggcgccagcctcggcctcgcttcggcacagggccccgaggacacggtcgatgccctgctcgcgcgggccgaccgtgtcctctacgacgccaaggaagcggtcagacgggccggcgtcagcgacggcggctga

SEQ ID NO: 7632 - DNA, 111 bp, Methylobacterium sp.
atgctgtccgtctcccgcgccgtcgtttcgaagcaccgtgagatttccgcgctgctcgcaacctatgccatgttcctcagcggcgtattgattttagcctgggcggcataa

SEQ ID NO: 7633 - DNA, 927 bp, Methylobacterium sp.
atgatccgtgccctgtcgatccgtgctctgtcgttgcctggacaggccccttccgccgcggcgccggatcgcatcggggccggccgcagttccgaggtgttcgctgcagggccggaccgggtggtgaagctctaccggcagcccttcgagccggaggcggttgcgaacgagtgggccgcgagccgcctcgcccatggtttcggcctgccggtgccgaaggcgctcggcatcatccgacgggccgagcgcaccgggatcctgttcgcgcgcctcgatggttcgccgatgacggtgcgctatgcctacaacccggtcgggctgatgatagcgctgcgccgcgtggcacggattcagcacgcgatccatgcctgtcccgcccccggcctgccctcgcagcatgacggtctccggacccagatcgagggcgcacgggtgccggagcccctgcggcaggcggcgctcgccgccctcgaccgcctgccaaggggcgatcgcctctgtcacggcgacgtgcatcccggcaacgtgatcgcgacctcggccgggctccgcttgatcgactggcagaaggccgccgcgggcgatccggccgccgacgtggcccgctccgaactgatgctgcgctacggccggctcggcccggcctggttcagccggcttcgtcccgtgcggatggcgcgccggctgatcgcggcgtggtacgtgcaggcctaccgcgcggcgagcggcctgccgcgggaggccatcgccgcgtggcgcctgccggtcgcggtctcacgcctgttcgggcgcccctccgacaccgacgccgatttgctggcggcgatcgaaaggctggcgcgcaaaaaaccggatttcgaaaaggcgagccttttcgcgggtccaaggcagagccctggtcgagggcagccggagcaatctccctaa

SEQ ID NO: 7634 - DNA, 2739 bp, Methylobacterium sp.
atgaccgacgcggccgagatcgcccggctcgaccatgtctcgcaccgctacggccggacggtcgcgctcgacgacgtgtcgctcggcctgccggccgggcgcatggtgggggtgatcgggccggacggcgtcggcaaatcgaccctgctcgccctcgtcgccggggtgcgccggatccaaaccggccaggttctggcgctcggcggcgatatggcggagcgacgccaccgcgcggcgcagggcgcgcgcatcgcctacatgccccagggactgggccgcaatctctacccgacgctcagcgtcttcgagaacatcgacttccacggccggctgttcggacagggacagcgcgagcggcgcgcccgcatcaccgaccttctcaccgcgaccggcctcgaacccttcgaggcgcggcccgccggaaagctctccggcgggatgaagcagaagctcagcctctgctgcgccctcatccacgatcccgacctgttgatcctcgacgagccgaccaccggcgtggacccgctctcgcggggtcagttctgggacctgatcggctcgatccgggcgcgccggcccggcatgagcgtcgtcgtcgccaccgcctacatggacgaggcctcgcgcttcgagtggctggtggcgatggatgacggaaaggtcatcgcgagcggcagccccgccgagctgctcgaacgcaccgccaagcccgacatggaggcggccttcatcgcgctgctgccgcccgagaagcaggcgcagcacaaagccgtggtgctgcggccccgcccgccggggctcgacgcggagccggcgatcgaggccgagcacctgacgcggcgcttcggcagcttcaccgccgtcgacgatgtcagcttccgcatcggccgcggcgagatcttcggcttcctcggctcgaacggctgcggcaagtccacgacgatgaagatgctcaccggcctcctgccggccacggagggcaccgcgcggctgttcggccggcccgtcggcagcaacgacatggagacccggcgcaacgtgggctacatgtcgcaggccttctcgctctacagcgagctgacggtgctgcagaacctcgagctgcacgcccagctctaccaactgccgccgcacgaccggccggtgcggatccgggagctgctcgaccgctacgagctggaacccgtcaaggacgcgcggcccgacagcctgccgctcggcatcaagcagcggctgcagctcgcggtggccgtgctgcaccggccggccatgctgatcctcgacgagccgacctcgggcgtcgatcccatcgcccgcgacgccttctggcgcaccctgatcgacctctcgcgagacgagggcgtcactatcttcctctctacccacttcatgaacgaggctgagcgctgcgaccgcatctcgctcatgcatgccggccgggtgctggctgtcggcacgccggccgacctcgtgagcgagcgcggcagcgcctcgctggaggattgcttcatcggctatctcgccgaggccgccggcatcgaccgggaggaaccggccgggccgccagcggatctccccgcctccgccgctcggcccgcgccgcaccgccacctgttcgatccgcgccggctctgggcctatgcgaggcgcgagacgatggagttgctgcgcgatcccatccgcatcgccttcgccttcatcggcccgatgctgctgttggttgccttcggctacggcatctcgttcgatgtcgagaacctgcgcttctccgcctttgatcaggacaacagcccggagagccggcagctcaccgaggccttcaccagttcgcgctacttcagtgaacaggcgccgatccgctccgcgaccgaactcgacgagcgcttccgcagcggcaccgtgcagatcgccctggagatcccgccccggttcggcctcgaccttcagtccggccgggtgccggaagtcgccgtctggctcgatggggcgatgccgttccgggccgagaccagccggggctacgtcacctcactggcgagccagtacgctcagcaattggtgatcgagcgcacgggcgccgcggcaacgggcaagaccgtgagcgtcgagacgcgcttccgctacaaccaggcctttcgcagcgtcaacgccatggtgccgagcgtgatgatgctgctgctcatcctgatccccgccatcatgtcggccatcgcggtggtgcgcgagaaggagacgggatcgatcgccaatttccgctcgacgccggtgaccaagttcgagttcctggtcggcaagcaacttccctatatcggcatcgcgatgatcagcttcctgctgctggtcctcgtcgcgctgatcgtgttcgacgttccggtgaagggctcgttcatcgccctggcgctcggcacgctgtattacgtttcggccaccaccgggttcggccagttcatctcgaccttcatgaagacccaggtcgcggcggttttcgccaccgcgctcctgtcgatcatcccggcggtcaacttttccgggctcctggtcccgatttcctcgctctcgggcagcgcgcggatcatcgggctctcgcttcccccggcatggtaccagccggtcacggcaggcgccttcaccaaaggcctgcccttcatcgaactcgcgcccaatatcgcggtgctggcgggcttcgcgttcctgttcctcgtcctgtcgcaactgctcctgcgcaagcaggaggcgtga

SEQ ID NO: 7635 - DNA, 339 bp, Methylobacterium sp.
gtgaggatcctgttcgtctgcggccgggcgcgcgcccgcagcccgaccgcggagcaggtgtttttgcgatggcccggcctggagacggcctcggcaggtgtctcggacgacgcggacgagcccgtggaggccgatcacctcgcctgggccgagatcatcgtggtgatggagcgcgcgcatcggcgaaagctgatgcgccgcttcgggccggcgctccggcatgcccggatcgtctgcctcgatgtgcgcgatgactacgccttcatggagccggcgctggtgcgcatgctcgaagcgcgggcggggcggctcctgccgcctggaagcaagcccggttga

SEQ ID NO: 7636 - DNA, 252 bp, Methylobacterium sp.
gtgaacgccaaggtctttctccttctcgtcggcgtcgtggttgggggcctcgtcggctacctgacccggccgcaggccgccgagttcaagctcggtccgctcagcgtcgagatccaggacaaggactcggcggtgggcgcacgcggcggagagctgaccaccggccagctccagcatgtcgggctgttcgccctgatcggcgccgtgatcggcttcggagcaggcttcgtcgccgaccgcagccggcgctga

SEQ ID NO: 7637 - DNA, 2211 bp, Methylobacterium sp.
atggtccgcggtgccgcagcctgggccgtcgtcctcggcgcgccggccagcgccttggagccggtcgagagccggatcgaggcgctgctcgcccggatgacgctggaggagaaggcgggccagctcaacctgatctcgcatgagccgatcctcgacctcgatgctttccgccgcggcgaggtcggggcggtcatcaacttcaacaatgccggtctcgtggcgcaggccgaccggctcgcccgctccgcgcggctcgggatcccgctgctcgtcggcctcgacatcgtccacggctaccgcaccatcttccccctgccgctcgccatggccgcgagcttcgatgccggtctcgtgcgccgcgccgccgccgcccaggcacgcgagtcggcagcgatcggcctcaactggaccttctcgccgatggcggatgtcgcccgcgatctgcgctggggccgggtggtcgagggcttgggcgaagatccgtggctgacggggcggctcaccgccgcacaggtcgagggctttcgcgatggcgggctcgcgagcacgctcaagcacttcgcgggctacagtgcggtgctgggtgggcgcgactacgacgcgaccttcgtggcacccaccgaattgcacgacctccacctgcccccgttccgcgatggcatccgggccggcgccgatgcggtgatgacggctttgaccgccctgaacggcctgcccaccaccgccgacccggcgctgatgacgggcctgctgcggcggcagatggcattttccggcctcgtcgtggccgattggcaggcgatcgccagtctcacgaagcacggcatcgcccgcgatggcgcggaggccgcgcgcaaggcgctggcggcgggcgtcgacatggacatgacgagcgggttgtttctccgccacctgcctgatgaggtgcgcgccgggcgcgttcccgaaacggcggtcgatgaagcggtgcgccgggtgctgcggctcaagttcgggctcggcctgttcgaccgccccgtggtcgatccggacggcgcggaggcgaaactgctgcgccccgagacccggcggctcgcccgcgaggcggcgcgggcgagcctcgtgctgctgcagaatcgcgaggatctgctgccgatcgatccggccaaggtgcgccgcatcgccgtcgtcggtcccttcgccgattccgcctgggatcaggtcgggccgcatgagggcacggggcaggaatgggacgcggtgacgatccttgcgggcctgcgtgagcgggccgccgcgtccggtgtcgcgatcgatttcgcgccgggctgcccgcgcgtctgcgacagccgcgcgggctttgccgccgcggtcgaggcggcggcaggggccgatctcgtcgtggcggtgatgggcgagccgcgggaccgttcgggcgaaggctcgtcgagcgccaccctcacttggcccggcctgcagcatgatctgctcgcggcggtcgccgaggccggcaagccggtcgcgctcgtcgtggtcggcgggcgcccgaccgacctcggggatgcgttaggacaggcgcaggcggtgctgatggcgtggctcccgggcaccgagggcgggccggctgtggccgagacgctgttcggtgacgccaacccatcgggccggctgccggtctcctggccgcgtaaggttgggcaattgccgctgacttacgacacgctgccgggcgggcgcccgcatgtccccggctcacgctggaccatgggctatgccgacgagtcgccactgccgctgttcccgttcggctacggcctctcgtacacgcgcttcgcctatggcgagccggagatcgtagcgccgcatgtcggcgtcggggaccgctacgacgcgatgctggaggtgcgcacctccgtcaccaactatgggacgcgtccgggccgggcggtggcgcagctctatatcggccaaccggtggcgagccgcagtcgaccgaggcgcttgctgaagggcgtcgcgctcctcgacctcgcctcgggcgagaccggagtcgcgagcttccgcgtgccggcgcgcgaccttggctaccacgagccggacggcacgctggtggtggaggccggcacctacctcgcccatgtcggcggggatgcgatcgccacccgcagtgccggcttcgctgtcgagaccggttggcgcgggccgccgggcagcgacgaggcgcggcgctga

SEQ ID NO: 7638 - DNA, 2697 bp, Methylobacterium sp.
atggaccaagccaagcccaaggaacgggtcaggatcgcccgggccggcgcgggacgcccaggctacgtcacggtaaagggcgcccgcgagcacaacctgcgcgacgtcgacgtcgaggtgccgcgcgacgcgctcgtggtgttcaccggcgtctcgggctccggcaagtcctcgctcgccttcggtacgctctacgcggaggcccaaaggcgctacttcgaatcggtcgcaccctacgcgcgccggatgatcgatcaggtcggggtacccgacgtcgattccatcgagggcctgcccccggcggtcgccctccagcagcagcgcggaacgccgagcgcacgttcctcggtcggcagcgtcaccaccctgtcgagcctagtgcggatgatgtattcgcgcgccggcacctacccgccgggccagccgatgctctacgcggaggacttctcgcccaacacgccccagggcgcctgcccctcctgcggcgggctcggacgggtctatcaggcgacggaagcgtcgatggtgcccgacccctcgctgacgatccgcgaacgcgccgtcgcggcctggccgcaagcctggggcgggcagaacctgcgggacatcctggtgagccggggcgtcgatgtcgacacgccgtggaaggatctgccgagggcgttgcgcgactggattctgttcacggacgaccagccgcaggagccggtctatgccgggctctccccggagcagacgcggctggcccgccggcgtcgcctggagccgagctacatgggcacgttcacgagcgcccgccgccacgtgctcggcaccttcaccaactcgcaaagcgccctcatgcgccggcgggcagcgagctacctcgtgagcgaggattgcccggtctgccaaggcaagcgcctgaagcccgaagcgctctcggtcaccttcgcggggctggatatcggcgagctgtcgcgcatgccgctcgccgacctggccgaagcgatgcggccggccgccgaggacctgctgcccgacgatgccgacggcaccgcgccggagaccctcggccgcgacacgggccggcaggatcgcgcccggcgcgccgcgtccggggcgtcggcccatgcgggcgcgccggacgtgcgcgcgacgcccaacctctcgatcgagaagcggctggccgctcagcgccttgcggccgacctcatcgaccgcatcggaacgctgacggagctgggtctgggctacctgtcgctggaccgggtgaccacgaccctgtcgtcgggcgagctgcagcggctgcgcctcgccacccagctccgctcgcaactcttcggcgtggcctacgtgctcgacgagcccacggccgggctgcaccccgccgacggcgatgccatgcacgacgcgctggccgggctgctcgcctcgggcaattcgctgttcgtcgtcgagcacgacatcggcacgatgcgccgcgccgactggctcgtcgatgtcggaccggccgcaggcgagcacggcggcactgtgctctatagcgggccgccggaaggcctgcgcgacgtggaggcgtcgcgcacgcgcctccacctgttcggcatggccgagccgccgcagcgcccgcgacgggagccgtcgggatggctgcgcctggagggcatcgtccgcaacaacctgagcggggtctcggccgcgttcccgctgggttgtctcaccgccgtgacgggcatctctggctccggcaaatcgagtctcgtgagccaagccctgctggagctcgtcggcgaccgcctcggacggcccgtcgagatcgacgacgagccggaggacccgctcgacgacgcgccgggcccgacggaggggcgcatcgtcggcggcatggacgggatccggcgtctggtgaaggtcgatcagaagccgatcgggcgtacgccccgctcgaatctcgcgacctataccggcctgttcgacgccgtccgcaagctgttcgccgccacacccgaggcacgcaagcgccgctacgacgccggccgcttctccttcaacgtcgcgaagggccgctgcccggcctgcgagggcgaaggcttcgtcagcgtcgaactcctgttcatgccgagcgtctacgccccctgcccgacctgccacggcacccgctacgcgcccgagacgctggaggtcacctggaacgggctgaccatcgcggacgtgctcgggctcaccgtcgagcgcgcctgcgacgccttcgcggacgagccgtccgtgttgcgacccctggccgtgctgcgagatctcggcctcggctacctgcgcctcggccagccggcgaccgaactctccggtggcgaagcccagcgcatcaagctcgccacggagcttcagaggggccagcgcgggggcacgctctacgtcctcgacgagccgacgacggggttacacccgaccgacgtggaccgcctcatgctccagctcaacggcctcgtcgatgcgggcaacgcggtcgtcatggtcgagcacgacatgcgcgtcgtcgccggggccgatcacgtcatcgatgtggggcccggcgccggaaacctcggcggcactgtcgtcgcggctggccctcccgaagcggtcgccggggcacgggcaagccgcacggcaccgtatctgcgggacgaactcatggcctatgcgggccaggagtcttcaccacggcttgccggctga

SEQ ID NO: 7639 - DNA, 843 bp, Methylobacterium sp.
atgccggtccgtgcctggcacatcgccatcctcttggcggcaaccgtgcttccggtgagcgcgtcggccggtccgagtggacgcgacggcgaacgcattcgggtcgtccatgtggcacccaagacggccgcctaccatgagatctacgacaccatgcgcgagcagagggtgctggagcgggtcggcgccatcatcggtctcgtcaggctgcccaatcgactgacgtaccggctgaccgaatgctccggcgagcgcaacgcttggtacgcgcccgagaaccggagcgtgaccgtctgctacgagctcctcgacagcatcgtccaggccgcaccgcgaacgaagtcgccggccggggtgaccaggctggatgcgatccacggcccggtcttccagatcctgctgcatgagagcagccacgctctgttcgacctcttgcaggtgcccatcctcggacgcgaggaggacgccgctgaccaggtcgcctcgctgatcctcctgcacctgtcgcccgccgatgcccgcagggtcgtgaacgggagcgcgtacttcttcgcggcgacagccaaggaggagccaatcgacaagggtgccttcgccgacgtgcacgggctgtcctggcagcgcttctacaatctcgcctgcttggcctacggctcggaccggagacggtaccgcgccatggtggccaagggctacttgcccaaggagagggccaagggctgcggcgaagagtacggccaggtcgacttcgctttccggacgctcatcggaactcacctgcgcgtgcgacccgcgggcggccagcggctgcgacgcgccttccgctctgcgttcaagtcctga

SEQ ID NO: 7640 - DNA, 279 bp, Methylobacterium sp.
atgtttcccaaactcgtcggaaccgccgcgctcctcgcggccggatccgtgcttcttcatagctggaatgcgccgcgctgggcgatcacggccctgtgcgtgatcggcacccttgcggccgcgctgtcccttgctcccattctggagcagccgatcgctccggccgcggtgatgccggcccccgaggcgctgaaaggcccggctccggtcttcgaagggatctgggatccggtccatcgccggcagctcttgggcgaagcggaccgaaccggtctgtag

SEQ ID NO: 7641 - DNA, 285 bp, Methylobacterium sp.
ttggccggcatccggcgcctcgcggcggcgaagcccgagggctacacccgcgccttcgaggtgccctacatcgtgaccacggcccgcaactgggccgggcgcatcggccgcttcaccctgacggtggacaagggccgcgcggacgccctggtcagcttctgccgacagggcgtgcgcaagacgggtccgaccaccttcgcctgggaagcccgcgactacgtcccggattccgacctgcgcgtgcttctcgtctcgaacgatcccgccttcctgggggatcgctga

SEQ ID NO: 7642 - DNA, 2346 bp, Methylobacterium sp.
atggcgaaaatctcggtcacctgggccaatgaatactcgatgggattggccgggtggcaggctggtctgatcctcgcgacggcacaggcggctgccgacgcttggggcaagtacatccaagtcgagagcacgttcgatatcgcgatcgggatcggcaatgtcggcggcgccctcgccaacggcggcccgcaatggacctggaacgggagatggtgggaaaacacccccatcctgaaggcgcgcgaggggtatgacccgaacggcggcgtgcaggacgccaacctcacgctcggcgagcatacgttccgcgattggttctacgatccgaccggtgttgcggccgcgcccggcaacaggttcgacgccttcaccattttccagcacgagatcggccacgggctgggcttccttgaattcccggccacggtcggagccaacgggctgctcctcttcaatggtgagaacacgcggacggttctcggcggcccggtcgtgctcgatggggcccgggcgcacgtgtggggatccgaggatctcatggacccctatctcggctggggccagcggtcctacatctcggacctcgacctggcgatgcttcaggacaaggggatgccgatctcgaccgagcgggccgacaagatgtggctcggcaaccgggccgacaccttcttcgcctatggcggtgacgactggatcgacggcggctggggcgacgacaagctcttcggcggcgtgggcaacgacacgctgatcggcggggacgggaacgacgcgctggatgggggcgcgggcgacgacacgctcatcggcggaaacgggggcgacacgctggaggggggcgagggcatcgacagggccgtgttgacgggccggagccaggactacgtcgcgctctacggcgccaccggttcactcgccatcaagcacctcgcctccggcagcatcgacacgctgacctcgatcgagacgctgaacttcgacgacaccgtgctcggcatgtcgggcctcctcgcccatctgcagcagcgcttcgggcccgtacaggccggcaaggcgccctacgagatggccctgaatgccaccgcggacgaggcctaccgccccgacatccccgagatcgacggcgcgttcagcgtcaccgcgcgggtgcggttcgacgacctcgccggcggccatttccagcgcgtcttcgataccggcaacggtccggacagcgacaacatctggctcggtcaggtcggcaacggccgggacatggccttcgagatcctcgacggcgcgatcaagcataccatcaccgccagggacggcatcactcagggcgtcgaggcgcgctggaccgccggtgtcgacgagcgcggatggatgtcgctgtacaaggacggtgtgctcgtcgccgagggtcagggggtggtgccccgcgacctgacgcgcgcgaaggatctcgtgggccaatccaactgggcgcaggacgcggcgctgaagggcagcatctacgacctgaccttcaaggacgacctgcccgacatccacggcgccttcaccgccagtgcgacggtccggttcgatgatctcgatgccggtgcgtggcagcgcgtctacgacatcggcaacggtgccggtgccgagaacgtctttctcggccagatcggcacctccggcgacatgcagttcatggtcctgaacggcaccaactccgccaacatcgtggccaagggcgcgatcgtcgaaggccaggaagcgacctggacgaccagtgtcaacgagaccggttggatgcgcctgttcaaggacggcgtgctcctgtccgagggacagggcatcgtcccgaaggatgtcgtgcggaccaacgagttcgtcggcaagtccaactggacgtgggacaaaccgctcgtcggcgaggtgagcgacctgacgatcacgccgttcaagggcatcccggagatcgacggcgccttcaagatgttcgccgaagtccgcttcgacgatctcgcccacggaaactatcagcgcgtgttcgataccggtaacgggcgggacagcaacaacatctggctcggtcaggtcggcaacggtgacgacatggccttcgagatcctcacgggcgccacgaaacaccggatcacggcggcggacaccatcgtcgagggtgagatggcaaagtggcaggccagcgtggacgaggccggctacatgcgcctgatcaagaacgacaagctcgtggccgagggccagggcgcggttccgctggatgtgctgcgcaccagcgatctggtcggccagtccaactggtcgtgggataccgcgctggccggacaggtgaaggatctgatcttcgcctga

SEQ ID NO: 7643 - DNA, 225 bp, Methylobacterium sp.
atgcgcccgagcaccgtctttgccgccgcgagcctctgcctcgctgccctgccatgccgggcccaaggcgtgccgtcgaaccccttcgcctcgaactacccttcggcgccgccgcgcatggtcgagcgggaggggcgccttcaggccccgcgcgctcggcgtcccctgccaccggggcgggtcgggcgcgggctgctgccgccggccgacgttccgggccggtaa

SEQ ID NO: 7644 - DNA, 1200 bp, Methylobacterium sp.
atggccgctcccgtccaggcccctgcccaagtccccgccccggcccaggtccccgcccccgcgccgctcggcttcggcacgcatgtggccaacgtgttccgcctcatcgtcaaagagctgcgcagcatccgggccgatccggtgatgctgttcctcgtcgtctacgccttctccttcgccatcgtctccgtcgcttccggcgcctcgaccgaagtgcgcaacgtgagcatcggcgtggtcgacgaggatcactccgacctctcgcggcagatcgtgagcgccttcaacccgccgctgttcaaggacgtcgttctgatcggtcccgcagaggtcgatcccgccatggataccggccggctggtcttcgtgatcgatctgccgccgcgcctgcagcgggacgtgctgtccggccacccgacctcgatcgaactcgacgtcgatgccacggccatgacccaggccggcaacggctcggtctacatccagaccatcatcacccaggagatcgccgccttcgccgcccgcagcgaactcaacgatacggcaccggtgcgggtggtgacgcgggccaagttcaacccgaacctccagacgagctggttcacctcggtgatgcaggtgatcaacaacatcacgctgctgacggtgatcctcaccggggcggcgctgatccgcgagcgcgaacagggcacggtggagcacctgctggtgatgccgctggtaccggtcgagatcatgctcgccaaggtcatcgccaacgggatggtgatcctcgtggcggcgggattctcgctgctcatcgtggtcgagtggtggctcggcgtaccgatcgccggctccatcgccctgttcctgttcggggcgggcctctacgccctcgccgtggcagctttgggcatcctgctcggcaccatcgccacctccatgggacagttcggcctgctggtgatcccggtgctgctgctgatgcagcttctctccggcagcagcacgccgatggagagcatgccggtctggctgcaatatctcgtgcagaccgtgagcccgacgccgcacttcgtcgccctcgcccaggccgtgctctaccgcggcgcggacctttccatcgtctggccgcagctcctcgccctcgcggccctgggcagcgtctacttcgccttcgccctcgcccgcttccgccgcgtgatcttcggagactga

SEQ ID NO: 7645 - DNA, 903 bp, Methylobacterium sp.
atggccggatcgtcctccgccgccgcgcggccgacgaagcgcgtcgagccgcgcacgctggccctgatcgggctcgcgggcctcgccgtcgccgccgctgcggccctgttcgcgacattggccgatgccggcaccgtccaggcggtccgggacggcctcagcagtcgcggcttctggaccgcggcggcggtcggcctcgcggcgcagaccgtcgatggcgcgctcggcatggcctacggcatcacctcgaccacgttcctgctgtccaccggggtgccgccggcggcggcctcagcctccgtgcatgtggccgagatcttcaccaccgccttctccggcctctcgcattggcggctcggtaatgtcgacgggccgctgttccggcgcttgctgatccccggcgtgatcggcgcggtcgcgggcgcgacccttctcacctcggtcgatggcgagaccatcaagccgttcgtctcggtctacctgctcgggatggggctctacgtcctgtcgaaggcgttccgcaccctgaaggccaaccgcgcgccgccgcgggccgtggtgccgctggcgctcggcggcggcttcgtcgatgcggtcggtggcggcgggtgggggccggtggtgacagccacgctggtcggcggcggtcaggatccgcgcacctcgatcggctcggtcaacgccgcggagttcttcgtcgcggtggcgagcgggttgtccttcaccctgctcggcgggctgacccactggaccaccatcgccggcctcgtcgtcggcgggttgttcgcggcacccatcgccgccctgctggtgcgggtgatcccggcgcgggtgttgatggtcgtggtgggcctcctgatcgcgagcctcagcctcgtgagcctcgcggagctgttcggttag

SEQ ID NO: 7646 - DNA, 1407 bp, Methylobacterium sp.
atggacgtccgcacacgccgcctcctcacggaccctatcgtgccgacactcgcccggatggccgcgcccaacatcctggtgatggcggtccagacctccgtcggccttatcgaaacgtatttcgtgtcgatgctcgggacggacgcattggccgggatggccctcgtctttccggtggtgatgctggtccagatgctctccgccggcgggatggggggcgccatccaatcggcggtctcccgcacgctgggtgcggaccggcaggcggaggccggaattctggcgtggcacgcgatggtgctcggcctggggctcggcattgcgacgagcctcgtcgcccttccgttcgggccgaccctctacgcggcgatgggcgggaccggaggctcgctccgagcggcgaccacctacgcgtccattgtgttcggcggggcggtcctgatctggctgttcaacgcgctgtcggccgtgatccgcggcaccggcaacatggtgcttccggccatcgtcacctgcgtcggggccgtcgtgctgatcccgctctcgcccgcgctcatcttcggttgggggccgttccccgagttcggcgtcgcgggcggtggcgtggcattcgcagcctactacgccgcggggtccgcggtcttcgccgcctacatctggtccggccgcagcgtcctccgcccgagccggcgcttgcccgctctctcttgggggccgtcacgggagatcctgcgcgtcggggttctttcgggcatcgccagcatgacctcgaacgtcacagtcatcgtggcgaccggcttcgccggggcggcggggccggcggccgtggccggctacgggaccggcgcccggctcgaatacctcttggtccccctcgtgttcggtctcggctctcccatcgcagccatcgtcggtacggccctgggagcgggcgaccacgtacgagcccgccaggcggcactgacgggtgccctcatcgccggtgtcctgacggagttcatcgggctcgcggcggccctgcatccggccgcgtggctcggcttgttcgcagacgatccggcgatgctcgcaacgggctcgctctacctgcgaatcgtcggcccgttctacggatttttcggcttcgggctggccctgtacttcgccgctcagggtgcaggacgtgtcggctggccgctcgccgccagcctccttcggatgggggtcgcattgggcggtgcttggctcgccttggcgctcgggctcggcctcaccggaacattcatcgccatgtcggccgggttcgtcactatggggctcgtcaacgcggcggccttcgcgacgggcaagatgttcccgagcgacgccctcggcccaccctccgtaacttccggaacgctagctccagccgcgggcgtgagacgctga

SEQ ID NO: 7647 - DNA, 195 bp, Methylobacterium sp.
atgatcttcatcggcggcttcgtcgcaatcccggcatccggccgatgggcgcatcaggtcacggaagcgctcgccttccttctcgcgaccgtcgtgctggtcattgcggtcatgctcctctgcaagacttggccggactactacaccagcccacagattccggccgccatgacggaaacgccactcgacgactag

SEQ ID NO: 7648 - DNA, 117 bp, Methylobacterium sp.
atgaaatccttccttcgcgccggcacggccatcgccggcatcgccttcgccggttcggcgctcgccgccgacctcccgcgccgcgcggctccgccgccggtgttccagccggtgccg

SEQ ID NO: 7649 - DNA, 1710 bp, Methylobacterium sp.
atggatcatagcgaaagccctcaccattccgcgtcggccggttcgcggcgtgcgcttctcctgacctctgcggctgccctgggggcgacgaccatgccgagccgtctcttcgccgaagcgagcgccccccgcggcgctctcgcccagtcccgccagggcatggtgacgagcccgcacgaactcgccagcgaagccgggcgggaggtgctgcgggggggcggcaacgcgatcgaggcggcgatcgccatcaacgccaccctctgcgtgacctacccgcatttctgcggtttgggcggtgacgcgttcatgatcgtcagcgatcgcaacggcgccagcttcaccctgtccggcatcgggcaggcggcgtcgaagctgccgcaggacggccagccgatcccgctgcgcggacccggctcggcgatcaccgccgcggccgccgtcgatacctgggagcaagccttcacctacagccagcgggcctggggcgggcggcaatcctggaaggggctgttccagcgcgcgatcacctatgcggcagagggctttcccctgacgccctcgcaacacttctgggcgaacttccgcgccaaggagctcggcaactggcccgatatcgtgcgcgtgttcaccgccgaaggccgcatcccggaggccggggagacgtttcggcagcccgacctcgcgcgcacactgacgacgctcgcggagaatggcggccgcgacttctacgagggcgagttggcccagcggatcgcgcgggggctggagcaggcgggctcgcccctgacggcggacgacctcgcccgctgccgggcgcgcaacgagagcgcgctgcgcgtgccctaccggggcggggagctcatcagcctgcgcccgccgacacagggcctcaccacccttgagatcatgggtgttctcgaccgcttcgacgtggcttcccttcccgagggcagcgccgattactaccacctcctcgtcgaagcggtgaagctagccttcatcgaccgcaaccgcttcatcgccgatcccgatttcgtcgatgtgcccgtcgagcggctgctatcggcctcgcacctcgacgcgcaggcccggagcatcgatccgcgcaaagctgcgccctggccccatgtcttcaagacgggggataccgtcttcatcggagcggccgaccgggacggcaattgcgtcagcctgttgcagacggtctatttcgattggggcagcggcgtcgtcgcgggcgataccggcatcctctggcacaatcgcggcgcgtccttcagcgtagacgctgacagcatcaacgtgctgcgccccggaaagcgtccgttccacacgctcaatcccggcatgtacttcaagaacggccgtccgaacttgttgtacggcacgcagggcgcggatgggcaaccacagaccctgtcggcggtgctgacgcgcctgatcgattacgggatggatccgctcaccgccctcgcgcgccctcggttccttctgggcaagaccttctcggacagccgcgacagcctgaagctcgaactcgatgcaggtcaggccgtgttcgaagagctgaaggcgcgagggcacgagatcagtcccatccccgcccaaagccccctggccggccatcccggcgcaatccgcatcgaggatgacggccgcttcgtcggcgcccacgatccgcgcagtgatggcttggctctcggcctttga

SEQ ID NO: 7650 - DNA, 453 bp, Methylobacterium sp.
atgcacctgacgctggccgagcggggcgtctgggtcgcgaccccggccgtcgcgcaacgcttcgacatctcggtgcaccacctccagaagatcgcccagacgctggtccgggccggtgtcgtcgaggccaggcagggccgctccggcggcgtgcgtctcgcacgggacgcccgcgagatccggctcggacggctcgtcgccgatctggagggagtcggcaccgttgtcgattgccggcgcgacccctgcccgctcctgggccgctgccgcctcaaatgggccttcgacgcggcggagcaggcgttcttcctcgaactcgaccgcctcaccctcgccgacgtggtggccgggccgacggcagccgcactccgcgccctcttccgcgccgagccgggagacgggggggcgacgcccgccgcgcccgttccgaccgatccgactcctagcaattga

SEQ ID NO: 7651 - DNA, 1221 bp, Methylobacterium sp.
atgacggttacaggacgccgcgaccgggtgctggcggcactgacggcgctgagcggtgccctcctcctcgccgtccttctgggacggggcgcgctgcgcgatgccggcttcaactcgcacggggcgctggccgacgcgttcctgcacggccggctctgggtcgagcgctgccccgagatcgattgcgccgtgttcgaggggcgcacctacatcatcttcccgccgctgccggcactgctgctgacgccgttcgtcgccctgttcggctttcccggcttcaagggcctcgtgcttctcggcctgggcctgtcggccctgagcctgctcgcctggagccgcatcttccgcgcgctggaggtcgagcgcgggcaggcgttgtggctgctcgccgcgctcgccttcgccagcccgctctatcaggtcactctgcgctccgacggcgtctggttcttctcccagaccgtcggcttcctgatgatgacgttgagcctgtgggcggtgatctgtcggagttcgctgccgctcgccggattgttcgtcggccttgccttcctgtgccggcagatggcgatcttctatccgctgttcctgctggttctggccctaccccgcgggcgcccgctgctggcgaatccggcctcggtggcgaaatccgcgatgctggcgggcctgttcgtcgcggccgccatcgccgtctactgcgcctacaacgccgcgcgcttcggaagcccgttcgagaccggctacgccttcatccacaatcccggacaggacagcttcatctggcggcgcatcaccgagggcggcctgttctcgcgcgactacctgctgttcaacacgctctacctgttcctgcaggggatccatttcgagttcggtggcccccggctgacggagctcgtgggcttcgacaaggccggcacggcgctcctcgtggcgagcccatggctgctgctggccttctacgcacggctcgaccgggtcttcgccgccggggccgcgaccatcgcggtcatcgccgggatcaccctgttctaccactcgaacggcgccgagcagatcgcgacccagcgctacgccctcgactggctgccgattctgatcgtgctgatggtgcgtggggaacgcccgccggctttcgccgccctaccaatcctcgtcacctggggggtcgtcgccaacctcgccgtggtgacgctgctggccctctaccggctctga

SEQ ID NO: 7652 - DNA, 1398 bp, Methylobacterium sp.
atgagcgcgaccggtctcccccccgatcttctcgcccgtctcgacggtctgctgggaccgggcggcctgctgacggacgatgccgattgcgcgcccttcgccatcgactggcgccgcctgttcccgggccggcccgctgccgtggcgcggccaacgagcacggcgcaggtcgcttcggttgtcggcctttgccgcgaggccggcatcgccctggtgccccagggcggccataccgggctcgcgggcggggccacccccgacgcctcggggcgccaactcgtgctctcgctggcgcggatgaacgcggtccgcgccatcgatccggtcggcctcaccctggaggtcgaggcgggctgcgtcgtccaggcggtgcaagcggcggccgaggccgccgggcggctgttcccggtgagctacggcgcggaaggctccgccatggtcggcggcatgatcgccaccaattccggcggcatcaacgtgctgcgctacggcatgacccgcaacctcgtgctcggtctcgaagtcgtgctcgccgacggcggcgtcgtcgacggcctgcgcgccttgcgcaaggacaatgcgggctacgactggaagcagctctttatcggcagcgaggggacgctcggcattgtcaccgcggcggtgctgcgcctcgttccccggccgcgccacaccgagaccgccctgctggcggtgcccgacccggaagcggcgctccgagtgctggccgccgcgcaggacggcctcggcgacaccattcaggccttcgagctgatctcgcgttgctccttcgacctgctggagcgctatgccggcctgccgagcccgctgccgccctccccctggtgcatcctgctggaggcgggatcgagcctatcgggcctccgggacgcggttgaaggcacgctgggcgaagttctggagcgaggcgacgccgtggacggcgtgctcgccgaatcggaagcgcaggctgccggcctctggggtttgcgcgagcgcatcaccgaatgcgaggcgcaccagggcaagtcggtcaagcacgacgtctcggtgccgatcccggcgatcccggcctttcttgaggccgccgaccgagccttggccgagggcgcgcccggcaccgtcccgaacgtgttcggccacatgggcgacggcaacctgcactacaacgtgctgatcgggcccgagcacgacagcgccgcgatcaaccggctcgtgcacgacgtggtcgatcggttcgccggcagcatctcggccgagcacggcatcggccagtaccgcgtcgacgagctggcgcgccgccgccggcccgaggagatggctttggcgcttcgcctgaagcgggcgctcgacccggacggcctgctcaacccgggtaaggttctgcgggtctga

SEQ ID NO: 7653 - DNA, 1887 bp, Methylobacterium sp.
atgacgcggcgccgggccgggccggcggatcagatcattcgggcgcacgcccccgccgcgatgcggccgggccctcaaggctctcaggaggtttcgaagatcatgccaccctcgtctcaagccgtggccgaggcagccgccttccgcagcttcgccaacggatatctgcgcgagatcgaccccggcatccgcatccggcacgcgctgacggacgggccgcccgcgccgtgcatcgagtggaatctgcgcagccgccgcctcgcgatccgcgtcgagatcctgtcgccctcgctatgcggcgcgcaggcgttcggccgcctctggacccgccacctgcacgagccgcgctggcggccggtggcgccgatgcgcgcgcttcaggagcttctcggcgaggcctattcgcgcacggatgaggggcggggcgacaccgcccgcgagcgggagctggaactcctcgggcgcgtgctcgacagctaccgtgagaccgcccgcctgctcgacctcgcggagcgggcggccgagacggaaaccggcttcatcgccgccgagcgcgccctcgtcttcggccattggctgcacccgacacccaagagccggcagggcctcacgacctggcaggctcgtgcctacgcgccggaggaggggggcacgttccagctcgcggtgttcggcgcgcaggcgagcctcgtccgccacgactcggcggtggcccgcgccgcgcccgacctcgccctcgacctgctcggccccgacgctgccgagctgcgcttgcgcgccgacgagatcgccctgccgatgcatccgctccaggccgaggcgctgatgctggagccgcacgtcgccgcatgggtcgaggcgggccgcctgcggcggctcggcgccttcggcccccgcttcaccgcgacctcctcgctgcgcaccgtctacgccgccgagagcccgtggatggcgaagttctcgctgcccgtcaccctcaccaactcgctgcgggtgaaccggctcgccgaactcaaggccggcgtcgccatggcccggctgctggcgaaaagcggattcggcacccgccatcccaacttccagatcctggccgaccccgcctacctcaccctgcacagccccgaccgcgaggagagcggcttcgagacagtcctgcgtgagaatccgttccgcgacggggcggagcggggtgtcgcgacgctggcagccctcaccgccgagccgctgcccggccgcctctcgcggctggaggcccttctgcggcaggtctgcccggagggttcggccgcgcgcgcccaggccgcccgcacgtggttcgctcgctatctcgattgcatgctggagcccgtcgtcgccctctacgacgcgcatggaatcgcgctggaggcccaccagcagaacgcgctgctcgatgtcgcctccggctggcccgagcgcggcttctaccgcgacaaccagggcttctacctctcggaatccgcccgcccccggctgctgcgcgatgcgcccgagaccggcgccatcgcctcgctctatttcccggacggcgagatccgccgacggctggcctattatctcgtggtcaaccagatcttctccgtcatcgcccggatgggccatgacggggtggcccgcgaggaaacgctcctcgacgacctcgcccgccgcctggaggcgatggcacgccgcatgaccggcgccggccgcgccttcgcccgctcggtgctcgacggtccgacgctctgcaccaaggccaacctgcgggtgcgcctgtccgaccgcgacgaactcgcctcgggcgacggcaccggcaactacatcgacatgccgaacccgctcctgcttcgggcggctcggggcgaggccggccatgccctcgcgtcctga

SEQ ID NO: 7654 - DNA, 423 bp, Methylobacterium sp.
atgctgatcggtgaactcgctctcgtcgcggcagcggcctttgccggcgccgcgctgtatgtcggcttcgtggagcatccggcccggctcgtcctcgacccggcctcccaattgcagcaatggcgcccgagctatcgccgcgcgacccggatgcagggcggcttggcgctggccgccaccgccctcggcctgctcgcctgggcgcgtaccggcgatccgcgatgggggctcggggcggcgctcgcgctcgccaactggccctacactttgcttgcgatcatgccgaccaaccgcgccctgctcgccgcatcagcgaccgatccggtcgtggcgccgctgatgcagcgctggatccgcctgcacgcggtccgcagcgggctcggtctagcggcggtggcggccttcctctgggcgctgtggtga

SEQ ID NO: 7655 - DNA, 339 bp, Methylobacterium sp.
atgaccgagatggcccaaccatgcccggcgacgatcctcggcctgatcgagcgcgagaaggcgatcgagaacccgtcgcacgagagagcggccgtgaccccctgcttcgtcgccgtcaccctggccggcctgctcgcgagcgggaagccggccaaggacgctcgcgcctacctccacatcgggccgagtacgcgcatcagcccggtggtcacggcgccggctgatcgtcctcacgcgcgctcagagatcaccatcgggccgctgacgacgttcgcccgagagacgccagaggaggtggtgcgggcgccctgcgtggagcgaggaccgccgccgcagtga

SEQ ID NO: 7656 - DNA, 1017 bp, Methylobacterium sp.
ttggcgcacctcagggtcgctcaagcgatctacgccgtcctcgtcgaactcgaagcggatcccgacaccctcatgatcgaggcagggctcgatccgaggctcttcgagtgtcatggcaagctcgtcccgtacagctccctcggtcgcctgattgccatagcggttgagcgcacccgctgccctcatttggggctcctcatcgggcaaaggaccaccatcacctccctcgggcttctcggcctgctgttgggcaactcggataccatcggcgatgccttgcgggctctcgaagcgtatctgggtatgctgaatcggggtgcggtggtcggcctcggcatcgacaacgacgtggccgtcctcacctactgcccgtatgagccgggagccgagggtgctgtccaccattcggatcgggcgctggccacagcgacaaacatccttcgggccctgtgcgggtctgattgggccccattggaagtgttgctgccgcgttctgctccgagcagcacgacgccttatagccagttctttcgagcacccgtccggttcgatcaggaaacggccgccttggtcttcccggccagcctcctcaagcggcgcatcgccggagccgatccggtcctgcgccgcagagtggaggatcgtatccgccggcttgaatcggcacgaccctccacgctgaaggacgggcttcgtcagcacctgcgcgccgaggtgatccggaagcgttgcgacgtgatgaagacggcgcttcgcctgtcgctcggtcgccgcaccttgagccgccgcttgagagccgaagggacaagcttcaagcagcttgccaacgaggcgcaattccgggtggccaagcgcctcttggccgataccaaaatgagcatgacggagatctcggccgtcctggacttctcggagcccgccgccttcacgcacgccttccggcgctgggcaggcatgacgcccagctcatggaggcagggaaaccattccgagacgaagcgcgaggaacaccaataa

SEQ ID NO: 7657 - DNA, 240 bp, Methylobacterium sp.
ttgtacgaaggtgccccggccgccccatccccggcggtcgacgtcgaagcgagccgcggcttgccgacctacatcgtcggccaggatggtcagggccattgggtcgccctggaaagccaaggcctcggcggcggctatttccgcagccgcgaggcagcgttccagtacgcggtcggcgagaccggacgccgtgcgggcgcggtgcgcctcagcgccgagccgctgcgcatcgccctgtga

SEQ ID NO: 7658 - DNA, 1959 bp, Methylobacterium sp.
atgcgcaacggttgggttgtggtcggcgcacttggctgcgccctcggcgctgcgccggctcatgcgggcatcaccggcatcgagatcgccagcgtcgagccttttgccgatggcgcggagttcggatcagccggaagctacgagcgtgtcgtcggcacggcccgtggcgagttggacccggccgatcccgcaaatgccggcatcgtcgacatcgccctggcgccccgcaacgcccgcggcatggtcgagtacaagacagacctgttcatcctgcggcccaaggatccggcccgaggcagcggaacgctcctgttcgaggtgctgaaccggggccgcaagttcctcttcaactgggttctcgacgcaccggctcaggccgcgcaggcggtcaacgatcctaagaccgccaccgatgccgggaccgggctcgtgctacgccggggctacaccatcgtctggtcgggctgggaggcggacgcactgcgccagcagggcggtatggcgatcgacgtgccggtggccacgcgcagcggcaagccgatcgtcgaggtcgtgcgcgatgaactcgtcagcgcgacccgtggcccgccggaggcgccgttctacctttccttcaagacagccagcccggacaaggccgaggcgcgcctcaccgttcggcgccgggagtccgacccgccgcggccggtaccgcccgacgcctggcactacgcgacgccgcgtcagatcgagcttctgccgaagggcaccaagccgctgcccgggtcgctctacgaattcacgtaccaagccaccgagccgaaggtgcttgggatcggttttgccgccacgcgggacgtggtggcctatctccgcagcgagggcggcgcggccaatccggcgggtggcgcgatccggcacgccctcgcgctcggcatctcgcagagcgggcgctatctgcgcgacttcatccaacagggcttcaaccgggacgaaaccggcaagcgggtgttcgacggcgtcctgtctcacatcgcgggcgtgggcggggtgttcctcaacgcccgcttcggtcagccctcacgcaccaacacgcagcacgaagaccacctctacccggagaacaccttcccgttctcggccatcacccagcacgatcccgtcactggtcggacgggcaagctgctgcgggatgacggattcgaccctctgttgatcgaggccaataccggcaccgagtattggcagaagggtgcctctctcctcacgaccgatccggttggccgcaccgatgtgcccctgcccgacaccgcgcgcgcctacttggtctcgagcggcttccactatgggcgtgccggcctgggctcgaccaagggcccctgcacgaacccacgcagcagcctgaacccggccccggcggtcagggcgctgctggtcgcgcttgaggagtgggtgaaggacggtaaggcacccccggagagccgtgtgccgcgcctctccgatcaaaccctcgtcgaggcggctgacatcggcttcccgttcatggtcggtgttcccgttccgacagcaccgaatgcgatcgcgcgcttcagcacctacgtggatccgcacccggaaagcggcccgcaatatcgcccactggtcccgcgcgtcgatgccgacggcaacgaggtggccggcattcgcctgccggcggttgcggccccgcgtgccaccttcaccggttggaacctgtatgccgatccgttccccgccggcgcgctgtgcgatcgcgagggcagccagatcccgttcgcgcgcacccgtgccgaacgagacacggccggcgacccccgcttgtcccttgaggagcgatatcaggatgcgggtgcctacgttgcggccgtgacgaaatccgtcgatgcactcgtgtcggatcgcctgctgctgcaggaggacggcgatcgcatgatcgcggcggcgcgacaggaaacgccgtag

SEQ ID NO: 7659 - DNA, 1452 bp, Methylobacterium sp.
atggtggcggagggtcgcgacggaaaggtcgccgatatgtcatccgcaggaacgtttcgggtatgcgaggcgggcggtccgccgcttcaggaggcgctggccgaggcggtcgcgttgccgtccgtgctcgccacgatgcttcgcagcctgatcgaggcgtggccggacgaggtttacacgcgaccgctcgtgacaacgcgcttcctcggccagcggacgacgtatgtctgcgcgcccgggcacatccgcagcctgatcgtcgatcaggccggagctctggagcgcgagcctttcatgctgcgggcgctggcgccggccctcgggtccggcatcctgacggcggatggcccgcactggcgggggcagcgcagaacggcagccccgatgttccggccggaccgggtcaaggccttcatccccgccatggcggaggccgcccacgccacgcgcctgcactggctcagccagatgtccgctcacggatccgcggatgcgcgctttgacggcgagcgggacatcctgccggagatgatgcgcaccaccttcgacgtcatcgtcgcgacgatggtatcgggcgacagccagttgaaggtcgagccgttcggacgggcgatcgacgcctatctcggccagactccctggaagatcgcgctctcgatgctgggggcgccggcctggatgccgcatccgggggcgcgggcgggagcgagggcggtccgttacctcaggagtgaggtggcgcgaacggtcgaacggcgccgcgcgcgcggcgaacccggtgccgacctcctcggcctgttgttgcaggccaaagacccggagacaggggagcgcctgtccgacgagagcctgatcgacaacctgctgaccttcgtcgcggccggccacgagaccacggcgctcgccctaacatggaccttgcgggtgctggccgaccacccggcggtcgaggctcgcatcctcgatgagatcgcaggcctcggtgcggatccggcccccgaggcgctggaccggctcgccttcacccggcaggtcgtcctcgaagtgatgcgcctgtacccgccggcaccgctgatcgtccggcggacggcggaggaggtccgcctcggcgacacggtcatcccggccggggaatcggtgcatgtgcccgtctacgccctacaccggcaccaatcactgtgggaccagccggatgtcttcgatccggatcgcttcgcaccggagttgacggcctcgcgcgatcgctacgcctacctgccgttcggcgccgggccgcgcgtctgcatcggcatgggcctcgcgctgacggagtgtctcgtcatcctcgccacgcttctgccggccttccgcttcgtgcccgcgaaggccgagatgccggcgacgcagtttcgtgtgacgcttcggcccaagggcggcatgaagatgaaagttgtcccgcgtcatgcccactga

SEQ ID NO: 7660 - DNA, 204 bp, Methylobacterium sp.
atgccgcatttctcgaaggaggatctggaggcctcggcggagacgctggccaacctgcgggagatcctgcacgggcgccagcagggcgggcgcgacggccgacccgtcccgacgacgccgaccaaggaagggcgcttcggcacctccggcggccggggggccccggtgcgtaagcggcgccacacggccccggcaggcgcgtga

SEQ ID NO: 7661 - DNA, 108 bp, Methylobacterium sp.
atgagggatgcggtcaaggtagtcctgctcgacctgggcgtgccggacggtcagatacggaccgaggccttcggaacggaccggcgcgatccgaccagaaggacctga

SEQ ID NO: 7662 - DNA, 99 bp, Methylobacterium sp.
atgtcggtgcaggacgcgctgagcgacggtgaccgggaggacggctacatcctcgcttgccaagccgaacccgagggcgacgtggagctggaagcctag

SEQ ID NO: 7663 - DNA, 1308 bp, Methylobacterium sp.
gtgagcaacgagacgctgatcgcggccatcggcacggtgctgcgcgaggagatgcagcatccccatctcgatgggttcgggccggacgcacggctgaacgaggatctctacctcgattccgtccagttgcttcaactcatcttgtcactggaactgacgcatggggtgtcggtgccggaagaagcgatcaaccggcaggacgtctccaccgtcgccgacctcgcccggctcctggcgccgggcgcggagccggtcgcaccggtcgccgagtccgagacgccctccgagggcgtccacggcgcgatgccctacgacctgaagatccactgcttcgtcagttgcgtctgcgacgggctgaaggcgcggggcatcgactaccgcccgttttacgccctgatctgggacgccgagttcgccatcaccgacggctcgcggctcgcctaccactcggacgcgatggaccacgagtcgttccgctactggttcgagcggctctacagcgtgccgctcgtctcctggtacgaccactctcgctctaaggacgagaacgtcgccaccctgctcgacctcctggaccagcgggagccggacacgcgcatcatggtgatgctcgacatgttccacctccccgagcgcgagaacaagttcaaccagaaccccttcccgcactacctgctcgtttcgctcggcgacgatcccgacctctggcaggtgcgcgaccccgacttccgctgggagggcgtgatcgagcgcgagcggatgctgaacgccatccgccagccgagcgtcgccggcggctaccgcttcgatccctcgcgggcccatccgccggcggacacggatctcgcggccttcttcgacgcctgtttccggttcgacaccaacccgctgatcgatgccgcgcgcgccatcgtgctcgcccatgccgaggggcggggcgggctgaagctgacggatgtcggcgaggcgctgcgcgaactgccggtcatcaccatccgcaaatgggcctacgagcacggcttcgccttcttctggcgggccctgcgctggccggacccggagttccagcggatctgcgacgagatcgaggccctggtgaacggcctcaccgccctgcactacgccgtcctcaagctcgcccggaccggggaaacgggggaggtcgcctccgtcctcgcgcggctcgacgccctcgacgcacaggaattcgcgatcaagcggcagctcgcttcagcctacgcggcgtggcggcagacgagcccggatctcggacaggcgctcccgtcacgcgaaaggctctccgcatga

SEQ ID NO: 7664 - DNA, 303 bp, Methylobacterium sp.
gtgccggaacttcaggagaccgacatgaccgagagccgtgccgtcgtcggcaccccgcatgccagccgctacctccagcagctctgcaaacactgggcccaccggttcgagaccgagttcagcccgaccgatgcccggatcgccctgccgctcggtgagacgcgcctgagtgccagcgccgaaaccctgacgatcgacctgactgcacaggatgccgccagcctacccgatctgcgcgacgtggtcgtgcgccacatcgagcgcttcgccttccgcgagacgctgcgcttcgactggacgtga

SEQ ID NO: 7665 - DNA, 480 bp, Methylobacterium sp.
atgcgcgaggacgacgcgccggatctgttcgagatctacaaccagcccgccttccgtttcggaacgctggcgctcccctacgaatcattcgaggcggtgaagaaatgggccgagccccgctcgccgcgtgatctgcacctcgccgcgcagcagggcgagcgcgtcgtcggggcggcggccctgcgccccttctacgggcggcgggcgcatgcggcggaattctggatcgccgtgcacgaggatttcgccggacacggcatcggctcgcggcttctcgcggcggtgatcgatacggccgacaactggatcaatattttgcgcatcgagatgacggtcttcaccgacaacacccgcgccatcgccctctacgaaaagttcggcttcgccatcgaggggacgcacaaagccgcctcattccgcaacggcatcttcgccgacgtgcattgcatggcccgtttgcgtccctcgatcggcccctga

SEQ ID NO: 7666 - DNA, 153 bp, Methylobacterium sp.
atggcgcaggacggcgttccccgcctgcctgacgccgtggccgcctacgccgcgcaagacgtgatctacggtgccttcatcgctgcgagctgtcgggacagcggagatcccggatggcggtcctgggacccggcggagcgggcctggacctag

SEQ ID NO: 7667 - DNA, 201 bp, Methylobacterium sp.
atgttcctcagccacggcacacgggacgcaatgtggtcggtggcgatgactcagcggctcgaagctcgcttgctgcaagctgggcgcaccccggaagtgcatctgttggcgggccaggatcacagcccgcatggcgaggatgagaacgagcaccacctcaggctcatcacattcctgcggcggacgctggaggccgcttag

SEQ ID NO: 7668 - DNA, 8385 bp, Methylobacterium sp.
atggccacgagccttgccgccggtgacatcgccatcgtcgggtacgatgcggacaaccccgacgatttcgctttcgtcgtcctgcgggacatcgaggccggcacagccatcagcttcacggataacggctggagttcgagcggcaacgcacttcgcaccagcgagggcacctacacctacacggcgccgacggccgttgcggccggcaccgtgatccacccgacatccgacggcagcgcgggcggccccgacagccccgtctacacgtcggccctcgccccgaacttctcgttcagcaccgacggcgaccagatcctggcctatcagggctccgacgcgaccccgaccttcctgtacgcgatcaacttcgccgacggagcaaccggcttcgcggccaacggcacgaacgccaacacctcggcactgccgccgggcctcgtcctcgggcagaccgccgtcgcgctgggcgccgacaatggccgctacgccggcaccctctcgggcacccgcgacgggctcctgaccgcgatcggcgccgccggatcctggtcccagagcgacacggtccgcatcggcgcccccggctacagcgctttcacgatcaccgccgccccgaccatcccggccctgtcgatcgacgacgtccaggtggccgagggcgataccggcacccggcagctgaccttcacagtctccctgaatgcgccagccccctcgggcggcgtcagcttcgacatcgcgaccgccgacggcagcgccaccgccggcagcgactacgtcgcccgggcccttaccggccagtccatcgcggccggccagaccgccacgaccttcacggtggacatcctcggcgacacggtgatcgagccgaccgagaccttctcggtcacggtctcgaacgtccggggcgccacggtggccgacggccagggcaccggcaccatcatcaacgacgataccggcccgcgcatcggcggcaccgcgatcttcgaggcggccccctcgctccagggcgtctccggcgccacggccacggcgcccccggtgcccacgaacgcgcttcaactggtgcggctcggcgcctacgccgccaccaacgatccggcgacgtcgacagcccccaacgcggaggtggtggcctacgattccggcacgggccgcctctacattcagaacaccgccgagaaccgcatcgagatcgcctcgctcgacgccaccggcgccctgagcaaggccggcgagatcctactgtccggcctcgagcaatacggtgcggtgaactcggtcgcggtcttcaacggcctcgtggcggtcgcctacgccaacgcggctggcgacgcgccgggccgggtcgccctgttcgatgccgacgggacgctgctgcgctcgctgaccgtcggcgtcggcccggaccagatcgtgttcacacgcgacggcagccggatcctcgtcgccaacgagggcgagcaggcgagcgcgaccagcaacccggtcggcggcgtctcgatcatcgacgtctcgggcggtgcggccaacgccgccgtcacggcgaccgtcggcttcgaagggctcgacggcagcgaggccacccttcgcgcgcgcggcctcgccctcaagccgggcaccggcgcggcggccgacatcgagcccgaatacatcgcgatctcccccgacgaccgcttcgcctacgtcaccctgcaggaggtgaacggcgtcgcgatcatcgatctcaccaatcccggcacggctcccatcgcgatccagccgctcgggtcggtgaaccattcgctggccggaaacgagttcgacgcctccgaccgcgacgggcccgccaacccgcaaggcaccggcacgccctcgatccgcatcgcggcgacgcccgccaacgccccgatctacggcctgcttcagccggacgcggtggcgagcttctcgacgggcggcgcgacctacttcgtcacggccaacgagggcgaccagcgcgtcatcggcggcggcgacgacacgggcgatgtcgcccgcctcagcagcattgccaacagccgcctgaccccggagcttcaggcgctgaaggccgacccggcctatgcccgcctcaacgtcctgctgcgcacgggcgacaccgacggcgacggcgtgatcgaccagctccacacgctgggcgggcgcggcatctcgatcttccgccagaacctcgacggcacgatcaccaaggtgcgcgagaccggcggcgaattcgagaagatcttcgcgcagatcgcgccggagcggttcaacaacgatcaggtcaccggcaacacgccggacgaccgctcggacaacaagggccccgagcctgaaggcatcacgatcgggacggtcaacgggcggatctacgccttcgtcggcctggagcggcagagcggcgtcatcgtctacgacgtgaccgacccggccaacgcggcctacgtctcctacgtcccgccccagcccggcgcgaccaccgatctcggcccggaggtgctgaccttcatcgccgccgaccgcaacccgacgggcacgccccttctcgtcagcgccaacgaagtcgccaacggtggcgcggtcgtctacgcggccctgccccagggcttcacgcaggaggtcgctttttccgcgaactcgctcgccgtgagccgggcggagggcgacacgggcgagaccgtgttcaccttcacggtcgagcgcagcaacggcacgctgggcgccgtcaccttcaccgccgagatcaccggcagcggtgcgaacgcggccgacggaagcgacttcgccggtgccctgccgctgtcggtgacgggcacgatcgccgccggcgccgcgtctgcagaggtgagcgtccgcgtccaagcggatgccgtgccggaggcggacgagaccttcgccctgaccctgcgcagcgccagttcgaaccagcccggcatcgcggcggcggtgcgcccggcggcgggcaccgcgacgggcacgatcgtcaacgacgacacgagcctgatctcggcggtgcagggggccggcgcggcgagcccgctggtcggccggaccgtcacggtcgaggcgatcgtcgtcggcgacttccagaacggcgacgccgacgccaagcgcaacctcggcggcttctacctgcaggaagaggcggccgaccaggacggcaacccgctgacctcggagggcgtcttcgtcttcgagggcaccggcaaccgcctcgtcgatgtcaacgagggtgaccgggtgcgcgtcaccggcaccgtgaccgagttcaacggcgagacccagatcgcggtctcgaacgccgcggcgatccaggtggtccgcgccggtgcgctgacgccggccgaggtcaaagccgcggcggtcgccgtcgaactgccggcggcgggggtcatcggcaccggcaccaccgcgcagcccgatctggagcgctacgagggcatgctggtccgctttgcccagaccctctcgatcaccgagcagttcaacctcgaccgcttcaacgagatccgcctcgccgccggcggccggaccgagaccttcaccaacgcattcgagccgaacgcggcggcctacgccgcctatctcgcccagacggcggcgcgctcgatcacctacgacgacggcctcaacacccagaaccagccggtcgagaatctggacggcttcggcccggtctatgccaccgcgacggcgccgcgcatgggcgacaccgtgaccgggctcaccggcaccctcggcttcggcccggccggcgcctaccgcgtgcgggccatcgacgacggcgacaaccgcttcgtcacggccaacccgcgccccgccgagcccgacccggtcggcggcacgctcaaggtcggcagcctcaatgtcctcaactacttcaccaccctcgacaccggttcggccgcccgcacggcgatcggtctcgagccgcgcggcgcgaactcgccggaagaactcgcccggcagaccgagaagctcgtcacgacgctgatcggcaccggggcggacgtgctcggcctgaccgagatcgagaaccagttccgcccgggcgaccccggcaacgcgctggaatacctcgtcggccagctcaacctgcgcgcgggcgccggcacctacgcctccatcaatccgggcgcgcagctcgaccaaggccagttcctcggcggcgacgcgatcgcggtcggcttcatctacaagccgagcaaggtcagcgtggcgatgaacaccacgatcgagcggctcgacgacacggacgtggcggccttcaacccggccttgctgcagcagagcaccctcgggcacctcttcaacggcgcgaacaccagccgggccgcgctcgcggtcaccttcaacgagaccgccaccggcgaagacttcaccgcaatcatcaaccacttcaagtcgaagggcggcaccgggaccggcgcggatgccgaccagggcgacggccagggcgcctggcagcagcagcgcgaactcgcggccacggctttggcgcagtgggtctcgatgcggccgacgggcacccaggacagcgacacgctcctgctcggcgacttcaacgcctacctcaaggaggacgcgctcgacatcctcaaggcagctgggttcaccaacctcgccgaggaccgtctcgccaacccgtattcctacgtcttcgacggggcctacggcgccctggaccacgccctcgccagcgcgagcctgaaccagcaggtcagcggcgtcaccgagtggcacatcaacgccgacgaggcggacgcgatcgactacaacctcgatttcggccgctcgcccatctccttcgacggccgctcgcccgcgcgggaatccgaccacgatcccgtcctcgtcggcctgcgcctcgaccagaccgcgccggtcctcgtcgcctcgatgccggccgacgacgccgcgcgggtggcggtgaacgccgacatcgtcctgcgcttcagcgaggcggtccgggccggcaccggcagcatcaccctcaccgacggcgccggcgacctgcgcaccatcgcggtctcggacactgcgcaagtcacgatcgcgggtgacaccgtgacgatcaacccgagcgccgatctgcggcccgggaccgcctacgacgtgatcgtgccggccggcgccttcacggacgcggccggcaacgcctccgccgccatcccccagaaccgcctcgacttcaccactgagcaggccaaaccgatgacctacacgctccagatcctgcacgcctcggactgggagggcgggctgctcgcgacccagcgcgcggcgaacttcgcggccatcgtcgatcggctcgaggatacgacgccgaactcgatcacgctctcgaccggcgatgcctggatcccgagcccgttctacatcgcgggggccgacccgcagatggcggcgacctataacggcgtctacaaccagttctatgggctgtccggcgccggcgcctacggccggctcgcggcctcccccggccgggccgacatcaccatccagaacatcgtcggcgtccaggccgcggtgttcggcaatcacgagttcgatggcgggccgacggaggtcgccaacatcatcggcgccaatctcggcgccgcggcgggtgctgccgacgacacctggctcggcgcgctcttcccctacatgtcggtcaacctcaacttctcccgcgaggccgccctgtccggcctcgtgcaccgcgacggtgacggcgcgaccttcgcccagaccggcccgacctcgacccagaccggcaccggcgcggacaagatcgcccgctcgacgatcctcgtcgagaacggcgagcggatcgccgtcatcggcgcgacgacgcagatcaaccccctgatcagcacactcggcaacgtcacggtcgacgggttcaccggccgcgacgagatcgcgctgctggcgagccagatcaacgccgaggtcgaccgggtgctcgcggccaatcccggcctcaacaaggtgatcgtcggcacgcacctgcagcagctcgccaacgagcaggcgctggccccgctcctgcgcaacgtcgatgtgctgatcggcggcggctcccacaccctgctcgccgatgccgacgaccggctgctgtccggcgaccgggcgggcggcggctacccgcaattcttcaccaacgccagcggccagaccctagccctggtgaacaccgcctccgaatactcctatgtcggccgcctcaacgtcaccttcgacgaccagggccacgtcatccgcgactcgatcaactcggccacctccggcgccgtcgcggtggacgacaccacggtgacgcagctctacggctcgacctccgccgccttcacgcccggctccaagggcttcctcgtgcagcaggtgatcgagggcctcgacgtcaacaacgacggcatccaggagaccgcgggcatcgccgacatcatccgccagcaggacggcaacatcctcggccgctccagcgtgtacttggaaggccgccgcggcgaggtccgcacggaagagaccaacctcggcaacctcacggcggatgccaacctctggtacgccaagcagttcgacggggcggtcgcagtctcgatcaagaacggcggcggcatccgcgactcgatcggctcgttctcgacgaccggcggcagcacggcggagcttcccccggccgccaacccggcggcgggcaaggcggcgggcgacatctcgcagctcgacgtcaccaactcgctgcgcttcaacaacgcgctcgccatggtcacggtcaccgcctccgagctggagcgggtgcttgagcacgccgtctcctcggccgctccgggtgccacgcccggcgcgttcccccagatcggcgggatcagcttctcgttcgacgcgacccggcaggcccagaccgtggacgtcaacggcaccgtcacccgcgaggggcagcggatcatttcggcggcgatcgtcgacgccgacggctttctcatcgacaccctggtgcaggacggccagctcgtcggcgatgcgaaccggagcatccgcgcggtgaccctcgacttcctgaccaccggcacgagcacggccccggggctcggcggcgacaactaccccttcccggcctatggcgagaaccgggtggcgctgagcagcgccgcgccggcctcgctgcccaacgccgcgactttcgcggcccagggcagcgagcaggatgcgctcgccgagtacctcaaggcgttccacagcgtgacgcccttcgcgcaggctgacacggcgccggcggccgacgcgcggatccagaacctcgctgcccgctccgacagcgtgctcgcccgcggcgtcagccggacgggagccgacggcaacgacgtgctgcagggaacgcccttcgccgaccgcctcttcggcggcgcgggcgacgacatcatcgtcaacagcgcgggcgacgacgtcctgtcgggcgggcgcggcaacgacacgctggtgttcaacacgagcttcgcgtcggtcaccgtcacggaggccggcagcctcacggccaccagcggaccggatggccgcgacctcgtcagcggcttcgagcgctacctgttctccgacgccacgatcgtggtgaacgacggcaagccgctcgtggacgacctgttctacctgtcccgcaacaaggacgtgttccaggccggccaggacgccgacgcgcactacgcccaatacggtgcccgcgagggccgcgacccgaatgccttcttctcgaccaagggctatctggcggccaatcccgaggtgagagcctccggggcgaacccgctcgaccagtacgagcaggccggctggaaggaaggccgcgatccgggcgtgcgcttcgacaacgagttctatctcgcggccaatcccgacgtgaaggccgccggcctgaacccgctcgcgcactaccttgccaatggccaggccgagggccgcgcgatccacgacgccgtcggacgcagcggggacatccgcggcggcttcgacgcggaatactacctgctcgcccatgccgatgtcgcgcaggcggccgggaccacggacaccttcgccttcgctgcccgccacttcgagcagtacggctggaaggagggccgcaacccgaacgcggtgttcgacaccaagggctatctggccgcctacggcgacgtgaaggcggcgggcctcaacccgctcacccattacgaacagtacggctggaaggagggccgcgatccctccgcctccttcgactcctcgacctacctctcaacctataccgatgtcgcggcggccaagatcgacccgatgcagcacttcctgcaagacgggctctacgagggccgctcgaccttcgcggacggcactttcggcggaggcaccctcggctga

SEQ ID NO: 7669 - DNA, 249 bp, Methylobacterium sp.
atggaccgtttcgagaccgattgtgccgatcaggaccatgtcgtccgtccggactcgtcctcgcgcgccctcgttgccgatacgcccagcgacgccggtccccgcatccggggccgccgcccgatggcgggctttctgacccaactgatcgtcagcgccgatcccgccttgcgtcccgcacgcctcgaacgcacgaaggccgcaaccgcgctctacgcgcggaatgcggccttcgcaaaacgggcctga

SEQ ID NO: 7670 - DNA, 204 bp, Methylobacterium sp.
atggctgaccggaaccaccatccctattccatcgatgtgagaccctgctggcggcgcccgggccgcttcgtctgctccatcatcgagaagggggagccacggcgctacggcgcgcagagctacgcgaccttcgacgaggcccgccgcgccgcccagacgcggcttcgccaactcgtcttcgaatggcagctcgtcggctcctga

SEQ ID NO: 7671 - DNA, 1230 bp, Methylobacterium sp.
atggatgtggtcaccatgctggtcatgagccttgccgcggccgccgccgctgcgggcttcctggccgtcgagtggcggatcctgcgcaaccccgcgctgctgctgtggagcgcgggcttcgccacgatcgtcctcggctgctcgctctcgccggtccgcgccgcctccttccttgtcggggtctggttcgccaacggcctgctcgtcgtcgcccacctcctgttcctcttcggcacggcccgcttcaccgggcgccggatcgcaccgctctggtggggcctgctgctggcctgggccggcctcctgctcctgccggcggggatcgacccgaccccggccttcgcgatgaccaattccggcctcgtcgctcttgccgccctgcgggccgcccacctgctgctgtcgcgggccggcacgcccttcccggagcgcactgccgcctccgacgcgctcggcgccgtcttcctcgcccacggcaccttctacgccgccaaggcgctgctcgtgcccgtgcccggcgccttcgtcagcctcgtcggcttcaagggcgtgctgatccaggtctcgctgttcgagggcattctcgtcgagatgctgctcgcgctgctgatggccgccgcggtgcgccgccgccgggaggaggcgatgacggcgctcgccgagcgcgatcccctcaccggcgccttcaaccgccgcgccttcgagagccgcgccgcggaggcgttgcgggacatggccgccgggcgccagtccggcgccctgctgctgctcgacgtggaccggttcaagacggtcaacgacagcttcggccacgccgtcggcgaccgcatcctcgtggcgctcaccggcgtgctggaagcctgcctgccgcgccacgcgatcctggcacggctcggcggggacgagttcgtgatcctggtgcccggcctcgacgaggcggcggcatccgcgctcggcgcggcgatccgcgaccgcatggcccgcgagagcggccggggcctgcccaccggcgccacggtcagcctcggcgccgctctgttcagcggtggcccggccgggctcgacaccctgatggcgctcgccgacacggcgctctacgaggccaaggcccatggccgcgaccgcctccaggcccgccgtcttgagccgccggcggagcgagttccggatcgatccggaccgggggcggcgaaggcgaacatgtccacgcagggtggctgctgcgcctga

SEQ ID NO: 7672 - DNA, 279 bp, Methylobacterium sp.
atgttcgcaatcgccttcgatctggtcgtcgtcgagacgcaggcccatcatccgaagggcatcgcacaagcctacagtgacatccgcgcggtgctcgcccggcaaggattcaactgggttcaggggagcctttacgtcagccgcgacgaggatctggcgaagctgttcgcagccatcacggcactgaaagccttgccgtggttcccggcctcggtgcgcgacctgcgcgccttccgcgtcgaacaatggtccgacttcacggcgaccgtcaaaggctga

SEQ ID NO: 7673 - DNA, 1041 bp, Methylobacterium sp.
atgacctccgcccccgaaccggccgccgatgtgtacgagggccgggacggctggctgttcctgattcgcggcaacaaccgggtgctggaacaatatggccggccgggcgtctcgcggcggacgctgtggcgctggcggcggatcatcgagacccgcatgcggcgctgcgcccggctcggcgcgacctatttccatgccctcgccccggaaaagctcaccgtctatcccgagcgggccgaggggctggctttcgatccggcccgcgccccggcgctccgcctcgcccgctggctcaccggctcgccgggcgtccgcgcctgggtcgatctcaccggcgccttccgcgcggcgaaggacggcccgccgctctacctgcgcaccgatacccactggacgcatcaaggctgcgtgctggcctaccgcacgatcctggcgcggatgggcgtacccccgcgcgacgacatcgaggcccggcgcgagcgcatcgccctccccttcacgggtgatctcggcctcaagttcatgcctcaccgttcagagttggcggagggcagcgcgatcgcgagcgaggcccggcgcatccacgccaacggcctgctcttggaaatggaagcgctcgggcgcggcggcgacgcccatctcggcgcgcatgcggtgttccgcaacgacgatccgggggccgatccacgtcgcctcgtgatcttcggcgattcctacgcgcagcacaccccccacagcccggtcgcgacgctcaccgcgctcttcgccgacacctttcgcgaggtgcatttcctgtggtcgacggggatcgactggcactatctcgacgccgtccgccccgatttcgtcctcggcgagatggccgagcgcttcgtgatcgacctgccgccgcacggcatccggatcgagcggctcgcggaactggcccgcgagcgcaagctgatgggcgagatcacggcagcggattcgcgctcacccgcaccgcttccgcctgacgcgcccgcatccgtgcctgaagccgctgacgccgcgccgcgatga

SEQ ID NO: 7674 - DNA, 1326 bp, Methylobacterium sp.
atggcaaaccgcctctcgagcttaggcgccagcctgagatggttgaggggccagcgccccggacgccgttccgacccgctcccgtcccatttcgactccgagcgctatctcgacctcaatgccgatgtggcgatggcggtcgaagccggtctcgttgcctcggcggaagagcattaccgcgtcttcggtcgccacgaggggcgcccgatccaggtcccgtcggcgacggccgagctcggcggcggaatcgccggacagtggacctaccgatatccctaccgcgcctggcccgaactgccggccatcgccttcgccgcgccccgacccggccctgaggatgacgccatcgcgcgacgcctcatcgccgcctggcaatccggtgccggacgcgcaccggtccaggccgacagcgagggcatgtgggcggcccggagccagggctttcccgatttccaccgtgccctgcaaggcggggatgccggcgcgctcgccggcctgctgaacaacctgttccagtcgcatctcgcgcacggcatcgccatggggcgcacgatggcgacgctggcccgccacgcgcccacgccgttcgctgcaagctggtgcgaccggctgctgcggctctcggaggcggtcggcctcgccccgatccgctcacccgagcagggcgattacgcggccgcgctccccggcccccttgcccaccatgtcgcgcctgcgcatctcgaggccgagctcggcttccccctggctttccccgaggtcggcgccccgttcggtgtgcgttacggcgccggcatcctgcccgagcacgccttgacccacgcctacgccgcttggcgggtcggacaactcggccgcttcgaccgggtggtcgagatcggcggcggtttcggcgggctggcttggttcctgcgccaccccgaccggcgctacacgatcctcgatctgcccttcaccaacgtgctccagggctggttcctgctgaaagcgggcctcgacgtgtccctggcgggcgagcaggacaccgcgatccgggtccgtccgtggtgggagatcgagcggaacgaacactacgatctggcgatcaaccaggactcgctgccggaaatgccgccggagacggccgccatgtacatcgcgcggatccgcgccatcgccccattgttctactcgatcaaccaagaggcggcggcaccgaacaccgacgcattccggcaggccgtcgtcgccgatctggttgcgcgggacggtggctaccgcaggctgggccggcatctgttctggatgcgtgacggctacgtcgaagaaatctacgctcgacgctga

SEQ ID NO: 7675 - DNA, 294 bp, Methylobacterium sp.
atggacgagagccgcaagcacgattccctgcgcgacttcaacgcgaatgccgaccgtaacgggcaggatttcgggcaggacagtcccctcgacgtcgcccggcccgccgatctccagcgcgccctccaggaagatccgggcggggaggcgcaggtagcgcgcacggcctccgacttcgatcggcgtgattcggtcgcgggcggcagcatcgagtcggtcgaggccaccgaggcggagacgccgccggagaacctgcgccgcatcagcgacccgagctacacgcccaagcgctga

SEQ ID NO: 7676 - DNA, 450 bp, Methylobacterium sp.
atgaccgagacacccaacctcaagattcctcacgggggatacgtcgtcgtcggcgacggtcgccgggccctggtgctgcgcaacgagggccacgcgctgcacctcgcccttcgcgtgcagcacgtcttcgaggcgcccccaaacccgccgacgcgcgagcagggcacggaccggccgccgcgcgtccggcagggggagcaccgcagcgccatcgaacagacggattggcacacgatcgccgaggagcgcttcgcggacgaggtcgcggcggcgctggaccgcatcgccgacgcgatccccgccctgatcgtcgtcgccccgccgcgcacgctcgcatcgttgcggcaggcgctgtccgagcgcctcaagcgcgtcgtcatcgccgagatcgacaaggatctgaccaagctctcgatcgaggagatcggacgccgcctcaccgatgggtga

SEQ ID NO: 7677 - DNA, 663 bp, Methylobacterium sp.
gtgacggcacaggttcgatcgcttcggcccgaggctgagaagcacttcatcgacgctttgcgccggcgctacgaggagcagggtttcgctttcacgtcggagcccgatccgaaacagcttcccggatttttcggttcctatgttccggatgcgcttgctcagaagtcgggacgcaacatcgtcatcgaactgaaggagcaggcgacgtcatcgacacagcgtgctttgtccgagatcaggcgcctcttcgaagaccatgccgattggcagttccgcgtgttttataccggaaccgatccgcaacaggccgagacggttgcgcccgcctccccggatctcattcgggaatcggctgacgaggtgaaggcactcgctgcacagggcaatctgcgggcggccttcatcgtgggctgggccctgttggaggcggccttgcgagcccgtcgcgatggattggagagtctgtcacgcaaacccggcacggtcgtccagacgctggcaatggaaggcttcattgagccgccagcagagcgccgattgcgcgaactgatcccactgagaaaccgcatcgttcacggcgatctgacggtcgagccgacgacggcggagatcgagttcgtcctcgcgaccatcgaaaacgttttggacgccgacttgtcttaa

SEQ ID NO: 7678 - DNA, 225 bp, Methylobacterium sp.
atggaaggcgacatcgacaatatcgtgaaaccgattatggatgctttgatccacgtcgcctgtatgacggacaacgatgtcgaacgtatcgtcgtccaaaagttcgaacccgaagtggggtgtgcgttcaccgatccaagtgcgcagttggtggccgctctggatgttccgccccccgctgtctacgtcaggatcgacgacgacttgagttggaggttcctgtga

SEQ ID NO: 7679 - DNA, 747 bp, Methylobacterium sp.
atgccgcccaaccgtgatgctgtgccccggatgctgagcgcggtgatctttgacgtcgatggcgtgctggtggattcgccccacgagcaggcgtggcgcgaggccctggcgggattcgccgacccggccggcttcaccacagcgttctatcaagcccatgtcgcggggaagccgcgcctggagggcgcgcgggccacgctggagcgtctcggcgacgccgaggcggccgcccatgccgctgcgtttgctgagaggaagcaggccgtgatcgaacgcctgatcgccgaggaccgctttgtggccttcccggacgcgattcgcctcgcgttcgcgctgcgggatgccgggttgcgcatcgtgctcgcctcgtcctcgaagaacgccgacgcgacgctggcccgcgtgaccctgcccgacgggcgcacgctgcggtcgctgttcgatgcggatgtcagcgggcgcgacgtgccgcgcggcaagcccgacccggccctgtttcagctcgccgctaaagccgtgaacgtgccgccagccgaatgcctcgtcgtggaggacgcgccagcgggcatccgggcggcgcaggccggcgggatggccagcctcggtatcgcccgcctcggcgacgaggccctgctgcgggcggccggcgccgacctcgtcgtgacttccctcgaccagctcgatgtcgccgccttgggcagcgggagccttcggacccgatccgtcgaagcggcgaacgacccataa

SEQ ID NO: 7680 - DNA, 465 bp, Methylobacterium sp.
gtgggcttggcgggcacagccgcctcggccgccgggctggattgcggcccaccgtcggcgccgcacccggaggccgacgctgtcctcacccaagcgatcgtctcgccgcaacccgagacgaatgcgggcacggcgctggcatccgccatacagcgtctcagggcccagggcgtgccgcgcacggtcatcgtcgatcgcgcggtcgccgcgtactgcccgctcgtcgcccgggacgagagcctgacgctcgaccgccagcgtgaggcggtccggcgctttgcctcggcgctgacgagcctcgtctacgatccccccggcccgaacgagggcgagaccgcgttcatcctgagcctgccggtcaagccggctttgtcgctgcagatcgatgccgccgccgccaaggcgggcaagacccgcgaggcctggatcctggaggcgatccaggcccggttggcgggcgactga

SEQ ID NO: 7681 - DNA, 606 bp, Methylobacterium sp.
atgcagcccgcggcgcagtcggtcgaacggggaggggaggggacgatgatcccggtctcgcgtcgcctcgggcgtgccatcctgtccgccgcggcggggttgctgctgatcgtgccggcagcggcgcgggcaccagatttcgacttcccggccgaagtcgcgggcttcagtcgcggcccccgcacggattacgaggcccgggcaccgggactcggctactccgtcgtctacacgaacgggcgctggaaggcggacatctacgtctacgatgccggtgtggcgaacatccccgacggagcgtcgtcacctgtcgtcaccggacagctcgcgcaggcggccggcgacgtcaggacggcggtggcgcagggcatctaccgcggcagcgaggatcgcggcgcggagcgcctgccgggggaggcgggcgcccggctcacctgccgcgccttcaccatcgatcacccggccctcggcgccaccgagagcctgctctgcctcaccggtctgcgcggccaattcgtgaagttccgcctgtccggcccggccgcgaagcagcctccgaaggcggaggccgagcggttcatgaccggctggctcgaccggcaatag

SEQ ID NO: 7682 - DNA, 192 bp, Methylobacterium sp.
atgaggaagccggagaagccgggtgcggatgccggcaagacgcacaaaggcggtgcgctcgggaacatcgacgagcagacggggcatcccggtaaaggcacgcccggcgcgacgctcaagcccgaggacaaccccgatccctcaaaggacttcaagccggagacgccggaggaccgcaagccgaaaggttaa

SEQ ID NO: 7683 - DNA, 1959 bp, Methylobacterium sp.
atgacttcgctggtgggccccctcgccggctccgccctgttccccttcaccctggccgcggtggtgatggccggcctcgtcgcggtggaggccctgtccctcctcctcgggcagtccctctcagggctggtggacggtgctctcggtcacgaggcggggagcggcggcgacctgacgagcgcggcggatgcagacgccgccttctcgcccgccgcagtgatgtcgtgggtcaatctcggccgggtgcccttcctgatccttctgatcctggcactcgccgtcttcgccctggcgggcttcgtggtgcagggcctcgccgcagccgtcatcgcgcccctgcccgccctcctggcggttccggccgccggggcggcgacgctgccggccctgcgcgtctcgaccaaggccatcgcccggctgatcccgcgggacgagagctacgtcgtgagcgccgacgacctgatcggcgcgacggcggaggtcaccctcgggccgctcgaccaaggccttccgggccaagtccgggcggtggaccgccacggcaacacccacttcctgcgcacccgcgccgcgcccggagccccggccatggaagccggcgcccgcgtcctgatcgtggaccgggccaacgccgtctacgtcgcggtgatcgaggcgaagttcgtcgatgccctgcgctcggtcgccgccggcatgaccctgcccgaccttcaggagaagcgcgccgccttcgtgaagggcgtgcaggaggcggtctcgggcgacctgcgccacaacggcctcgaactcgaatccgcctcgctgacccgcctcgaccagacctcgatcgagcatttcaacccggacaactcgttcgacgcggaaggcctcgcgcggctgaaggagatcactgagcagcgccgcaaggagcgcaacgccaccgagcgcgacgccgaggtcgcggtggccgagaaggaccgcgagaccgcgctgaagcagctcgagatcaagcgcaccacccgcgaggcggaactcgcccaggagcgcgacatcgccaacaagaccgccgagactcgggccgagaccgcccaggccgagcaacgcgctcagcagagcgaggagaccgcgcggatcgagcgcgagcaggtggtccgtctgcgcgaggccgaggcgcgcaagaactcggagggcgcgcggatcgaggcggatctggccatcgcccagcgcaacgcggaggctgagcgcgagcgtcagctcatccttcaggacaacgccatcaagatcgccgagcgctccgagaaggagtcgcaggcccgtgccgccgctaaggcggcggaggcgctcgccgtggccgcggaggagcgggtcgccacggccaaagccaaggagatcgccgagcgtgagcgcgaggtcaccgtcatcgccgccaagcaggaggccgagcgggaggcgaccggcgtcaccgtgacggcggaggccgagcggcgcgccgccgaggaccgggccaacgccatcatcaccctggccgaggccgaggcgaccgccgccgcctcgcgggcggaggccatcgccaagctcggacaggccgaggccgagcgcgagcgggtgatgaacgaggcccgcaacgcgctgtcggccgaggcccgcgctttcgagacgaacctcaagcgcctcggcatcatcccggatgccctgcgcgaaagtatgcgggcggtggagaagatcgactcgatccgcatcttcgatgcgggcgggatgatgggcagcggcaacggcgccggcggcgtctcggccaatttcggcgacagcctctcgggccacctgctgcgctaccagtacaacagcccgatcctcggcgcgattttgaacgaggcgggcttcgccgagggcaagggcagcctcgataccttggtcggcgggctgcggaacggcacggccgtcgagccggccgccaaagggcacgccgccgcggccgagtga

SEQ ID NO: 7684 - DNA, 1062 bp, Methylobacterium sp.
ttgaacccgaccgcgcaaggcccgctcgcggacgaggacgcccgaaccgaggacgcgaagctcgcgcgggaggtggcccgacactgcgccgcgttccgcgaaccgataccccggatggcctttcggcaggtggccgatacgctgctgccctacctgatcctctgcgcggcgatgctcgtcgcggcggcgaacggctacgcgcttctcgccctgccgctggcggtgcccgcgggcggcctcctggtgaggctcttcatcatccagcacgattgcgggcacggctcgttcctgccttcacgccggggcaatgattggctcggccgcgccctcagcctgctgacggtgacgccctacgatagctggaagcgcgcgcatgcgctgcatcacgctacgaccggcgatctcagccgccgcggcacgggcgacgtccacaccttgaccgtgcgcgaatacctcgcgctgccgcgctggggccggctgcgctaccggctctaccgcaatccgctcatcctgatcgtgctcggctcgccgatcaacttcctcatcctgcagcgcctgcccaccggcgtcgggctgccgtggcggacggcatggcgcgatgtgctggcgctcgacgccgtgctccttgcggcctttgccgtactggcgctcgcggcgggcggcatcgggccggtgctctgggtgttcctgccggtgatcgccgtcgccgcctgggtcggcggctggctgttctatgtccagcaccagtacgaggagaccgtgtgggaggaggctgacgcctgggatttccaccgcgtggcgctcggcggcagttcctactacgcgctgccgcgggttcttcagtggtttaccggcaatgtcggcctgcaccacgtccaccacctcaacagccgcatcccgaattaccggctgcaggaatgcctcgacggccacgaggttctcggtcgggtgggccgtctgaccctgcgcgacagcctgcgctgcctgaagctggcgctctgggacgaagaggcacgcaagatggtcggcttcgcccgagtgcgcgggcttcaggccgcctga

SEQ ID NO: 7685 - DNA, 249 bp, Methylobacterium sp.
atgcctgcccatatctcttccgcgccggctgccgccgtcacggatggaaccagctcgcaggcctcgcgccgaagccggtcccgtgccgccgccggccgcctggaggcggcgcgccacggcttcgaacgctccctgatcacgctgcgccgggccgccctcgacgccatcgacagcggcgatctggcgagcctgaccctgcgggtgtgcggtgaccgccgccggcatgccggcggagagggggcggcgtga

SEQ ID NO: 7686 - DNA, 1416 bp, Methylobacterium sp.
atgcacaagttgctgattcagctcggccttcgcttcgacgatccccacgaggagcagtcgttcgtgaggagcttcacgctcgacgatctcggccgcacgcaggccgcgatggtgctgggcgctttcgtcttctgctcgttctcggccatggactggattctcagtcccgatgcctgggccatggccaccgcgctgcggcttgccgtcgccgtcctggtcctggtgccggcgaccctcctgctcagccggccggacgcccggcctttcgcggaatggatctacctcgtctactgcgtcgtgccgggctgcatgctcagcctgatctacgtcttcctgcggccgagcttcgatcacggcgcagcggggctgatcgtggtgatcctgttcgtctcgacgctgctgccgctgcgcgtctcctcgttcggggtgttcgccgccctgacctggacctgctttgccctgttcgagaccatcgcgacacacgacaatcccggcttagccctcgtgaacaatgccgagatcggcgcggcctacgcgctctcgctctacggggtcggggcacgggagtttcgcgcgcggcgccagttccggaccacgggggagctgcaggtcgagaaggagcgctcggaggcgaccctggccgaactgcgcgccgcccaggcgcagttggttcaggccgagaagctcgccgcactcggccagctcgtggcgggcgtggcgcacgagatcaacacgcccatcggcctcgcgctgacgacctcgaccgcattcgaccacgacctcgccgaactgcgtcggaccgtcgcctcggggcagatccgccggtccgacctgacgcggagcgtcgatcggctgagcgagggcgcgggtctggtcttcgccaacctgacgcgggccgccgatctggttcagaacttcaagcaggtcgcggtcgatcaggcgacggaggaccggcgccgcttcgagatgcgcccctggctcaccgagttgatgagcacgctcgatccgatcctgcggcgcaagggccacgaggttcggctcacctgtcccgacggcatcctcctcgattcctatccgggcgcgctggcgcaggtcgtcagcaacctcgcgctgaacgccgtgatccacgcctttcccgaaggccgcaccggcacgcttctcgtcgacgtgagccggctcggcgacacgcagatccggatgacggtgcgggacgacggacgcggcatcccgccggagaatcggcagcggatcttcgacccgttcttcaccaccggacgcgacaagggcagcaccggactcggcctgcacatcgtctacaatctcgtcgtctcgaccctgcgcggacagatcgccatcgacagcgaggagggggtcgggacaggggtgacgatcgaccttccggtgacggtgccgtga

SEQ ID NO: 7687 - DNA, 957 bp, Methylobacterium sp.
atgaaccaactcgccaccttggctaggttccccgcccctgccttggtggcggcagcgggcgatcgcgccgcctaccgcttcctcgaattcttcacggcgcagatccgcaaccccaacacccgccgcgcctacgtcaaggcggtgggcgagttctgcacttggctggaacggcacggcctgccctcgatcgccgccgtcagttcgatccacatcgccgcctacgttgaggaactggggcgcagccgtagcgcctccacggtcaagcagcgcctggccgcgatccggatgatgttcgactggctggcgaccggcggcgtgctgccgttcaacccggccagcgccgtgcgagggccgaagcatgtggtgaagcggggcaagacccccgtgctcgcgccggacgaagcccgcgcgatcctcgacgccatcgacgtaagcacgcctatcggcctgcgcgaccgggcgctgatcgggctgatggtttacaccttcgcccggattggcgccgccaccgccatgcgggtcgaggacgtgtacgtgcagaaccgccgcttatgggtgcggctacacgagaagggtggcaaggcggtggacctgccctgccaccacaacctcgaaacctacctgcacgcctatctggacgggaccggcatcgccggagacagcgacgggccgctgtttcggacgatccggcgcggtacagccgaactgacccggaccgccctccccgccgccaacgcctacgcgatggtgcagcggcgggcgaaggcggccgacattgccactcggatcggcaaccacacgttccgggcgaccggcatcaccgcctatctcaagaacggtggcactttggaacgcgccgccgccatcgccaaccacgcctcgacccggactacacagctctatgaccgacgctcggacgaggtgaacctggatgagattgaacggattttgatttga

SEQ ID NO: 7688 - DNA, 255 bp, Methylobacterium sp.
atgctgcgcaaaccgaccctgaccctactttccgtgctggcgtttgccggcggcatcctcggcaccacctcggccgccatggccgatccgccctgggcgcgcggcggaggacgcggcttccatcacggtggtccgccgccctgggcgcccgcccatggatggcggcgcaagcacgatttcggcggctatggaggccggtcgtatcgcagctcccggtacaatgacgggcggcgatacgaccggtacggttactga

SEQ ID NO: 7689 - DNA, 777 bp, Methylobacterium sp.
atggctctggggcgccggatgatcggttggctccgccgcctgctcggccaggaccgtccgcccccgcaccccgtgccggcctgggaaccggaaccaccgccgcccgtgcccgcctgggagccggaaccgcagccgccgcaacggcgcagcgaggcggagatcgacgttgtcgaggcggccctgaacggcttgatcgcggccggcctccggcttggaccccattacgaagggatggaccggcgcgccgtcgcgcgagcgatggcggaacatctcgaattcgctgtcggcgacggcaacgagaccctgccgctgaccgagcacagctcggacgcgctgtcgatcgacatcctgtggagctatcgcgccctcgccgacgcgatcgaggacgaattcgccaacgcggcgatcttcgaagatcactgctacgacggcgccgacgaggagacctatcgcgcgctgttcgcccggctgatcgaactcgccggggcctggaccggccgcggcgtcaccgtctcccgtgtgccgggactggggccctacgggcacggcttccgcatcgcgttcgagacgcagccgccgatcccgcccctcaccttcccggccgacaagaacttcgactggagcctgctcgaacggctcgatgcgtgccggccggcgggcgagacgcgccggttccggatcgccgccgatggcggagcggggctggtgctgttcctcgacgacaccgaggccagagcgatcgccgcgcgcctgggctgggggccggacgatctctga

SEQ ID NO: 7690 - DNA, 222 bp, Methylobacterium sp.
atgccggttcggatgacccaggaaacgcaggacgtgatcgacggccggcggcaggtggtggtgcgggttctgttcggccggccggacgcgggacgcgacatcgtcgaggtctcggcgacggtccgggtgcccgccatcgaatccgaaacgcagacggaggccgccgcgcggcagatggcacggcgcgcgctcgaacaggcgctgtcggccttcccgctctga

SEQ ID NO: 7691 - DNA, 168 bp, Methylobacterium sp.
atgacgggcctgtcgttggtgatctgtggagcgatcggcgtcggacttctcgcaatgctgttccttctgcatgagctcaagaacgctccctacgacgacggcctcgaacccgagcaggtggtgcccgaactcgaaaagcagaggttgcgctaccggtcgttcgattag

SEQ ID NO: 7692 - DNA, 1104 bp, Methylobacterium sp.
atgtcgaggcttggcctgtacgccgcccttctcgggatcgccctgatggcgaacgatcctgtcgcggcagccccagacaccgcaccggtcgaggccgcccccgcaacggaagctgccctcggcgagcgcatgaacgccaacaccgtcacggtggtgaccggcacgcccggcggaacctacttccgcgtcggcgccgagctcgccttcgtgctggatgacggcgataagctgcggatcttgccgatgctcggcaagggagcgggcgaaaacgcctatgacatccggttcctgaagggtgttgatctgggtttcgttcgcaccgatacgctggaccagctgcggcaagacaagcgcctgagtaacattgagcggcaaatccaatacattgccaagctcttcgacgacgagctgcatatcatcgcaccgaattcggtccggaccgttagcgatctcgccggcaagcgggtcagcttcgacgtcaagggcagcggcaccgactacagcggccgggccatgtttcgcgaacttggcgtcactgtggaggggatcaacgtcgatcagcccaccgccctcgagatgctacgcaacggcgagattcaggctgtcgtgtcggtggcggctaagccggtggctttcattgcgggcttcgagccgggtgagcgcttccacttcgtaacggcgccctacccggacacgatgaacgaagcctatgtccccgcgaccctgacgcggactgattatccgaagtttgtcggcgaacaggcggtggagaccgtcgcggtcggcacggtcctcggggtctacaacagcccgaagggatcagcgcgctatgagaagctcgtccgcttcgtcgacgccttcttcggccagttcgacaagtttctggctccgcagcggcatccgaaatggcgggaggtcaacttcgcggcctcggtgaagggctggaggcgcttccggccggcgcaggagtggctcgaccgccacaaggagcaggaggccgctacccagccggatctggaccggttcttccagtcacagcccgagcgaccggccggaaaggaggagatctaccaagcctatctgaagtggcgccaagcgcggtga

SEQ ID NO: 7693 - DNA, 132 bp, Methylobacterium sp.
atgacccgtgccggcgggaccgtccgcctcccgcgccgctcgctgttccgcagcggagtcggcccacgtctcgcggccgccctcatcctgtcgagcctgctctgggccgtgatcctgtgggccaaatcgtga

SEQ ID NO: 7694 - DNA, 837 bp, Methylobacterium sp.
atgagaatcgcgctctgcaccatcagctttcgccaccatctcgtgtcgatcggcgagctcgcccgcttcgcccgcggccacggcttcgacgggatcgaattgtggggcgtgcacgcccgcaatctcggccccggcgaccacgccgaatggctcgccgcctacggcctgcgggtgccgatgctgagcgactacctgccgctcgacgcgccgctggagaccctgaccgagcggacggccgaactcgcccggctcgccgggagctggggggcgccgcggctgcgcaccttcgccggcaccaagggcagtgcggccgcctcggcggacgagcgcgcccatgtcgcccagcgcctgcggatggcggcgggccagctcgccgaccagggcctgcggctcgtggtggagacgcatcccggcacgctcgccgacaccaccgcctcgctcctcgacctgctggacgcggtcgatcacccgaacctccgggtcaatttcgacacgctccacgtctgggaaggcggcgacgacccgctcgcggcccacgcccggctctccccgcatatcgactactatcacctcaagaacgtgcgcagccgcgccgacctgtcggtgttcgagccggccaacgtctatgccgcggccggacggcgcgagggcatgaccggcctgttcgagggcgcgctggattacgctgccttcctgaagacgctgccgccgcaggcggaaggctcgctcgaatggttcggcgaggccagcttctcggtcctgcccaccgaccttttccgcctgcgcagcgccactgccggccgccgcggggcgggagccctccacgccgcgcgctga

SEQ ID NO: 7695 - DNA, 318 bp, Methylobacterium sp.
atgcacaacccgatgcttcgccctctcttccttcgccaagcgatcctcgcggccgccgccgccctggcgctgacgctcctcccggcgagccttgcccaggcccagagcatgcccggtgcgacggtcggactgcccatgggctcgcccgatccgttcggcctctccacggtgaaccggccgtccggatattccgcggagccctacgccgagcccggcatggacccggccgagcgccgtatccgcccgcgcccgcaacggaggctcaagagccatcgcacttccgcaccgaagcggcgggcaccgatggctcggcgctga

SEQ ID NO: 7696 - DNA, 1059 bp, Methylobacterium sp.
atgcagggacagatgcagcaggcggatccggacctcgaccgcgctctggctcccgcgcaccgcgcctgggaggcgctgcggcagtatgcgctgccgccctccccgcggaactacgaattgctgcacaccttcttcgccggcgccaatccgccgctgagcgaacgcctcgcggcctgtctggcacccggtggaacgctgaccgaggagcaggcgagcgcgctctacgacgcttgtatcgccgggaccgggacggaggcctccgtgctcgatggggcgggccggctggcggaggcggccggtaccctggcggagcgcgtcgcgggcagccggagggcgctcgccggctatggtgacgccctgacccattggtccggccgcctgaatgcacgtccgaccgccgatgagctgatgacggcgctcgtcgccctgatcggcgagaccgagcaggcgcagacccgcaaccacttgctggaggagcagctctcggcctccgccgcccacatcgccaagctgcacaaggatctcgtcgagacgcagcgcgcggcggcgaccgatgccctgacggggcttgccaaccgcaagaccttcgacggcttcctgcgcgactcgatcgcccggacccggagcgattccggcagcaccttctcgctgctcatgctcgacatcgaccacttcaagggcctcaacgaccggcacggccaccgcttcggcgatcaggtgctgcgcctcgtcggacggctgctcagcgcgaagacgacggatcgcgacctcgccgcgcgctacggcggcgaggaattcgcgatcgtgctcggcgaggccggcatcggtgccggcgtcgcgctcgcccaggagatctgcggccggctgcggggtcagcggctggtcaagcgcggcaccggcgatgtcgtggcacaggtcacgatctcggccggcgtcgcacagtaccgaccgggtgaagccgcccgcgacgtgatcgagcgggccgaccgcgcgctctacgaggccaagcggaccggccgcgaccgcgtctgcccgacgccgcgggccgcggtcgcgtga

SEQ ID NO: 7697 - DNA, 1140 bp, Methylobacterium sp.
gtgacccgttcaggaaccctcccctctcgcctcacctaccggctccttcccgagccggccgatctcgctgaggtgttcgccctgctcgcggcctatcggcggatgctcgttctgctcgaggaaatccgccgcgagcatggcctgcgcgccaacgtcgtcgccctgatcgagcacggctaccagcgggtgcgcgacgagaccggactgcccgcccggctcgtgacgctcggcatccgcgacttcgcccagcgcgccgccgggttcgaccccgagacggtcacgtcgatgccgctcgacgacaagctgttcagcgtgaagggcgcctcggagatcgcgctgaccacgatgaacggccggcgcacgatgccctaccgcgtcgagggctacgacggcccctggcgcgaactctccagcgcccgcctcaccatcgcgggcgacgcgctcaccatccaggtgggcgtctccgtcaccgcaccgcaggaggagacccgcatgactgaaaacatcctgacccgtgtcggccggatcatcggcggcctctccaacgccgccctcgaagcggtggaggatcgcaacggcctcgcggtggccgagcaggcgctgcgcgagatcgacgccgtcatccaagaggcccggctcgacctcggcaagatcaaggccgaggaacaccggctctccgcccggcgcggccagctcgacggcgagttgcgggcgctgcccgagaagctatcgctggcgctctcgaacgggcgcgaggacttggcgcgggccggcatcgcgcggcagctcgacctagagagccagatcgaggcgatcgattcgagccttgccgacgttgccgagcggcacggggcggcgacaaaagcgatgcaggcggccaccgccgcccggcgcgacgccgagcaccgcatcgcgctcctgcgcaagcccccggccaaggcggccgacctgctcgacggctacggcagcgaggaggcgacgcgcacccgccagctcgaacaatcgctgcaggcgatcgaccgggtcaccggaactgcctcggcggtcgccgacccctcggtcgaggaactggatcgtctccaccgcgacgacaccatcgagcgccggctcgcggcgctcaagcagggccggccctcatga

SEQ ID NO: 7698 - DNA, 222 bp, Methylobacterium sp.
gtggcgatcgtgctgagcgtcgtgatgatcacgatgtatttcgggttcatgacgatgttcgccttcgccaagactgcgatgggtacgatcctgatgcccggtttgtcgctctgcatcctgctcggtgcgggggtaatcgtcggatcgtttgtcctttgtctggtctacgtcgtctgggcgaaccggttctacgacccggccgtgcgccgcatcatgagctga

SEQ ID NO: 7699 - DNA, 1569 bp, Methylobacterium sp.
atgcaggccgccaacaaccccctcgccgtcacgttcttcttcatcttcatggcgctgacgctcggcatcacctactgggccgcccggcgcacgcgcaccacggagcagttcttcgccgccggagggcagatcacggcctggcagaacggctgggcgctcgcgggcgacttcctcagcgcggccgcgctgctaggcattgccggcatcatcacgtcgcatggcttcgacggcttgatctactccatcggcttcctggtcggctggccgatcatctcgttcctgatcgtcgagccgctgcgcaacctgggcaagttcaccttcgccgacgtcgtcgcctaccgcttgcggcagcgcccggtgcggatggccgccgccatcggcaccttgaccgtgatcctgctctacctgatcgcccagatggtcgcgacgggctcgctgatcaaactcctcttcggcctgccctacaccgcctcggtcatcgtggtcggcaccgccatgctcatttacgtgatcttcggcggcatgctggcgaccacctgggttcaggtgatcaaggcggtgctcctttcgctcggcggactcgttctggcgctcctcgtgctcgcccatttcgagatgaacccgctgcgcctgttctcggcggcggccgacaagtacggcgaacgcgtgctccagccgggctccaaggtcgcgggaagcgggtgggacgcgatctcgctcggcgtcgggctgatgttcggcacggccgcgctgccgcacatcctgatgcgcgccttcacggtgccggatgtgaaggaggcccggatgtcgatcctctacgccaccggcatcatcggctcgttccacctcctcgtcttcgtgatcggcttcggggcgatggttctcgtcgggcccgaggctgtcacaaaggcgggcggcggcggcaacatggcggcaccgttgctcgccctcacggtcggcggtaacgggttcttcggcttcatttgcgccgtcgccttcgcgaccatgctggcggtcgtcgcgggcctgacgctctccggtgttgccacggtctgccacgatctctgggtcaacgtcgtccgcaatggccatgccccggagcgcgagcagctcaccgttgcccggatcgcgacggtcgccatcgcggtcctggcggtggttctcggaatcgtcttcgagggccagaacgtcgccttcatggcggggctggccttcgccgtcgccgcggccgccaacttcccggccctgctgctgtcgatcacgtggaagcggttcacgacggcgggcgcggtcgccagcatcctgatcgggacgttcgcctcgctgctgctgatcagcctctcccccacgatccaggtcgatgtgctggggcggagcctcgcggaggtctcgcaggcctggtggttcgtcccgatgaagaacccggccctcatcagcatgccgctgtccttcctggtggcgattggcgtctcgctcgtgaccaaggaggatgcggccgacagcaccttccaggagatgcgccggaggatcatgttcggtgcgtcgcggacggcctacgccggccgctga

SEQ ID NO: 7700 - DNA, 267 bp, Methylobacterium sp.
atgatcgccgcgagcgcggttttgtccgccggcctcgtcgccggcttggccgcgacggatgccgccgccggcccgaagccggctttgtccgcagcgcccatccaggcgcccgccgcaatggcttccaaggtctcggcgcccaaagcgacggcgctcaagggcgaaacatcgacgaccgccccctgtgccgccgcgtggccctaccaaccggcagcctgcgccgccgacgggcgcaaggtccgcatcatcgctctcaccgcgcgttga

SEQ ID NO: 7701 - DNA, 888 bp, Methylobacterium sp.
atgagcgacccggtgcaagggcccgtgcaagactccttgcaagaccccgtcgatgcggagcgccccgacatcgtggtgctggccctggcgcgcaattgtgcggccaccctccccgccttcctgcgcttcctgtcctccctgagggatgcggggctcgattgccgcgccctcgtcggcgaaaacgactcccgtgacggcaccggggcacagctctgggcggcgcaggcgcggggcgaactcagccatgtccccaccgccttcatgtccgacatccgcggccggctggcgcggatggcccggggccgcgaacatctcaagcgcgtgctcgacggtcaggggccggcgcccgcctatgtctgtgtcgccgacatcgacaacgtcatggcgcgcccgcccgaggcgggggcggttctcgcggcgctggccaagctggagcgtccgggcctgttcgccgtctcggcggcgtcgcagccgcactattacgatctgctcgcctacgaggacgaggcggtgagctacgagtaccttctcgacgacatcgcccgccaccgccgcggcgcgctcggctattaccgcttcttctccgacacgatctacccagcgcaaagcgcgctgacgcgggagcgcgaggccacctgcctctcggccttcaacgggctgacgctctaccgcggcgcggattaccggctcggctcctatctcgacgacgattacacgcgctgcgagcacctcaccctcaaccgccgcatcgccgccgccacgggccggcggatgcttgtcgatccgggcctcgtcctgcgcacccccggcgaccacgcccagcgcgggtttctttcgttctacgcgagccgggtgcggaagatggcggtggcgcggctgcgggggtga

SEQ ID NO: 7702 - DNA, 1272 bp, Methylobacterium sp.
gtgacgcgacgcggccgcgcaggcggggcggggctcggcctcgccctgctgttcgcggcaggtctccccgcccgcgccgccgaagtgaccctcgggtcgtcccgcttcgagctgcccgtcatgttcgagggctggacacgccgggaggccggcgacggcctcgtgttcgaacgcctcttcgagccgaccgcgccgcgcgggcgcaagggcgccgcgctcctgatcgtcgccaagccgaagccggcctcgggccggttcgacgagacgttcagcgccttcgtccgcagcctcaagcagatcccgcccggcgagaagccgctcacggcgaaggccggcgaaaccctcgacgggcaccgcatccgcgtcgagcagcgctgctgccgcacgaccgacggcctgcgcatggcggcctggcatatcgggatcgccacccggacgagcgagcattttctgatgctcctcaccctccagctcgaacgcgagcagcagaacccaatccgcgaggggttcgaggcgctggtaggctcctaccgtccggccaaggacgaccgcggcctcgttctggcacccgtccggggggatggcggcctcgacgggctctacacgcgcaccaagacgcagctccgcccaaacgccttcggcgggatggacttcactgccgaccaagacacgctgctgttcgacaagggcggcctctacaccacggagcttccgcgcgacggcgacatggcggcccattgccgggccgagcccgccacctgcggcacctacgcgctgaagggcggctggttctcggccaaccgcatcgagcgggtcgaggtggaggacgggttcgggcgcgtcacgcgctccggcgaagcgttctcccgcaccaaggaggcgctgaccatcggcggcgacacctacgtcgcggtgccgcccttcgcggacgggtaccgcttcgacggcacgtggagccacacgttcggatcgagcggcgcgatgggctcggtcggcggcacgcactcgcttgccctgacgccggatggccgcttcacccgcgaaggcggtgtcggcttctcctcgaccggcggctcgatggacggcggcaccgtggtcgccggccacagccgacggccggtgcgcagcggccgctacacggtctcgggttaccggctgactctgacggacgatgctgggactactgaagcgctgagcctgttcgcgcccgaccggggttcggacaagctgctgataatcggcggcgcaaactatctgaggcaggggcggtga

SEQ ID NO: 7703 - DNA, 252 bp, Methylobacterium sp.
ttgaaaatcgcactcgtcggcgggatctgcctgctcgcgtccacggccgcgaatgcgatgaatcatccggcgcagaccgggacgggcggcggcccggagacgacgatcacagccccgcacgtcgcgccgaccggaagagtcatcccccgcccgcaggtttttagctcgccgacaagcggcgaggccgggcagaagcctgaacctcagttcaaggacagtttcctcatgaaggacatttgtgtcggctgctga

SEQ ID NO: 7704 - DNA, 873 bp, Methylobacterium sp.
gtgcttcgtgcctgcgacctcggacagcacgacgggccgcatctcggcatgacgtttttcagacgaacgctgcacaatcatccgcagatcaagcgggcactcaagtccgtcgccaaatcggtgggattatttcgcagcagcccggccaacgacttctatcgcgatctggccgaggtgaagacgcggggcgacgacgccttctcgaagctgttctacggctatgacggcgaccacctgatcaacaagtggaaccacttcctgccgatctacagccggctgttcgcgccctttcgcgacggcaggccggacgggcgaccgctgcgcttcctcgagatcggcgtctacgagggcggctccctcgacctctggcgtcgcttcttcggaccgagcgccattctctacggcgtcgatgtcgatccgcgctgcgcggtgttcgacggtcgcgccgcgcaggtccgtatcggctcgcaggccgatcccgctttccttcggtccgtggtcgaggagatgggcggcgtcgatgtcgtcctcgacgacggcagccacgtcgcgagccaccaacgcgtcaccttcgagacgctgtttccgctcctggcaccggacggtctctacgtcgccgaagacctgcacaccgcgtactggcgggactacgagggcggctatcgccgccggggcacatttctggagatgacgaaggggttcatcgacgacatgcacgcttggtatcacgaccggggcgcgcaggagatcggccggagcatcggcgcgatccacgtcttcgacagcatcgtcgccttcgagaagggcggcggcgaacggccgttccacaccacgatcggcacaccgcagcgggcaatcgaccgggtgcgctga

SEQ ID NO: 7705 - DNA, 150 bp, Methylobacterium sp.
atggcctcgaaggtgttgttggcgctggtggtgttcgtgttcctcgtggacggccacctgccgggaatgcgcgagctgcgcaatccggacagcgagggcgggaagggcgcaggccgcgccgcgctgctgtcgaagcggtccgaggcctga

SEQ ID NO: 7706 - DNA, 222 bp, Methylobacterium sp.
atgagtgtggtgcttcgatccatcgaaatcgagacggtgcgctacgtgcgggcgccggccgggccggtgtcgcgcgccgaagcggccggagccggcctgccggcgagcgcgggcgtcgtcacggacatcgcccgctaccggacgatcggcagcctgcaggcgctgggcctggccgccaccgcttcggtggtgacgatcgcgctgctctggctggccgtctga

SEQ ID NO: 7707 - DNA, 621 bp, Methylobacterium sp.
atggtcgagacgcaactggtcgcccgcggcatccgtgacgcgggcgtcctcgatgcgatgcgggccgtgccgcgggaggcgttcgtgccggacgctctggcgggggaggcctacgacgacgggccgctgccgatcggcgcggggcagacgatctcccagccctacatcgtcgccctgatgatcgaggcgctggccctgcggcccggcgaccgggtgctggaggtcggcgccggctgcggctatgcggcggcggtcctggcgcggatgggcgcgcaggtcttcgccatcgagcgccacgcggcgttgggcgaggccgcccgcgcgcgcctcgccgcactcgggctcacggtgtctctgcgcgtcggcgacggccatgcgggctggccggaggctgcgcccttcgacgcgatcctcgtctctgcggcgggctccacgatccccgaggcgttgaaggctcagctcaagcctcgtggccgcctcgtcatcccggtcggcccgcccggcgggcagacgttgctgcggctgacccggcgcgggcgggaccggttcgagagccgcgatttcggcccggtctccttcgtgccactgctgcggggcgtgggaacggcggaccccgtgtga

SEQ ID NO: 7708 - DNA, 681 bp, Methylobacterium sp.
atgatgctggagatcctccgccgactcttccagagccggagggtgaaggcgcagagccaagccccgtccgactcgcccttggaggcgatcgaccgggccgacaccgccgagcggatcgagatcctggcccgcggcggcttcgagaccgaagcctcgacgctcaagacgatcctggacgagtacttgaaccccgacgagatcgatcccgaggatcgccgctgggtcgaggcggaggtggcgcgcgccttcgcacgcaagcgggccgacgaggcgacgtggccgctggagacggatttcgaccgcctcgccatcgccttcgatgcgctcgacgcgagcgggatcatcgcgctgcacgatgccggctacacccgctcggacggcatctcggatgcggccgaaatctatcaccagcgccgggagcgcgggcgcgcctcgcgggggttcgtcttctaccacgggcaggatgtcgaggcggtcgtctgcgaccgggggctctacctcgccttcggcgcgttcgacgaccgcgaagcgaccatggccgccatcgccgccgagatcgtggcggccgtggaggcgcaagggttgcggacgcattgggagggggatgtggggacgcgcatcctcgtccacccgatccactggttgaagcgcagcccgtccgacgacccgcgggcggcgtaa

SEQ ID NO: 7709 - DNA, 216 bp, Methylobacterium sp.
atgatctccctggctctgctcgccgccctcactgccggcgtcgccaacatcgctctggtcaccctggtggccaaccgtctcggtccgaaggccgataccgctgctgccggcgagttcgcggccgtcggcggggctgcgcctgcttccgcgaagcgcgccgccgtcaagatcggcaacgagaacgtcctgcccgtcggcgcccagcgcgccgcctaa

SEQ ID NO: 7710 - DNA, 201 bp, Methylobacterium sp.
atgtcaatcgccaaggttcgccagcctgaagagcagtggatcgagctcccggagccgaatcttgaccgttacatgctgcactcctgcagccgcgctgcgaacgacaaccgccggccggccggcgaaatctttcgcgtcgtgcaaatcggcgcctgcgtggtcctgatcggtgcaaccaccctgatcagtgctttgatctga

SEQ ID NO: 7711 - DNA, 1122 bp, Methylobacterium sp.
gtgggccagttcgggctcgtggaagacgccaattcggccgcgttcgaccgtttgccggacctcgcgatcggccttcccctgccggttgaggggacacatcgcgagcggatgagccgctacctcagcctgtgttcgcggaccgagaacccgatccccggcgcggtgttcgtccgcgccggagccgagagttcctgccgtcatccatgccggggcgcgcgcatcgtcctgcgcgcctatggtgacgagccactcgtcctgcttcatctcacgccgacgaacctggagggccgccttcacctcctcacggagcggctgaacgatgtccggcgcgtcatgcaggagcggaagcggcgtgagatcgagatgcaggcgctcctgaccgagcgcagccggttgctggtccacctcgaggaggacgcgcaggcacggcagcgtgccgaggccgagcgtgacgccgttctatcaaggctctaccgggccgggcaggacgagcggcggcgcctcgcgcgcgatctccatgatcatgccggtcagcaactcgtcacgctgaccttcggcctgagaaagatcgcgtcacgcctatcttgcccaacggccatccatgaggtcgagcaacttctccgacacacccaggacatcgggcaatcgctccggagggtgacccttgaactccggccggccgccctcgatgagttcggcttcgtgaccgcgctgcgctcgcttgtggatgagtggagccgggtgacggaaatcgtgaccgagtttcaaatcgtcggcgaggaggtggatttcccgctggagacggcgatcacgctctatcgcctggctcaggaggcgctcacgaacgtggcgaagcatgcggggccgggcgtgtgcgtgtcggtcgtgctgcggttcagcgctttgcaggtcacgctgacgatcgacgacaacggcggcggcttcgcggccgacgaggcgatcgcgaccagtctcgtctcccagggaaagctcggcctgctcggcatgcgtgagcggatggcgctggtcgatggcacgctgaacatcgagtcggcccccggccggggcacgagcatcgttgcccgcgcctaccggtccgtcgaggaaagcgggcatgcctag

SEQ ID NO: 7712 - DNA, 669 bp, Methylobacterium sp.
atgcctaggaccctgatccacgtcgtgctggcggacgatcatccggttttccgtcacggtgtgacgagcctgatcgctgattccggcgagatcgtcgtggtggcctccgtcgaaacgggcgcagccgcctaccgggcgattgttcagcacgagccggacgtcgccatcctcgacatcaatatgccggagatgaatggcgtcaccgttcttcgccatctcgccagaaccgggacgcggacccaggctatcatgctgagcgtctatgagagccgggtctacatcgaccaagcctttgaggcgggcgcccgcggctatgttctcaagcggtcggccttccagaacatcgccagcgcggtgcgggcggttcatgccggcggcatctatctcgatccggcattgccggaacgcaccgctccgcatcggcggctgagttcaagcgtggatgaggcggcgtgctcaaccttgagcgagcgcgagcgcgacatcctccggttcgtcgccttcggcttcacgagcaaggaagtcgccgaccggctcggggcaacccccaaggcgatcgagacccaaaaggctcgggcctgcaccaagctcggcctcgcaagccgagcacagatcgttcagttcgccattctccagggctggcttcatggagagattcccctgcgctga

SEQ ID NO: 7713 - DNA, 2115 bp, Methylobacterium sp.
atgtcgccgcttttgacgcgcctgcttgcatcggtcagcgcactcggcgtgagtacgcttccgagccatgcgctcgatccgaccgcgattgagctggaggaattgcaggtcaccgcgcagggcggttccgcaaattccgttgcggcggttgcggggccggccgcgaacctgaagacccagatctcatcgtcggtcctggctctcccaggcaacagcacggtgatcgatgccgcggagatcgctcgcctgccggtgcaaagctacggcgacctcttccgccccgtggccggcttcgatgtctcgaattacggccagggcggcgtcggatacggcatcgccctgcgcggcttcagcgatgccgagcatggccgcgacgtcgcggtcttcatcgacggggtgccgatcaacgaggtctcctcgatccacaccccgaactacgtcgatctcaatccgctgatcccggagaccatccgctccatcagcatcgtgcgcggccccttctcggtcgaagcgggcgacgccaatctcggcggctcgatcttcatcgagaccaagcgggccgagcccttctcgaccgtcggcgcatcgggcggctcgttcggcacggggcgggggcttgccaccttcagccaggtcggcccggggatccagcccttcctcgcctacgagggctacggcaccgggggctatcgcgagaacggcgacctcgggcgctacaacgccttcaacaaggtcaccatccccctcgatctcggctccagcctgtcgctgcgggtgcagatgtacggcacggggttcgggcagccgggctacctggagcgcgaccgcgtgcgcgccggtctcgtctcaccgcgggccgcgaccaacatcaccgatggcggcggcaagaccctgcagaccttcgtggccaactacgtcaacggtggaccggacgacgagctgtcggcgctcgtctacgccagccacgacgtgttcagccgcttctcggatttcggcgccggccagcgcgggcaggtcgaggaacgggagaccgtgggtggccgcatccgcaaggtctggacgacgagcctgttcgacgcgctgccgacccaagtcctcgtcggcggcgattggcggagcgacgcgctcgacgcgaacaccggcccctcggtcgcgcgcacgttcaccgcacgcaccctcgatctcgatctctcgcagcacaacctcgcggcctacgcgcaggtgcaggtcaagccggcgccctggctgaagctgaccggcggcgcccgcttcgaccagttcttctacgacgtgcgcaacaatctcgacccggccctgtcgcccaaggtcagccccaacgtggtctcccccaagggcggggcggcgctcacgcccttcgactgggtggagctgttcgccaattacggccaaggcttccgcagcccctccgcttcgagcgaattgacgaacaatccccgcctcaccccgctgaccatcgagagtacggagggcggcggccgcctcgtgttcgaccggttcagcctccttggcacggtgttcttcaccgacatcgccaacgaagtcttccagcccgcacctggcctgcccgtgcagaacctgggcaagtcccgccgcgacggcttcgagatcgaggcgaaggtgctggcctatcgtgaaggcctcgaccgcgtggcgttgttcgccaactattccggcgtctcggcccgactgctcaacggcgcgccatccgtcttcatccccaacgtgcccgcgtatcttgccaccgtcggcgccgaattcgacgtcgccgcaccggccgccctgttgccccgcgggcgcctgaccggtgcggcctacctgtcctacatcggtgccaagccgctgaccgaggacggcctgttgcattcctcgccctatccgcgcgtcagcggccggatcgcctacgtccacgagagcggctggacggcctatgggcaggcgacctggtatccgggcgaccgcacgagcgagagcatcttcaatttcggctcgtcggtctctgcctcggccgccgagatcttcaccagcccgcagccgcgcctgacgctgctggccggcatcacctccagctttgcaacaggagcacctcttcgatga

SEQ ID NO: 7714 - DNA, 1203 bp, Methylobacterium sp.
atgcgcgacagcatcctcgtcgtgaatgcgggcagctcgtcgatcaagttcaagctgtaccgcatcgagggcgccgatctcgcgccgagcctaagcggggggatgagcgggatcggcagcacgccctcgctgaaggtgacggacgggagcggcgccctcttggaggaccgccgcttcgaggctggcgaggtgcccgatgcctcagcggcccagcaccatctcgccgattggctcgtgcaccatctgggcgacacgacgatcgtcgcggtcgggcaccgggtggtccatggcggagcggacttcgcggagccggtgctgatcgatgacgccgtgttgcgccggctcgaaaccttcatcccgctggcgccgctccaccagctcggcaacctcgatccgatccgtgtgctacggcagcgccggcccgatctgccgcaggttgcctgtttcgacaccagcttccatcgcggccatccggaattgtccgatcggttcgccctcccccgcttcctctatgacgagggcgtccggcgctacggcttccacggcctgtcctacgaatacgtcgccgggcgcctgagggagatcgcccctgaggtggcggacgggcgcgtggtgatcgcccatctcggctccggggcctcgctctgtgcgctgaaggacggccgaagccaggaaaccaccatgagcttcactgctctcgacggcgtgccgatgggaacgcgctgcggtgcgctcgatcccggcgtcgtgctgcatctcatcgagcatcggggcatgacgccggccgaggtcgggcacatgctctattacgagagcgggctgctcggcctgtccggcctcagcaacgacgtgcggacgctgctggcgagcgaccggcccgaggccgccctggcggtcgacttcttctgccggcgcgtcgcccaggcggctgccgccctcgccgtgacgctcggcggcctcgacgccttcgttttcacggccgggatcggcgagaacgcacccgaaatccggcggcgcatcatcgccgatgtgagttgggccggtttgatcctgagcaatgacgccaacggttcgggcgtcgcaagactcgatgcatcgggaagccgggcgcagatctgggtcatcccgaccgacgaagaacttatgatcgcgaaacacacgatgcgtctgctggatcgaatcgcgtcagggacgagggcatga

SEQ ID NO: 7715 - DNA, 1311 bp, Methylobacterium sp.
atgacgatgaccggcatgttcacgctccgggtctgggtggccgccgcaacgctctccgccgcgtgcccgcccgccatttcgacggcgttcgcgcaggccgagccgacgggcccccccgtcgtcggcatcatcgccgcgcgcaaggagccgatcacccagacggagcagttcatcggccgcatcgaggcgaagcagcgcgtcgacatcgtcgcccgggtgacggcgttcatcgagaagcggctcttcgtcgagggcacggatgtcgaggaaggcgcgctcctctacctcctcgagcagggcccgttccaggcggtcgtggccgcgcagaaggcgcagattgcgcaggtcgaagcgcaattggagaacgcgcgtctgacgacgcagcgcgcccgaaccctgctcggcgggccggccgggcagcaatcgacctacgacgcggccctcgcgaacgagcgggccttggaggcgcagctccaaggcgcacacgcccagctcgacacggcgcagatcaatctcggctacacggagatccgcgcgccgattgccggccagatcgggcgcacatccctgacgatcggcaacgtcgtcgggccgggctccggagtgctgacgacgatcatcagccaggacccgatgttcgtgacgtttccggtgccggtccgtgaagcgatcaatctgagagcgcgctatgggccgacgggcggattcggcgccgtcctgatccgggcgcaactcccggacggccgcttctacgatcacaccgggacgctcgatttcgtcaacaacaccatcgcgacgaataccgacacgatcctgcttcgcggcgtgctgccgaaccctccgatcttcggtcaaacccgcagcttgctcacccttcgtgaactcacggatggcgagttcgtgaccgtgttcctcgagggcgtcgagccggtcgaggtggtcgcgattccccgcgccgccgtcctggccgaccagcggggcagctacgtctacgtgatcgggcaagacaataaggccgaggagcgtcggattcagcttggtcagtcgagcacgacgctcgcggcagtgacgggcggcctcaaggtcggagagcaggtcatcgccgaaggcttgcagcgggtccgcgcgggcgagacggtttctcccaaacccgccgacgccattctgcagaggatgatgcggaattcggccgtgaacgcggaccgcgcggggccggctgcgtccgtttcgccgcctgccggacacgctccgacgggagccgccagcggcgccggtccgagcgcgagcggcagcccgaacagccggcgctag

SEQ ID NO: 7716 - DNA, 168 bp, Methylobacterium sp.
atggccgagaccaaacagacggacaaagtcgaagccccggatcgaccgcgcctgacgcctcagggccatagcagcggcacagcttccggggaggacagcaccgacccccaaggcggcgcgaagcagggtcaaagcgacaaggcggaaggcgagcggcgcgagccgtaa

SEQ ID NO: 7717 - DNA, 999 bp, Methylobacterium sp.
atgagaagcgagcccgctgtttcgtcgcagcgcctgcatcgtgcggaagacaggccgtgcatcgagccggtccagctctcgggcgtggccggtgtgacggcgccgcgtctcgacttggagcgctccgcgacaggccgcgggggcgctccgcgggtcccggctcgcatcaaggatctgaaagccaaggatctgaaggccaaggatttccgggcggccctggccgggggagagttttcgctcgcctaccagccgatcgtgtccgcggcgacgggggcgatcaccggttgcgaggcgttgctgcgctggcagcacccgttcctggggccggtatccccagccgacttcgtccccctggccgaggagaccggcgcgatccgcccgatcggagcctgggttctcgaagccgcctgtcggcaggcggcggtctggccggacttctgccgggtctcggtgaacgtttccccggttcaactgcaggatccgggcttcgcgggtcgggtcgtcgccgcgttgcgggccagcggactggcggcgggccggctcgaactggagctgaccgaaggcgtcttgatgggggacgtcgccgtcgcgctcgagggcgtcgcggccctccgtgccctcggcgtcagcatcgccctcgacgatttcggcaccggcttctcgtccctcggctacctgcagcgcttcgccttcgaccggctcaagatcgatcgcacgttcatccgaggcctcggcgaggcgcgcgagagctggttcctggtccggacgatgcacgacatcgcccgtcatttcgggatggcggtgaccgccgaggggatcgagaccgaggacgaagcccggatgcttcgcgagatcggcgccacggagctgcagggattcctgttcagccggcccgtcgcgggcgcggtcgcgacggcgctcctgagcgagcaggcgcacagactgcgatcgggcgaggccggaccacccgcgaaatcgtcggatcacccggtcccatga

SEQ ID NO: 7718 - DNA, 426 bp, Methylobacterium sp.
atgctcgacgcgaccgatcgtcagctcatcgctctgctgcgcaccgaggcgcggatgccggtggccaagctcgccgcggcgctcggcgtcacgcgggcgacggtgcgggcccggctcgaccgtttggtgacgtccggaatcatcaccggcttcaccgtcacggtgcgggaggtggagcccggaggcgtgcgggcggtgacactgatcgaggtggatgggcgccatgccgagagcgtgatccgccgcctgtccggccttccggagatccgggcgcttcacaccaccaatggccgctgggatatcgtcgccgagatcgaggtgccgacgctcggcgatttcgatgccctgctgcgcacgattcgtcagttcgaggggatcgccaattccgagaccagcatcctgctcgcggcccggaagggcggatga

SEQ ID NO: 7719 - DNA, 255 bp, Methylobacterium sp.
atgatccgttttccgatcctcagcgcgctcgtcctcggcggcctctctcttgccggcaccgcgacggcgcaggctttcccgaacgacgaggcgtcggtgcggtaccggcagctgatccagcagcttccgccctccgagcgtccgcgcccgcacgatccgcgctggaccacgaacgggctcagccccagcgtcggccgcttcggcctgcccctctccggcccggccgcccgcggggggatgacggccattcgctga

SEQ ID NO: 7720 - DNA, 651 bp, Methylobacterium sp.
atgttgcggatcatcatcgcagatgaccaaagaaatttccgcatcgtcttgcggcgaactctggaattgaatctgagtggaatcgtcgtcgtcgatgtttcgaattcatcagaattgattaacagtctccggtcaccgctgaagacggacctcgtgatcgtcggatcgcgcctccttccggctggggatccgacctatctcggagccctgaagcgcgcggccggcaccgcacgcctcctgctcgtcgtcccccatgcctcggccgacctgttccaggatgccctgagcctcggcttccacggattgatcgttcggcgccagcgccacgaggaaatgctcgaggcggtccgaaccacgctcgatggccggctctacgcacccaccaccatcctggccgtgaagccgccggatgccgggtcggggctgcggcaaccggagcgcagcgtgcgaacgttcgggttgaccctgcgccaacgtgaagttctggcgctgatcggcaaggggttatccaatcgagagatcgcgatcgcactgagtatcgccgaggcgaccgtgaaaattcacgtttcagccgtgatccgaatgctcggcgtcagaaatcgaaccgaggctgcgctgctcgcgccgaccattctcaagggaaaagcctag

SEQ ID NO: 7721 - DNA, 156 bp, Methylobacterium sp.
atggtcgcgagcgtcgcttgtcttgtcgcgggtgtcgggctggcggctcaggcgcaccgcttcggcgcgcgcgcggcgctggccgaaaccttgtccggcctcctgctgatcctcggcctcggcctgatcgggctcgggctcccggtgtttcggtag

SEQ ID NO: 7722 - DNA, 750 bp, Methylobacterium sp.
atggccctcacgacgagcttcgccgagcgcagcacgcagccgcgggacaaccagggcaacaacaacctcgtcgtcttcctctgggcgacgccctggaaggtgctgggcggacagttgcggttccttcagtcgtttccgttcaacgcggccagcccgcagggaggtccgtggcaggcaggcctctatcagccgctgacgacggcccagatcgcctggaagatcaacgacaacctcggcgtcagctacttcctcggcggcttctggcccagcgatacgcttctggcactccggtcggcctcgatcgcgcagcgctttgcgatcagctatgtcggcgatggctggaacgtgacggccaacctccattacggcacgatgctggcagagaattcgccgaccaacgtgcactattccgactacctcaacctcgacctgaccgcgaccaagcggttcggcaaatggtcgttcggtgccgtcgccttcggctcgaccgacctgccgacgaaccggcggggctaccggcccggcggacaggtcgccatgggcccgctcgtcgcctacgcgttcgataagttcacggtccagtccttcgtcacccgcgacatcgcccagcgcaatctcggtggcgaggagacgcgcgcttggctgcgcttcctcgtgccgctctggcggccggataagggggaacaggttccgaaccgcgtcctcgttcggcgcaacagcgccgccgggccggcgattgccggccagtga

SEQ ID NO: 7723 - DNA, 1032 bp, Methylobacterium sp.
atgaggcggacgaggccgggccccagggcgcgcggggccctgcttgcgatcctgctcgccaccggtttcgccgtcgcggcgccaccgccgtccttcgcgcaatcgcgcctgaagcagttgatcgaccgtctgcgtggccagaagatgccggacggcatcgccaagtcgaacgggcgcatcgaggcgacgcaggtcgatgtcgccgcgaaatatgcgggccgaatcgcgaagctcctcgtcaaggagggcgacgaggtgagcgcggggcaggtcgtcgccacgatctcctcgcccgagaccgaggcgcagttgcgcggcgcccagtcccaggtgctgcgggccaagaagagcctcgccgaggccgtcgccctgatcgcccagcgcaacagcgacctcaccttcgccgacgccgactacagccgcggcaaggagctggtcggcaagggctacatggccaagcagatcttcgaccagcgcaaggccaaggccgaggcggccaaggcggcgctcgacgccgccaaggcgcaggaggatcaggccaagttcgccgtgcagagcgccgaagccgacgtgcagcggctggaggccatgctggtcgatctcgtgctgcgggcgccccgcgacgggcgggtgcagtaccggctggcgcgggagggtgaggtggtgggcgccggcacccgcatcctgacgctgctcgacctctcggacgtctacatgacgatctacctgccggcgtcgcaggccgggccgctggcgctgaacgacgaggcccgcatcatcctcgatccggttccgcaatacgtcgtgccggcgacgatcagcttcgtggctgccgacgcgcagttcacgcccaaaagcgtcgagaccgaggaagagcgcgagaagctgaccttccgcatcaagctccagatcgatccgcaggtgctgaagacctaccgcaagcgggtgaagaccggcgtgcgcggcatcgggttcgtgcgcatcaagggcaacgtcgcgtggccgcccgacctcgccgtgaagctgccgtga

SEQ ID NO: 7724 - DNA, 489 bp, Methylobacterium sp.
atggacctcgacagcccatgcccgatcaccagcgagagcggccttccggtccagccctccgaatgggccatgttcggcgtcgaagtcaggctcgacgacgcattgggtttggtgaagcaagccgcggacacgatccacgacttgcagcgctggaaggagatgatcgagccgcaggcgctgaacctgattcaaagcgtccagcaggagcgcgtccgatggcaatcggaacgatcggcgctgatgaacgaaatcagcgagtgccggctgacgatcaccgcgacgaagatggcgctgcgaacggcgctttcggaaaaagagatcctgtcgcgtcgctatcatgaggcgaaagcggcggcggcctcgtccgagacgcgcgcctgcgcggcggaggagttgctcgccttcatctacaagaccttcaatgtcgagctgagcgaacatccggcaacgggacgtatcgctcaaatcccgttcgatccggccggctaa

SEQ ID NO: 7725 - DNA, 540 bp, Methylobacterium sp.
gtggaacagagcttggtagattcgcggggtgatttctgcggttcgcagattcgcttggaccgggaaatattcatggatctagtggtgacgacgatgggatccttgtttgaggatacagtcggatccagcgaagctggcagcttcattagcttggtcggcctcgctgtgggtgagaagatccaggaagagtacctccaggtgagtggcgcgagccaactcgacaggaaagggatggtcgacgctctgctcgacatgaagcagcggatcggcagcgatttctacgtcatggacgaatcggagcagcgcattgttctcggcaataagcgctgtccgttcggagaactggcaaagaaatgcccttcactgtgcatgctgaccgcgaacgtgtgtgggcatctggccgcggagagtcagggatatgcacgagtcgatcttcccgaaaccatcgccgcgggggcgtcagagtgccgggtcgtcatcaacctcgacccgaacacaaccggcagcgggcggcggtatcatcggcgagcctgggcctga

SEQ ID NO: 7726 - DNA, 990 bp, Methylobacterium sp.
atgagagcgctcctctgcgccggggcggcgctgctcgggctcgccgcgggcggcgcgcgggcggcggagaaggtgacgctccagctcaaatgggtgccccaggcacagtttgccggctactacgtcgcgcaggccaagggcttctacaaggaggccggcctcgacgtgacgatcaagccgggcgggcccgacgtggccccgccccaggtcatcgcgggcggtggcgccgacgtcgtcgtcgattggatgccctcggcgctcgcctcgcgcgagaagggcgtgccgctcgtcaacatcgcgcagccgttcaagaaatcgggcctgatgctgacctgccgggcggatactggcatcaagtcgcccgccgacctgaagggtcgcacgctcggcgtctggtatgccggcaacgagtacccgttcctggcctggatggccaagctcggcctcaagaccgacggctcgcccggcggcgtgacggtgctgaagcagggcttcaacgttgatccgttgatccaacgccaagccgactgcgtctcgaccatgagctacaacgagtattggcaggtgatcgatgccggcttcaagccggagcagcttgtcgtcttccgctacgaggaccagggcgtcgccgcgctcgaagacgggctctacgccctcgaatcgaagctgaaggacaaggccttcgtcgcccggctggcgaagttcgtggcggcctccgagaagggctgggcctatgccgccgcgcatccggacgaggcggccgagatcgtgctggagaacgacgccagcggcgcccagaccgagacgcaccagaagcggatgatgcgcgagatcgccaagctgctcgacacctccggcggccggctcgaccccgccgattacgagcgcaccgtcgcgatcctgctcgccggcggcaccgaccagcccgtcatcacccgcaagcccgagggggcctggacgcatgcggtgaccgcaaccctggggcagtag

SEQ ID NO: 7727 - DNA, 1326 bp, Methylobacterium sp.
atgccgcgccccctgcggcggcacgaaccgcaatcccgcacgaacgtcgcgttctccgtcggcccgcgcatcgtcgccgggttcatcttcggcgcggcgctcgtcggcggcgtcggcggctgggccgccacgaccgatctcagcggcgcgatcctcgcttccggatccgtcgccgtcgatcagcgagccaagtccgtgcagcaccgcgacggcggcgtggtcggcgagatcctcgtgcgcgatgggcagccggtcacggccagccaagtgctcctcagaatcgacgacgcgcagacccgcgcggaactcgccatcgtgaagggacaactggtggaactcgccgccaagaaggcgcggctcctggcggagcgcgacgggcagcgcgaggtcagcttcccgcaagccctgcttcaccagggcgccgaggtgcagtcgatcctggagggcgaactccggctgttccagggcaacctcgccggccgtgacagccagcgccagcagctcgaacttcagattgggcagatcgctgaggagatcgccggcctcacgaagcagcgggacgccaagagagacgaactggccgtcctcaccaccgagcatggcaagctatcgatcctcgtcgagaagcagctctacgagagttcccgcttcctgccgatcacccgcgacaagcaccgcctggccggcgagcagggatcgttggaagcctccatcgcgcgggcgaagacgcggacgagcgagatccgcgtccagatcctcgccatcgcagacaccgcccggaccgaggcacagcgcgagctcagtcaggtcgatgccaaggcggcagagctcagcaaccgtcgcgtggcattggacgaccggctgacgcgcaccgagatccgtgcccccgtgaccggcatcctgcacgaattgaagacctttacggttggcggcgtcgtcacccccgccgacatcctggcgaccgtggtgcccgaggacgcgcggctcaagatcgagatccgcatcccgccgaccagcatcgaccagatcggcgtcggccgcgcggcccgggtccgcttcaccgccttcagccagcgcaccacccctgaactcaagggaacgctgacctacgtctcgccctcaacgacgaagggcccacgggacgaggcgttctatatcgggcatgtcgagctcaaggatggcgagattgaacgcctgggaggctcggcccgccttatccctggaatgcccgtcgaagttcaggtcgctacggatgagagaacagcaatgtcctacctgatgaagccacttcaagaccagtttagtcgcgcattcctggagcgatga

SEQ ID NO: 7728 - DNA, 795 bp, Methylobacterium sp.
atgagaggtccgctgatccaagacccccgcgtccaggcggcgctgccgcccctcctcgtcgggattgcggtgctgagcctgtgggaggccgcctgccgcggcttcgcggttcccgagtacctgttcccggccccttccgtgatcgccgcctccctcctccagaacggtccggacctgctgcgggccctgtggagcacgatgcgggtgacgctgatcgccttcgcgctctcgaccgtgctcggcacgctcgtcgccttcctgttcgtgcagagccgcttcatcgagcgcggcttcttcccctacgcggtgatgcttcaggtgacgcccgtggtggcggtggccccgctcatcatcatcctcgtgcgcgacacgcaggtcgcgctggtgatctgcgccaccatcatcgcgatcttccccatgatctcgaacaccacggtcggcctgcgcagcgtcgatccgggcctcgtcaacctgatgcgggtctaccgcgcgagccgccttcagacgctgctgcgcctgcgcatcccgagcgcgctcggctacttcttcgcgggcctgcgcatctcctccggcctcgccctgatcggcgcggtggtggcggagttcgtggccggaaccgggggccgcagcgccggcctcgcctacgagatccttcaggccggcttccagctcgacatcccgcggatgttcgccgcgctctcgctgatcaccgccgccggcatcctgctgttcctcgccatgagcggcctgagccgcctcgcgctcggttcctggggcgatcccgagcgcccctga

SEQ ID NO: 7729 - DNA, 1269 bp, Methylobacterium sp.
atggcgcaggtcgtgcggcgcctctgggtgcgcgccacgctgatcggctccgcaggggtgctggcggcgctgctggcggcggtggccgagcgctatctgccctggacggtgccgggcgcgatcagcaccgatgcgctcgacagcatcctgaccgtcatcgcctccagcatgctgtccgtcaccaccttctcgctcaacgtcatggtgtcgtcctacggctcggccacgagcaacgtcacgccccgcgcgaccaagctcctcatcgaggaccgggtgacccagaccgtcctctcgacctttctggggtccttcctcttcggcatcgtcggcctcgtcgtcttgaagaccggggcctatggcgagagcgggcgcaccatcctcttcgtcgtcaccatcgcggtcatcgttctgatcgtcgtcgcgctgctgcgctggatcgatcatctgacgcgcctcggccgcgtaggggagacgaccgaccgggtcgagacggcggcgcgtaccgcgatcgaagcgcggctgcgcgacccctatctcggaggccgaccgctgcgcgatcccgaccgtcggattccggcgggcgccgcggcggtgacggtggatgcgatcggctacgttcagcatatcgacatggcggccctgtccaagatcggcgaggcgcacgacatcgagatcttcgtcgcggcgacgcccgggcgattcgtccacccggagacgccggtggcctggatcggccggccggaggccggggaggacggggacacgctgcgccggaccgtcggcgaggcgttcttggtcgggaacgagcgtgccttcgatcaggacccgcgtttcggcctcgcggtgatgagcgagatcggttcgcgcgccctgtcgcccgcgaccaatgatcccggcaccgcgatcgacgtgatcggccgctcgacccgcctcgtcagcctctgggtgcgcggcacgaccgctcctgaggaggacgagccgaaacatccgcgcatccatgtcccgccgctcgacaccgccgacatgttcgaggatgccttcatgctgatggcccgcgacggcgcggggctgatcgaggtccaactgcgcatccagaaggcgctgctggccctgagccgcatcggcggggaggcatcccgggctgccgcgctgcatcagtcgcgcatggccctggagcgcgccgaactcgcgctcacgctcgaggccgacaagatccggctgcgcgtggcggccggcgccgtcgaagccgtcgatgcgagcccggcctga

SEQ ID NO: 7730 - DNA, 1413 bp, Methylobacterium sp.
ttggtccgtctcgcggcggctctgggcagcctgattccggtggcggccttcgcgcaggtcgcgccgggccagacgctgcagcagaagccgtacttcgccctctacgaggccctgggcaagcccgagaactggaagatccagggcagcttccggccgcgggccgaagggctcggcgggcagttccgccccgcccccgcgccggccaccaacgacctgttctcgatgcagaccaccctgtttgccgagtacgacagcggcccggtccggttcggcggcgagatcttcgacagccgggcctatttccagcgccggaactcgaactccatcgccaccaccgaggtgaacgcgttcgaactcggccaggcctatctcggcttcgacatggcggatgccgcgggccttggcaccgtgagcacgctcaccgtcgggcgcttcacgcagaatgtcggctcgcgccgcctgatcgcccgcaaccagttccgcaacaccatcaacgccttcaccggcatcgcctacgattgggagaatgcggccaaggaccggctgcgcctgttctacaccctgccgcattaccgcctgcccgacgaccgcgccggcatcctcagcaacagcgtcgaatgggatcacgagggcctcgacacccagctcttcggcggcatcttcaccaaggcgggcgtgctcggcggcatcctggaggcctacggctacgggctgctcgaacgcgattccggctcgcagctcgaaggcatccagacccgcgaccggcgcctgttcacgccgggcttccggctctaccgcgtgcccaagccggggcagttcgaccacgaactcgaaatggtcggtcagctcggcgtcgcgcgcaacaccgccgccatcaccgacgtgaccgacgtgcccgtgtcggcctacttcgtgcacgccgaggccggctacaccttcaagaccgcctgggcgccccggatctcgctccactacgaccatgccagcggcgacagcgccaaccccaacagctacacccgcttcgacacgctctacggcgcgcggcgcttcgattacggcccgacgagcctctacggcgccgtgcagcgggcgaacctgatctcgccgggcatccggttcgaggtcgcgccggaccccgattgggacgccttcatcgactaccgcagcctctggctcgaaaacccgaccgacagcttcgccgccaccggcgtgcgcgaccggaccggccgctccggcagcttcgccggccaccagatcgaggggcgggtgcgctactggctggtgccgcgctcgatcgtgctcgacagcggcgtcgcctacctcctcaagggcgatgtgctgcgcaacgcgccgaatgcgccgaataccggcgacacgatctacggctacatgacgacgacgttcttcttctga

SEQ ID NO: 7731 - DNA, 1044 bp, Methylobacterium sp.
atggccggttacataccggcaatggtagcgctcgtttcggtagtctatcttattcttccggcatcggcgcaagtcgcggacggccaacctcctgccgacgtcgcggcacccggcagcagaagcgatgcagatcccggccagggcaagacatctgatctcttctttgctgcacacgatgtctccgggaagctcggcacccctctcccgctggaaatcaagcttgtccgcacaggccgggtctcgatcgaatccatcctcctgctgggcctaccccaaggcgtgacgatcagcgactcgaccaacactttctcgccgtcagacgagacaagggacgtagacatcaaagcgtgggatctcccgaacatcaaaatcacgcagaccgacgagcgcgagagccgcttctcgctcgccgtcgcggcgatctggaccgcggggtccggtgggcaggtcgatgtcgcgacgagccttctcaacgtcagtttccgccccgacggtcctgatcgggccactgccgccggcgacgaaccacgcagccccgagaagcctgcggctgcgactcgcggaaccctgtcgccccctcaagtcatcgccagcgctgccgctcccgatgcatcggccacggccgagggcgtcgtggtgccgtcggcccgtggcacgcctctcacgaacacagcggggatcgaccgtccggcctcgcccgccgtcacggagaaaagccccgccgctgagggcgaggctgcgcggctcaaacgtcccgtagagaccgcacggccgacgctccaggcggacccgctggtggagcgagccaggggcctgatacggctcggcgatatcagcggcgcccgacttctgttggagcgcgcacaggcgcgcaacgcaccgaacgcgactttcctcctggcacagacctgggatgtggacatgctgcgccgctggaacgtgcgcggcctgcgggccgatccggatctcgccaggagcctgtacgcgaaggccgcagctcagaaccagacggatgagcggctgctcgccgcgacgggccgctga

SEQ ID NO: 7732 - DNA, 831 bp, Methylobacterium sp.
atggctacgctcaccaccatctccgttgaaaaacttgcgcgcctgatcggcactcccggctgcccggccattgtggacgtgcgcaccgacaaggcgttcctcgccaaccagcgccatgtgccgggctccctggcccgggcacccgaccgagtcgccgagtgggcgccccgactgcgcggcaggtcggtcgtggtcgtgtgcgaggatgggcgtcggaacagccatggggtcgccgcttggctgcgcagcgccggcgtcgacgccgaggcgctccaaggcggcttggcggattgggcggccgccgaacggcccatggttccggccgacaagatccgcaaccgcgacgcgcagggccgcaccgtctgggtcacgcgcgcacggcccaaggtcgaccgcatcgcctgcccatggctcatccgccgcttcgtcgatccggacgcggtctttctctttgtgccgccgagcgaggttgtcggagttgcggaacggttcgaggccgccccgttcgacatcgacgaccccggcaccttctggagccaccggggcgatctctgcaccttcgatgtcatggtcgaggagctcggcctcgccacgccgccgctcctgcacctcgcgaccctcgtgcgcggggccgacacggggcggccggatctcgcacccgaggccgccggcctgctcgcggcctcgctcggcctgtcgcgcatctacgcggacgacctcgcccagctcgacgccgggatgctcctctacgacgccttctaccgctggtgccgcgacgccacggaggagacgcataactggccgaccaacaagcccaaggagagagcctga

SEQ ID NO: 7733 - DNA, 558 bp, Methylobacterium sp.
atggacacgatgcctgtcgcgctggccggccggatcctgctgccttgcggcgcggagcgggattgcctctgccgactgtctcaggccgacgaagtgtacgttgtgatcggggatgccggcgcggctgtcggctcgcgcgtcatctgccacgtcgacgggctgggggtcatcgaggcgagcgtcaccaccgtctccaggggcagccttcggctgtcggtcgagggttcaccggcgcacagggcccgcctagcgacgcgtctagcgtggcatcgcgcgcgactggacgggcgtgaggaccagcgcggtgccatgcgggtgataccgctcgacccatccgccgaggtgacgctctcggacggtatggccgtggaggcgcggattgtcgacttgtccgcaaccggggcggcgctggaaatggtcctcaggcctcccgtagatgctgttctgaccgtgggacggcgccgcgcccgcgtcgttaggcagacggacgccggcatcgctgtccggttcgtgctgccgctgcgtccccaggacgtgagtgccgacattcgcctctga

SEQ ID NO: 7734 - DNA, 546 bp, Methylobacterium sp.
gtgtcgtcggtcagccttccgggacgctacctcgacggatcgggcgcggagcgcgactgtacgcttcgcggcgacacacccgaggcgctggagattgcgggcgaccgcgcccccgtcccaggcgagcggatcgtctgccgcattcccgggctcggccttctcacgggacgcgcggcgatgctttcggatgggacgttccaccttgaactggaggccggccccgtccagagggaccgccttgccgcgcgtctcacatggcatgcgggccaggcggatggagcattggaccgacgagaggctgtccggatcacgccgatccggaccggggtagtcgttgtttgggacggcgccgaggtccacgggtccctacgtgatgtctccgcgaatggggcatccgtcgatttgacgccttgtcccgggatcgggacaccgatcgccatcaaccggcgtcggggccatgtcgtccgtcacaccgagaccggcatcggcgtccgcttcgtgctgccgttgagcccatacgatgtgaccgagggcatcgtcctatga

SEQ ID NO: 7735 - DNA, 231 bp, Methylobacterium sp.
atgaaacatccgattctgaccgctgccgtcctcgctctcggcgcggccgctctggccggcccggtcgaggccaagggctgtctcaagggcgccgtcgtcggcggcgcggcgggcagcatggccggccacggcaaggccggtgccgctgccggttgcgccatcggccaccacgaggctaacaaaaaggacaagtccggcggtcagagcccgcaacagggctccgcgaagtaa

SEQ ID NO: 7736 - DNA, 1389 bp, Methylobacterium sp.
atgtcccgcaacttcgaccaagcctgggaagcgctcgtcgcgcatttcggagccgagcaggtcaacggcatcacgagctctcgccggcagttcggcgcccatctgctgcctgaccttcaggcgaccgttgtggctgagatcggctcggtcgcctctgtgctgctgggtgtgcaccaaatctacgaccaactgccgctgacgatttccagtctgctggtccgtcagggtcagtacacgatctccgtcacgccgctgcagtatcaggacatggatgtcggcgaggcggagcctttcgccgccctcaacaacggcttgtggctgttccacgttgagcagcgccccgtcgcagtcctgctctcgcattataccaaatacggtgaaggaaccttcgcccaggtcgaaatcgcgacgctgccggatccggcttcgctggccttcgcgcgcggcttcctcgccgccgttcagtcggccggtgcgaactcgacgctctatcgcggcaaagttctctccttcgaatccggatcggactattccggcatgaaggcggccatgcaggtgcacaagcttcccttcatcccgcgcgaggccgtgatcctcgaaaccgcgacgatggctcggctcgaccggcacgtcttcgagttcgaccggcatcgcgacgcgctgaagcggctcgggcaatcgacgcggaagggacttctgctgtacgggccgcccggcaccggcaagacgcatgtgatccggtacatcgcctcgaacctacccgagcgcacgacggtgctcatcacggcagaggaggttgtctacctagatcgctacatgctgctcgcacgcactctccaacccagcatcgtcgtgctggaggatgtcgatctggtcggccgctcccgcgagggcatgaacagtccgaagacggaggtgctcctcaaccgtttgctcaacgagatggacggcctgcgcgacgacgccgacgtgctgttcatcctcaccaccaaccggccggaggaaatcgaggaggcgctcgcctcgcgccctggccgtgtggacgaggcgatcgagatcgcaaaccccgacgcggcctgccgtacccggcttgtcagcctctacggagagtccatcgatttcgaggaaggggcgatcgatgccatcgtcacccgatcggaaggagcgagtgcggctttcatcaaggagatggtccgtcgtctcgcccaagccacgatcgccgcggggacgggcaatcggatcacggtcgcgacggtcgaatccgtcctcggcgaggccgtcggaagccgcaaccgcatcggtcgccgcatcgtcggcctggcgtccggcgcgcccgagcgtgccggcaagcaggcgccgcccttcgacagctgctgtgacgacctctag

SEQ ID NO: 7737 - DNA, 630 bp, Methylobacterium sp.
gtgttcatcgaggaggattggatggcagaactcgtggtgatcggcttcgaggatccgcaggaggcggatcgcgctctgaacgaattggcccgcctgcagacggaatatctgatcgatctcgaggatgcggtcgtcgccatccggagccctgacggcaagctgcggctcaagcaaagcgtcgatctggtcggcgccggggccgcctccggcggtatctggggcgcgatgtggggctcgctggtcggcctcgtcttcctcaacccgctgctcggcctcgcgacgggggccgccctcggactgggcgcgggcgccctgtcgggcaagcttgccgattacggcatcaacgatgacttcatccgctccgtcgccgaggcggtgcagccgaacacctcggcgctgttcatcctcgtgcgcaaggcgcagccggagaaggtgctcgcggagatgtcacggttccgagggcgcgtcatccgctcctcgctctcgccggagcaggagagccgcctgcaggccgccctgtcgcagcctgacgtgtcgatgcccggaagtgacggcgcgtcggccgaaccatccgcgggcagcacgggcgcgccgcctcccgggggctccggcaccgccgacggctcttga

SEQ ID NO: 7738 - DNA, 882 bp, Methylobacterium sp.
atgacgactcccgatcacgacacctcgccccccgacacctggaccttcttcgagggcgcgtggcaccccggcaatgtccggatcatggggccgcgcacccacggtgcgtggctcggctcgacggtgttcgacggcgcccgcgccttcgagggcgtcacgcccgacctcgacctgcacctcgcccgggtcaaccgctcggccaccgccctcgggctcacgccgaaggtcgggatcgaggaatgggcccggctcgtcgccgaggggctgacgcgctttgcgcccgacgccgaactctacatcaggccgatgtactgggccgagagcgggttcgccggcggcgtgcgcttcgatcccgcctccaccaactggtgcctgtcgctctacacggcgccgatgccgttgccgtcgggcgtcaaggcgacgctctcgcccttccgccgcccgtcgatcgaggtcgcccccgtcgatgccaaggccggctgcctctaccccaacggggcgcgggcgctcaccgaggctttgtcgcgcggcttcggcaattgcctgatgctcgacgggctcggcaacgtcgccgaattcgccaacgccaatgcgttcttcgcgcgggacggggtggtctacactccggtcccgaacgggacgttcctcgccggtatcacccgcggccgcgtcctcgcgctgttgcgcggggccggcgtcacggtggtggagaagacgctaagctacgaggacttcctcagcgccgacgaggtcttcaccgccggcaacttcgccaaggtcgccccggtcaccgggctcgatgacgtacgcttcgagccagggccggtgtttcgcctcgcacgccagctttactgggatttcgcgcacgggcggctgtcgtag

SEQ ID NO: 7739 - DNA, 882 bp, Methylobacterium sp.; identical to SEQ ID NO: 7738

SEQ ID NO: 7740 - DNA, 102 bp, Methylobacterium sp.
atgcggatgatgcaggcgttttcttacgggatgatcggtgcgctcgcgctcggcctcgcgaccaccgtgatcggttccgcgaacgtgttgctcaacctttga

SEQ ID NO: 7741 - DNA, 1251 bp, Methylobacterium sp.
atgatcctccggcgacgggcatcccaagcggccgcgctacagccgcgggagcatgcaaacacgcttgccgttgattacgcggccgttctgaacgcgctcccggtcaacgttctcgtcctccacccgacggaggcgaccatcaccttcgcgaaccagcgcagcatcgaaacactgcgcagcctgcgcgagcatctgccgacctccgtcaatccggacgcgatggtgggcctcaccatggacgtgttccataagaacccggcgcaccagcgcagcatcgtcgctgatcccgcccgcctgccctggcgcaccaagatccggctcggaccgaagacgctcgaccttcacgtctcgccggtccgcgacacggccggccgctacattgccgccgtgttgtcctgggccgacgtgacgccgttcaccgaatccatcgccagcttcgacgccgccgtccgaaccgctctcggtgaggccaccgcggccacgggcgcgatgcgcggggcggccgagcgcgttctctccgcgaccgacgcgacctcccgcgcggcggacagcgctgccaccggcgcgaccgacacgacggtgaacgtccaatccgtcgccgccgccgtcgaggaactgaccgcctcgaacggcgagatcactcggcaggtcaaccgctccagcgcggcgaccggacaggccgtgaccgaggccggcgcggccatggagagcgtcaaggcgctttccgagacgtcgcagcgcatcggcgaggtcgtcggtctaatcagctcgatcgccagtcagaccaacctgctcgcgctcaacgccaccatcgaggcggcccgggccggcgaggccggacggggcttcgccgtggtggcgaccgaggtcaaggtgctcgccggccagaccgcgcgggccaccggcgagatcgctcagcatatcgggctgatccaggcggcgaccgcccagacggtagcggccatcgagcggatttccggggtgatccgcggcctcgacgacggcgccaccaccatcgccgccgcggtcgaggagcaatcggccacggccggcgagatcagccggagcgcccgcgaggcggccgatcgcaccgggctcgtcgggggcagcatcgcccaggtcgccaccacggccgagacctcggccggctcggcccgctcggtcctctccgcgacgacgatcctcgaccagcagatggaacaggtgacgcgggcggttcaggaattcctggtcgaggtcaggcggatctga

SEQ ID NO: 7742 - DNA, 330 bp, Methylobacterium sp.
atgacccgatcgtggaccgccgccgcgcttttcaccgcgctgatgctcgcgcatctgcccgccccggtgcgggccgatccggccctctcgcccgcggagagaaagagcctgcccgccgaggtcgtgacctatctggatcggcacatgggctgcaaccactggtccggagaggacgcctacgatgcggcccgtggccggcagatcgccgccgccgtcaagacgctgcgctgcgacgccatcgaggcggacgcgaagcggttgcggcagcgctacggccgcgatccggcggtgcggaaggcgctcgatgcggccgcgcatgcggagggctga

SEQ ID NO: 7743 - DNA, 1767 bp, Methylobacterium sp.
atgcgttccagagatcagaaaaagctcgctcagcagcgatgcgccgagcagctcacccaaagcgttcgggggcccttcgtcttcctgttcgggatgtccggcatcatcaacatcttggcgttgaccggctcgttctacatgctgcaggtctacgaccgcgccctgccgagcgggagcctgccgacgctcgtcgggctgtcgatcctcgccgtcggcctctacctggcgcagggcctgttcgacgttctccgctcgcagatcctggttcgcctcggggcgcagttcgaccgccgggtcgctccgctggcgcagcgggtcgggatcgacatgccgcgcttcggcttctcgaccgcggaggcgatggagcgcggccgcgacgtcgacacggtgcgcggcttcctcggcagccccggtctcgtcgccctgttcgacctgccgtgggtgccggtcttcctcgtcttcgtctacatgctgcacccctatctcggcgcgctcaccgtcgcgggggcggtcgtcctcgcgctgctgaccatcctcgccgaactcctgacccggcgttggaccggcgcgacgcagcaggccgtggtggcccgcaacgccatcgcggactcgaacgcgcgcagcgccgacgtgctcaaggcgatgggcttcgccgaccgggccgtggaccgctaccgccgcgccaacgacgaacacctcgacctgcagacccgcaccaccgacatcagcggcacgttcggggcgatcgcgcgcgtcctgcgcatgatcctgcaatcggccgtgctcgggctcggcgcctacctcgtcatcggcggcgaactctccgccggggcgatcatcgcagcctcgatcacctccgcccgcgccatggcgcccatcgaccaggcgatcggcaactggaaggtcatcctggccgcgcggaccgccttccgccgcctgaaggagaccgtgatcgccctggccgccgccgagccgccaatgacgctgccgccggcgcaccggtcgctcagggtcggccacatcacggtcgcggcccccggctcgggtcgcgtgctcctctcggatgtagggttcgagctcaaggccgggcaggcgctcggcgtcatcggaccgagcggcggcggcaagaccaccctcggccgcgcgctgaccggtatctggccgctgctgcgcggtagcgtgcggctcgacgaggccgacctgccgcaatgggacgaggcgagcctgggagggatgatcggctacctgcctcaggaggtttgcctcctcgacgcgacggtcgaggagaacatctcgcgcctggccgaggacagcgatccggcgctggtcgtggcggccgcgcaggcggccggcgtgcacgagatgatcctgcggatgcccgacggctacaagaccgaactcgggccgctcgggacggcgctctcgggcgggcagcggcagcggatcgctctcgcccgcgcgctctacggtaatcccttcctcgtcgtcctcgacgagccgaacgcgaatctcgatgccgagggcgaggctgcgctcgccgcggcgatccagggcgtgcgtgcccgcggcggcctcgcgatcgtgattgcccaccgcccgagcgtgctggcggccgtggatcggatcgccgtgatccaggacggcaagctcacggcattcgggccgaaggaggcgatcctcggcaaggccgcccgcgacggtgcggccaagcccgacagcgcccaggacaacagggagcgctccatgccggagcgggtgcccgcatga

SEQ ID NO: 7744 - DNA, 858 bp, Methylobacterium sp.
gtgcatgcgacgtcgatcaacccgctcgacgcacagatccgccgcggtgactacgccgatcaggtcgaactgcctgccatcatcgggcacgacgtctccggggtggtcgaccaagtcggatcagacgtgacgaacttccgcgtgggggatgaggtctattacacgccgcagatctttagcgggccgggatcgtacgcggaataccatgtggcggacgccgagatcgtggcgcgaaagccggccaacctgacccattccgaggccgcgagcgtcagcctggtcggcgtgaccgtttgggaggggctggtcgagcgggcccggttgcaggtgaccgagaccgtcctgatccacggcggcgccggcggcgtcggggccatcgccgtccaggtcgccaaggccatcggcgcgcgggtcctggcgacggcacgaggcagcgacgcggcgctcgtcgaacggctcggcgcctcggccgtcatcgatttcgagcgcgaggactacgtggacgccgttgatcgcctgaccgaaggcaggggcgtcgacgtcgttctggatacgatcgggcgcgacacgctttcgcgttccccacgcatcctccgcgaggatgggcgagtcgtcaccctggtggacacggcgacgccccagaacctcatcgacgcctggggccggaacgcgacctaccacttcgttttctctcgccagaacggcagcaagctcgacgccctcacgcgcctcctcgagcgaggcctggtggtgccgcaagtcggcctggagtttcccctcgacgacgtcgcacgcgcccacgcgcgctccgaggagggccggctcaagggcaagatcgtgctcagagtcagatcgtga

SEQ ID NO: 7745 - DNA, 252 bp, Methylobacterium sp.
atgcgtaaggtgttgctcgtgacggccgccctcggtgggctgatcatccaggaggctcccagcttcgcgcagggctttcgggtcggtccagggggcgtcgaaatcgatgatgggcgcggctaccgcgaggatcggcaggagcgccgctaccgccggatgtgccgcgagcttcgcgacgcttgcgagaacaaggacatctacggtgaggagggccaaggcaattgccgacgctatcgccgcacctgcggctga

SEQ ID NO: 7746 - DNA, 1122 bp, Methylobacterium sp.
atgaacggtcaggccgaaacccgtatcaccgagcgcaaccgagcccgcgccgcgcgcatgaaggcggcgatcttcgtcgagccggggcgcatcgtgctggatgagaagccggtccccgagatcgggccgctcgatgccctcatccgcatcacgacgacgacgatctgcggcaccgacatccacatcctcaagggcgagtatccggtcgcgcgcggcctgacgatcggccacgagccggtcgggatcatcgagcggctcggcagcgcggtccaggggttccaggagggccagcgggtggtggccggcgcgatcacgccgtccgggcacagcgccgcctgcctctgcggctgcctctcgcaggacggcccggacacgaagtacggcttcaagcccatgggcggctggcgcttcggcaacaccatcgacggctcccaggccgaatacctcctcgtgcccgacgccatgacgaacctcgcccccattccggacgatctgagcgacgagcaggttctcatgtgtcccgacatcatgtcgacgggcttctccggtgccgagagcggcggcgtgcggatcggtgacacggtcgcggtcttcgcccaggggccgatcggcctctgcgccacggccggcgcgcggctgatgggggccacgcggatcatcgccgtggaatgcgtgcccgagcgccagcgggtcgcccgcagcatgggcgcggacgagatcgtggatttctccaaggaagatccggtcgatgcgatcctgcggatcaccgacggccggggcgtcgatgtggcgatcgaggcgctggggcggcaatcgaccttcgaggcggccctgcgcgtgctgcgcccaggcggaacgctcgcctccctcggcgtctattcggaggatctgcgcatcccgctcggacccttcgtggcggggctcggcaaccacaccatcgtcaccacgctctgccccggcgggaaggagcgcatgcgccgcctgatgtcggtcgtcgcctccggccgcatcgatgcccgcgcgctcgtcacgcaccggttcaggctggaggcgatcgaggaggcctacgacctcttcgcgcaccagcgcgacggcgtgttgaaggtcgcgatcacgccctga

SEQ ID NO: 7747 - DNA, 348 bp, Methylobacterium sp.
atgaagcttcccctggttaccgccgtcatcctcgcagcttgcaccccgcttgctgaggaggccggcgcgcaggatctgcagcccggcatgcggacgatgctccagcagggcggcgccgagggtctgccgctcgtccccgtccatcccgacgatctggacgacgacaagctgcagccgggcatgcgcacgatgatccagcgcggtggaagcgagggcgtgcagctcggcgcgctcctgccccgcgcctatgatccctatgatgggccgggctacgacccatcctatcccccgcccgcctacgagacccgtcctgatcggcgccgggagccgcttcgcgcgcggaactag

SEQ ID NO: 7748 - DNA, 231 bp, Methylobacterium sp.
atgtcggcggtcgcagcctccgccacgggggacggcctgactgcaatcgggtcggaacgcgcgggaaggcatccggtgcaaaccgaggcgatcgcgatccgggcgcgccggtcgctgcgctcccagacggattcgcgcgccgtcgccgcggcggccggcccggaggccgcagttccagaggtcgaagtcccggcgagccgggcgtccgggttcgcgcggatccgcagatag

SEQ ID NO: 7749 - DNA, 216 bp, Methylobacterium sp.
atggcggtatcggcgaccaggaagacatctcgcattcgcagtctctggccgagctggaatccgggactgctctccgccgccgcgcctccgctggaccggcgctccatcgacctgcaccccatcgaatccgaggcgcgcctgccgtcgcacaacctcaccgctaacgaactcatcgccatggcccgcgccgcccgggcgcgccgcctcgatccgtga

SEQ ID NO: 7750 - DNA, 936 bp, Methylobacterium sp.
atgaccctgcacgagcccctcggcctcatcgacgcggcgcgcgaactgcgcggtttccagaccgagccagcgcagatgcgggcgggcgcgcccggcaaggtcggccgcttgcgcctcgggttctcgctgcgcgacgggcgctccgtgctccacgacctctaccgggtcgccccgttgctggtgcagcaggcgctctactgggacgaggcgatgccggaactgccggtctgcccgatcatctccgtcggcggcggcatcctgcagggcgaccgctacacgatcgccatcgcggtgggggagggcgcctgcgcgcacgtctcgacccaaggcgccaaccgcatccactgcatggacgcgaacttcgcctcgcagcaccaggccgtgaccgtcgaggccggcggctacctcgaatacttgccggacttcaccattccctatcgcggctcgcgcttcctctcgcgcacggacctcgtcgtcgccgcggacgccaccctgctctacggcgagatggttctcgccggccgcaagcatcatcatgtcgaggagcggttcggcttcgacctgctgtcgatggatgtgagcctgcgacggcccggcgggcataagctcttcgcggaaaagatcctgatcgagaagggtgatccgacgatcgccttcgcggcggtgatgcgcggcttcgacgccttcgccaacatcctctgcgtcacccctcccgagacggccgcccgcatcaaggaacggttcgagccccatttcccgatcgaggcgccacgggcgctgtccggtgtgagccgcctgcccaacgccgccgggctgatgctgcgcgccgtcggcgtggagagctacgacgtgcgccatgaggttcgccggttctggcgcatcgtgcgcgaggaggcgcgcgaccggtctcttcccgccgaaccctactggcgctga

SEQ ID NO: 7751 - DNA, 1041 bp, Methylobacterium sp.
atgccgcgagcgaacagcaaccttctcgtccagtcgctgcgcgggacgagccaagtcttcttcatggagaatgccctgacgggcgtgctgttcttcgccgcgatggcctacgcctcctcggtgacgggcaattgggccaccacggtcggggcggcgatcggcgtcctcgtcgcaacgctgaccgcccgacttctggaatgcgacgacccttccgtctcctccggtctctacggattcaacggcgttctcgtcggggccgcgctaccgaccttcatcgcagcctcgccccagctctgggcctcgatcgtgatcggcgcggcggcgagcacggtcttcaccgccgccttcagcgcgacgctcaccggcaaatggggcattcccggctcgaccggccccttcgtgctgacgggctggctgatggtcgccgcggcctattccttcggcggcctgcacgtgacgggcgacgcccccaagctcgcgggtgacgtcgcgcctaacctcaccggcattccggcgccaatggacctcgtcgcgatctttttccgcaacatcgcgcaggtctacctgctgggtagcgccgtcagcggcgtcatcatcctagccggcatcctgatcgcctcggtcccggccgggatcgccgccgccgccggatcgctgatcagcatgatcgtcgcgatcgcgatgggtgccgatcccaaggccgtgagccagggcctctacggcttcagcccggtcctgacggcgatggccgtcggcgtcgtcttcctgacgccctcgccgcgggtggccgtctatgccggtctcgcgaccgtgatgaccgtcttcgtccagggcgccctcgacgtcatggtcgcgccggcgggcatcccgtccttcaccgccccctacgtgctgacgatgtacctgttcatcgcgccgaagaagctgatggcgccccatccgcacgggcccgtcgccgatcccatgatcgacgatcaaggcaaggcgccgggcaaggtttcgggcaaggcaccggtccacgcggccggaaccgcacggtga

SEQ ID NO: 7752 - DNA, 1239 bp, Methylobacterium sp.
atgcaaggcatcaatgccggcgacacggccttcatcctcatctgcaccgctctggtcctcatgatgacgccggctcttgccctcttctacggcggcctcgtcagacagcgcgatgtcctgtccgtcatgatccagaatttcgtctgcatcggtgtggtcggcgtgatctgggtgttcggaggtttcagcctcgccttcgggcctgatatcggcggcacgatcggtaatttcgcgtattacttcggcatgtacgaggtcggcatcgagccaaatccggtctacgctcccaatatccccttcatcatggtctttgcctaccagatgatgttcgccatcatcacgccggccctgatgaccggcgccttcgtcgggcgcttccagttcggcgcctacctgttcttcatcacggcctggaccatcctcgtctatgtgccggccgcgcactgggtctggggcggaggcttcctggccaagctgggcgtcgtcgatttcgccggcgggatcgtcattcacacctccgcgggtttttcggcgctggcgacggcgaagtttctcggcaaacgcagggtggcggcgggcgaatccgaatcggcgccggccagcctgcccctggtcgctctcggcgccggtctgctgtggttcggctggttcggcttcaacgccggtggcgcctacgcggcggatgcgctggcggcctacgccttcaccaacaccatgctcgccggttccatcgccatgctggtgtggatgttctgggaatggcgcgagaccaagcacccgtccttttccggcgtcctcgtcggcgccgtggcggggctcgcgacgatcacgccggcctccggttatgtcgagcccatcgccgccctggcgatcggcgccatcggcgcgacggcctgctactttgcgaagtacgtccagaagtggctgaagatcgacgacacgctggaagtctggcgcgcccacggcgtcggcggcctcaccggtgccctgctcatcggcatcatggccagttcgcatatcaaccaagtctcggcgagcctgcagcagttcggggttcagcttctcgccgtcctcgtcgtcggtgcttatgcctccttcgtcaccttcatgatcctgacgggcctggatcgcttcggcacgctgcgggtgccggaaaagatccaggaagaaggcctcgacacgatgctcggcgagcgcgccttcaacctgtggaacatggatcgcaccctcccgaagtag

SEQ ID NO: 7753 - DNA, 522 bp, Methylobacterium sp.
atgacgatcggatcgccgaaattcttggccggcgcggcactcgccttctttctgctggccggcagcgccgcccttgccaagaaggttacggtcgtcaccggagatcgaccgatttccgtcgagatcccggctgcgtggaaggtgaccacgatcgaccgtggcgtccaggcgcggaccgcggacgaggaaatctatctctggttcgagagctacaagcccacccagttcgacaccctgctcggcgagcacaacgcctacttcaaggaacaaggggtcaaggtgaccggcgagggccagtcgaaggaggtcgatttcccgacctacgccctcaaggtcaccgaatatccggcgacctacgagggcaagccgacggtgctgcgctacctctcggtcgtgccgaaagccgagagccagcgccatctgctggtgagctactgggcctcgccggagggtgacaagaagtacgacgccgagacgaaccagatcatgaacagtctcgccgcctcctacgacggcaagtaa

SEQ ID NO: 7754 - DNA, 1527 bp, Methylobacterium sp.
atgaagatcctgctcgtcaacgtgccccatccggcgatcggcagccggatccccgacgaccatctgcctccgctgggtcttctcgccatcggcggcccgttgatcgatgacgggcatgccgtctcgctcatcgacgccgagttcggacccgtgccgctgccggacctcgtccgggagatcgtggcgcaggcacccgaggcggtcctgttcggtcattccggctcgacctcggggcacccggtcatcgcggaggtgtcgtcgagggtggccgcggcgatgccgggcgtgacgatcgtctacggtggcgtctttccaacctatcacgcgcgcgagattctcgaggccgagccccacgtcgccgcgatcgtgcgcggggagggcgaggagaccgcccggcggctcatggcggccctcgcggcgggacggtcgctcggcaccgtgcccggcctcgcctaccgcgacggcgacgcgatccgcgagacggcgccggccccgctgatccgcgatctcgacgcctaccggatcggctgggagctgatcgaccatgcccgttacagctactggggcggtctgcgtgcggtcgtcgtccagttctcccgcggctgcccgcatccctgcacctattgcggccagcgcggcttctggacccgctggcgccaccgcgatcccgtccgcttcgccgccgaactcgcccggcttcaccgcgagcacggcgtgcgggtgatcaacttcgccgacgagaatccgaccgtctcgaaaaaggtctggcgcaccttcctggaagcgctgattgcggagaacgtcgatctcatcctggtcggctcgacgcgggcggacgacatcgtgcgcgatgccgacatcctgccgctctacaagcgggcggggtgggagcgcttcctgctcggtctcgagagcaccgatacggccaccctcgacctgatccgcaagggcgccaccacgacgaccgaccgcgaggcgatccgcctcctgcgggcgaacggcatcctctccatggcgacctgggtggtgggcttcgaggaggagcgcgaccgcgactactggcgcggcctgcggcagctcctcgcctacgaccccgaccagatccagatgctctacgtcacgccgcatcgctggacgccctatttccggcttgccgaggagcgccgcgtgatccagctcgaccggcggcggtgggactacaagcatcaggtgctcgccacccgccacatgccgccctggcgggtgctgctctggttcaagctgatcgaggtgatccttcaggcccgcccgaaggcgctggcgcgcatctacctgaaccgcgatcctcgcctgcgccacgccatgcgctggtacacgcggatgggccggcgagtctggtcccacgagatcctggcttggctgcgcgatccgctgacacggacgggcccgacggtcgtggcgttctggggcagggggcaagagcgggaggaggcgatggccgtgcgcgccgcggcccgatcccgtccggctggtcgcgaggccgcctga

SEQ ID NO: 7755 - DNA, 867 bp, Methylobacterium sp.
gtgctcctgcttggcggcgcgatcctgctctggggggcgaactggccggtgatgaagctcggtctcggccatgtttcgcccctgtggttctccgctgcccggttcgccacgggggccgcctgcctgttcgcttggcaggccctgcgcggcgaggtgtggtggcctcagcgcagggacctgcctcgcgtcgcctccatcggcttgtttcagatgatgctgttcacagccctcgggaccgtggcgatgaggcatcttccggcggggcggtcggcgatcttgagctacaccacgcccctctgggtgctcccggtcgcggtcctggtgttcggcgaacggatcgagcgtcggcattgggccggtctcggcttggctgggctcggcgttctcgttcttctcaatccgcacgcggtcgactggggggacggtcaggtcgtcggcgccaacgccatgctggtggcggcctcgctcgcctgggccgtgtgcatcctgcacctgcgctacgggcgcgcctcggcctcggcctcggcgatccagctcgcgccctggcagatgctcgtcgccgcggccaccctggccccgctggcctatgccgtcgagggtcccttcacgggcgacggcacggcggccttctgggcctgcctcggcttcgtggggcccgtcgccacggccttctgcttctgcgccgtcaacgcggcgagcgcccggctgccggccagcacgaccgcgaccctgatgatggcggtgccggtcaccggtctcgccctctccacggcaaccctgcacgaagacccgagcctcgacctgatcgtcggagccctcgcgatcgtgctcggcatcgccgcgagcgcgcaacgatcccatccctga

SEQ ID NO: 7756 - DNA, 1476 bp, Methylobacterium sp.
atgacgacctacacagccacgcgcggagccattccgctctcctccttcgatcggcctgccgcacccgccgggcagtccccttccattacgccggcgcagctcctggcgatgctcaggcaccgccgtcggctcatcgccctctcgatgatcctcggcacgctgggcggcgtactcgtcgtcgcgcggacggaaccgaactacgtcgccaccgcccaggtcatcatcgatccgcgcgccttgcgcgtggtcgaacgggaggtgacgccgagcatcgacaacgccgacgcgcagatcgcatcggtcgagaacgagatgcgcgtcctgcggtcgagcacggtgctcaacgccctgatcacccgcgaccggctcgacgaggatcccgaattcaccggcgagccgcccggcctgctgcgccgggcgaaggccgcgatcctcgaccgcgtcggcctgtcgccgccccgctcgcccgatccgcgccgcgcggcgctccagaccctggagcgcaagatcgccgtccgccgggccgagcgcagcttcgtcgtcgaggtgcatgtcgcaacccgtgatcccgacaagtcggcccggatcgcgaacgaactcgtgacgctctacaccgagcaggcgaaccggacccggtccgagctcgcgcgccgctccggcgcctccctcgacgatcgcctcgccgaattgcgcgccgccgtgcgcgccgcggagaaccgggtcgcgaccttcaggagcgagcacgacctcgtcagcgccgacggcgccctcaccagagaccggcgcctgcgcgacctcaacacgcagctcgccgccgcccgggcccggtccaccgaggccctcgtccggatggagcaggcgaacgccctgcgcggccggctcgacggcctgtcggaggccgtccagtcccaggccatgatccagttgcgctaccagatcaccgaggcccgtcgccgccgggccaacctcgccaacgtgctgggaccgcgccatcccgagctgaactcgatcagccgcgagatcgatgcccttcaggatcagctcggccaggagctgcagcggatcggcgacgcggcacggaacgattatcgccgagccaagcagaccgaggaggagctgcgcaggacggtggagacgatgtcgaccgcctcgctcgccgacgaccgcgcgctcgctgagctgcgggcgcgggaggcggaggcagaggcccagcgcaagctgttcgcccagtatctcgtgcgctctcgcgaactcatcgagcagacgcaggtcgacgtgaacaacatccgcgtgatcggcgcggcgatcccgcccgaactgccgacaaacctgagcaaggccatcgtcctcgtgctcggaacgctgatcggcctggcgctcggcatcctggcggcgatcgccctcggcgtcctgcgcggcgaggcggcgcccctgccgcgctacccggtcgggtcgggcgaagcggtgatcgcctga

SEQ ID NO: 7757 - DNA, 2127 bp, Methylobacterium sp.
atgacgatcgagatcaagggcacgaagcccgggcgggacgcgcccgagggtgccgagcgctacgtctcgcgcagcgccgaccggcgatccggcgtcccctacttcgccgcggtggcggtcgcgtccgtcgccgcctacctcaaatccctgcttctgccccgcgcaaccctggcagaggaagtggacccggagatcgtggcggcacgcgccgacgccctgcgcctcgtccattccgaggaactcgccgcgcccacccctgcaaaggccgccgaggcaccgaagccactggccgagccgccatccccggttctgcaatccggcatgtccctgttcgatgacgggcacgaactgctcgcgcgcgggctgcgcttcgcaaggcccgacgcgcatccggacctcggcgacttcaaggcctctccggtcatcccccagccgatcaacgacaacggcggctccctcgcagccggatcgggcgggcgcggaggtgggcagccgagcggcggcggcggccggccacgggacgcatcccacccggaaccggatgcgcaggagcccggcaacgaggcacagccggccccccgaccgctgggagaggagaaggctgacaggccggatcaaggcttggccgggcaaggctcgaccgggcaaggctcgacagggcaaggcggatcgaacccacaggatcctgggccgtcggacggcggcgtccggatccctcccggctccacgccgggcggcgatccgcgtcccgtcgatcccgcgacgccgccgcgcggccgggacgacggaccggcggggcaacgcaaccgcgcgcccgtggtgaacggcccggtccagctcggggatatcgcgggctgcgcactcctcaccatcgccctgagcgatctcctgcgcggcgccagcgatccggacggagacgcactcagcgtgcgcgacgtccgggtctcctccggcaccgtgacggcggacggctcgggttgggttttcgacgccgatgcgcctggtccggtcacgatcacctacgcggtgacggacggcgagttctcggtcgcccgcacggctcatctgaccgtcctcgaacgggccttgatcggcggcacggacggggacgacctcatcctcggcacaccctgcgcggacgacatcgcggccggcgcgggcgacgataatgtcgacgcccgcggtggcgacgacctcgtcgatgccggcagcggcagcgaccacgtgatcgcgggcgacggcgccgacacggtcctgggcgggccgggcgacgaccttctgttcggcgaggcgggcgacgatctgctcgatggcggcgagggccgcgacatcctggatgggggcgacggtgacgatctcctccttggaggcgagggcaacgatagcctctacggcgcggccggcgccgacgacctgtccggcggcaccggtgccgacgtgctcgtcggggatgcgggcgacgaccggctgcagggcggcgagggtgcggacatcctctcggacggggccgggcgtgacctcgtgtcaggcgaggcgggcgacgacgtgatcatcctcgccctcgacagcgcggaggacacggtcgacggcggtgcggggcgggacacgctcgacctgtcggcggccacggtcgatctggtggtggacctgaggaacgagaccgtctccgctcaagaactcggcctcgaccggatcgcctcggtcgaggcgatcatcgcgggatcgggcgacgaccgcttcgtggtgggcggccgggatatcgtgctcaccggcggcggcggcgacgacgtgtacgcgttcgccgctccggccgagccgcgcgatggcacccgcaccgtgcagatcacggacttctccgtcggcgattacatcgatctggtccgctacgccctgttcaaggaggagaccgcggccgggcgcccgctcgcggaggcgctccggggcgaaagcgatgcaccgaccgggatccagtgccggttcgatcgttccgaaggccgggaccgcacggtcgtctcggccgacctcgaccatgacgaggcctacgaaaccaccgtcgtcctcgatggcgagcacttgctgcgcttcacgatcgggccgctgcccgaaccgccgacattccacacttga

SEQ ID NO: 7758 - DNA, 519 bp, Methylobacterium sp.
gtggcggacccgcaggcgacggttcacggcgtggacgagaatgacctgtccggcccgtccggaggtcctgacctgacgtcgccgtctgcaccggctgcgcaggaggcgatcgcaccggcccatcccgatcgaggacaggtcgatgacgtcctttcggtcaccggccgcaccgaccgcgaggcgcccggacaggcggcccttccggtcaaggtcaacgagccgacccagccgcctgtacaggtcgaagccgatctggcgggcgggcctttgccaaacagccaatccggctccgcggcgtcccagggggcgtccggtcaagcgaagccgggccggccaagccctccgcccgcggcgatcgacgcggacggcaatctcgtgttccacacggacgcccctcaggatccggcgccatcagcccttccacacgggccggacgaagcaacgacccatcacacggtcggcctgatcggggtcacggatcagacgcatccggtgcacgacatgtatcaccacacctag

SEQ ID NO: 7759 - DNA, 906 bp, Methylobacterium sp.
atgacgcgtaaggcggcgtcctttccccgcggccgggcgctgccggtggccggcgtcgtgctggcgcttctcgctggctggtacctcgccgccctgctcggcaactggaacggcgccgcggacgcgctggtgcgggccggcgcggcgccggacgctgcgggcatcgctgcggcgacgatggcgcaggaacggccagtcgtgccggcaccgcatcaggtggtctcagaactgtcgcgcagcgtcctcggcgtgccgctgagttcgaagcgcagcctcgtctatcacgcctgggtcaccctctcggcgacgctcaccggcttcgccctcggctcgctgctcggcatcgcgctcgcgatcgcgatcgtgcacctgcgcagcgtcgaggcgagcctgatgccctggatcgtcgcctcgcagaccgtgccgatcctggccgtggcgccgatcatcatcgtggcgctcggcgcggccggcctgaccggccttctgccgaaggcggtgatcgcggcctatctctgcttcttccccgtcacggtcggcatggtgaaggggctgaacgcccccgaccggatccagcgcgacttgatgcggacctactcggcctcgcgcgggcagatcctggcgcggctgcgctggccggccgccctgccctacctgttcgcgagcctgaagatcgcggtggcggcgagcctcgtcggcaccatcgtcgccgaattgccgaccggggcgcaggccgggctcggggcgcggctgctcgccggctcctattacggccagacgatccagatctgggcggccctgttcgcggcggcggcgctctcggcgctcctcgtccaggggatcggccttgcggaacgtgcgagcgcccgcgccctcggcgcccggcccgcggggagtgcccgatga

SEQ ID NO: 7760 - DNA, 966 bp, Methylobacterium sp.
atgacgcgtcgcgccacacggatcggcctgctcacgcccgccgcgctgatcggcggggcagcactcgccatcgccgcccaccggcccggcctagccggcgcggcggggccgggcttctggctcgccgccttcctgatctggctcgccgccacgctggccgcgcgcgacctcgccgccctggagccgggccatgcggcgggccgccgcctcgtgcggctggccgtgccgctgctgttcggcgtcctcgtgctggtgctgtgggaagtcgtcgtggtgggtgcgggggtgcccgccgtgctgatgccaccgccctccgccgtcgccgagcgcttcgccacggcgctgcccgtcctcggggcggatctcgtccagacctgcctgaaatcggccctgccgggctacgccatcggctgcctgtcgggcctcggcgttgcgatcctggccgaccggctgcccgtgctcgggcgcggcctcctgccggtggcgaacgtcgcctccgcgctccccatcgtcggcatcgccccgatcatggtgatgtggttcggcttcgactggccgtcgaaggcggcggtggtcgccgtgatgaccttcttcccgatgctggtgcaggccggcgccggcctcgccgccacgggttcgatcgagcgcgacctgatgcgcacctacgcggcgggctatgcgcgcacgctcctgagcctgcgcctgcccatggccctgcccttcctgttcaccgccctgaaggtcaacgcgacgctggcgctgatcggggcgatcgtggccgagttcttcggcacgcccatcgtcggcatgggcttccgcatctcgatcgaggcggcgcggctctccctcgacatggtctgggccgagatcgtgctggcggccctggcgggctcggccttctacggcctcatcgccctggccgagcgcgccgcgaccggctggcacccatcggtgcgcgccggctga

SEQ ID NO: 7761 - DNA, 120 bp, Methylobacterium sp.
atggggcgcatccgttctccggacccgacggcagcacaggaccgcgccgtcgccgccacgctctgcgtgctggtcttcctggaatgtctgaccctgatcgcgagcctgatctggctctaa

SEQ ID NO: 7762 - DNA, 294 bp, Methylobacterium sp.
atgcaggcgggcgagacccgatacggcggcgttgcgcaccgttcgggccggcgaccggaggatacggtgatggccgaaaacgtctcagatcacgccgcggaccgcgctctggcggatctcgtggacgcgttcggtcactactccgatgccgagatgcaggcttttctcgatgcgacgccgttcgcggccgagatgcgctgcggagtctcgctcgccaaaccggccgggcccgaatggctggctgccgcgggatttgctgcaggcgaagtcgcggttcaggcggcgcgggcgtag

SEQ ID NO: 7763 - DNA, 207 bp, Methylobacterium sp.
atggccctggccttcgaccgcacccgcctcctccaggcctttgagctgctgggcgcggatctgtccgcgcgggggctgttcgtcgaactcgccgtctacggaggcggggcggcgctgcacgacctgtacgtctccgtctacgacgagacgccacccgatgaggcgagcctgcgcttccggtcggtgcttcaggatggcccacgatga

SEQ ID NO: 7764 - DNA, 912 bp, Methylobacterium sp.
gtgctcgaccgcgtgacgggaatgcaggtcttctgccgcgtcgccgcactcggcagcttctcggccgccgggcgggcgctcggcctctcgcagaccggggtgaccaagcatgtcgcggccctggaggcgcggctcggaacgcggctcctgcaccggacgacccgccgcctgacgctcaccgaaaccggccggacctatctcgaggcctgcgagcgtattctcgccgagatcgacgacgcggaggcggcggtcggtgccgaaggggtcgaggcccacggcaccctgcggctcaacgtgccgctctccttcggcgtgcgggagatcgccccggcgctcgcggcgttctccgccgcgcatccggcgctgacgatcgaactcggcctcaacgaccggcgggtcgacctgatcgaggaggggtgggatctcgccgtgcggatcgggaccctcgccgattcggggctgatcgcccggcgtctcacatccagccgcctcgtggcctgcggcgcgcccgcctatttcgagcggcacggcacgccgcgccggcccgaggagctgaagaaccacaattgcctgggctacaccctgtcggattccagcggctggcacttcggcgagcaggcctacccggtctcgggcaacctgcgggcgccgaacggcgccgccctgacggctgcggccatggccggcctcgggctgatctaccagccgacctttctggtggcgcaggccctgcgggcgggaacgctcgtccccctcgatttcggcaccccctccccggttctgccgatccacgccctgatgccgccgggccggcgcccggccaagacgtgcgccttcgtggagtttctggtgcagcggttcgcgggcgagccggcctgggagcgggatctgccggaggctttgcggcggtga

SEQ ID NO: 7765 - DNA, 261 bp, Methylobacterium sp.
atgctcgcccaggtcgcacagcgccgcagggaccaggggctcaagctcaaccatccggaaaccgtctccctcatctccgtcgccgccctggacggcgctcgcgccggcaagacggtggaagaagtgatggaactcgcaggcaaaaccatcacgcgcgacgacgtcatggacggggtcgcggaaatgattccctacgtgcaggtcgaagcggtgttcacggacggctcgcgcctcatcacggtgcatgctcccatcaagtaa

SEQ ID NO: 7766 - DNA, 411 bp, Methylobacterium sp.
atgagtcctccccagaagaaggcgcccgtcggcggaattattttcggttcaggggatatcgagatcaatgccggatatcccacgacggcgatcaaggtccgaaacacgggtgatcgcccaatccaagtcgggtcgcactaccatttcttcgaggtgaacgcctcgctggaattcgatcgcgagcaagccttcggcaagcgtctcaacatcccggccacgaccgctctccggttcgagcccggagacgagaaggaggtctcgctcgttccctatcagggcaagcagcgggtgctcggcttcaatggcctcgtcgacggctgggtcggcgacgaaacctacgacgattaccgcccacggctgtcggacgcgctggatcgcgtgaaccgctacgggttcaagaacaagccgtaa

SEQ ID NO: 7767 - DNA, 384 bp, Methylobacterium sp.
atgggggcgcaggccgtcttcgtcttcatcggtggcgggttcggcgctctcacccgcgaattcctcatgctgctgatccctcagcacagcggcgcctttccgctcgacatcttcaccgccaacgtcgtcgcctcgttctgcctcggcgccgccttcgaacttcaccgcctgaaccaagtctcggacgagtacctgctcctgatcggcacgggcttcgctggcggaatgtcgacgttctcgagcttcgtctacggcatcacttccgaagccgcgtcgccgggccaagccggtcttgccgtcctctactgtttgtccagcctgatcgtcggctacgccgcgatctggctcggaatcgcatccgggaaacgcctgcgccgcgcgtga

SEQ ID NO: 7768 - DNA, 663 bp, Methylobacterium sp.
atgatcctcgtcgaacacaaactcggtcatctcggcgatccggtctggcaggagcgcgcggggcaggcgcgcatcgatccgctggtgctggagcaatgggaggcgcccaagagccgcctgcgcaaggcgaccgagagcgggatcgagctggcgatctcgctgccgcgctccgagcacctgcatgacggcgacgtgctccactacgacgcggcgcaggggctcatcgtcgtggcccggatcgccctcaaggaggtgctggtcatcgagctggaggggctggagagcctcgcgccgcacgagatcctgcgcgcctccttcgaactcgggcacggcctcggcaaccagcactggcccgccgtgatcaagggatcgacggtctacgtgccgctttcggtcgatcagaagctgatggcctcggtcatgcgcacgcacgccttcgcccatgtgaagacccgcttcgccccgggcgaggaggtggcggcccaactcgacgcgaaggaggtccggctgctgtttgctggcgccgacgccaccccgcatcaccatcacgacggtcacgaggctgcacaggcccatgacccccatgatcaccacgaccaccctgatcacgcgcacgatcatggtcacccgcacactcatcaccaccatgatccggtggcgtga

SEQ ID NO: 7769 - DNA, 681 bp, Methylobacterium sp.
atggctcatctcgcgcgcctgctgcaattctcggattcgacgctgccgatcggctcctttgccttctcgaacggcctcgaatccgcgctgcagacggggatcgtcaccgacgcgagcagcctgctgcatttcgtcgaactcgtcctgcaccagaacgcccgggtggacggcgtcgcgctgctgcacgcccatcgcgccgccctggcggaggactattccggcatcgtcacggccgaccgagaattgctctgccgccgcgtcggggaagagcagcagctgatgctgacgcggatgggcaagaagctcgccgagctggcgctcaagatcggcccctcgccggtgctggagcgctggctcgcggatatccggtcggacaccacccccggctgcctgccgatcggtcaggcgatcaccctcgcacatctcggcgcggacgagacggacgccttcgtcgtccaccaatacggcatggcctcgatgatcctgagcgccgcgcttcggctgatgcggatcgaccatttcgagacccagcgcatcctgttcgccgcccagggccgcgtcgaggacgactacctcgcggtgcgcgatcttgccctcgacgaaatggccgccttcgcgccggtcttcgacgtgctcgttgctcatcacaccacggtccatgtccgcctgttcatgaattga

SEQ ID NO: 7770 - DNA, 648 bp, Methylobacterium sp.
atgaagaagatcacccgtatcggcatcggcggcccggtcggatccggcaagacggctgttatcgagaccatcacgccgcgcctgatcgcgctggggatcaagccgctgatcatcaccaacgacgtcgtcacgacggaggatgccaagcaggtgcgccggactctccacggcgtgctgatcgaggagaagatcgttggcgtcgagaccggggcctgcccacacacggcggtccgcgaagatccgtcgatgaacatcgccgcggtcgaggaactcgaagacaagtatcccgacagcgacgtgatcctgattgaatccggcggcgataacctcacgctcaccttcagcccggcgctggcggacttctacatctacgtgatcgacgtcgccgccggcgacaagatcccgcgcaagaacggcgccggggtctgccagtcggacatcctcgtgatcaacaagaaggacctcgctccctatgtcggcgcgagcctcgacgtcatggcgcgcgactccaagctcatgcgcggcaagaagccgttcctcttcaccaactgcaagaccggcgagggtgtcgacgacctcctccagctcattctcgacatggcgctgttcgatgtgaggacgcgtcctccgctcgcggcgagcgcgtga

SEQ ID NO: 7771 - DNA, 381 bp, Methylobacterium sp.
atgggttcacttgccgccgagctccgactcctgggtgtggccgccgctctcggcggcttgctggtgatgatgttggctggtgagccgaacatcgcttcggtgggctggggcttcgtcggtctcattttcttcggagcgacccggctcgtcctgtaccgtaagccggcgccggcgattgcaaagaaagcggtcgccgtggagccagcgcacccgacggacacgacgcacgggagcgaagccagccttcccgttgctgcggtgccgggcgatgtccatgccgcactccaccgcaaagttcgcctgatacgcccaacaagcccgatgctggcctcctcggtcctgccccgctcacgggttgcccggtcgccgtcgacgacctga

SEQ ID NO: 7772 - DNA, 180 bp, Methylobacterium sp.
gtgccgaccttgaccagcgccgtcttgagcctgtggtccgcctactgggcggcgatcttcgcacaagtcgcccacttgcgagcgcttgatgatggcgtgggcgtcagcgcgtttgcccgactctcgagaagcctcctggccgtggggttcgggttcctcctgatcgccaagctcatgtga

SEQ ID NO: 7773 - DNA, 1833 bp, Methylobacterium sp.
atggaccagactttcgccgcagcgccctcccccgatccgctcgaggggcgcccggaaccggacagcgcggccccgccgccccggccctcctccaccgccggctggctcggggccctggcccgcacggcgcggatcgacgcgagcccggagcgcatcttccccctcgtgctggacgccgtcgcggccgagcgcccgcacgcgccggccctgatcggccgggacgagaccctgagccatcgggagctcgccgcccgccgcaaccgctacgctcgctgggcgctggggcgcgggctcgccaagggcgacaccgtcgccctcctgatgcggaactgcccggattatctcgcggtctggctcgggctcacccgcgtcggcgtctgcgtggctctgctcaacacccacctgcgcggcgccggcctcgcccattgccttacggtcgccgcccctcgcctcgtcatcgccgccgccgacctcgccgaggtgctagagggagctctgccccatctcgccgagccgccggagatcgtgtggcaggggacggacgcgaacgacacgttcgccgcggcgtcggcggggtttcgcgaggctccgctcgggcccgacgaggcgccctccgtcacgctgcgcgatcccgcgctgctgatctacacctccggcaccaccggcctgccgaaggcggcgcgggtgagccaccaccgagtgatgatgtggacccattggttcgccggcctgatcgacccgacgcccgacgaccgcatgtacgattgcctgccgctctatcacagcgtcggcggcgtggtggcgccgggctcggtgctgctcggcggcggctcggtggtgatccgcgagaaattttccgccagccggttctgggccgacgtggccgagagcggggcgaccctgttccagtatatcggcgagctgtgccgctatctcacgctcgccgcccccgaccccgccgagggtcggcaccgcctgcggctctgcaccggcaacgggatgcgcgcggacgtctgggaggcgttccaggcgcgcttcgcgatcccccgcatcctcgaattctacgccgcgaccgagggcaccctctcgctctacaacgtcgagggccgggtcggcgcggtggggcgcgtgccctccttcatggcccggcgctcgccggccctgatcgtccgccacgacgtcaccacgggcctgccggcgcgcgacgcgcgggggcgctgcatcccggccgagttcggcgaggccggcgaattgctcggccggctctcggagcgggcggaatacacgttcgagggctataccagcgccgccgaaagtgcgcgcaaggtgctgcgcgacgtgatcgaacccaatgatgcctggatgcgcaccggcgacctgatgcgccgagatgcgcagggcttcttcacgttcgtcgatcggatcggcgacacgttccgctggaagggggagaacgtcgccaccaccgaggtcgccgaggcgctccaccgcgtcgcgggcgtgcgcgaggccaacgtctacggcgtgtccgtgccgggggcggaaggccgggccggcatggcggcgctcgcggtcgggccggatttcgacctcgcgcagctgcacgccgagatgaaaacccggcttccggcctatgcccggccgctgttcctgcgcctgagcgacgaactcggccacaccgagaccttcaagcagaagaaggtcgcgctggccgaggacggcttcgaccccgcccggaccgacgacccgctctacatcgaccgcgacggcgcctaccgccggatcgactcggcgatgcacgcggagatcgccgggggcacactgcggctgtga

SEQ ID NO: 7774 - DNA, 1833 bp, Methylobacterium sp.; identical to SEQ ID NO: 7773

SEQ ID NO: 7775 - DNA, 1293 bp, Methylobacterium sp.
atgcgcagcgaaacgatcgcccttcatgccggcttcgaccacgatccggccacgcacgcggtcgctgtgccgatctatcagagcgtcgcctacgccttcgacagcgccgaccacggcgccgcccttttcaacctggaggaagagggttttcgctacagccggatcgctaacccgacggtcgccgtgctggagcggcgcgtggcggaactggagggcggccattcggcgctcgccgtcgcgtcggggcaggccgcactccactacgccatcgccaccctggcggatcatggcggcaacatcgtcgcggtgccccagctctacggcacgacgcatacgctgctggcccacgtcctgccgcgccagggcatcacctgccgcttcgccgcgagcgatcgggccgcggatatcgcggcgctgatcgatggcgacacccgcgccgtctactgcgaatcgatcggcaatccggccggcaacatctgcgatatcgaggccctggcggccgtggcccacgcccacggcgtaccgctcgcggtcgacaacaccgtgccgaccccgatcctgatgcggccgatcgattacggggccgacatcgtcatcgcctcgctcaccaagttcatgggcggccacggcaccacgctcggcggcatcatcgtcgattccgggcgcttcgactggacggcgcaggctgagcgcttcccgatgttcacgcggccggacgtctcctatcacggcctcgtctacgccgaccatttcggccgcggtgccttcgccgcgcgggcgcgcagcgtctaccagcgcaccaccggcgccgtattgccggcgatgtcggccttcctgctgcttcagggcatcgagacggtcgcgctgcgggtcgagcgccatgtcgcgaacgcgcgcaaggtcgccgagcacctgcgggcgcacccccagatcgcctgggtgaactatgccgggttcgaagacagcccgaaccacccgatggcgcgcaagtacctgaagggcgaaggctcctcgctcctcaccttcggcgttgcgggcgggttcgcgggcggcaagacgttctacgacgcgctgaagctggtgaagcgcctcgtcaatatcggcgacgccaagtcgctcgcctgccatccggcctcgaccacgcaccggcagatgacccccgacgagcagcgggtcgcgggcgtgctgccggagacgatccggctcagcgtcggcatcgagcatatcgacgacatcctcgaagacctcgaccaagcgctcgccgccgtggcccccgccgcactcgcggcctga

SEQ ID NO: 7776 - DNA, 1293 bp, Methylobacterium sp.; identical to SEQ ID NO: 7775

SEQ ID NO: 7777 - DNA, 576 bp, Methylobacterium sp.
atggccgccgccgcgctggcgccggagctcgccatcgacggggagctcctcaaacaggcgatgcgccgcctcgtcggcggggtcgtcgtgatcaccgccggaaccggcgaggaccgggtcgggctcaccgcgacctcggcggtctccctctccgtcgatccgccgaccatgctggtctgcgtcaaccgcgcctccgcgacctggccggtcatcgcccggcggcggcatttctgcgtcagcatcctcggggccgggcagcaggcgaccgccgagcgcttcgccggcatcggcgggctgcggggcgccgcccgctatcgcggcgcggattggacgatcatggaatcgggcgcctccggcctcaccgaggcgcaggccatcatcgattgcgcgctggaagaggtcatcgagcggcacagccacgccatcctcctcggagcggtgcgcgcggtgcggctgaatcggatggagcggccctccctggcctatggcggcgggcgcttcatcgggatctcaccggatgaggcggcacccggcatcggtcgcgttcacagcaccgctgacaacaagacagattaa

SEQ ID NO: 7778 - DNA, 576 bp, Methylobacterium sp.; identical to SEQ ID NO: 7777

SEQ ID NO: 7779 - DNA, 270 bp, Methylobacterium sp.
atgtcgcaagcggtggcagccagcgtcgcggatcgcaccatgggcctcgcctacgcgatcgccgcgcgccacgcgatcaagccgaaattcgatcaagcggacgccctggtcgatgtcgggctctcgtcgctcgatctcgtcaacctgatggtcgcggtcgaggcggagttcgacatcatgatcccgcccgcgagcctgacgccgaagaacttctactcgatcgagaccatcgcccggatggtcgagagcgtgcgcggcctgaacgcctga

SEQ ID NO: 7780 - DNA, 270 bp, Methylobacterium sp.; identical to SEQ ID NO: 7779

SEQ ID NO: 7781 - DNA, 1362 bp, Methylobacterium sp.
atgatcctgcgcgagagacttctggcggcgggcggactcgagggcctgttcctgtccgaccaccgcagcaaaaaagatctcgccgggatcgtttccggcgagcgtgacgccgccgtgaccgcggcgctcgcgggccgccgggtgctgctcgccgtcggcgggcagatggcggcggcccgcgccatgatcgcgctcgacggcctcgcggcccggctcgccctcgtcccgccgaagctcgcgccggagcacatcgcccggatcgctcgcgattccgaggcggagatctgcgtcgccgatgccgaggggctgcctcccgacgcgctgccgggcctgccccgaatcgacgcggccgacgcgttccgcgcgggctccgagacatcgcgggagacggagtgggcactggccacctccggcaccaccggcgcgccgaagctcgtcgcccacaccctcgaaggcctcgccggcggcatcaacacggctgcggcgccggagcccggcacggtgtggagcaccttctacgacatccgccgctacggcggcctccaagtgttcctgcgggcgatgctcgggccgtcctcgctcgtgctctccgacgcgggcgagccggtgcgcgactatctcgtccgcgtcggcgcggcgggcgtcacccacatcctcggcacgccctcgcactggcgcctcgccctgatgagcgcggcgctcgaccgactgagcccccgctacgtgcggctctcgggcgagatcgccgaccagaacatcctcgacgccctgcgcgacgccttccctgaggcgcgcatcgcccacgcctacgcctcgaccgagggcggggtcggcttcaccgtcgaggacgggcaggagggtttcccggccgcgctgatcggcacccgcgccgggatcgagatcaccgtgcgcgaggacagcctgttcgtgcgctccggccgaaccgggcggcgctatctcggcgcggcgcccgaggcgctgatcgccggggacggcttcatcgacaccggcgacctcgtggagcgacggggcgagcgctaccacttcctcggccggcgcagcggcgtgatcaatgtcggcggcgccaaggtgcagccggaggaggtcgagaccgtcatcaacgtcttccccggcatctcgatgtcccgggtgcgggcgcgacccaacccgatcctcggcgcggtggtcgaggcggaggtggtcctgcgtgccgatgcgggcacggatcaggccgcgctgaagaaggcgatcatcgcccactgccgcccgcgcctggccggacacaaggtgccggcgagcgtgaaattcgtggatgcgctgccgatcacgtcgggcggcaagctggtgcggaggggcgcgtga

SEQ ID NO: 7782 - DNA, 1362 bp, Methylobacterium sp.; identical to SEQ ID NO: 7781

SEQ ID NO: 7783 - DNA, 747 bp, Methylobacterium sp.
gtgagcgacgatctcaagaccggacgcctcgtcgtcgtcacgggcgcgagccgggggctcggcctcgccatggccgaaacgctcgccgccgacgggtttcgcgtggtggcgctcgcccggcgcccgagcgaggcgctggaggcggcgcaggaggccgccggcccgggccggatcgccttcacggccgcggatctcggcgagatcgatgcgctccaggctctcgcccaaagaattcgcgccgagcacgggcaggtctacggcctcgtcaacaacgccgcgctcggcacgcccggtctgctgacgacgatgccggcttcgaagatcgccgaactcgtccacctcaacaccctcgcgccgatggtgctgaccaagtacctcgcccgcgggatgatgacggccggcgccggccgcatcgtcaatgtcagctcgatcatcgccttcaccggctacaacgccctgtcggtctacgcggcgaccaaggcctcgatgatcggcttcaccaagtcgctcgcccgcgaggtcgggcggctcggggtgacggtgaacgcggtggcgccgggcttcatcgagacggcgatgaccggcgagatggacgagggggagcgcgggcgcgtggccaaccgcagcgccctcaagcggctggccgagccgcaggacgtggccgacgccgtcgcctacctgatgtcggaccgcgcccgcaacgtcaccggcacggtgctcaccatcgacgccggcagcaccgcctga

SEQ ID NO: 7784 - DNA, 747 bp, Methylobacterium sp.; identical to SEQ ID NO: 7783

SEQ ID NO: 7785 - DNA, 945 bp, Methylobacterium sp.
atgattggggtgagcgagaccgtggaagacgtcccacccgcgggggagggcgtccgcagcgcgcgggtcaaggtccgctgccgcaccatcgaggaggatgacctcgcctccgtggtacggctgttacaggccggcttccccgatcgctccgaagcctattggcggaccgggctcgaccggcaccgcacccagccgctgcccgacgacgtgccgcgctacggctatgtgttggaacgggacggggccatcgtcggcgtcctgctcgctctctaccgcatggtgacggacgaggccggcacgcatctgcgctgcaacctctcgagctggtacgttctgccggaattccgcgcgctgggcaccctgctcgacggcttcgccatgcgcgaccggcgggtgacctacaccaacgtctcgcccgctccgcagacgtggcagatgcacaaggcgcgcggcttcaagccggtctgctcgggccagatgctcgtgatgccgctgctcgccggcctcggccgggggcgccgggtccgcgtggccacgccggagaccctgcgcctgctgccggagccggaggcccggctggtggccgaccacctcgcctttggctgcatcggcctcgtctgttccgatggggagaaggcgtgggccgtcctgttccagcggcgcgccatcaagatgcggccaggggaaacccggtggccgcgcctgccctgccttcagctcgtctaccgctcgaccgcgctcgacctgtccgccttcctcggcgcgatcggccggcatctcatgctgcaccacgccatgccgtggttcgtgctcgatgccgtcggcaagctgccgggctttgccggacacttcttcgagggccgcgccccgaaatacgcccgtggcccgaacccgccggccaccggagacctcacctataccgaggtcgtcctgttcggtgcctga

SEQ ID NO: 7786 - DNA, 945 bp, Methylobacterium sp.; identical to SEQ ID NO: 7785

SEQ ID NO: 7787 - DNA, 177 bp, Methylobacterium sp.
gtgatccggcccgaaccgggtccggccccggagcgcggtgcctacctcgtgcgccacgatccggtggcgattctggagcggcgggacggctgggtgcgggcgctctaccggcgcggcgcgaagccggtcgcgggttggctgccggaggccgacctcgccctggccgccgcgccctga

SEQ ID NO: 7788 - DNA, 243 bp, Methylobacterium sp.
atggagtatcccatgacccgcatcctcaccgcttccgttctcgccctcgccctcaccaccgccgcctcggcccagagctacaatgccccggccggcatccccgccgtcaccgccccgggcggcctcgccgatgacgtcagcgccgtgcagcgccccacggcccacgacacccgcttcggaaccctgccggcgggcgccgacctgaccaccggctcggtgcggcggacgcatcacgcgcgctaa

SEQ ID NO: 7789 - DNA, 360 bp, Methylobacterium sp.
atgaggacgatcagcgcacctggcggatcggtcgatcgcaagatcttggatgtcgccaaggtgtttctggagcggctcgaaggccgctatcccgttcggggcggcgtcttgttcgggagccgcgcgcgtgccagccatcaagcggacagcgatgcggatttggccgtcgtgctcgcgggctcttcgggcgatcgacgttccgcgtcgcgagagatggccggaatcgcattcgacgttctgatggaaacgggtgtgctcgttgatccgcttccgctttgggaggacgaactcgaacgccgggtcgcgttcagcaacccggcgctcatcgatgcgatttggcgcgacggggtgcgcgtgtga

SEQ ID NO: 7790 - DNA, 207 bp, Methylobacterium sp.
atgcgcgtgaaacgggcccttttcggcctcagcctacccctcctcgcttggttcgtcgcagccttctgcctcggcagcggcatcgccacggcgcccggtgcccgtgcgcagggcacggtgacgccgccggccggccaatcgcgcgtcacagctccgggcgggcggcgcggaaaggccgcccgttcgcaccggaagcgtcatcggtaa

SEQ ID NO: 7791 - DNA, 1449 bp, Methylobacterium sp.
atgccgcgccgcgcctccgtcgatcgagcctaccttgagcagcatggcaggcattggcgtgtcagcgtgaacgtgcctgccgcagtcaaggacatcatcgggcgaccgaagcttcgacacgatctcggcaccgattccctgcggaccgccaatcttctgaaaggtccctacatcgcccgcttcaaggcccagatccaagaggccctcaccacggtcggtcgtcagaagcagtcgacgacccgggaggcgatggaactggcgaagtgggcccgggaggccaaggagcgcaacacctcgcgggaggactgggacgagtaccatcagatcatctcggaacggaccgtcgagatccggacacggaacgccatgcccgtcgaactgcctgcgatcgatgatgacggccccgggctcggatggatcaacaagccggaggatgtcgcggaggcccggcgcttcgggcgcattgcctatcaggccgggactccgttcgccgagttccatgaggagtatttgaagggatcccaggtcgcggcccggacgaaggccgatgacgaacgatctcttcggcttctcctacaatggctccagaatgagaatgttgacccagagatcgagcgcatcacccctctgcgcgcgcacgccttcgcaaaaagattgcccacgctcgccgacgtcgcaccggcgacatgcaacaagtacctgtcgcggctatcctcgttctgggcttacctggcaaccgtgaccgaggtcgccgcctcgaatccctgggtcggcgtcgctcttcggaaaacaggcccgaagtccggcgaggaagagcgtccattcacagacactgaggtcgccaagttgctgcttgggcccgcctccccccacatgctcgacctcatgtacatcggtgcactgaccggggcgcgtctcgacgcgatcgtagacctcaaggtccaggacaccgccaaccgcgtcatcctgttccaggcgcgcaagacggagacgcacgcccgctacgtgccgatccaccctcttctggaacctgtcatcgccaagcgttgccagggcaaggctcccgaggacgacctgtttcccgagtggccgccggtgaggaaggtcggctccatgcgcgagcgctccttcaaggcttccaaccatttcaccgattacaggcgtctcgtcggcgtggacgaggtcgtggcagggaagcgacgcgcccgcgtgaacttccacagcttccggcgttggttcatctcgcgggccgagcaggccggggttgcgaccgcgatgatctccgccatcgtcggccacaagcacggttcgatcacactggacgtgtacagcgaagggacgacgatgcagcgagcccgaagggcggtcgccaaagtgaagctccctcccctcgacggcagtccgatccgtgagatccagacggtccgcgcgcgagtgcggtcagcataa

SEQ ID NO: 7792 - DNA, 1422 bp, Methylobacterium sp.
gtgccccgcaagcccgaccccgagatggcgtatctcacggtacacgacggcctgtaccgcgtctccatgggcgtgccgaaggcactgcgccagcagctgggcagccgcctcgtgaagtccaccggcacgaagtcgaaggggcaggcgaagctggtccgcgaccgcgtcgtgcccgagttcaagaagcggatcgaggacgcctggaaggcccgaggcggcaagcgcggatccctcctcgccgaggccctggagacccgcaagctcctggagacggcggacgacaacctcgccgacttcatgattcaaggcgccctggagcggagcgacgagatcctcaatgagggagcgacctgggtcaacgagcacactcctgacggaatcgtcccggtccggcggccgaccccggaggcggtgaagtccgtcaccgagttccggcgcgtgctcgccggggacaccccgatcgcgttccatcatcaggccttcgtcgacggcctgaagatcaaggcgcggagcaagctcgacgaaccccgcgccctgtcgatcctgctcgactggctggaggccaacgacatcgagccgttcatcgagaacatcaaccgccgcaatgcaatccggttcatggactggatggatgccgacacgaacctgtcatgggcaagcaaggccaagtatttcgggaggatcaagttctactgggcgtggcttgcccgacgcgaatacgcgaaggagaacccgttcctcgacctcaacctcgacaagccggatacggagcgcgccgacgacgagcggccctacaccgatggcgaggtccagaagcttctcatgggcagccccatggaaggggaccggatgcgcgacgtgatgatgatcgccgctctgaccggcgcccgcctcgacgccgtgatcgacctgaaggtcggcggcctgttcgacggctacttcaccttcaaggcgcagaagaaggagcgggacagtcgccacgtcccggtccaccccgacctcgacgagatcatcgcgcgccggatcgagggcaaggcgcccaaggacgacctgttcccggagtggcccggtccgccgtcgacttcggtgaagccgcgctcgtcttacttctcgaagcgctacaccaagtacacctctgatattggggtgcgagacgaggaacagggtcgccgccgtagcaagatcaacttccattcgtggagacgctggttcatcacgaagctggagcgcgctcgcgtcggcgagcccctgatcgccgcgatcgtcggccacaagcgccccggcatgacgctcggcctctactcgggcggcccggagttcctggaggcccaggaggcgatcgcgctcgtgaagctgcccccgctcgacggctcgcccgtgatcgaggagcggtccctcatgccccgccggaggacgtcatga

SEQ ID NO: 7793 - DNA, 129 bp, Methylobacterium sp.
ttggacgacaccgcgcatcaggagcggaccgactgggaactcgtctatgccggcatgggcgtgggcgtcgtcggcctgatcggggcggccctgttcttccgtcgtcggcgcgacgcggtcgcggcctga

SEQ ID NO: 7794 - DNA, 447 bp, Methylobacterium sp.
atggtccggtcaccgcaaagaccgcgaccgcgccacaccttcgagatgatcatgaccgacgcccgcaccgccccctacgccgccctgctgctgcggctcaccctcggcggcctgttcctggcccatgccgggctgaagctgttcgtgttcacgcccgcgggcaccgccgccttcttcggctcgctcggcctgccgcccgcgttcggctatggggtgatcgccgcggaagccgtcggcggcctcgccctgatcctcggcctctacgcccgcttcgtcgccctggccatcgtcccgatcctgatcggcgccatcgtcaccgtgcacggcgccaacggcttcttcgcgcagaatccgggcggcggctgggagttcgccggcttctgggcggtgatgctgctggtccaggccgggctcggcgacggcgcctacgccctgcggcgggcgtga

SEQ ID NO: 7795 - DNA, 366 bp, Methylobacterium sp.
atgtgggtgtgtctcggcggcggagccggttctctgctgcgctggcagctcggcggcttcatcgaccgcgcgatccccgcgcgcttcaagttcggcaccttcctcgtcaacgtcaccggcgccttcgtgatcgcctttctttccgcggcgctggccctcggctggcagcaacgccacggggacgtggtgtcgtccctggtgctgacgggctttctcggcggctacacgacgttcagctcgatgcagctcgatacggcgcagatggcgatggagcatcgccaggggctggctgccttgtacctcgtcgcgtccgtcggcgtcggcctctgcgccgcggcggcgggcgtcgccctcgcaagatcgtag

SEQ ID NO: 7796 - DNA, 360 bp, Methylobacterium sp.
atgcgtactggatcttcgaagacttacctgctgtctgcccttgcggtcgtcttatccgccggtctcgttcaggccgaaaccaccagcgggaagagcaccgacaaaaatcaggaaaaactggcgagcaaacccctcgagaaggtcacctgcgaggagttcaacgggttcgaagacacgttcaaaccgaaagtcgtcgcatgggccgcaggctacaaacagggccagaagaagcccgatgtggtggccatcgatatcgccggggtcgagaaggtcacgcccctggtcgctgaagaatgcaggaaggcgccgaccgcctccctatggtcgaagatcgatggtgagctgaagaagatattctga

SEQ ID NO: 7797 - DNA, 108 bp, Methylobacterium sp.
atgatctgcagtggatgctggaaggtcgccgtcatccatggcgggccgaccgaggcccaggagcgcttcatcgcgcgcaccgtccgcgtgctcgccgagcagcactga

SEQ ID NO: 7798 - DNA, 129 bp, Methylobacterium sp.
atggccaccgagaagaaacgcggcaaccgcgagacgaagaagccgaagaagtcgaccgcgaaggtgatcgccgccgcgccctctaccaagaacctcgtctccgcggccgtgaaatccgccggccgctga

SEQ ID NO: 7799 - DNA, 258 bp, Methylobacterium sp.
atgtccctgcgtgagaccgtcttcgccgagatcgccgccatcgccgccgagcaggaaaaggcgatgccgccgatcaccgacgacctcgtgatgctcgacaccgagttcgactcgctctgcttcgcgctcctcgtcgcgcggatggaggatctcaccggcgccgacccgttcggcgagatggatgcttccgacctcccggtgacggtcggcgacctcgtcgccctctacaaccgcgccgccgcccggcaggcggcctga

SEQ ID NO: 7800 - DNA, 258 bp, Methylobacterium sp.; identical to SEQ ID NO: 7799

SEQ ID NO: 7801 - DNA, 1560 bp, Methylobacterium sp.
atgcagcggcttcgatcccatccgcgcgtcgcgcagttctgtctcacgctcggcgtcatctcgggctgttccggcagcgcgttcggccaagccgtcacccgtgcgcaggtcgaggcgcgtttgccggccctcgaagcgctggcgcagcaggccatcgatgcgggcaacgtgccgggtctcgcgatcgcaatcgtctacggcgacgagaccctcttcctgaaaggcttcggccgcagggcgatcggaaagcccgacttggtcgggccggagacggtgtttcagatcgcctccctgtccaagcccgtgacctcgaccgtggtggccgccctcgtgagcgagggtgtcgtcggctgggattcgcgcgtcgccgatctcgaccccggcttccggcttcacgagccctatccggcctcgcaggtcacggtgcgcgattttctcaatcaccgcagcgggttgccgggcagcgccggggacgaccttgaagggatcggatacggccgcgacgacatcctccgcaggttgcgcctcgtgccgccgtcctccagcttccgtgcgggctacgcctacagcaatttcgggttcaccgagggggccgtggccgccgcgaggccgaccggcaagctgtgggatgtcgtggctcaagaaaagctgttcggcccgctggggatgacctccacgagcacgcggcatgacgacttcctgacgcgggccgaccgggccgcactccatgtcaggcgcgacggcgtctggacggccgggaccgaacgcgatcccgacgcgcaggcgccggccggcggcgtcagctcgaatgtccgcgacctcgcccgctgggtgcggctcgaaatcggaaacggcctgttcgagggcacgcaacgggttgccggcgcggccctcgctcagacgcgtgggccgcttaccgcacgcggcaccaatcccgtgaccggaggcgcctccttctacggcctgggctggaacatcgagtacggccgccacggcctcgtctggggccatgccggcgccttcagcatcggcgcgcagaccctcgtctcgatccatccggaggccaagctcggcatcgtcctgctcacgaacgccttcccgtccggcgtcccggagggattggccgacagcttcgcggatctcgtcttcgacgggcggatccgcaaggattggctgaaagattggggcgaagcctacacgagcctgttcgggccgggcgcggcggcgaaccgcgccgtctacggccagcctccggcgaacgcctcggcgtcgctccccctgtcggcctatacggggcgttacgccaacgcgtatgtcggcaatgccgaggtggcggagatcgacggtcgcctgacccttacggtcgggcctggcggggcgcggacctatccgctgcgccacttcgatcgcgaccttttcctctgctttcccgatgcggaggcgccggacaatccgtcggccatccgtttcgccgtcggaagcgggggcaaggccgatgcggtgacgctcgacgcgctgaacgcgaacggtctcggcacgctcgatcgggcgagcgagtga

SEQ ID NO: 7802 - DNA, 222 bp, Methylobacterium sp.
atgccggatgagacaaggttgccgaccttggacgttctcgccgatctgcctcaagcggagttcgtggcccgctggcggtctctggtcggcgaacctcctgccatcatgctggagagccggtcagagatgatccgcctgctggtggacagtacggaaccggctccgtttcgcttcgatgagcaggctctgaacgcgcctcaaagtcatccggaccggcgctga

SEQ ID NO: 7803 - DNA, 1368 bp, Methylobacterium sp.
atgaagccggcagatcaacccgccacgtctccgcaacaggcacgcttcgttgccgtggccctgatcaccggtgccctcacgggcgtgttcggcggcctcttccacctcgccatcgacacgatcatcgattggccgacatggctcgccggccagaccgccggttggcggttggtcgcggcgagcgccgccatcaccatggcggccacggtctttgccgtgttcatcacccggcgctttgccccggaagcgagcgggagcggggttccggaaatcgagggggccatcgccggcatccggcatgtgcgctgggagcgcgtgctgccggtgaagttcatcgccggcatcgcggcgatcggctcgggcctggttcttggccgcgaggggccgaccattcacatgggcggctcggcggcgctcgcggcgtccgagatgttccgggtgagggacgtcgatcggcgggctctgctggcggccggcgcgggggcgggtctcgcctgcgccttcaatgccccgatggcggccgtgctgttcgtcatcgaggaaacgcgcaagcagttcccctacagcttccggaactacatgggggtgttcgcggccgcgatcaccggaaccgcggtgacccagatgatctcgggcgcgcggccggacttgccgctgtcggccggggcagcggcgctggcttcgttgccggccttcgccgtgctgggcatcatcctgggggccgtgggcgtgctcttcaatcgatgcatcctggcgatgctggaccgcgccgccgcatggcagaagcgggccccgtatgtttggcctgccctggtcggactgctcgtgggcgccctgctgatcgtcgcgccgcgcacggcgacgggcggggagcaggtgatttcacagatcgccgttctgaccccgagtgcgggcgtgctgctgatgctggcggtcgcccggctctgcacctcggttgtctgttattccgtcggcacgccgggtggcattttcgcgccgatcctgtcgctggcgacctgcatcggtttggccttcggcctgctcgcgcagatggcgttccccgaggtcttgtccggccttggggtgacgccggtctccttcggcatcgtggcgatggccgcactcttcagcgcgacggtgcacgccccggccgtgggtgtggtgttggtgctcgaactcacgactgcctacgcgctcgtcctgcccatgctgacggcctgcctgacggccagcctcgtggcccaatggctcggcggccgtccgatttatggacagatgctggagcgcgcccttgcccaggccggcagggtgccagccaagggctcggatatcggtctggctgccgatcgggatcgtgcgacccactga

SEQ ID NO: 7804 - DNA, 582 bp, Methylobacterium sp.
atgctggaagcggccaccgctctgttcctcgaacagggattcggtcgcacgacgctcgatcaggtgtcgcggcgctcggggaccggcaagtccgcgctctacggccgcttcccggacaaggaagcgctgttcgctgccgtcgtccgccgctcgatccacgtcatgttcgatgagctgaccgcgagcccaaccggcgtcggcgtccgggaacggctgcgccatgtcgggcgcggtttggcggaaaacctcctggtgccgcgctgcattgccttgatgcggatcacggcagcggaagctccgaatttcccggacctcgcgcgaatggcgtaccgggtcagcttcgagggctccgtccgctgtgtcctcgccgccctcgatcctgtcggcggaggcgaagcgtcccaagacatgatccgaatggccgaacggttcgtggagctggccatccagccgatctcgtttcaggcggccttcggtaccgacatcgagcctctccggcagcgatgcgccggcgacgtggacgatgccatcctgctcctcgaagccaagggctggctcacgcgcgaaccgcccggaacttag

SEQ ID NO: 7805 - DNA, 291 bp, Methylobacterium sp.
atgagcgtccgcctctcgccgagggcgcgcgcggatctcagccggatctgggacgattcggccgagcgctggggagcggatcaggccgaccgctacatccgccttctagccggaggcttcgaccgattggcggaggatccggctcggggtctaagggccgatgagatccgcaaggggtatttccgcctctccgtcggatcgcacgtcctattctaccgcctgggcgccgagggcggcatcgaggtcatccgcatccttcacgggcggatggatttcaaacgccatctttga

SEQ ID NO: 7806 - DNA, 384 bp, Methylobacterium sp.
gtgggcgccgttcaagggggaccggggctcgacgtcgtggtgttgaaactgccgaggctcgcttggttctcgtgcttggcgacgatcgccgcgatgtcgctgctaaatttgtattgtgcggcgagcattcaaaccgaccgagttcccatgcaatggggcatcaacggacggccgacatggtacgccgataagacgatcggcctctggatcccggtcgcgatcatcgtcgttattgctccccagatttttctgaagatcaagcaggtcgaagcccaagccggggcttggtactggatcgggatgatcgcaatgttctgcttcatcgccgccgtgtatgcgtggcatatctcggcggtcataacctgggcggaagcgcagccctga

SEQ ID NO: 7807 - DNA, 1173 bp, Methylobacterium sp.
atgagtctctcccgaaccggaaccatcgagggcgagttcgccggcctcaccccgttgcggttctcgcccccggtcgaggcgcggttcgagacggaggggctccccgaacgcatcaggctcgcccaggcgacgcttttcgccgccattttcctctacgacatcttcctcttagccgactggatgatcctgccggacgtgctcgggccgctcgccgtgatgcgcctgggcgtcttcacgccgctgacccttctgatgatctggatcctgccgcgccggacacggacctggcaggtcgacgggctgctcgtgggaggttgcttcctctcggtgctgatgccgtccacgatcatctcgttcagcgcatcgcactacgtcgcgacctaccagctcggctcgatgctcatcatcttctacatggtcctggtgcagcgcgtccggttccggatggcggtgatcgggatggcgctgatcgtcctgacccagatctcgaccgtcgcgagacggcccgaggtcgatgccccgaccttctggtacatcgtggtcttctacctcatcgcggccgccatcatcctcctgggatcgttcgtgctggagcggacggagcgctacggcttcctccagcgcctccgggtcgagtcgatgatcgagcgcaacgcggagatggcacggaccgaccaactcacgggcctgttcaaccggcaccatctcgcgaccatcggcgccgatctcattcccaagaaggacacgcagtccctcggggcgctcctgatcgacatcgaccacttcaagcggttcaacgacacccagggtcatctggcgggtgaccgctgcatccgcaccgtcagtgacttggtgcgcgagatgctggtcccggcgaacgagaacaagcccccgttgggaacggccgtgcgcttcgggggcgaagagttcctcgtgctgctgccaggcatggatgccgcgcgggccgccgcgctcggggaggccatccgccggcgcgtggaaggcgtcgggattccgcatcccggcctcgggccgaacgccgtggtgacgctgtcgatcggcgtcgccgactggaagaagggccatacggcgctggacacactcgtgaacgccgccgacgccgccctctatcaagcgaaaaatctcggccgcaaccgcgtggcggtggcctga

SEQ ID NO: 7808 - DNA, 1053 bp, Methylobacterium sp.
atggcagagatccgaagggccctggttgcgggcgcgaatggcatcatcggcaaggcgctgatgcaggaactcgcggcagcggacggttggcatgcgcgcgccctctcgcgtcgaccgcacggatcgagcggggacatcgcggcggatctcaccgatccacacacgacccgcgccgccctcgcgcaggctcgagatacgacgcacctgttctacgccgcgctcgcgccgcatccgagcctcgccgaagaggatcgggtgaacggcgcgatgctgcgcaacctcctcgacgggctggacgccgtcggcgcgccgctggagcgcgtggtcctgtatcagggcgcgaaggtctatggcgtccacctcgggccggttcctgcaccgttctacgaggacgagaacccgcgccacatcgggccgaacttctacttcacgcaggaggacgtgttgcggcgtcgggcggagcgcggcggtgcggcgtggtcgatcctgcgccccgacgtggtggtcggcgacgcggccggtaacgccatgaacatcgccatggtgatcggcgcctacgccgcactgtgccgtatggaaggggcagcgttccgtttccctggtcccacgcacgtctacgagggcgtgttcgcccaggtgacagatgcccgcgcccttggccgggcaagcctttgggctgcgacagcggacgccgcgcgcggcgaggccttcaactacgtacacgagcctttccggtggcggcgggtctgggagaagctcgccaccgcgctcgatctgccgctcgggccgccggttcccatgcgcctcgccacccacatggcggacaagaagccggcctgggagaagctggtggctgaacagggcttgagcgacatgccctacgagcgtgcggtcggctcgggcttcggcgacttcgtgtttcacagcgacttcgacctcgtctccgacatgggcaagatccggcgcgctgggttcggcgagagtgtcgacagcgtcgaagctctgatgtccgccattcgccgcctacaggaggcaaaggtgctgccgcgctag

SEQ ID NO: 7809 - DNA, 453 bp, Methylobacterium sp.
atgcgatattctcttgttcgcgtcgccgaaccatccgatcggcaggtctaccatgccatccgtcgttcctcgttgtgggaggaaaggggacgtgttggttatgacgatgcccggcctgaggagcttttcccgaaccaccacgccctgctcttgatgcgggatgaagcgggcatcggcaccacgcgcctcgacgacctcgggaacgggacagggatcgtcagactcgtcgccatcaccgccccccttcgcaggaacgggcatggccgggtgctcgacgcgatggtggcggattacgcgcgagcgcttggcctcggcaggctgttcgtcagcgcggcgtcggatgccgaagggttctattcgtcaacgggatggacacgactgatgagggatgcgccggtcctgctcggacaagccgagagctttgtgccgatgacgaagcgcattcaaaggtga

SEQ ID NO: 7810 - DNA, 519 bp, Methylobacterium sp.
atggcgacatccgtggttgttgaggatcgcgcggcgctcgatgggttgttccgcaagcacaacggctggctgatgcgctggctgggccggcagcgctggacggtgtcctcggcagaagatctcgcctccgacgtcttcattgcactgctgacgatgccgaatctcggcgccgtccgcgagccgcgcgcactgatgacgacggtcgcccgccggctgatctgcgatgcgaggcgccgagacgacgtgcggcgcagctatgaggccgagttggcggccttgcccgaatccctggatatctcggccgaagagcggctcatcgtcgtacaagctctgcaggcgatcgacgcgatgctgtccaccctgtccgacaaggcacgcagggcgttcctgctcagccaggtcgagggtgccccctacgcggacattgccgcggaattgggcgtctccgtcagcatggtgcgcaagtacgttgcacaggggttgcgcgccacgtatctggcaaccgccaaccagggctga

SEQ ID NO: 7811 - DNA, 519 bp, Methylobacterium sp.
atgcccgaggtcacattcaactcaaaccgaaggacgctcgaagagatatttcgcgcccataacgggtggctgaaaaactggttgcggaaacagtcgtggaccgtgcaatctgccgaagacttggcttcggatgttttctgcgcgttgcttacggtgccgaacattggggccatcaggcagccccgcgcgatgatgacgaccatcgcgcgccgcctcatctatgacgagcgtcggcgacatgatctccacgccgcctataaggccgagctcaccttcctgccggaggtgttagaagtatcggcagaggatcgcctcatcctgatccaggcccttcaagctgtcgagacgatactggcgaatttaccgcgaaaggcacggatcgcttttctgatgagccagatcgaaggcatgccgtatgccgtgatcgcggtggaactcaatgtttccgttagcatggtgcgcaagtacgttgcgcaaggactgcgtgctgcttatgccgcggtcgatcatcagaactga

SEQ ID NO: 7812 - DNA, 972 bp, Methylobacterium sp.
atgtcgggggtcgaccaactcgaggacccgcgagccgaggctgccgtcggctggatggtggagatgggctcgggccccatgtccgagcatcagatccgggccttcgaggcctggctggaggccgacccgctcaacgaggcagcttggattcgccttcagggcggaatgatgccctacggcatcgcctcccgccatcggctgcagcccgatctactggcacgccggcgggggcgttctccgacccgccgcacgctgctgaccgggctgtgcgccgtgctcggagccggggcggccggcgggagcctcctcaaccgtttcgttcctctcggcggtgtcctggccgatcacgtcaccctcaccgcccagaaccggagcgttcccttggcggacggcagcgagaccgtcctctcgccgaggacggcgatgaacctgcgctacgagcccgggttgaggggcatccagcttgtgagcggcgaggtgctcgtgcgcatcgcctcccgggccacccccttccacgtcaccgtcggccctctgaccctacgcgcgcaggccggaatcttcgttctcgaagaccgaaacgaggtcgtgacggtcaccggggtgcaggggacgggcgaactcgccggccttggcgcggagggcccgcaagcggtcgccccgggcgacctcctcgaattcggtgacggtcgcctgcaccgtctcgttgcggatcgggacgccgcaacggcgtggctggacgggctgcttgtggccaaggaccgaccgctcgccgcgatcgtcgacaagctgcgcccatactttcccggagtcatccgggtggacccctccgtctcggcgctgcgcgtgacgggagtcttctcgctcaaggatccgagcgcggccctggacgctctggcggaatccctcgatctgtcgatcagccgcctcacacattactgggtttcgctcggcccacgcgccgcggcggcctga

SEQ ID NO: 7813 - DNA, 909 bp, Methylobacterium sp.
atggtggagatttcctcgggcgaagtatccgcggatcagctcgaggcgttcgacgcgtggttgcgcgccgatcccgccaatgaaacggcttggattcgcctgcaggaaggcctcatgccctgcggcgtcacggcgcggcgaggagctgggcaggcagttctgaagcgccatctcggcgcccatcgagagaaccgacggaacgtcatcttgggcctggcctgcttggccggactcggcgtgatcagtgccgggatcgcggaccgatacattcccttgagcgagatcttggcagatcgcgtcacctatacgggtgggcaggagactgtggcgctttcggacggaagcgagctcgtgctcgcgccgcggactgccctcaacatcgtaagcgaggccgggcagcggggcatccaacttctgacgggcgaggtgctgatgcgcgttgcccctgacgcaacgcccttcaaggtccagaccggggcgttgacgctggtgacctccgcaggaacattcctggtcgaaagccgggatgagcgcctcgcggtgacgggaatcgaagggaccgggcgactcgcctatgcttcggcgaccgaatcgttggccgccggagacttgatcgagttcgcgggcggaaacaggcgacatctgaaggccgatatcgctgccgcgacggcttggctcgatggattgctggtggccaaggacagcagtcttcaggcgatcgcaaccaagttgcaacgctacttcgccggaatcatacaggtggagcccggcgtcgcggacctgcgtgtcaccggcgtcttctcgcttcgagatccggaggcgaccctcgacgccttggcggaatccctcggcctttcacaggcacgcctgtcccggtattggatcaagctcggcccggccaaggcctga

SEQ ID NO: 7814 - DNA, 711 bp, Methylobacterium sp.
atggccgaccgagacgagatttatcgagcggcggacctgttgctcgcggaaggtcgtacggtctcgcaagcgagtgtgcgcgatcgcttgaaggacggcggttcgtaccgtgacatcgcgccgatcctacgggactggaaggtcgatcggaattaccggtcgcggccggggcgcgaggagcttcctgcatccgtcgcgaggctgctcgacgccttcgccgtcgaagcctggaaggcagcgcgtctggatgcacacgcatcgctggaaaacgaccgtgcgaaagtgtcggagcagcagagggtatcggaaggcttggtgatcgagcttgccgcggcggccgacgccgctgagcgccgcgccgctgatagcgagcacgctgcttcggaggccagagatcgggccggccgtttggagagggagagcacggacctgcgccgtcaggttgaccttctcgaacgacgggtccgtaggctcaaagccgaggcctattgggatctcgtcatgcgaaccgtacagggattgctgacccccgagaacggcctgaccgcggaagagatcgtcgctcggttaccttcactcctgggtgagcatgcgtggggtcagcacgatccaatcacggcacctatcctcaaagaaaagatgcgggtacgggtcggggcaaaaaattattttcgcatggatggagacaatcgcttctaccggatagtctga

SEQ ID NO: 7815 - DNA, 126 bp, Methylobacterium sp.
atgacgggcttcctcgtcgcgggggctatcggcttcgggctcggctggttggtgttcggccagcattcctattccggggattacgtcgcgagacgcatgagccgcagcagcgagcgcgattactag

SEQ ID NO: 7816 - DNA, 159 bp, Methylobacterium sp.
ttgactgcacagaatgatcggccgaaatcagaatccgagccgaagccgatcggtgatccgcctcccgctccgcagccgccggccggagatcccccgccgcatcggccggatgcgatccccgacgaggatctcgaccaggtcgaggagcagccgagctga

SEQ ID NO: 7817 - DNA, 189 bp, Methylobacterium sp.
atgatcaagcacaccggcatcgcgatccttctgagcctcagcggtttcgccctgggcagcgtcatcgcgcgggtgacggaacaggcaggcgcggccgggacgacggcggcggcgccggccctgcgccacatctcgcagcttccgccgccgcccgccgccgggaagcccgcggcccgttcaggccgctga

SEQ ID NO: 7818 - DNA, 357 bp, Methylobacterium sp.
gtgagtcaggacatctcggcgggaccctaccagggcgtcccggagatcgaagtcgcggtcatcaaggaagtcggaagtttcggccagcaactcgggatcatttccgaggccgtccgtgaactcgccgagaaggttagtgcgatgccgcccgcaaaatcggctcacgagctggtaaaatcgagcgaggcatctcgcgaactgacgccactcgaaaagctcgacgttctcatcgaacgcgtggatcgggttaaagcagcctaccatgaatcggtcgagcgggacgcgatccgcgcgctggagcggttgcaccgcgtcgatcccggagcttcgagcaagctcgcggcacgcttccgatga

SEQ ID NO: 7819 - DNA, 750 bp, Methylobacterium sp.
atgacacccggacgcgcacagcctctttcctcctgcgccgcccttgtcgggctctcgatcgggctcctcgccccggccgcggccgagggctggaacgcggcgcggttcgatccgcccgccaaggtcgaaaccgccacggatgcggtgggccgggaaatcacctgcaccttttatcccgatctcgtcatccgcgagagcgacaccggcacccccgagcccggggatgcggcgctcatcccgatccgcggcggcccgcccgtggcctgccgcgccgcgcccggcccgagcgcgcgtacgctggaaaccggcggccagcgcttcatcgggcgggcggacgggtttctcgtgttcgaggatgcgagcaccaacggcaccatgcccttcgcggtgatcgatgccgggaccggccgcaggctgttcaccgacacgaccacctacgacggcatcgacagcttcgcggccgagggcgcgacgctgcggctcagcttccgccgcggggtgcaggccccctgctcgatcccgcaagggggcgcggcctgctgggcgcggatcgtgcgcgaggacaagctcccggcaccggtcgcggccctgccggcgccggcgccggccaaggcctgcgcccaagcctaccgcgccggcaaagcccccaaggataccccgagcatcgtctccttcccggtgcggctcgtctggaccggcagtctcgccgtcgaggccgacggcccggtgcgatgcctgccgacgccgtga

SEQ ID NO: 7820 - DNA, 1968 bp, Methylobacterium sp.
atggccgaagccattccaggcaaggaaggtcacgatttcgtcgtcgaaaccgatgcatcggccgcctattggcacaatcgccccaccaatacgcttccgccccccgacatgatgggcgcctacatgcgcaaccgcccggtgccggggccgcgggtggaggggcgcaaggcctggatcatcggcggcggcatcgccgggctggccgccgcattctacatgatccgcgacggcggcatgaacggccaggacatcacgatcctcgacgcgctggacgtcgaaggcggctcgctcgacggcgccggcaacccggaggacgggtacatcatccgcggcggtcgcgagatgaactggaactacgacaacctctgggacatgttccaggatgttcaggcgctcgaacttccggaaggctacagcgtcctcgacgagtaccggctcgtcaacgatcacgaccccaattactccaaagctcgcctcatgcatgagcaggggcagattcgcgatttctcgaatttcggcctcacgaaatcccagcaatgggaactgatccgcctcctgctcaagcgcaaggaggatctcgacgacatcacgatcgagcaatatttcagcccggagttcctcgagaccaatttctggttcttctggcgatcgatgttcgccttcgagaactggcagagcctgctcgagatgaagctctacatgcaccgcttcctcgacgcgatcgatgggctggcggatatgtcggcgctcgtcttcccgaaatacaaccaatacgacagtttcgtccggccgctggtcaaccacctcatggcgcgcggcgtgaccgtgcggttcggcgtgcgggcgtatgatctggctatgagcgtcgatggcaatgcgcgcaccgtcacgggcatccacgtcaaaacgaagggcgaggaggacgtcattcccgtcgagagccgggacgtggtctttgctctgaccggctcgatgaccgagggcacggcctatggcgacatggatcaggcgccgatcctcgaacgtggtcggcacgatccgggccaggacagcgactgggcgttgtggaagaatctggctgagaaatcaccggtcttcggtaatcccgcgaagttctacggcgacatcgacaagtcgatgtgggaatcggtgacgctgacctgcaaaccctcgcccctggtcgagcggctgaaggagttggcggtcaacgatccctattcgggcaagacggtgacgggtggcatcatcaccttcacggattcgaactgggtgctgagcgtgacctgcaaccgtcagccgcacttcccagaacagccccaggacgtgctggtgctctgggcctacgcgctcctgatggacaaggacgggaaccacgtccggaagccgatgccggcctgtaccgggcgggagatcttgagcgaactttgctatcatctcggcatcgccgaccaatgcgaagccgtcgcggccaacaccaaggtgcggttggcgctgatgccctacatcacggcgatgttcatgccgcgcgcggcaggcgaccggccgcatgtcgtgccgaagggctgcacgaatctgggcctgatgggccagttcgtcgaaacctcgaacgacatcatcttcacgatagacagctcgatccgcaccgcgcgcgtggccgtctatacgttgctcggcctgcacaagcaggtgccggatatcagccctgtacagtacgatatccgaaaccttctcaaagccgcgcgcgccctgaacaacaatctcccattccccggcgaacgtctgctgcatcgattactgggcaagacctattacgcccatatcctgccgcccctgccggccttggagggcccgagccgcgaagcggcccagttggacctgcgacatctgctggggaggcgtcgccacgccttgagcgcgatcggcgaatctttcgaacacattcgaggctatctcaaatcgcagaaatga

SEQ ID NO: 7821 - DNA, 306 bp, Methylobacterium sp.
atgccgaccaagatgatcgccaagccgatcgcgcttgccgccgcgctgaccctcgccgtctccggggcggccttcgcccagtcgagcaccggcaagggcggcaccgggggcaccacggacagtgccagcccggtgcggaacaacaccggcaacagcatgcggccgacgaacggcagccccgcgggcgcaaccaccggctcgaccggcaccatggcccccggcgccacgaccggcaacgcaccgggcggcaccatgggcggtggcgcgggcagcgccggcggcggcaacagcgccgcgggccgctaa

SEQ ID NO: 7822 - DNA, 2088 bp, Methylobacterium sp.
atgaaggacgggctgagtttcctgccgaccgggaccggcagctccgccgagccgcggagcgcccgcactgagcccgatccggttcgggccaagatcctgatcgtcgatgacgatcagcgcaatctcctcgccgcctccgaggtcctcgccgatccggcgatcgacctcgtgctggcgaactcgcccgaggaagccctgcggcaggcgctccgggaggatttcgccctgatcctgctcgacgtgcagatgccgcgcatggacggctacgaggtcgcctccctaatccgcagccgctcgcgcacgtcccgtgtcccgatcctgttccttacagcccacaacaaggaggacatccacatcttccgcggatactccgccggagcggtggactacgtattcaaacccatccagcctctggtcctcaaatcgaaggtcgatgtcttcgtcgatctgtacctgaagacagcggagatccagcgcaaggcggcggccgagaagcagctgctcctggaaaacctgcgcgtacggggcgagaagcttgccgccgagcaggctctgcgcaggcgtgaggaacatcaggccgctgtcctgcgcggcctccccattgcgctctacacctcgccattcagtggagacgatcgacggcttcacttcacgaatgacagcatcgagcgcatcaccggcttctcgcgcgaggcctttgctgcctcaaacctctggggggagcagcttgaaccggatgacagggagaggatctctgcggatttgagcacggtctcggaatccggcgcggtaactctcgaatatcgctggcgcaacgcagacggcagggagcggcacattctcgatcagatcgtgatcaacgttgatgagaacggtgcgccggtcgaactgtttgggatgtggttcgacgtgacagagcgcaaggagcttgaactcagcttgcagcatgcgtcaaagcttgaagcggttggccgcctgacaggcggtattgcgcacgacttcaacaatatgctgagcatcgtgatcggcaaccttgatctggtgaagagctcgttgtcgggcaacgagaaagcgctccgccgcatcgagagcgccatcgagggagcccatcgctgcgctgaactgaccagtcggctgctggccttctcccggcgctctcctctccagcccagagcgttggacttcacgagcttcatacctggcctgataaagctcctagagcgcactcttggggagcggattgcgatctccgcggacctggaggatggactgccggaagtctgcgttgatcacgctcagttcgaggccgccctcatcaacctcgctgtgaatgcgcgggacgcgatgccagacggggggaccttgggcattcgcatcaagcgtcatgaggccgacgcgcaggaggactccgagcaggtgcactccgtcgagatcgcggtcacggactcgggcacagggatgtctccagccgtcctcgctcgcgtattcgaaccgttcttcacgaccaaggaggccggtaaaggcactgggctcggtctgagcatggtctacggtttcgtacagcagagcggcggaaccatcgccgttgacagcaatcctgaccaaggcacccggttcgttattacgttgcccgtgctcgcccagcggagtttttcgtcggaggaaatggatccaggcaacgcccccggaccgcagaacgcgatgaatggtgcagggagagccgtgctcgtcgtcgaggacgatgccgatgtccgctttacggttgtctcgacttttgaagcacttgcattcaaagttttcagtgcgcaggacgtcgacgaggccctccgcctcctgcaaatagagtcgaacatttctctcgttttcagtgacgtgaacatgcctggcgcgatgaacggcatcgagcttgggcacatcatccgccagcgatggccggacatgccaattttgctgtcgtccggctaccttcaagaagatcaggacacgaacggcttttcgttgctgcagaaaccgtatcgcgcgactgagttggtcgaaaccctacgtggtctgctcagcaatgcgcatgggacaatgccaatcgaataa

SEQ ID NO: 7823 - DNA, 297 bp, Methylobacterium sp.
ttgagttcggacgtagatgtcatcaatcgggctgccagcgtcagcgccggcgaccgcttcgtgcgctggctcggctggatcgcgaccattaccggcgtcctcatgttcgcgtcctatctcgaccagatccagctgaacctctccggtcagaagggctcggtcattcagccgctcgccacggtggtgaattgcggcctgtggacgacctacggcgcgctgcgccgggactggccggtttctttcgccaatgccccggggattgtcctcggcgctctttccctgatcaccgcgctctga

SEQ ID NO: 7824 - DNA, 321 bp, Methylobacterium sp.
atgaccctcgcccatacccagccgacctgtcaggcccccgctgccggcacgccggaccgccgcgacggcggcaccgagcgcttcgtgcgctggctcggctggatcgcgaccgtcaccggcgtgctgatgttcgtttcctatctcgaccagatccagctcaacctcgccggtcagaagggctcggtgctccagccgctcgccacggtggtgaattgcgggctgtggacgacctatggcgcgctgcgtcgggactggccggtctccttcgccaatgctccgggcgtcgtgctcggcgcggtcgccctgatcaccgcgctctga

SEQ ID NO: 7825 - DNA, 348 bp, Methylobacterium sp.
gtgcccctgcccacccgcttcgccggtatcatcctggcgttcgcgccgctgttcgcccatcgctcgtggcggcatgcccggatcctgctgatcggcgcgtttctgacccccggtcggcgcacggtggccggcgccctgcggatcatgggcttggcacacgagcggcggttcgtgaacctccatcgtaccctcaacctctcaatcagcctgattcaaagccagccggtcaggtcaggaaggcacctgtgcgacaggtgcctcacctcagatgggcctcgaaacccgcttcgttcgccgcccaacgggcccctgctcgttccgcgcttgggtgcctcccgagctgcgtga

SEQ ID NO: 7826 - DNA, 234 bp, Methylobacterium sp.
atgattgaaaagcctggcttcgaaattcgcatcacgaccaccgagacgggcagcatcctccgcgcgcagaccgagcgcgaggtggctacgaaagcggaatccctgatccgcagggtacatgcgcgcggcgagttgatcgggttcagcatcatggggccgagcgcgaccgagatcggccgaatcaaggcctatcttgaggatgtcctgatcgaggttgcacagctcagcatctga

SEQ ID NO: 7827 - DNA, 924 bp, Methylobacterium sp.
atgccgatgaatcttttggatgtggccctgttctgcgccatcgtcacgaccggcagcctctcggccgccgggcggcaggcgggactgtctccgatggcggtcagccggcgccttgcggcactggaacacgagctcggggtgcgcctgatccaccgcaccacgcgctccgtggctctgacagcggacggcgagacgttcctgccgctcgctcagacgatgctggaggcgcaggaggcggcgacggcggccttctccgaacagcacgagggcttgagcggggtcctgcgcgtgaccgcgccccaccgcatcggccgggctctcgtcgtacccctggtcgtccggctgatggccgaaaacccgcgcctcaaggtcgacttgaccttctcggacgggatcgtggacatcgcggccgccggtatcgacgtggcgattagagcagcaaccctgcaagcgtccgagctggtagccgttcaagtggcggacaacccacgcatcctgtgtgccgcgacggcctatctcgctgcgcacggatgccccgagcgtctcgccgacctcgacgcacacgcctgcctgacactgcacgcgatggacgcctggacgttccgccaagccgggcaccctattgccaagcgcatcaaaggcagactggccgccagcagcgtcgatacggtgcacgccgcctgcgtcgccggagctgggctcgccttgctgacctattgggatgtggcacaggacttggccaatggcaccctcaaggccctaaccctcaacgatgccgagccggagcagctggccatctgggccgtgctcccaacccggcaacacatgccggcgcgcgtgcgacggttcattgacgggctcaggtccgcgttgatggtgtctcttccaaacgtaccgacatcaggaagcctcttcgcatcctga

SEQ ID NO: 7828 - DNA, 1674 bp, Methylobacterium sp.
gtggacgtccatcacatcacgcgcgacttggccgtcgcaccgcagatccggcctgacgacatcccggcggtcgcgtccgccgggttccggtcgatcctctgcaaccgccccgacgccgaggcccccgaccagccgaattttcgtgagatcgagcggcgggccggggagggcggcctcgtcgcccgcgacctgccggtcacgtcgggccgtatcaccgacgcggatgtcgcggccttcgaggcggcagcggacaccctgccgaagccggtgctggcctattgccgcaccggcacgcgctcggcgacgctatggtcgctcgccgaggcacggcgcggccgcgccgtggcggagatcctggcggccacgaaggccgcaggctacgacctgaaaggcgccgcgccccggatggcggcgcaggccggcgcggcgaaagagagaaccgagcaacggttcgcgattgtcatcgtcggcggcggcgcggccggcctcgcggcggcctcaagcctgaaggcgcgcaagcccgacctggaggtcgccgtgatcgacccggccgacatccactactaccagcccggctggacgctggtgggcgccggcgtgttcgacacggcggtgaccgcccggaccatggcgtccctgatcccggacggcgtgacgtggatcaaggccggcgttgtcgccttcgagccccagaggaaggccgtgatgctggaggacggccggaccatcggctacgaccgcctcgtcgtcgcccccggactcaagctcgactggggcggcatcgaggggctggtcgaaacgctcggccggaacggggtcacctcgaactaccgcttcgacctcgcgccctatacctgggagctggtccggaacctcggcggaggtcgggccgtgttcacccagccccccatgccgatcaagtgcgcgggcgccccgcagaaggcgatgtatctctccgccgaccattggcggcgtgccggccgcctgagggagatcgggatcgacctcttcacggcgaccccgagcctgttcggcgtgaaggaatatgtgccgcccctgatggagtacgtccggcgctacgacgcgaagctgcacttccgtcacgacctcacgcgcatcgacggctcggccaagcgcgcgtggttcacctgcacggccgaggacgggaccccatcgacggtcgagaccgggttcgacatgatccatgtcgttccgccccagcaggcccccgatttcgtcagggaatcccccctggcggatccgagcggctgggtcgaggtggacccggcgagtctgcgccacaagcgctttaccgacgtctacgggctgggcgacgcttgcagcgcgccgaacgccaagaccgccgccgcggcacgcaagcaggcgcccgtggtggcgcacaacctgctgcgcgacatgggcttcatcgaggggccggatgccgtctacgacggctacggctcgtgcccgctcaccgtcgagcgcggcaagatcctgcttgccgagttcggctatggcggcaagcttcttcccagcttcccgtcctggctcctcgacggtacgaagccgagccgggccgcgtggctgctcaaggagcgcctgctcccgcccctctactggcacggcatgctcatggggcgcgagtggatggccaagcccaagcgggcggtttga

SEQ ID NO: 7829 - DNA, 501 bp, Methylobacterium sp.
atggacgacaacacatcccccgacttgctgacgatggcggcggatatcgtcgctgcctatgtcagcaacaactccgttccagcaagcgatttgccgaccctgctggtgcaggtgcatggtgcgtttgtcagcctgtcagcaacaccggcagccgaagccgatagcgagatcgagaagccgacgccagcgcagatcaagaagtcggttacgccggacgcgctgatctcgttcgttgatggcaagccgtatcgcaccctgaagcggcatctcagcgtgcacggcctcacgatcgaagggtatcgcgctcgctacggactgccgaacgattacccctcagtcgctgcaaactactcggcatcgcgctcggcgctggccaagcagctcggcctgggcaatccgcgcaagaaagcggagcctgcgcctgagccggcacctgaaccgacgatggcctctaagccgaagcgcgccggtcggtctcgcaaggtcgccgaaccggcttga

SEQ ID NO: 7830 - DNA, 1647 bp, Methylobacterium sp.
atgcccgctaacccgctcctaccggtcgccgagcccgccacggcgacgctgacccttcccgacggggtgagccttgccgccgatgtctggcgcccggccggacccggccgccatcccgtcctgctcatgcgccagccctacggccgcgccatcgcctcgaccctgaccctggcccatcccgcctggtacgccgcccgaggctacatcgtcgtggttcaggatgtgcgggggcgcggcggcagcggtggcgccttccgcctgttcgagcacgaggccgaggatggcgcggcgaccctcgcctgggcggcggatctgccgggatcggacggccgggtcgcgacctacggcttcagctatcaggcggtaacgcagttcctcgcgctggcgggcgccctgcgcgcgggcaccaagcggcccgacgcgagcgtgccggcaatgggcgcatggagcatccgcgacgactgggcctataccggcggcgcctttggccttgccggcaatattggctgggccagccagatgggcgccgaggctgcccggctccggggcgacgccgccgccttcgcggcgctcggcgcggcggcgcgcggcacgccctggagcggaccggtcgcggcctatcccgaggcgctcgcggcccacgccgccgaccaccactatttcgattggcttggcgacgatccagccctctgggaccggatcgcaccggcccgccgcctcgccgggagcgacctcgccttgcccagcctgcatgtcggcggctggcaggattttttgctcgacggcacgctcggcgcctacgacgccttccgcgccgggccggcgccgcagcgtctgctgatcgggccctggacgcattccccctggggtcgccgggtcggcagcctggatctcgggccagaggcggtcacgccggtcgatgccgcgacggtcgccttcctcgatcacgtgctgcgcgggcgcgaggaaccgggtccgcccgtccggctcttcgacgtgggggctcgcaattgggccggtttttccgaatggccggaccccgaaccgacagcgctgtatctcgcctcggacggtctcgccgcgaccgctgcgaacggccgcctcgtggcggcaccgggggaggccggcgaggaccgcctcgtgcacgatccctggcgccccgcgccggtcgtcggcgggccctgggggacgccgccgggctatcaggaccgcgccgccctcgacgaccgcagcgacgtcgcggtctatgacggcccggtgatcgccgcacccctgcagctcgccggccgcgtggcggcggaggtgttcgtcgagaccgcggcggcgagccacgacctgcacgccacgctctccctggtggagccggacggacgcgccgtcaccctcaccgccggccatctgcgggtggtcgaggccgccgcacccggccctcgacgcatcgccatgcggggcgtgtgttgcacgctgcggccggggcagcgcctacgcctatcgctccaggccgccgcttggccggccttcgccgtcaatccgggaaccgggagccgcccggaggcgaatgcggcgatgcaggcccaggtgatcgttcttgctctccgccacggtgccgagcggccgtcgcggctgctgctgccggtgctcgggtga

SEQ ID NO: 7831 - DNA, 549 bp, Methylobacterium sp.
ttggcgcggcggctggaaggggtggcgcggccctggtgcgtcgtcggcggctgggccctcgacctgtggcacgggcaccagacccgcgaccacgaagacctcgaattcacggtgctgcgcgacgatgtcggggtcttccgccaagccctatcggacatgacgctctacacggtggccgacggtcgcttcgagatcctgcctgaaggcgcagagccgccgcctcacattctccagatctggtgcttcgatgcccgcgccgcccgctggcgggtcgatctgatgatcgagccgggtgagcctgacgtctgggtctgccggcgctgcccggccatccggcatccccgcgcggagatggtggcgtcgacgcccgacggcatcccctatctcaggccggccgccgtcctgctgttcaaggcgaagcatcggcgcgacaaggacgcggccgatttcgagcgggccctgccgcatctcacccacgcagaacggcgctggctgcgcgagggtctcgaccgcctgcatcccggacatgcctgggcgcaggcattgtag

SEQ ID NO: 7832 - DNA, 249 bp, Methylobacterium sp.
atgccacgcaacgcacacacaacgatccgctcgggcgacgcccggctcgaaacggcggcccttctgctcgcggggttcaccgcgctgattgccatcggccgctccgatcccggcccgcgcgcctgcaccggcgcgccgccggtcgcggtcgcccggcccatgtcggaagccgcgctgctttctacgaaggaggccgaggcggaagccgcgcggcaggcgatcctgcgcgacatgcggctccacgactaa

SEQ ID NO: 7833 - DNA, 432 bp, Methylobacterium sp.
atgaccatcgccgagaagatcgagcagagcctgaccggccggccgaactcgttcgtgccggcccataccctgcaacggctgcttggtcgctcgcagcccgaccgagacgatatcgtgatgaactgggccatgcactggggccagggcatcgccctcggcccgcttcgagccctcatggccgagcacggcatgcgaggttcggtcgcctcgttcctgttcctgaacgcacggctcttcaacgatcaggccctggagaacgtcacgggagccggtgccccgccgtggacctggccactcgacgagcaacgcgtcgatctcctgcataaggcgatctatgccttcgtgaccggctacgtggcggaccggctcgcggcgggcgaggaccgaaacagggagcacggacgcgccttctacgacgagggcgccccttga

SEQ ID NO: 7834 - DNA, 180 bp, Methylobacterium sp.
atggacctgcagaccacgatcagggacgccatcctgactgaacttcagcgtcaagcggaggcgacggatgccgcgccgaaggtcagcctcgcggaggacggctttgtcgacatccaagggcggatcgatatcgacgcgttgattatggtgatcacgggctctctcgccggaggaccgtaa

SEQ ID NO: 7835 - DNA, 513 bp, Methylobacterium sp.
gtgagcctttctcggtcgagccgcgccgccggcatcatcgggccggggctgctcggcacccggctgcttctatcggcggccggaacgatccccgtactcctgacgaccacggcagcgcggggcgcggcgatcacggcgccgggcggatgtcggctgaccgtcgatgtccccaagggtttttcggcccagccatatggcgagagcatcgtcctgcgccccatcgggcaggagcgccggcgcagcgtgttcgagatcaggctgacgcccggacacggcagagacgcgaccgccctgacggagcgccggccgctcggtggaacgatcgcccgttaccggatgacacgcgaaaccgggggatcgggcggcgaggagacggcgctcatcgccgaggtccagcgtgtaggcggtgtcatccgtctcgaagcgtcggtgcagcgagacgatggcgccgagccggatttcgaaccggcatggtcggctcttgcgacggcgcgctgcaccgagatccgctga

SEQ ID NO: 7836 - DNA, 387 bp, Methylobacterium sp.
atgttcgcggccgatcgtctgatcctcgcaacggccgtcgcgctgctctgtccgtgggcggcgcaggctgagtcgctctgcgagcgcaccgtgctgccgttccgtgccatggtggcagccctcaaagcagagccaggggcccaggtgctgcgggacaacggctcggtcatcgagattgaggacccgaaacgctttatcatctggacgctcgtccgtcccggcggcaccgcaccaggcgcccatatctgccggagggtcgtgcaggagaatggcgagatcttcatccagctgaaggcctactgtgccggaaagaagtcggattgcgacggcgtgattcagggggtcctgaaggcgcagaaccaagccgtggaacgatttcggcagtaa

SEQ ID NO: 7837 - DNA, 366 bp, Methylobacterium sp.
atgcagcagcaccttcctgcctgggcctgcgtcctcgtgatgctcgctggcgaggcgagcgcgcaggaagcccgatcgcccctgatcgacgcggcggactcgcgcatgcagatcggcgccgcctcgctcgtgccgacgctccgccgccgctggctctatgctgatcacaagctcgtcgtcgggcgcgtaaaggatgtgcgggtctcggccgacggcacggcgctgatcgcagtggtggcccgccgccgctggctcgggggtggggaggttggcatcccggttcctctcctgcggcaggcggacaacgacctgaccgtcagcgccacacgcgagaccatcgggcagcttccactcttcaagccgtga

SEQ ID NO: 7838 - DNA, 282 bp, Methylobacterium sp.
gtggtggcagcgccccggcccgaaccgaagcctgcggcccccgccaagcccgtcgcacccccgccgttcgtggcgccgcccaagccggatgcggtgaagtccgaacctttcaaggctgagccgccgaggccggagcccgccagacccgagccgtccaagccggagccggcgaaggccgagccgccggagcccgccgctcaggcgcagaacccgttctcggtggaggagatcgaggccgagttcgcccgcctcctcggacgcccgctcgacagcaagaactga

SEQ ID NO: 7839 - DNA, 906 bp, Methylobacterium sp.
atgctgcatcatcgcctgctgggctacctcgacgaggtggcccgcagcggctcgatccgccgggcggcgacgcgcctcaacgtcgcgtcgagtgccgtcaaccgtcagatcctctcgctggaggaggagatgggcacgccgctgttcgagcggctgccgcggggcctacgcctcaccgcggcaggcgaggtgctggtgcggcacgtgcgcgacacgctgaacggccacgagcgcatgctggcgcaggtcgcctcactcaagggcctgacccgcggcgaggtgacggtggcgacgatggcgagcatcgccgccggggtgctgccgggggtgatccgcaccttccgcgagacccatccccgcatcgtcgtcaaggttctggtcctgccggtcgatcagatcgccgccgccctgctcgcgggcgaggccgacctcgccttggcctaccggctcccacccgatccgcgcatgcgctgcatcgccgagttcgagcaccgtctcggtgcggtgatggcgcccgaccatcccctcaacggccgctatcaggtgcgcatggccgattgtctcgaatatcccctcgtcgtcgccgaccgctcgatgaccctgcgcgacgtgctcgaactcctcgtgcccgagggcacgagcttcacgcccgtggtcgagacgaactccatcgagctgatgaagcgcctcgcccagacggccccgcacatcaccttcgtcaacctctcggatgtcggcgaggagatccgccgcggcgtgctggccttcacgccgatctcggatgccagcgcgatcatccagcgggcgtcgctgatgcagcgcgcccgctccgcgctcgacgggcccgcccacctcctggcggcccggatccaggccgagttcgagcgccagagcgttccggactga

SEQ ID NO: 7840 - DNA, 969 bp, Methylobacterium sp.
atggtccgtttgtccgctctcctcgcgacgctggccgccctcgtggcgtcgccggcgctcgccctcgacaaggtctcgttcggcctcaactgggtgccggaggccgagcattgcgggttcttccaggccaaggcgacgggcctctacgagcgggccgggctcgatgtcgagctgagacccggcaatcccaacgtcaacatgccgctgctcgtcgcctcgggcgaactcgacatgggcatggggtcgagcttcaccacgctcaacctcgtcgccaagggcatcaagacgcgcaccgtggcggccttcttccagaaggatccgcagacgctggtggcccatgccggccaaggcgtcgcccggctggaggacctgaggggccggccgatcatggtcggcggcttctcgcgcaacgagttctggcagttcctcaaggcgcgctacggcttcaccgacgatcagctcaggccgttcgcctattccgcggcccccttcctcgccgacaagcgggcggtgcagcagggctacatcaccgaggacgcggccctgctcggcaaggcgctgcccgaaccgccggtctcgatcctgctggccgattatggctacgacaactacgccacctcgatcttcgccaccgaggccttcatcgccgccaagccgaagctcgtccgcgccttcgtcgaggcgagccggaagggctgggaggcctgcatggccggcgattacgagcccgccatgcgggcggtgctcgccctggttccgaccggcggcgaagacctgttccgcttcaagatggatcagatgaagcggcgcggcctcgtcgagggcggcgacgcggcccggctcggcctcggcgcgatgacggatgcgcgctggcgctcgttcttcgacgtcatgacccaggccggcctctacccggcctcgctcgacgtccgccaagcctacacgctcgacttcctcgcccaaccctga

SEQ ID NO: 7841 - DNA, 714 bp, Methylobacterium sp.
ttggcgccgctggagccagcgcttccggaggccggtgtctccggcttcaccgtgctgctgccggtcgtgccgcccttggcggacgtgtccggtctggcatcggtcgccttagcgccggccggattcggcggaattgcgctgctgccggtggcgcccggcttcgacggtgcattgcctcccggtatgccggaggcagcggccggcgcgccggacggctttccgggctcggtgggtttgttggacatcgttcctgcgctggtcgaggcggccgacggagggaccgcgctgctgccagtggcgccgggcttcaacggcgcgtctgctcgagcgtcctgcgggcgcgcggaagacccaggcgcattgctaccggccagggcgctgctgccggtcggacccgcctttgcgggctcggacttgaccggctccaacgccgctggccccgacctggccggctcgaccttcggggtggaggccgctgcggacggctcgccaggcttgcccatcgccttgtcggcgggccgggacgaatccttcgtcacgtccctggccgcttcccgggcctgctccggcgacttgccttgttccgaagacttgccttgctccgaaaacttgccttgctccggcgacttggcgccatccctggcgccgtccttgggtgaagtcacgggcgttcgctccattcagccgccgcaccggcgcagtgtgctcccatag

SEQ ID NO: 7842 - DNA, 216 bp, Methylobacterium sp.
atgaagaagaccacgctcgcgctggcaatcctgcttggaggctttgccgccggcaccgcatcggcagcgccgattgcacccgctggcatccaagccgacagcagcgtcacgcaggcccgcatgtcccaccacgagcggcggatgatgcaccggcacatgatgcgcaagcggatgatgcatcggcaccatcaccggtcgatgcgtcatcggatgtaa

SEQ ID NO: 7843 - DNA, 267 bp, Methylobacterium sp.
atgtggcgccggggcaatagcttcatgcgcgcgatttcggccgttccgcggaaggctgccggctggctgctgccgcataccgtgctcgcgcatagcgagctgaccggccagagccaccgcgtcgtcgatcccgccgcgcggttcgccggagacggctgtttcgacctcgacctgcgcgccgaccgggcgacggcgaggtccgccgctgccacatggttccggcccggatcggcaacctctacgatccggatttcgacacggccctga

SEQ ID NO: 7844 - DNA, 546 bp, Methylobacterium sp.
atgaaaggcgtcgtttttacggagttcctggacttcgtgtccggggcgctcggttccgacgtcgccgacgacatcattgatgacgcggacgtcccgaacggcggggcttacacggcggtcggaacctatccgtataccgagatgcaggccctggtgaccgccctgtcgcgccgcacgggcaagcccgtgcccgacctgctgacgctgttcggccgccatctctgccgacggttcgcggtgcgctatcccgagttcttcacggtgcagacatcgctgttcgatttcctggaaagcgtcgacgcctacatccaccgcgaggtccacaagctttaccccgacgccgaactgccggtgttccgcctcacccgctacggctcggatgcgatcgatctcgattacgagagctgccggcccctcgaagcgctggccgagggcatgatccacggcgcggccgaccacttccgccagcccgtcgccatcgccaagctgagggtcgagcacccggccggccccttcgtgcgcttctccatcaagcacgcggcctga

SEQ ID NO: 7845 - DNA, 1425 bp, Methylobacterium sp.
atgtacggcgccgtgctggcgggggcctcgacggatgcggcggccgaggccacgcccaaaaatgccccagccaaaggtgcccccgccaaaggtgcccctggcggaaacgtgaccctgatccgcggcgcctacgtcatgaccatggatgccacgcggggcgacctgcccgaagccgacatcctcgtgcgcgacgggcgcatcgctgcactcgatcgcgctctgccggtaccggcaggcgccgacatcgtcgacgcggcgggcgcggtggtcctgccgggcttcgtcgatgcccacacccacggctcgatcagccagatgcggggcctctacggcaacacgcccgagaccgcattcttccccgtcaccaaccggctctcagcgcactacacgccggaggacacctatctcggcatgctgctgagcgccgtggagaatgtggcgtccggcatcaccaccaccgcagatttcttcgacatcgtgcgcgaccgcgatcacgccgaggccggcctcagggcgctgcaggacgcgccgatccgggcgaggctgctctacgggatgaagagcaagaccacggcggacccgatcgatcttgctcatgtcgaggaatggcagcggggctgggcacagcgctcggcgggcggtcgcctctccctcggactcgcctggcgcctgccgcaggatctcgacgacgcgcaggcctggacgatcaaacagagggaatgggaggcagcccgacggctcgggctgccgatgcaggtccatgtcagcggcacggtgccgggacgggcggcggcgatgttcgacgccctgatcggccggcggatgctgcatccgaatctgcaggtcattcatgcgacggacgcccgggatgaccaactcgccgcgctggaggaggccggctccggcctcgtggtcacgcccctgaccgagcatcgggtcggctacggcctgacccggatcgatcgcttcgccgggactcggcgccttggtttcggcatcgacgggagcgcgctggccgggttcaccgatatgttcgccctcatgcgcctcgtcgcgctcacccaggccggcgccacgcgtgacgagacggccgtttcgccccgtcggctcctggaactggcgacggtcggcggcgcccgggcgctgggtctggacgcggagatcggcgcactcgtgccgggccgcgcggctgatctgcagatcgttcggctcgacgcatggcacctcgccggtttcgacggcggcgatccatcgggactgctggtctactcggcccggccggaggatgtcgcggccgtcatggtcggaggccggttcgtgaagcgcgaccgtcgtctccttggcttcgatgctgcggcgcttcttggccaagcccgctcgtccatccgaagcatccgtcgacgtgctctccgggctgatccttga

SEQ ID NO: 7846 - DNA, 1404 bp, Methylobacterium sp.
atggacatcagtcggcgcgacctggggaaagctctcggcggcgtcgtgctcgtgggcgcggcgagcgatgcgcgggcggccgacggtctgccgggcggcgtcacactgatccggggcggctacgtcatgaccatggatgccgggctgggcgatctgcccggcgccgacatcctggtgcgcgacggacggatcgccgggatcgggcggggcttggcggtgccggaaggcgccgtggtggtcgaggccggcggcatggtcgtgcttccgggcttcgttgatgcccatacccacggcgcgatcagccagatgcggggcctgtacggcaacacgcgcgagaccgccttcttcaccgtcaccaaccgcctcctggctcactatacgccggaggacacctatatcggcatgctgctgagcgcggtggagagcgccgcctccggcatcaccaccacggcggacttcttcgacaacgtgcgcgaccgcgcccatgccgaggccggccttcgggcgctgcaggatgcgcccgtccgggccaggctgctctacggcatgaagagcaagaccgacgcggaccccatcgatctcgcccatgtcgcggagtggcagcagggatgggccgagcgctccgtcggcggccgcctgtcgctgggcctggcgtggcgcctgccgcaggacctcgacgatgcggcggcctgggcgatcaaggccagggaatgggagacggcccgccgcctcgacctgccgatgcaggtccatgtcagcggcaccgtcccgggccgggcgacggcgatgttcgatgccctgatcgcccgacggatgctgcatgccgggctgcaggtcgtccacggaaccgatgcgcgcgacgaccagctcgccgcgttggaggaggccggcgccggcctggtggtgacgccgctgaccgagcaccgggtcggttacggcccgacccggatcgaccgcttcgatggcatccggcgtcgcggcttcggcatcgacggcagcgccctcgccggcgccacggacatgttcgccctcatgcgcctcgcagcgctcacgcaggccggcgcggcgcgcgacgagaccgccgtccggccccgccacctcctcgaatgggcgacggccggcggtgctcgggccctcgggctcgacgcacagaccggttcgctcgtgccgggccgcgccgccgacctgcaactcgtccggctcgactccctgaacctcgcgggcttcgacgggggcgacccgtcggccctgctggtctattcggcccgccccgaggacgtcgccgccgtcatggtcgagggccgcttcgtgaagcgcgacggccggctcgccggcttcgatgccgcgacgctcctcgaccgggcgcgccagtcccttcgaggcgtccgcgcacgggcaggctga

SEQ ID NO: 7847 - DNA, 981 bp, Methylobacterium sp.
atgcctttcctgcgcacctttccgaccagggcggcggatgccgccggcccgtcaccatcgacctacggcctgctgctcctgtcggttgcggctgccatgtgcgttcagagtctgacggacgtctggcttcacacctccgttgtgcagtggcttgctccgctctcgatgcttgctggtgctgtctacttcagcacccgcccgatctctcgccgtcgcttcggcgcaggactcgccctgctggccgtcttgatcatacagctgcccacgaccagcgctctcgcctacggcgttcaagccttcggcctgccgctgcgcgacgactggttcatcggaattgatcgcgccttcggcttcgattggctgacgttccagacctccatggtcgagcgacggggtttgatggagatcctgagtcgagcctacgagacattcttcctgcaactcggccttacgcccgtccttctcgcggctctgggcgaagtgcgtcgctccgatcgtttcgtagcgtccttcatcctctgcgtgtcgatgacgaccatcatcagcgccgtgttgccggcagagggcgcggcaggcctcctcgggccggacgaggcgcatctgctcttccagggcgcgacgccgctcgtggatctgcatgcgttgcgggacggcacgatgcgcgccctgcctctgaacgaagtcgggccgctgatctcctttccgtcacttcactgcgctgtggcctaccttgtgacggctgcgatctggccgttgcagcgcttgcgctgggccgtgctcctcctgaacgccgtgatgacggtttcggccgtgacacatggtgctcactatgcctgcgactgcgtcgcgggcttgctcgtcgctgcggtgtcgttccacctcgccgggcaactggggccttggagcgagagaatggtcgcgcggatgcgcggtgtggcggtgctgcctgccgccaccgcttcgaccgcgctgactccgtag

SEQ ID NO: 7848 - DNA, 435 bp, Methylobacterium sp.
ctcgaagcccccgcccccgcccggccgaggccagatgcggatgccgaggcgcatctgcggatcctcgtggtcgaggacaacctcgaagtgggccgcttctgcacccagatcctggaagaactcggccaccagccggtctgggccgagaacgccgaggcggctctggtcgagctggaacgcaccgagacgccgttcgaggcggtgttttccgacgtcgtgatgcccggcatgggcggcatcgccctcgcccgcatcctgcgcgagcgctaccccgatctgccggtggtcctcacctccggctacagccacgtcctggcgcaggacgacgcgcacgggttcgagctgctgaggaagccctactcggcgcaggagctggggcgagtgctgaaggagatggcggggcggcgggggaggcgggagacggcctcgcgctga

SEQ ID NO: 7849 - DNA, 1653 bp, Methylobacterium sp.
ttgatcgcgtgcgcctcgccggaggatcgcgtgcgggccgcggccggacgggccgtgatcgcccgtcctcctcggcacgtcggtcgcgagagcaagaaagggcacggctccatggagcgcagggacatcctcaagaccggactgctcacgtcgatcggcttggcggccggtgcgacgatcccgaaggtggcggccgcggagaccggcaaggccggcgtgcagcccgccgggagctctgcgacggatggcggcgagtgcttccgcgtcgagaaggacagcatgggtgaggtgaagatcccctgcgacaagctgtggggcgcccagacgcagagatcgatcgagaatttcgacatcgggatcgagcggatgccgcgtgagctcgtgtcgagctacgcgatcctgaaaaaggccgccgccaacgtcaatttcgcggatggccgcctcggcgagacgcagcacaagctcatcgttcaggtctgcgacgagatcctggccggacagcacgcggagatgtttccgctgcacgtctggatgacgggcagcggcacccagttcaacatgaacgtcaacgaggtgatcgcgaaccggtcgagccagatcgccggtcagccgctcgggagcaagaatcccgtgcatcccaacgaccacgtcaacatggcccagtcgtcgaacgacaccttcccgacggcgatgtacatggccgccgcgatcgcggtccggcagcggctcgcgccctccatcaccgagctgcgggacagcatcgccgcgaaggcggaggcgtggaaggacatcatcaagatcgggcgcacccatatgcaggatgccgtcccgatcacgcttgggcaggaatggtcgggctattcgggcatgctgagcgacaacctggagcgcttcgacgatgcgctgaagggcgtgtaccgcctagccctcggcggcaccgcggtcggcaccggcatcaacgcgcagccgggctttgccgaggcgagcgcgaaggagatcgcgcggctgaccggcctgcccttcgtcacggcgcccaacaagttcgtggtccaaggcgcgcacgacgccatcgtccacctgtccggcacgctgcgcacgctggccggctcgctctacaagatcgccaacgacatccggctgctgtcctgcggtccgcgcgcgggcctggccgagctgatcattccggagaacgagccgggctcctcgatcatgccgggcaagacgaacccgacccaggtcgaggcgctgacgatggtcacccttcaggtgatgggcaatgacgtcagcaccgggttcggcggcgccagcggctcgctcgaaatgaacgtctacaagccggtgatgatctacgacgtcctgcagtcgatccggctgctgagcgacggcagccgcaacttccgcaagcacctcatcgagggcacgaagcccaatcacaagcggatcaaggactacgtcgatcgctcgctcatgctggtgacggctttggccccgacgatcggctacgacaaggcgtcgaagatcgcccacctcgcgcacgaggaggatctcagcctgcgggaggcggcgctcaagctcggctacgtctccgaggccgactacgaccggattgtcgatccgcgcaagatgatcgccccctacgtcgccaagaagtag

SEQ ID NO: 7850 - DNA, 1380 bp, Methylobacterium sp.
atgtccgagccgccattcctgcccgaggcccgcgcctaccgcctgcgcaacgcgcgcgtgcccggagccttcctgacgggcggcgtgccggccggcgcgacactcgacggggacggctgcgcgctcctcgacatcgtcgtcgcggacggcgtcgtcgcccgtctcctgccggccggggggacgccggacgcctcgccggatacgctgcccgccgccgatctcgccgggcggcaggtctggccgcgcctcgtcgatgcgcacacccatctcgacaagggccacaccgtcgcccgcacgcccaatccggccggcgactttcccggcgcccgcgacgccaccacggccgaccgcacccgccactgggacgcggaggatctgcgctgccgcatgaccttcggcctcgcctgcgccttcgcgcacggcacgggcgcgatccgcacgcatctcgacagtcaggagagcggggagggcgcgctgcgcgaccaggccgcgacgacctgggcggtgttccgggagatgcgggcggcctgggccgggcggatcgcgctccagggcgtcggcctgaccccgatcgacgcctacgccaccgattacgggcgccgcctcgccgacctgatcgccgattcggacgggctgatcggcggcgtgacccggccgaccggcggcctgcatggcggggcgctggccgagatcgacgccctgctcgaccgcctgttcggcctcgcccgcgcgcgcaacctcgatgtggacctccatgtcgacgagaccggcgatcccgcggcggcctccctcgacgcggtcgcgcgggcgaccctgcgccacggctacgagggccgcgtcacctgcgggcattgctgcagcctcgcgctccagcccgaggcgcaggcttcggccacgatcgcgcgggtcgcacaggcgggaatccgcatcgtcacgctgccgaccgtcaacatgtaccttcaggaccggcagcgggggcgcaccccgcgctggcgcggcgtcgccccggtccaggaactgatggcagccggcgtgcccgtgatggtcgcgggcgacaattgccgcgacgccttctacgcctacggcgaccacgacatgctcgacacattccgggcgtcggtgcgcatcctccatctcgatcatccgctggccggcgcgcccgcgctcgccgggccggtgccgggggcgatgatgggacttccccatgccggcacgatccgcgagggcgcccccgccgacctgatgctgctgcccgcacgcagcctcaacgaggtcgtcgcgcggccgcatgcggaccgaatcatcgtggtcgcgggccggcccgtcgcggcgcggctgccgccctacgaagccctgaccggtgaggccgccccctggtag

SEQ ID NO: 7851 - DNA, 423 bp, Methylobacterium sp.
gtgccgatccgccccgaacaccgccacttctacccgatcgactggccgcagctctcggcggtgatccgcttcggccgggccggagggttctgcgagcgctgcggacgcccgcatgggcgggtcatcgtctgcgtcgatgacgggagctggtacgatgccgacggcggcgtctggcgctcgggccgggggcgcattctgcggcgcatgccagacctcgcgagtgcccggctgacccggccgatcctcgccgcctgccaccgcgagcacgacacaagccgcaacggccccgccgatctcgccgcctggtgccagcgctgccacctggagcacgaccggccggagcacatccggcggcgacgcctgaccttcctgcgccgccgggcgctgggggacctgttcctcgggctgtatccggtgctctga

SEQ ID NO: 7852 - DNA, 1410 bp, Methylobacterium sp.
atgaggccggtcgatccccttcccggcggcccgccgcgagacggcgtcgatgcggtgccgcccgcgccgcgcctgttcgtgctcggattgcagcacgtgctcgtcatgtacgccaacgccatcgccgtgccgctgatcgtcggcggggcgctgcacctgccgaaggaccagatcgcgcttctcatcaacgccgacctgttcgcctgcggcatcgccacgttgatccagacggtgggcatcggcccgttcggcatccggcttcccgtcatcatgggcgtgaccgcggtggcgatccagccgttgctcgccatcgcggcgatgcccggcgtcggcctcaccggcatctacggcgctgtgatcgtcggcggcctctacgggctcctcgtcacgcccttcatcggccgggtgatgcggttcttcccgccggtcgtgaccggcacgatcctcctgatgatcggcatcgcgctcacccgcgtcgccgtcggctgggcgggcgggggtgcgggtagcgccgatttcggtgcgcccggcacggtcgcggtggcggcgggcgtgctcgccgcgaccctgctcatcgcccggttcggtccgggcttcgtcggccgcgtcgccgtgctcctcgggatcgggctcggatacgccgtcaccctggcactcggctggacgagcttcgagggcctgggcgccgaaccgtggctgcgagtggtgctgcccctgcagttcgggctgccgaccttccacctcgtgccctgcctgatcctgtgcctcgtgatgacgatcgtcttcatcgaggcgaccgggatgttcctggcgctcggcgtcatgaccgggcgaaaggtcgcgaccgaggacatccgccggggcctgcgcgccgacgcgctcggcacgctgatcggcggcctgctcaactcgtttccctacctgtcctattcgcagaatgtcggcctcgtcgggctcaccggcgtgcacagccgctgggtctgcgcggccgccggcgggatcatgctggtgctcggcctcgtgcccaaggtcgcctatctcgcggcctcgatcccgcagccggtcctcggcggggcggcgctggtgatgttcggcatggtggcggcgaccggcatccgcatcctggctcaggtcgattacgcccgcgcgggcagccgcgacgcgctgatcatcgccgcctcattggggatcggcctgatcccgatcgtgcagccgctcttcttccgggccgtgcccgacgcgttcgggccgatcgtgaaggatccgatcctgctcaccgcgatcgcggccatcctgctcaacgccctgctcgggcagagcggggctcagccggaagcggagaggtccggcagcgcgatcggcgcgtccgagcccgagatcgccgcctccagcaggtcgagccggtcctga

SEQ ID NO: 7853 - DNA, 987 bp, Methylobacterium sp.
atgcggtcgatccgattcgatacgggggcctccgccctcctggcggtcaccttagggctggcgatggccgggcccgcccaggcagcggacaaggtagtcttcctgacgagctggtacgcccaggccgagcacggcggcttctatcaggccaaggccaccggcctctacgagaaggccgggctcgacgtcgagatccgcatgggggggccgcaggtcaacgggctgcagctcctgctcgcgggcgaggccgacgcgatcatgggctacgacatccaggtgctccaggcggtcgagaagggcctgcccgtggtcaccgtggcggcctcgttccagtacgacctccaggggatgatgacccacgacgacgtcacctcgctggcgggtatcaaggacagggcgatcctcgtctcctccgccggcatgacggcgtggtggccctggctgaagaagaaatacacgctctcggacgcccaggtgcgggcctataccttcaacctgcagcccttcttcgccgacaagaacgtcgtgcagcaggcctatccttcctcggagccgttccaggcgcaggagaagggcgttccggtcaacttccatctcttcgccaaggacggttatccgccctacggcaccacgatcgtgacgacgcgcaagctcgccgagggcaagccggaggcgatgcgccggttcgtggccgcctccatggaaggctggaagagctacatggagaacccggctcccgccaacgtgctgatcaaggcggccaacccgaagatgagcgacggccagatcgccttcggcatcacccggctgaaggcgctcaaggtgctgggcggcgaggagaacgtccccatcggcaccatgacggaggctcgctggaaggcatcctacgactacctcgtcgaggcggggctgctcaaagcctccacggactggaagcgggccttcagcctcgatttcatgcccgtcctctcggcaaaagccgagtga

SEQ ID NO: 7854 - DNA, 882 bp, Methylobacterium sp.
atggccagcccgcttccggcctatccgcggccggccgaggcggccgcgccggcctcggagcggctgacacggcccgccgcgaacgcggcgccggccatcgagatcctctcggccgagaaggtgttcgccgacggcacccgcgggctcgccccggtcgacctgacggtgcgcgagggcgagttcctgtcgctgatcggcccgtctggctgcggcaagagcaccctgctctcgctcgtggccaatctcagcgagcccagcgacgggcgcctgctgtggtggcgcggcggcttcaacggtgtcggcgcggaggggcggcggatgtcggtggtgttccaggacgccacgctgatgccgtggctacgcatcgccgccaatgtgcgcctgccgctcgacctcgcgggcgtgaagaaaacggaggctgccccccgggtccaggccgcgctcgatctggtcggcctcggcgagaagggtcggagctatccgcgccagctctccggcggcatgcgcatgcgcgcggccatcgcccgcggtctcgtcaccgagccgaacctcctgctgatggacgagccgttcggcgcgttggacgagttcacccgcaacaagctcgacgccgacctcgtggacctctggtggcggcgctcgctcaccgtgctgttcgtgacccactcgatctatgaggcggtgtttctgtccacccgcatcgtcgtgatggcggcgcgtccggggcggatcttctccgagctgaccatcgacgagccacatccccgcggcgacgctttccggcgctccccgcgcttcgccgaatattgccagcgtctctcggcgctgctgaccgaggcgtcgctggcgagcgatccggccagcgcggaggcgcgggcatga

SEQ ID NO: 7855 - DNA, 1074 bp, Methylobacterium sp.
atgctgacgacccgccagaagctgtggcgccattactggtacgcgaccttgcgcctgtccgacctcgccgacggccccaagcccttcaccctgatgggcgagcggatcgtgctgttcctcgacggcgagggcgagcccgccgcgatgatggaccgctgctgccaccgcaccgcccggctctccaagggctggtgcgaggacggcctgatcgtgtgcggctatcacggctgggcctatgaccggcacggcgcgctcgcccgcatcccgcaattcagcccggagcaggtcgtgccgcggctcgcggtgaagagctaccactgcaccgcgaagtacggctacgcctgggtctgcctggaggagccctacgcggcgatccccgagatccccgaggacacgatgcctggctaccggcgcatccagcaattccacgacgtgtggaagacctcgcccctgcggctgatggaaaattccttcgacaacgcgcacttcgccttcgtgcaccagaacacgttcgggcagatcagccagccgatcccggaaaagtacgagatcaccgaaaccgagtacggcttcgaggcggagacgatcatcaccatcgccaacccgccgatggctcaccgcatcagcggcaccaccgagccgaccaccaagcgccacatgcgcaacaagtggttcatgccgttctgccgccggctcgacatcgaatacccgtcgggcttgcggcacatcatcttcaactcggcgacgccgatcgacgacggcacgatccggctcgcgcagatcctctaccgcaacgatcgcgaggaggattgctcgacggaagcgctgatcgcctgggatgcggtgatcgtcgaggaggaccgcgacatcctcgaatcgaccgacccggacgccacggtcgatatgggccgcaaggtcgagagccacatgccctccgaccgtcccggcatgatcatgcgccgccgcctgctggccgccctgcacgcccatggcgaggaggaggtgtccgaggcaacgccggcggtctccgtgccggtggcgccgacgctgatgccgcacgagagggtcgcgtga

SEQ ID NO: 7856 - DNA, 972 bp, Methylobacterium sp.
atgcggcaggcggatctcccgatcgtcgatatcgccccgttcatcgacggcgacgccgccgcgcgggcgggggtcgggcgcgccttcggacatgccttcgagacgacgggtttcgccgtcgtcgtcggccacggcattcccgagcgtctggcgaacgacgtctacgacgcgatgaagcgctacttcgcgcagccgctcgcggtgaagagccgcgacgctgcgccggagaagaccaagggccggggctacctgccggtcggcatcgagagcgtcgcgcggacgcttcagggcgagacgccgcccgacctgtgcgaggcgctggtcttcaacgcgcctcatcgcgaggggccctcggcgcgccccaacatctggcccgccgagccgccggaattgcgcggcctcgtcgaggcgtggcgcgacgcgatcctgcggctcaccgggcagctcaccgaattgtcggcgctcgcgctcgacctgccgcaagactacttcgcgccctggttcgcggatccggcgctgacgctgcgcttcgtccactatcccgaccaggccgagccgccgatgccggggcaactccgctacggcgcccaccacgattacggcggcctgacgatcctgcggcaggacacggcgccgggcgggctccagctcgccgaccgcgacggcaactggttcgaggccggggtggtgccggattccttcgtcatcaatgtcggcgaccttctggcccgctggaccaacgagcgctggcgctcgaccctgcatcgggtgtcgaaccccgaccgtgcgctgaccggctcctccgcccgcctgtcgatggtcgccttcaccgcgccgaacgaacagtctgaagtcgcctgcctgccgagctgctgcgacgcggccaacccgccgcgctacgagccggtgaaggccggcgcctacatcctgtcgaagctccaggcttcgatggacctgacggcccgggcctga

SEQ ID NO: 7857 - DNA, 1389 bp, Methylobacterium sp.
atgccgagccgcccctcccccgacgccctcgcggcgctcaaggccgatctctccggccgcgtcgccctggtcgaggagccggcgcgggtgcgcaagcgctcgcgcgacttcttctggtactcccccgtcctcgacgccgaactgaagggcttgtccggcgacctcgtcgccgagcccgcgagcgaggccgaggtgatcgcggtcgccgcctcctgcgcccgacacggggtgccgctcaccgtgcgcggcggcggcaccggcaattacgggcaggcggtgccgctgcatggcggcgtggtgctcgacgtctccggcctcgaccggatcgagtggcagcgcgacggcgcggtgcgcaccggccccggcctccgcatgaaccgcctcgacggcctcctcgcggaaggcggagaggagatccggatgcatccctcgaccaagcgcacggcgagcatcggcggcttcatagccggcggctcgggcgggatcggctcggtgaattacggccagttgcgcgagcgcggcaacattcgcgccgcccgcgtggtgacgctggagccggagccgcgggtgctggaactgaccggcgacgcggtcaacggcgtggcgcatgcctacggcaccaccggcatcgtcacggcgctggagatgccggtggtgccggtccatccctggatcgacgtcatcgtcgccttcgacgacttcctgacagccgccgaggtcgggctagcggtcggccgcgaccccgcgatcaccaagaagctcatcacgccgatcgcctggccgctgccgcaatggttcacgccgctgcgggcgcagtgcccgccggggcaggcgatcctgatcgcgatggtgtcggagacgaccctgcccgccttccgggcgacgatggcgcgggagggcggcacgatcaccctggagacgccgctcgacgattcaccgggccacacgccgctctacgaatacagctggaaccacaccacgctgcaggtgctcaagaccgaccggagctggacctatctccagagccttcaccccgccgacgggctgatggagagcatcgccgagatggcggcgctgtttcccgacgagatcgtgccgcatctcgaactgatcgagttcgccggccggctcacctatgccggcattccgctgctgaagttcaccgacgcggagaggctgaaccacatcatcgcggcgcacgaggcgcgcggcgtctggatcgccaatccgcatgtctacacgctggaggacggcacccggcacaagcgggcggaaaccgaccagctcggcttcaagcggctgaccgacccgatgggcctgatgaacccgggcaagatgcggagcttcacgcccgccggcgtggcgaccggggcggtttgtttcacgtga

SEQ ID NO: 7858 - DNA, 588 bp, Methylobacterium sp.
gtgaaacgcattctttacctttactgccacccgctgccggagagctttcacgggtcgatccgcacggccgccctcgacgggttggcgcgggccgggcacgcggtcgatctgctcgacctctacgccgagggcttcgatccggtcctgaccgcggaggggcggcgccactaccacgacgtgacggtgaaccagcgggggctggaggattacgtcgcgcggctgcgggcggcgcaggttctggtggtgcagtttccgacctggtgcttcggcccgccggccatgctcaagggcttcatcgaccggctgatgatgccgggcgtcgccttcgacctctccgatccgcggcatgtccggccgaccctcgactcgctggagcgaatcgtcggcgtcgtcacctacggccgcccgcgctggatggcactggcgatgcaggacccgccccgccggatggtgacgcgctacctccgctggttcgccgcgcgccgggcccgcgccgagtacctcgcgctctaccacctgaacgtcgcgtccgatgaccgccgccacgccttcatcgagcgcgtgcgtacgcggatggagcggctttga

SEQ ID NO: 7859 - DNA, 1548 bp, Methylobacterium sp.
atgctgatgcatcgtctcctcacgctcggcgccgagcgccatcccgaccggcccgccttccactgggtcgatcgcgaccggggcctgacctatgccggcgcggtcgatgccatggagcgcatggcgggtgccctgcacgatgcgggcgtgggcaagggggatcgggtcacgatcttcgcccataacgggctcgactacatcgtggcgatgctgggcgcctggcggatcggcgccattgccgccctggtgaacgtgaagttcgccgacgaactgaccgactatttcgccgaccacacgccgagcgcggtggtctacacccacgacatggaagggcaggtcgccgccgcctgcaccgccatcggcacggtccgcgcccgcctgtgcatggacggcgcgcaggacggcgccctctccctgccggagatgctggcggccggcctgccggcgccgcccgatcccggcgacgagaccgccatcgcccacctctcctacacctcgggcacgacgggtaagccgaagggcgcctgcctgcgccatgagccgaccgtgcgggcctcccgctgcatcggcgagcggctgcggctgcggccgggcgacgtctcgttcgggccctcggcgctctccagctcctaccagctcgtcgccaacctgctgccgccgctcgccgtcggggccgcgatcaacgtgatgcgcttctggacgcgggagggcggctacgacgcgctcaccgcccgcggggcaaccagcctcgtcgccaacccgccgatcctcgacgacgtgctgcaggaggcccgccgccgcggtggtcccccgccgtcgctgcgcctcggcatctccggcggcgggccggtgccgccgacgctcaaggcggcgtggcgcgacgaactcggcctgccgctcgtggagagctacggccagagcgaactcggcggcttcgtcggcctcggctacccggaactggagccggacgatgccaaactcgggcgggttgggccgccgctgcccgacaaggaggtcttcatcctcgggcccgacgaccgggtgctgccgccgggcgagatcggcgagatcgcgctcaccggcggcttcatggccggctattggggcaagccggacaagacggaagccgcgacccgcggcggctacctgcgcaccggcgatctcgggctcctcgatgccgagggctgcgtcacgctgcgcagccgccgagcggaactcgtcgaggtggccgggcgcctgtggtatcctcgcgatgtcgaggaggcgctctcggcgcagcccggcgtggcgcaggcggccctggtcggcgttgccgacccggcactcggccagcggccggtcgccttcgcccaggcccagcccggcgtcgcgctcgatgccgcggcgctgaaagccgcgatcactggccgggtcgcctacgacctcaacccgctcgtcctcgtcgtcgtgcccgagatgccgatgaccccgaccggcaagatcgccaaggccgatctcgcccactccgatctcgcccggaacgctgcaaagaacatggcggcggcgtga

SEQ ID NO: 7860 - DNA, 819 bp, Methylobacterium sp.
atgcgccccgcctcgcgctggtggtgggatctgaccacggaggacttttcgcgcctcgactgggggccgctcgtcgcgatcctgcccgtggcggcggtcgagcagcacgggccgcatctgccggtgcgggtcgatgcggcgatcaacgccggcatcctcgcccgtgccgtggccctgatgcccgacgacctgccggccctggtcctgccgatgctgcccatcggcaagtcgaacgagcaccacgccttccccggcacgctcagcctctcccacgagaccctggcgcgcctgtggatcgagaccgccgagagcgtgcaccgcgccggctgccgccgcctcctgatcctcaacagccatggcgggcagccgcaggtgatggagatcgtcacccgcgagttgcgggtgcggctcggcatgctcgcggtcggctgtggctggggcggggtgacgccgatggacgacctgttctcgcaggccgagcggcgccacggcatccatggcggcgagatcgagaccagcgcgatgttggcgctccaccccgacctcgtgcggatggagcgggcggacgacttcgtgccgctctcggtcgcgatggagcgggccggcggcctgctgacgccggaaggccgggtcggcttcggctggatggcgcaggatctccacccgtccggcgtcagcggcaacgcggcggcggcggatgcccggcgcggggccgaactggtggagcgcgccgccgcgggcgtggtgcggctggtgcgcgagatcgcggatttcccgctcgaacggctgagttctggaacggccttcgatgcccgctaa

SEQ ID NO: 7861 - DNA, 813 bp, Methylobacterium sp.
atggatgacctcgtccttcgcatcatcatcttcgcgatcgttggcttagtctccggtttcatatccggattgttcggcatcggcggcagcaccgtgcgcctgcccattttcatttatctgcttccctgggtcggcatcggacaatcggtcctgatgcacgtggcatcggcaacatccatggcgctggtcatacccagtgcgattaccgcgatccgcaagcaatatgccctcgggaacctcgatgtcgggttttacaagacatgggtgatcggcctcttcatcggcgtcgccttaggggcaatcttgcttccgcatggatcgactgaaatcctgcagaccctgtttgcggtctatatcctcttggtcggcttctacatcgcgttcggccgtggacgcttttcgtccagaagcgaggcgccgtcgggcagcaagaggatcggcatcgcttcgttcgtcgggctcgtcgcggctttgaccggaacaagtggtggcacactgacgacgccgatcctgagcacctgcgggctcgctctcgaaaaggcgatcgcgatcgcctccgccaccggactggtgaccggaagcatcgcgacgatcgggggcatcctctccggatggcatgccccggatcggccctcctattcgctcggctacgtggacctcgtcatcttcgtcgtgatgatgccgacggtgatgatcagcgcgccctggggcgtctccgtcggcgagaagttcagcgagacgacgctgcaacggacctatgccgcgctgctcatcctggtcggcttggatcttctgcggcggctggcgttctga

SEQ ID NO: 7862 - DNA, 120 bp, Methylobacterium sp.
atgatgcagcagatccaccgcgccctcaccgcgatcctcggtctggtcgtgctcggcctccaggccaaggccgccgggcggctgccgcagggcgaccggggccgggagacgccgcgatag

SEQ ID NO: 7863 - DNA, 231 bp, Methylobacterium sp.
atgcgacctgcaccctttaccatcgtcatatccggcaagcggtacgagtgccgtgttgctgggaacactgaagccgaggccgccgatacggccgagcacatcctgcatcagctccgacaggaggagcgggtttggcctgggcaggtcaacatcgagtgcgaggatttcgaagcggcaaagcgtcttgccgcgtacttcgccaccatcaccgtcgaacccgacctcaagtga

SEQ ID NO: 7864 - DNA, 159 bp, Methylobacterium sp.
ttggcccggttgttgccagaactcactctttcctggcgctgccacgtccgcaggattgagccgatgcaagacggtccgcttcttcagatgctgtacgcggccctcatggcctcgagcatgatgctgacatggcaattctcccgcctgcgtaagccgtag

SEQ ID NO: 7865 - DNA, 213 bp, Methylobacterium sp.
atgctcgatgcgaagcctgcggctctccaagaaccccgtagcctgatcggctcatggcggcgcttcggctcggctgggcctgtctatgaaatcgtcggcgtgacggagccgaaggccgcggatcacccgcagatgaggattcgcgtcttggagacgggtgaggagctcgactacccgctcacagaccttctcgaagaccctgcggaaggctga

SEQ ID NO: 7866 - DNA, 1344 bp, Methylobacterium sp.
gtgacgaccgtgaccttgcgcttccgcaccctcctcgccacggcggcgctcgcgctctgcctgccgctcggcctcgtcgcctcggccgagaccgagccggccccggttcagaagaacgacgtcgatacgcctcaggtagtggaggcgccgaagacggagcccgatcccgcgatcgagcgcgggcgctacatcgcggtcgccgccgactgcgtcgcctgccacagcaatccgaagagcgggaagccgttctccggcggctatgctctggagacgccgttcggcacgctgctgtcgagcaacatcacctcggacgaggagaccggcatcggccgctggaccgaggcggagttcacgcgcgccctgcgcgaggggctcggcaaggacgggcagcacctgtacccggcgatgccgtatacgagctacaccaagatgtccgatcaggacgttcacgacctgtggctctacatgaagacggtgccgccggtccgtaacgccgtcgtcaccaaccagcttcccttccccttcaacatccgcgccctgctgatgggctggaacctgctgttcttcgaacagaagcggttcgagctgcgcgccgaccgatccgccatctggaatcgcggtgcctacctctccgatgccctcgcccattgcggcgcctgccacacgccgaagaacgtcctcggcggcgacaagaccagcaaggcctatcacggcgaggttctgcaatcgtggtacgccccggacatcaccacgagcaaggccggcggcatcggcgactggtcgaaggatgacatcgtccagtatctcaagatcggcagcaaccggatggcggtcgcctccgggccgatggccgaggcggttacgaactcgacccagcacctgaccgacgccgacctcgctgccatcgccgactatctccagaccgtgccgccgggccccgcgaccgaggcgccgcgcgccaccgtcaccggacccgtcatggcccagggcaagcgcgtcttcgactcgcagtgcaaggcgtgccacgcttccgacggcaccgggatccggcacatgacgccgagcttccccggcaacagcgccatccagtcgcacgaagtcgccggcatcgtccggaccgtgctcgcgggcgcccgcggcgccatcacgcgcgagaacccgacgggggcggccatgccgtccttcgcctggaatctgtcggaccaacagattgccgctgctctgacctacatccgcaacagctggggcaacgccgcgccgccggtcaccgccgaggccgtcgccggcacccgcaagaccctcaacctgaatgccgtcgggcgtgcgccccatccggcaccgtga

SEQ ID NO: 7867 - DNA, 1344 bp, Methylobacterium sp.
gtgacgaccgtgaccttgctcctgcgcaccctcctcgccaccgcagcgctctcgctctgccttcccctcgggagcgtcgcctcggcccagtccgagccggcaccgatccagacgaaggacgtcgacgcgcccaaggtggtggaggcgccgaagacggaggccgaccccgccatcgagcgcgggcgctacatcgcggtggccgccgactgcgtggcctgccacaccaatccgaagagcgggaagccgttctccggcggctacgccctggagaccccgttcggcacgctgctgtcgagcaacatcacctccgacccggagaccggcatcggccgctggaccgaggcggagttcacccgcgccctgcgcgaggggctcgggaaggaggggcagcacctgtatccggcgatgccgtacacgagctacaccaagatgtccgatcgcgacgtccacgacctgtggctctacatgaagaccgtgccgccggtccgcaacgccgtcgtcaccaaccagcttccgtttcccttcaacatccgcgccctgctgatggggtggaacctgatgttcttcgagcagaagcggttccagccgagggccgaccggtccgccgcctggaaccgcggcgcctatctctccgacgcgcttgcccattgcggcgcctgccacacgccgaagaacgtcctcggcggcgacaagacgagcaaggcctatcacggcgaggtcctgcaatcgtggtacgcccccgacatcaccacgagcaagaccggcggcatcggcgactggtcgaaggacgacatcgtccagtatctcaagatcggcagcaaccggatggcggtcgcctcggggccgatggccgaggcggtgacgaactcgacccagcatctgagcgacgccgatctcgccgcggtcgccgactatctccagtcgctgccgccgagccccgcgaccgaggcgaggcgcgtcgccgcccccgatccggtcatggcccagggcaagcgcgtcttcgacgctcagtgcaaggcatgccacgcctccgacggaaccggaatccggcacatgacgccgagcttccccggcaacaccgccgtgcagtcgcacgaggtcgccggcatcgtccggaccgtgctggcgggcgcacgcggcgcgatcacggctgagaatccgacgggggcggcgatgccgtccttcgcctggaacctgtcggaccagcagatcgccgcggctctgacctacatccgcaacagctggggcaacgccgcgccgccggtcaccaccgaggccgtcgccgccacccgcaaggccctcaacctcaacgccgtcgggcgcgcgccccacccggtcccgtga

SEQ ID NO: 7868 - DNA, 1332 bp, Methylobacterium sp.
atgactgccaccagcctgaccgacacgagccttccgccaaacgccgtccgggccgcgccgccgtcgatcgggttgtccggcgcgcggtggcgcgcggcctttgtcgtcttcgcggtgctgatgtgcgcgaacgccttctacgtgctcttcctcggcagcaacaacgaggtcggcaacaccaagacgctgatgccgtcgaaccggaacaacctgctctatgtcgggctctggctctgcctctacgtcctgtccctcggcgtggtgctgcgggacatgcggcgcaacgggatcgacctctgcctggtcgccgtccttccgttcgccggctacatcctgctctccacctgctgggcgaccgatagctgggcgtcgctggttcccgcggggatgctcgtcctgaacatcgccatcgccgcggcgctggcctgcctcgtccatccggcggtgttcctcagcctgtacgcctggaccaacgtcttcctggtggcgtcctccctggtgatggtggtggtgatgcccgatgcggtgcgcaccgacatcacccggccgggcctgctgatgtcgggcgaactgttcggcgcctatggcagcaagaccctgcacggcatgtcggccgcgagcgcgatgctgatcctgctgttcctgcccagcgcgagcccgcggggcctgcgcgggccggcgctcgccatcctcgcgctcgggctgatcctggccaactcgatgtcctccgtgagcggcatcgcggtggcgggcctgacgctcctgaccgcccggatgctgcccggctgcggccgggccatcttcgcggcggtgaccgggttcgcgatcctgctctcgctcttcctgcccttcatcggggtcggcgacatcgccgtcgcgctcggccgcagtcccgatttcaccgggcgcagcaacttctggccctacgccctcgaagtttttcgcgatcgaccggtgttcggctacggctatctgagtttcttcaacaccgacccgttctcgaaagcatggaatgtgtgggagcgggagatgttcttcttcacacccgacttccacaacaccttcctcgacactctggtcggcttgggcctcgtcggcggcgcgttctatctcgtcctgctcctggcctcgtcctgcatcttcgcgcatccgagccttgagcggcgccccgccttcctgctctcggccctcctgatcgccttcatcctcaacagcgcgaccggctaccttttcctcgcacacaaccggatgtcgacgatcttccagttctactgcctgttcgttctctgccgccggtatcggccgcgcttcccacaaccggccgtcgtctga

SEQ ID NO: 7869 - DNA, 867 bp, Methylobacterium sp.
atggaacgcccgtcctccagcgttgcccgcaccctctcccggaccggcgcgcagctgatgcggtcgggaacggtcgggcgtgggctctcgctcgccgaatggagcaaccgcgacaaccaagcccgttacgatcggcccgatcaccacacgctcagcatctatctcgacgggggcgagcgcgtcgtgcgcgaagaccggcatttgtcgggcggggggccggacaagctctgcctcttgcccgccggacacgagagccactggcacatcggcggatcgctccggatgttccacctctatatcgagcctgacgtgctcgcttatcgagcgttgacggccttcgacgtggatccgcgccggatcaacgttcaagacctgaccttctccgacgatcccgcgatggcgatgatcgttcgcggtggcgtgatgcccctcgactggacggagggaggcgatggcccggcgctggatgccgcctgccacctcctcgttcaccgcctcctacggcaatacgccaaggccacggggccggcgcccgtccgcggtggcctgtcgcccacgacgcggcgacggattgcagcgttgatcgaagcgcatctcgacgagccgctgacgctcgatcgattggccgcggaggctcgcctcagcacgttccacttcgccaagatgtttcggatcagcttcggcatgcccccgcatcgctatctcggcgcacggcgtatcgagcgggcaaaacagctcttgagaggggaaccggccggactggccgaagtggcgctggcttgcggctatgcttcgcagagccacttcacgcgcgtcttcaagaccgcgacccagatgacgcccggcgaatggaaaaagcgatcgtga

SEQ ID NO: 7870 - DNA, 684 bp, Methylobacterium sp.
gtggcggctcttgctggcaacgcctctgccgcgcaggccgcggaactcagcggcgagatgccctgggagcccggtcaggccaatgttccgcccctgcctgaacccggtccggagcgctggaccttcttcacccccgcggaggccgaggctatcggcgccatggccgatcggatcgtcccggcggacgacctgagcgtcggcggcaaggaggcgggctgcgcccgcttcatcgaccgtgaactcgccggcccctacggccgggcggcgacgcagtaccgcctcggccgcttcgtcaaggggaccgccgagcagggcatccagtctcccctcgctccggccgaccgctaccgactcggcctcgccgccctcgaccgccactgccgcgcggcccacggcaagggatacgcgaacctgccgccggctgaacaggacaagatcctctcggcaatggaggccggaacgctcgatctcgagccggtcgatgcgaaggagatgttcgagcagattctgcagaatgtccgcgagggcttcctcgccgacccactctacggcggcaacaaggacttggtcagttggaggatgctcggctttcccggagcacagtacgacttccgcgacgtcatcgatttgaagggaaagaagctcgacttcgttccggtcagcatgatcgacaagtcactttaa

SEQ ID NO: 7871 - DNA, 684 bp, Methylobacterium sp.
atggcggcccttgccggcaacgcctccaccgcgcaggctgcggaactcagcggcgagatgccctgggagcccggtcaggcgaacgttccgccgctgcccgattccgggtcggagcgcttcgtgttcttcacgcctgcggaagccgaggccgtgggcgccatggccgaccggatcatcccggcggacgacctgagcgtcggcggccgggaggcgggctgcgtccgcttcatcgatcgtgaactcgccggcccctacggccgggcggcgacgcagtaccgcctcggccgcttcgtcaagggaaccgccgagcagggcatccaatcccctctcgccccggccgaccgctaccggctcggcctcgccgccctcgatcgccactgccgcgcggcccacggcaagggctacgcgagcctgcccccggacgagcaggacaaagtcctctcggcgatggaggccggaacgctcgacctcggcgaggtcgatgcgaaggagatgttcgagcagatcctgcagaacgtccgcgaaggcttcctcgccgacccgctctacggcggcaacaaggatctcgtcagctggcggatgctcggatttcccggagcacagtacgatttccgcgatgtcatcgacttgaagggaaagaagctcgacttcgttccggtcagcatgatcgacaagtccctttga

SEQ ID NO: 7872 - DNA, 2082 bp, Methylobacterium sp.
atgcgcgtccggaatctcttcgtttcgtgcatggccactgtcggactcgtgactgcgggttcgagctctttcatcgcttggcaggaatggcagcgctggtcgcaggccgacgaggcacgtcagctcgtcggggtcctgggggagatcgcccgctttaacgagcgcctcgccctcgaacgcggctcctacaaccagcttctgctctcggacagcgccgagcaggcgccgatccgggcctcggcggaggcgaaccgcaaggcgaccgaggccgttgccggccggatcacgggcgccgtcgcggccctgcccgccgacaagcgggccgtgctcgatcaagccctgcagccgacgatccgccaactcgagggcgcgcgtgcggcggcggatagcgagatcgccaagccgctcaaggagcgcgacgagcaggccgccaagtcgttccagaaagcgatcatcgcggtcgtcgcccagaacgcgaagacgctcggcatgatcgagatcgacatcacccgggagaatcccgaggtcgcccgctcggtgccggtcgtcagcctcgcgatggagctgcgcgacatcggcggcagccgctcgatctggttcagtcagtatgcgggcgccaagcagcgcttctctccggccctgaccgtgcagatccacgagatgaacggccggatcgagcaggcttggcagcggctgcagcgcagcgtgatgcaggtcgagacgcaaggccctctggtcgatgccctcacgatggtcgagcgcaacttcatcgccgatccgggacaggtggtggcggggatgttcgcggccggccgggatgggaccgagccgccgatgaccctcacggaatggcggccccacaccaccaaaatgctccagtcgatcctcagcgtcagggatgccgccctgcaatcggccctcgccaccgccgacgagacgatcgcctcagcgctgcagcgcctcgccgtggcaggtgcgaccctgctcctcgtcatcctgttcaccttcggcatcgtggtcttcttcacccgccgcgtcgtgcagccgctggcctcgctggcgcggaccatcacgcagctcgtggagggcacacgggacgtcgaggtgctcggaacggaccgccgcgacgagatcggcgaaatcgcccgcgcggtggatgtcctgaaggcgcacggcgccgaggcggagcggctgagaggggagcgcgagggcctgcggcaatccgccgaggtggagcggcgccagagcctggagcggaccgcggaccagttcggcagttcggtcgggggcatcgtcggccaggtcgcgacggcggcgggctcgttcgaggcacaggccacgaacctggccggcacggcccgggaggccgacctgcgttcggcggaggccgcacggctctcccgctcggcctcgcagaacatcgaggccgtggccgcggccgcggaggagctgtccgcttcgatcgatcagatccgccagcaggcgcgagggtcgtccgcggcagcctcggaggcggctcaggaagccgcctcgacggaagccaaggtcgccgatctcggcgccgccgccgcgcggatcagcgaagtgctcggcctcatccgcggtgtggcggagcagacgaacctgctggcgctcaacgccacgatcgaggccgcccgcgccggcgccgccggtaagggtttcgccgtcgtcgccgccgaggtgaaggcgctggcgggtcagtcggcccgggccaccgacgagatcgcggcgcatatcggctcggtccgcgtggccacggagcagacggtgcaggccatcggcaacatcacgcaggcgatccagcgcgccaccggcatggcggacgcgatcgcctacgccatcgacgagcaatcgacggcgacccaggagatcgcccacaacatctcggccgcctcgcacggcatgcgcctggccaccggcgagatcgaatccgtcatcggcgcctctagcgccacggggcgtgcggcggatcgagtgctgcaggacgccatcgcgctgaacgggcaatccaccgagcttcggagctccgtccagcacttcgtcggttcgatccgggcctga

SEQ ID NO: 7873 - DNA, 987 bp, Methylobacterium sp.
atgcgtgtggtcgcggtgagccgagtgctcgatgaggtcgatgtcatcgaggcgttcattcggcacgcggcggccttcgtcgatcatcacatcattctcgacaacggcagccgggacgggaccgtcgagatcatccgaaaactcgccgaagaggggcttgcgctcacggtctaccagtcgccgtcgatctgcttctccgagcgggacatgaacaactggctctacaacgaggcggtcgaccggcacgatgcggattgggtcgcctgtctcgacagcgacgagttctacgacgagcgtcagctgccgggaggattgcggaactacctccaagagctggaaaacgccggcgggaacgtcgtcgccgtccgggtcccctgggctcactacaactatacgacccgggatgatgcaggagaaaacctcgtcccgcgccgcatcactcatcgcacggagatcgccagcgacggcaagatcatcgcgagctggcggttggcgaaggagaagggcctcgtgcttgagggacagcacgacgtgcatctgccggagggtagccgcggcacggtggtcgtcgagcggcggctctggatcgcacatttctccgagcgcaacgcggcgcagtacgtcaccaaattcgtgagagggtgggcaaagatcctcaccgccgggcaagcctgccaggatcggggcttctcggcccattaccgcggaccgttcgagcttctcagagaccatcccgagacgctgctgaggtctgacgagttcctcgagagaaagaacgaggaccgaagcgccatccatgacccgatggattaccgcggcggcccccttcgctacacgcctccgaacgatccggagatgcagtcggtccgagcgctcgtcggattcctctcggatgtctgcgcgcgctacggcgaacttaccgatgcgttgcccgtggcaagggcctattccgagcgaatcgagcggcggatcaaccggctcatctga

SEQ ID NO: 7874 - DNA, 126 bp, Methylobacterium sp.
ttgttgcgcgcgggcgccaagatcgacaagttcgagaaaacaagagcggtgacaggcccggcgcaagatcgggcgcaccgcatcggcaacaacacgctcgccccgctttcgcagggcggcacgtga

SEQ ID NO: 7875 - DNA, 150 bp, Methylobacterium sp.
ttggagacgaacgtgccgacccttcgactcaacacccggcggatcgcccttgctaccctcacggccgtgctcaccctgagcgccgccgcctgcgcgaccaagcccccgcccgcaccggtcgagccggcgccgctgatcaagaagggctga

SEQ ID NO: 7876 - DNA, 150 bp, Methylobacterium sp.
ttgaacgggcgcttcacgtggcccggcacggtgcggttcgtgaagggcgaatgcttctgcttcatcgcgtccgttccgtacgaaacgttcgacgcgatctgcccgcgcatcagaagcttcgacgacgcccccgagctgaaggccacctaa

SEQ ID NO: 7877 - DNA, 195 bp, Methylobacterium sp.
gtggacgtgctcgtcgagcggtatctcgacacgtcgaacggcaatgccgtggctgcccttcgacaggccatctcggacgcactgcaggacgcggtcgagtgccggcagaagctggaggccgccgaacgggcggcttcgcgcggattcaggcggcaaatgccgatgccgcgcatgacagggacggccttccagtag

SEQ ID NO: 7878 - DNA, 213 bp, Methylobacterium sp.
atgagcgcagtggcagcggcgcgggcggacgaggtggagatcctcgtcgagcagtacctcaagaatgcgcagggcagcccggtagtggctctccggcaggcgatctcggatgcgctcgtggacgccatggaatgccggcagaggctggaggcagccgaacgagctgcctcccgtggcttcatgcggcaactgacactctcggcttccaagtag

SEQ ID NO: 7879 - DNA, 1743 bp, Methylobacterium sp.
gtgatcgtcggactcggctggtgcggctcgctcatggccgaggaactgacccgggcgggcctcaccgtcgtcgccatcgagcgcggtccctgggtcgagacggccgtcgacttcccgccctccgtcgacatggacgagctgcgctgggacacgcggcgggcgatgctgctgccgccggcgatcgagactatcaccttccgcaacgacccgtcccagaaggcgctgcccgcgcgggactggaacttcaacgaatggggctacaacgtcggcgggtccggcacccactgggccggcatggcgtggcgcttcctgccgttcgacttccagccctacagcatgaccgtgcagcgctacggcgccgagcagatcgccgacggcctgatcgtgcaagattggggcgtgacctacgacgacctcgaacccttctacgatcggttcgagaagatcgccggcgtctccggcaaggccggcaacctcaagggcgagaagattcccggcggcaacatcttcgagggggcgcgatcggacgagtatccgctgccgccgctcaagacgacccgtctgaccgacctgttcaccgaggcttcggcgagcctcggctatcatcccttcatggtcccggcgggccagacctcagcggcctacaccaacccgctcggcgtccggatggggccgtgcacttattgcggctactgcctgtattacggctgcggcaactggtcgaaatcgacgcccaacaactgcgtcgtcccggcgctgatgcagcgcgagaacttcagcgttctcaccgagtccacggtcctgcgcgccaacctcgcacccgacggcaagaccgccaccggcgtgacctatgtcgacaaggacaaccgcacctgggagcagcccgccgacatcgtcgtcttctccgccttccagatgcagaacgtccggctgatgctgctctcgaagatcggcaagccctacgatcacgcgtccggggaaggcgtcgtcggccgggcctacagcttccagaccgtgtccggcgcgaacatcttcttcgagaacgagtacctgaaccagttcatcggcgccggcgcgctgtcggcccaggtcgacgacttcaacggcgacaacttcgatcatgccggcatgggcttcatcggcggcgccggcatcctcgtcgtctcccgcggcgcccgcccgatcggcaatgccgacttcgtcccgcctggaacgccccgctggggcagcgactggaagaaggcctacacccacagcttccagaacgggaccttcatcttcggccagggcacgagcttcgcgcacacggacgccttcctcggcctcgaccccgagtacaaggacatccacggcctgccgctgctgcgcctgacctacgattacaacgagaacgaccgccgctcggcgaagctgatcgaggacaagagcgtcgagatcggccggaagatgggggcgaaggtcgtcgtcggcaccaacgccaccaaccagcacgcctcgccctatcaactcgccagcgaccacaccaatggcggggccgtgatggggctcgatccgaagaccagcgcgctgaaccgcttccagcagagctgggacgtgcacaacgtcttcgtcctcggcgcgtcgtcctttcccaacaatgccggctacaacccgaccggaacggtcggcgccctgacgctctggactgcaaaggcgatcatcgagacgtatctcgacaagcgcggtccgctggtggcgaattga

SEQ ID NO: 7880 - DNA, 1773 bp, Methylobacterium sp.
atgaccaatgttcgtccaaaagccgatgccgtgatcgtcggtctcggctggtgcggctcgctcatggccgaggagctgacccgggccggcctcaatgtcgtcgccatcgagcgcggcccctgggtcgagacggccgtcgatttcccgccctccgtcgatatggacgaactgcgctgggacacccggcgggcgatgctgctgccgccggcgatcgagaccatcaccttccgcaacgacccgacccagaaggcgctgcccgcgcgggactggaacttcaacgagtggggctacaatgtcggcgggtcgggcacccactgggccggcatggcgtggcgcttcctgccgttcgacttccagccctacagcatgaccgtcgcgcgctacggcgccgagcagctcctcgacggcctgatcgtgcaggattggggcgtcacctacgacgacctcgaaccattctacgaccggttcgagaagatcgccggcgtgtccggcaaggccggcaacctcaagggcgagaagatccccggcggcaacatcttcgagggggcgcgctcggacgagtatccgctgccccccctcaagacgacccgcctgaccgacctgttcaccgaggcctcggccagcctcggctaccatcccttcatggttccggcgggccagacctcgggggcctacaccaacccgctcggcgtccggatggggccctgcacctattgcggctactgtctgtattacggctgcggcaactggtcgaaatcgacgcccaacaactgcgtcgtcccggcgctgatgcagcgcaagaacttcagcgtgctgaccgaatcgacggtgctgcgcgccaacctcgccccggacgggaccaccgccaccggcgtgacctacgtcgacaaggacaaccggacctgggagcagccggcggacatcgtcgtcttctccgccttccagatgcagaacgtgcggctgatgctgctctcgaagatcggcaagccctacgatcacgcgaccggcgagggcgtcgtcggccgggcctacagcttccagaccgtgtccggcgccaacatcttcttcgagaacgagtacctgaaccagttcatcggcgccggcgccctctcggcccaggtcgatgacttcaacggcgacaacttcgaccataccgggatgggcttcatcggcggcgccggcatcctcgtcgtctcccgcggcgcccgcccgatcggcaatgccgacttcctcccgcccggaacgccccggtggggcagcgcgtggaagaaggcctacacccacagcttccagaacgggacgttcctgttcggccagggcacgagcttcgcgcacaaggacgcctatctcgacctcgatcccgagtacaaggacatccacggcctcccgctcctgcggctcacctacgactacaacgagaacgaccgccgctcggcgaagctgatcgaggacaagagcgtcgagatcggccggaagatgggagcgaaggtcgtcgtcggcacgaacgcgaccaaccagcacgcctcgccctaccagctcgccagcgaccacaccaatggcggcgcggtgatggggctcgacccgaagaccagcgcgctcaaccgtttccagcagagctgggacgttcacaacgtcttcgtcctcggcgcgtcgtcctttcccaacaacgccggctacaacccgaccggaacggtcggcgccctgaccctctggactgcgaaagcgatcatcgagacttatctcgacaagcgcggtccgctggtggcgaattga

SEQ ID NO: 7881 - DNA, 810 bp, Methylobacterium sp.
atgaactacgaaatccaacctcataacgccaagcctgccagtatctggaactccggcggcgctcattacaacgagatcagtcgcggcatcgccgacagtattgaacactgcgtactgcgtctcgatccgaagccgggcgagcgggtgctcgacctcgccaccggcaccggctggacttcgcgcgtcgtcgcccggcggggtgcgcaggtgactggggccgacatcagcgccgatctcttgtcgttcgccgctgagcaggctcgggccgagggtctcgacatcgattaccagctgggcgacgctgagagactgccctttgccgacggcgcgtttgacgccatcatctcgacctgcggcgtgatgttcgctagccggcctgaggctgcagccgctgagttggcacgtgtctgtcgcaagggcggaaggatttgcctcaccacctggctgtcgaacgacaatgtgttcaggatgttcatggtgatgaagtcctacatgccgccaccgcccaatccggccccgccctcgccatttgagtggggccgcacggagcggcttgaggaactgctaggtcgggactttgagctggctttcgagaacggcgtctcgttctatcgcgagcagagcgcagaggcggcctgggagcggttcgccggtggctacggtccgaccaaggctctggtcgccagcctcgacgaggaccgccgcgccaatctgcggcgcgacttcatcgccttccatgcccagttttccaccccgctcggtatctgcgttccccgcgcgtactgggtcacgcgtgggattcgccactag

SEQ ID NO: 7882 - DNA, 354 bp, Methylobacterium sp.
atggcgaccatcggcaccttcacccggacccagaacggcttcaccggcgagatcgcgaccctgacgatccaggccaagcgggtcacgatcgtcgagacgactggcgacagcgagaacgcgcccacgcaccgcatctacctcggcaaggcggagatcggcgccggctgggccaagcgctcgcaggagcagcgcgactacatctccctcaagatcgacgatccgagcctgcccgccccgctcttcgccaacctctgcgccgacgaggatggcaagaccttccaggcgatctggagccgctccaaggcccgccccatgggccgccagcagggccgccagccgagccgccgggactga

SEQ ID NO: 7883 - DNA, 171 bp, Methylobacterium sp.
atggcgcacgatctcaccctcgcccgcagcagcgcctaccacctggcccagtcgctgatggtctgcgtcaccctctttgtcaccgacggcggctacggcgtcatgcccagcgacgagttcgacggcgacccggcgagcgtgatccacgagttcgacccccacggcgaatga

SEQ ID NO: 7884 - DNA, 936 bp, Methylobacterium sp.
atggactgggaaaatcccatcggaaccgacctctacatcctgccgcgagggatggcgcgcaatggtgaggtcgggcctgcttcgatccggtggacgtcgaaatatggatccttggtcgcgacagcgttcgacaattcgacctcggacggcgccaacgaagcgggccttacggccaatgtgctctggcttgaagagtcgcagtacccggctttcgacggcaagggcccgcctggattggcgatctcagtctgggcgcaatacgctctcgacaacttcgcgaccgtcgatgaagccgttgccgccctcaagaagcaacccttcacgctcgtgacgagcgtgattcccggcactcagatcatcgcaaatgtccatatgtccctgtccgattccggcggggacagtgccatcatcgagtatatcgacggcaagcaggtcattcatcatgggcgccaataccaagtgatgacgaactctccgacctacgaacagcagcttgcccttgcatcctactggtcacagatcggcggaacggtcatgctgcccggtacgaaccgcgcgtccgatcgcttcgcccgcgcctccttctacgtcaaatcgatcccgcaggatggagactcggatcacctcttggccagcgtatacggcatcatacgcaatgtttccgtgccgattgggctttcgacgccggagaaaccggagatatcctccacacgctggcgcacggtcttcgatcacaagcgccgcctctatttcttcgagtcggcgctttcacccaacacgttctggaccgacctgaatcagatcgatttctccaaggaaacggggaaagtgctgaaactcgatctcggcatcgatcaggccaacgtcttcgctggaaacgcgacacggtcctatcgcgcgtcggagccttttccctttgccggactaccgcgatag

SEQ ID NO: 7885 - DNA, 198 bp, Methylobacterium sp.
gtgctgccctcgggcctgatggtgcgctcgccccccgagcatcgcctcgactacgacccggtctccctgaagatgcggtcctgcaccggctggagcgaggctgcgctggcggcggagtgccgcttcctcacccggcaggcctcgctccagggcgggcgctcgggcgagttcttctggaccttcccgccgccccggtga

SEQ ID NO: 7886 - DNA, 105 bp, Methylobacterium sp.
atgaccaagcgtgtgctcttcaccagcctcgtcgagttcactgcctttggcctgctcttcggagcggtcgcgctctgggcggtagccttggcgccgattcattaa

SEQ ID NO: 7887 - DNA, 1626 bp, Methylobacterium sp.
atggtgaccacggccctgtcggggttcttcttcactaacgcgcatcagcaggcactgatcgatctgcgcgagggcggacgtcagatgcgtatcgcgcaggaagcgctgatggacgcggagtcctatgtcctgaacaaggcactggggacgggcgatggtcagttcggagcgttcaaccgcgcactcgaggcgctgcacagccggcgcaccgcgcagctcgccttacttacccccttcattgggagatcggacggcaaggctacggcgggaggcattatcgaatcgcttgaggcgagttggaccgaggtgctcgagctcgcgcggaccggacgtctcagcgaggcgcaggcgctactcagggagcgccatagtgctgctcaggtcggtaggattcgaagtgccttcgacgcgttcctgaccgactggaacgcgcacttcgctgtgcacgagacccgcatcgagatcggcaagcttttcgttctgctctcgcagctcctgatcggcggagtgatggtcttcgctttccggtctgcggcacgcgatgctcaagcgcggcaggccgccattacgcaggtggaggcctctcgtaagcaggtcggccacttgttcgggatgaccgacatgctgcagagcgcagcggatcaccacgacgctaacgcggttctgagagccaccgccggagaactcatcgctggcttcggtggtgccctttacgtcttcaacaactcgcgtgatcgtctggttctctccacctcttgggcatgcagtgacagtgcgtccctcccggaggctatcatggtcggccagtgctgggcgatgaagcgcggcaagccgcacatcaaccatcgaggggcgaaagctctctgctgcgagcaccatgcctctggcatggcggccttggagatcccgatggcggcgcgcggcgaaaacctcggactcctgcagatcttcgcggagggggccgacgcggagacacgcctggccgcgatgctgccgctcagctccgcgctcggcgatgccatgtcacttgcgctctcaaacatcgctcttcgtgagaagctgcgcaaccaagcccttcgcgatccactgactgggctctacaatcgtcgttacatggaggacagtcttgagcgttacgttcggctcgccgaacgggaaggccggaaagtttctgtcgtcatgatcgatctcgaccacttcaaacgactgaacgacgagcacggtcatgcgactggcgacgcggtcctgtgcgaagccgccgccgccatcgtgggcgccttgcgggagacagatgtggcctgtcggtatggcggcgaggagatgatcgtgtttctgcccgattgcgatctcgaggacgcggcagccaaggccgagcagatccgaggccgtatcgagagcctatccggcacgcatggggcaaaggtctctgcctcactcggtgtcgcctccgtcccgagcacctcgggcaccagtgccgaactgatacgcgctgcggatacggcactttaccgggccaagcacaacggccggaaccaagtggccgtggcgccgccgcgtcaaggatggcggagccgatccgaggccgcgccggatgagcctgtgctgctaccgatcgcggcagagtag

SEQ ID NO: 7888 - DNA, 882 bp, Methylobacterium sp.
atgcgggtctccggccttgaggtcatctcccattcggctgtcggtactcgggccgggccgtccatcatcttggtccacggcgcatggcacgcggcgtggtgctgggacgagggctttgccgcccggctcgcagcgcacgggcacgacgtgcatgccgtcagcctgcgggggcacggccacagcgagggccgtcgcggtctgtggcgggtgcggatccgggatcatgtcgccgacctgcggcgggtcatcgatgcggtcggtggcccggtcctcttggtcggtcattcgaggggcgcctacgtcgtccagaagcacctggaaacggctgccgccgccggtgcagtgctgctcgcgccgatgccgcatttcggcgtcgctccctgcatgggccggctcatgcgtcgcgtaccaggggcggtcgtgcgcatccatgccagcttcggcgcactcccaatcgccgcgaccccggccacggcgcgcgcactcttcttctcggcacggatgcccgagaaagcggttcgccgccatcaggcccgtctccagggcgaagccttcctcgcctatctcgacctgctcggtctcgatctctgccggcccaggtggggagggtcgccgatgctcgtgctcgctgccggcgcggacgccctcttcacgcgccgggaaatggaagaggtcgcagcggcgcacggggccggcctggagttcgtcccaggcatggcccacgacatgatgctggagcccggctgggagaccgtcgccgaccgcatcgccgcctgggcgcagaccatcggcgcccgccgcgaagagcctcgcagcggcgacattgcccgatgggcaaacgagccggtcggcggcgtagagcaagccgaggcgctgtcgtga

SEQ ID NO: 7889 - DNA, 1062 bp, Methylobacterium sp.
atggagcttgacgctgccgaatccgactccgggccgacgccccgcgcgtttgctgcaccggtcccgttcgccgacgcgctgccgcccggcctcgacctgctgatcgagcggctcgaggaacacgcccgcgccgcacgcggggctttcgccgacaacacgatgcgcgccttcgccgccgacagccggattttttcggcatggtgtgggcaagcggggagggcgatgctgccggccacccctgaaaccgtcgccgccttcatcgacgcccaggccgagatcaaggcgcgcgccaccgtcgagcgctaccgctcctcgatcgccgccctgcatcgtgcggccggactttcgaacccctgtgccgacgagatcgtccggctcgcggtgaagcgaatgaatcgggccaagggccgacgccaggaacaggccgagccgctcaaccggggaagcattgagcgcatgcttgatgtgaagacgcccgagcgacggcatcggcgcgtgaccgaggcgaaacgcgacgtgccgctgatcgcgctgcgcaacgctgcgctggttgccgtcgcctacgacaccctgctgcgccgctccgaactcgtctcattatatataggggatctgcacaggggcgccgatggctccggcaccgtactggtgcggcgctcgaaggccgaccaggaaggggagggggctatcaagtacctcgcccccgacaccatggcgcatgtagacgcttggcttgcggctgctcagctggtgagcgggccgctgttccggccgctgagcaagggtgggcaggtcggcgcggccgcccttgggggaggggaggtcgcgcgggtgtttcgcgatcttgccacagcggccgggctgaagcttgcgcgactcccctccggacactcgacccgggttggggcgacgcaggacatgtttgcggcgggattcgagctgcttgaggtaatgcaggccggctcgtggaagaccccggcgatgccggcgcgctatggtgagcgcctgcgagcccatcggggagccgcgagaaagttggcgactctgcagaacagagcatga

SEQ ID NO: 7890 - DNA, 309 bp, Methylobacterium sp.
atggctgcttttctgaccgtcggcgaccttttcaaagcaaagaccgtcaccgacgagcaggtgagcgcggctgtcgagacgtatctgatgaagcccgatacgtcggcacatacgatcgcggacggctacacggtggaccttgctgcggctgtcgagagccacggctgggcaagccaaatcacggcccgtccgaaaacaaatcccattctgaagcgagccgcggttcagacggcgatcctgctggcccgtgtgaggagggcgcggaccagagtcaaaagggatcggaccatccccgcgggcgagccatga

SEQ ID NO: 7891 - DNA, 372 bp, Methylobacterium sp.
atgcggaaggctgagcgagccttggcgagcgcgcgggtgcttctccatgacggtgatcccgagggggcctgcaatcgcgcgtattacgcgatgttcgacgcggctcgtgccgcgttgatgacgcttcccgaagacgttggcccgctggcgaccatcaagacgcaccgcggtttgattgcggcgttcggtcagcgtctcgtcgcaacgggccggatcgatccggctttcggacgctctctgaatcaggtcgagaagcttcggctttcctccgactatttcggtgacgtgctggcggcggacgacggccgttgggccgtcgagcaggcggatgccttcgtcaacgaggtcaaagcccgttttccggggctctga

SEQ ID NO: 7892 - DNA, 948 bp, Methylobacterium sp.
atggtggcgctcgaagcgatcgaaagaacgaagtcgattagagggttaagcgagaccctcggcctgtcctatcgcacggcttggtgccgcctgcagatgtacgaaatggctctcggccagccactcgtgcgcaagacccggggccagggctctgaactcaccgagttcggcgctgccctggccgaagctctcacctccgcggtcgcggggctagacgcgaacctcggatgcgagacccgcgccatcgagcatcgtctgcggcgtctgctcaccggccgatccgaagtgctgacgctcgcagccagtcacgacccgttgctgatcgaggtcctgcgcgagctcccggccgagcacggccagatccgattgtcggtgatgggcagcagcacggcggtgaagctcctcctagacggcggcgtcgatgctgcgggcttccattgcggggcgctgacccccgaacaggcggatgttccgttctcaggcgtgcattcgagagctgggctcgtgccgcgtccgttgttcgagcgcgagcaggggctgctactcgcccctggcaatccgctcggaatccgcaccctcgccgacctgaccgccgagggggtgcgctacgtcaatcgccagccgggatcaggcacgcgcagttggttcgaccgcatgctggcgaaggccggtctttcgccggacgcgatccagggctacgccgtcgaggagttcacgcatcaggcggtcgcggcgatgatcgcctgcggagcggctgatgccggactcggcgtgcgcgttgcagccgaacggctcggcctcgatttcctcccggtcggctgggagacatactatctcgcggcgagccgctctctagcttctcccctgttcgacgagttggttgctgcggtgcgcgtgcgcgcagcagaaacaacgggctaccgcctctcaagagaacacaagagctga

SEQ ID NO: 7893 - DNA, 597 bp, Methylobacterium sp.
atgaccgtgccgagagagctgattccctacgcgaccgatgacgtatcggcgctggccaagtcccttcgcagccagatgacggcgcgaacgaaaccgccgagccacgtcgagatgctcaacatgctggcccgggcggccgggcaccgcaacttccagcatcttcgcgggctggcggcgggtctcgtgccgcgcgcctccgacgccgtcggagcgcccgctcaggccgatggcgcgctcgtcgctcgggccgcccgctgcttcgacgcgcaggggcggctgacgagttggccagcccgccgatcggttcaggatctctgtctttgggcgatctggtcggcgcttccccgcgaccgcctgttcgacgagcgcggcatcagcgcgctcctcgacacactgcaccggttcggcgatccggccatcattcggcgcacgatgtgccatctcggcctgatgagccggaccgtggacggccgcgattatcgccgcatcgagcgggcgccgacgcccgaagcggcggcgctgatccggttgcttcgcgagcgggcgcgcggcgcggtcggaccgcagggtcagggtgcggcggagaccagttcgtag

SEQ ID NO: 7894 - DNA, 945 bp, Methylobacterium sp.
atggaccgccggatgaaggagagggcgcgcctctccgttgtggctgtgctgacggtgccggtcgtgctgctcgcgccactatcggcctcggcacaggacgaggcgcagccttcgcccgccgccgcctattcggtctcgcagccccccggcgaggtcgtgcaaccggcctctccggcagcgcccaccgcagaagccgccccgcccgcgacgcctgcacagatcccggccgcgaagccggacaaggccgtccacgacctttcgccgatggggatgttcctcaacgccgatccggtcgtgcaagccgtgatgctgctcctggccgccgcctcggtggtcacttggaccatcctgctcgtgaaggtcctgagcctcctcctggccaagcgcgggatgagagccagcctcaaggagatccgggcgtccgccaccctggcggaggccggtcagcgggtgcgccgcggggtcggcgcccttctcctggtcgaggccgaggaggagttgaccctttcgcggggcctgccgagcgagggcgtcaaggagcgggcggcgatcgctctgggccggatcgaggccatggtcggcaagcgcatggcgtccggaaccggcatcctggccaccgtcggctcgatcggccccttcgtcggcctgttcggcaccgtctggggcatcatgggcagcttcatcggcatcgccaactcgaacaccaccaacctcgccgtggtcgctcccggcatcgccgaggcgctgctcgccaccgggatcggcctcgttgccgcgatcccggccgtcgtcatctacaacgcgctgacccgctccatcaccggctaccgcgccatgaccggcgacgccgtggcgctgatcatgcgccacctctcgcgcgacctcgaccgccgcgagtttgggacctacggcgccaagtccggcatccgcgtcgcggcggagtga

SEQ ID NO: 7895 - DNA, 438 bp, Methylobacterium sp.
atggccgtcaatctcggatcgaacgacagcggcgatctcgccgagaacgccgacatcaacatcacgccgttcatcgacgtgatcctggtgctgctgatcatcttcatggtggccgcgccactctcgacggtcgacgtaccggtcgagctgccggtctccgcggcgccacagcagccgcgccccgacaagccgatcttcgtcagcgtcaaggccgatctcggcgtcgcgctgggcgaggacgcggtggaccggccggccctgggggcagccctcgatgccgcgacaaagggcaacaaggacgagcgcatcttcctgcgcgccgacaagggcgtgccctacggcgagctgatgggggtgatgaacctgctgcgcggcgccggctacctcaaggtcggcctcgtcggcctcgaagacacgtccgggggaggtcagccgtga

SEQ ID NO: 7896 - DNA, 138 bp, Methylobacterium sp.
gtgggaacgggtgcgaggctgacgctgccgaccgaaaccgactggctgcgcaccgagcggcgcacgcccatcatcgccctcgaccggatcgtctcgccctacgcgcacaggctgatgccgcaggtcggcgtggactag

SEQ ID NO: 7897 - DNA, 291 bp, Methylobacterium sp.
atggcgtttcgacccctgcacgaccgcgtgctgctgcgccgcattgagagcgacgagcggacgaagggtggcatcatcatccctgacaccgcgaaggagaagccgcaggagggcgaggtcgtggccgtcggtcccggtgcccgcgacgaccagggccgcgtcaccgcgctggacgtcaagaccggcgaccgcgtgctgttcggcaagtggtccggcacggagatcaaggtcgacggccaggatctcctgatcctcaaggaatccgacattctcggcgtgatcgccgcctga

SEQ ID NO: 7898 - DNA, 162 bp, Methylobacterium sp.
atgcccgagaccaaacccgccccgctccccccggccaccgaggatgccggcctgccgacgccgccgagccccggccgcctgccgccgccgaacctgccgccctcgcccttcacggatgacggcgcgtccgatgccgggacggacggcgccgacacggagtga

SEQ ID NO: 7899 - DNA, 1011 bp, Methylobacterium sp.
atggacgtcacgatcttcagcaccaaggcctatgatcggcggttcttggacgaggccaacgcggcggcgggcgaaccgcaccggctgcgctatctcgaagcccggttgacgcatgagagcgcgccgctgacgcagggagcgcaggccgtgtgcgctttcgtcaacgacgtgctcgaccggcccgttctagaggtgctggccgcctccggcacgcggatggtggccctgcgcagcgccggcttcaacaatgtcgatcttcccgccgccgcggaactcggcatcgcggtcggccgcgtcccggcctactcgccggacgcggtcgccgagcatacggtggccctgatcctcgcgctcaatcgcaagacccaccgggcctatgcccgcgtccgcgagggaaatttcgcactcgaagggctgctggggttcgatctaaagggacgcacagtcggcatcgtcgggaccggcaagatcggtcgtgcggtcgcgcgcatcctcgccggcttcggctgccgcgtgctggcctatgatcccatgccctcggccgaactcgccggcttcggcgcggaggcggtgggcctcgaccggcttctggccgaggcggacatcgtctccctgcactgcccgctgacgcccgacacgcatcacatgatcgaccgtgccgcgctggcgcggatgaagcgcggcgtgatgctgatcaatacggggcgcggtgcgctcgtcgataccgcggcgctgatcgagggtttgaaatcaggggtgatcggcgatctcggcctcgacgtctacgaggaggaaggcggcctcttcttcgaggatctgtcgaaccagatcatccgggacgacgtcttctcgcgcctgctgaccttcccgaacgtgatcgtgacggggcatcaggccttcttcaccgccgaggcgctggcggcgattgcggcgaccactatcgagaacctgtcctgctttgagaagcagggcgttccgcggcatcccgtatcggtcgagcgcctcgcctga

SEQ ID NO: 7900 - DNA, 1545 bp, Methylobacterium sp.
atgccggaaccggacgaaggcccgacggtcacggcaagcccggaacgcgacgagcgcatccggcgcctggagcggcgcgtcgcccgcgagcggagcgcccgcgccgaggccgagtccctcctcgaagccaagtcccgcgaactctacgccctcaaccagcaactctcccgcttcgccgcggacctggaactgcgggtcgatgaacgcacgcgcgaactggccctggcgcgcgagcgcgccgtggcgctggccgagcgcgaccagctcaccggcctagccaaccgcacccgcttcgcccgcgtcctcggcgccgccgtcggccgggcgggccgcgggacgggcagcgagcgcttcgccctgctcctgctcgacctcgatcgtttcaaggagatcaacgacagcctgggccatgaggccggagacgtgttcctccagcatgtcgcccgccgcctgagcgggaccgtcggccaaggggcggtgacggcgcgcctgggcggcgacgagttcgcggccatcgttccgctcggccctcgcagcgatctcgcccgtctcggcgaggccgtggtggcggagatccgccggccggtcgcctatcgcgggcggatgctggaggcgtccgcctcgctcggcatcgccgtcttccccgacgatgccgcgacgggcagcgaccttcagcgcttcgccgacatcgccctctaccgctcgaaggcgacccgcgccgcttggacccggttcgacccgcggatgggccgggagatcgaggagcggcaggccctgggggccgatctcggcgcggcaatccgctccggcgcgatcgagccatggttccagccgatcgtcgacggggtcacccgccatcccgtcggggccgaggcgctggcgcgatgggttcatccgcagctcggcttcctcgctccggctgccttcctcggtctcgccgaagagcgcgggctgatgcgcgacctgttcgcagggatgatgcgccgcgcctgcccgccggcgcgggactgggtccgggcgggggcgatccgcaccctgtcggtgaacctctcgccgagccagttcaagctcggctcggtcgccgacgacgtcatcgcgcttctcgccgaactcgacttcccgcccgaggcgctgaccgtcgagatcaccgaggaggtgctgctgaacgatctcgatcgcgcacgggtgcagctggagcggctcgccgcccacggcgtgcggatcgcgctcgacgatttcggggtcggctactccaatatcggctatcttcgccggctgccgatccagacgctgaagctcgaccggctgctcaccgtggacgtggcgcaggagcacgaggcccgctgcatcctcggcgcgatcgtccagatcgcccgcgccctcgacctgcgattggtggcggagggggtggaagatcccggccaggccctctggctcagccatctcggctgccgccacctccagggctacctgttcggccggccgatgccggcggaggctttcgccggctatctcggctttgacggggcgcggcgcatcgcctga

SEQ ID NO: 7901 - DNA, 1599 bp, Methylobacterium sp.
atgcggtcatggcacagccatgcggcatgggcgatgcgaggcgtcgcgctggggagcctgctcgccttgacgggcgcgggcacggcctgggcgaaggagatcgtgctgccggagaagaatccggccgtcaccttgacgatccccgacgactggaagaccgaggtgcgcgacaccgaggtcgtctcgacctcgcccgatggcgacgtctcgttcgaggtgggcttcgaaacgcgggcggaccgcgacagcctcgtcaaggacaaggtgagcttcctgcgcaagcagaaggtcaatctctcgatcaagccggtcgagcaggcgatggacttcggcggcacgccggcccgggttcagcgctaccgcaccaccgacaagtacgggaagacgatcgtcgatctcgtgaccctcgatgcgagccgggaccgcgcgctcctcatgacgatctggggatccgaggatcagcgccaagccaacgaagcggcgctggacaccatcatgaagagcgtccgggttccggccgagaccggcgggagcagcaacttctggtcaggcggcaagacggccgccaaacccgagacgaagccggaaccgaaagtcgagacgaagtccgagcccgcggcggccggcttgtcgccctcggtggcggccgcccagcccgcgcccttgaggccctacgccacccggcgtgcgctgtacgtcgcccgcaaggccgccgatttcggcgatgtcgaggcccggccctcgaacgtcttcaagcccggcgagccgctcctgacctatatcgagccggtgggcgaggccacgcagccgatcggaagcgatcagatcggcttcggcgtgatcgtcgatttcgaggtccgcacgccggagggcaaggccctcgcgacccagaagaacatgatcgaccgcgacgtgaccgtgaaacgcgcggagggcgagccgaacttcttcctcaacctcagcctcgacctcgacggctttccgccgggcaattacgtgctggtctataccctgcgcgataagctgagcgggcgcacgctcgacgtgccgcagcccttcacgattgccccggccgccaccgacaaggccgccggcgcaagcccggccgccccaagcccggctccggcggctcctgcgacgccccccgcttcggtgcaaaccaccgtcgtggacgggtggacggtccagcttgccccaccggacggcgtctcctgcgccatccactacgagaacaagcccccgcgcgccgacggcaagagattcgccacgatcgtcgccttcgtctcgatccccgacaggaacctgaagctcacaaccctggaactcaaattttccggctggaactggaccaaggaccaagaggtcaaggccacgctccggacgggggaattttacctgtattccggcctgaactggatcgtcctcgatcccagatccctcctgctccgatccaacgatccggacgatatcctgaagctcgtcaaaacgacgtcgaaactcagcgtcgagagagacggcgaggacgccgtcacgttcgacatcaccgcgccggacaaggcgctggaggctctcaagccctgccgggatcaattgaagtag

SEQ ID NO: 7902 - DNA, 1449 bp, Methylobacterium sp.
atgacgcttgttacccggcgcaacctcgttactggcgctgccctcgcggtgccactgatcgccaattcgtcgctggtgtcggcgcaagtctccgaggcactgctaggaagcgcatccgatgcagagcggatcgccatggacgcctatatttacggctactcgctgatcaccacggaggtgactcgggtgcagatgtcgaacgtgcctgcgctcagcggcctgcacggacctatggggcagttcatcaacgtcaaacgctatccgccggccgactaccgcggcgtatcggcgcccaatgcggacaccctctattcggctgcctggctcgatctcggcgctgagccgacggtgttctcccatcccgatatgggtgaccgctatttcctattcccgatgtacagcctttggatgccagtggtggaatgcccaggcgcgcgcacgacggggggccgggcagctagctttctgatcaccgggcctggttggtcgggccaggtgccgtcgggtatgagggaaatcaagtcaccgacgcgctacctgctcatcctcggtcgtacctatgccaacggtaccgacgctgactttgcagcggtcaatgccctgcaggaacagtacaaactcgtcccgctctcctccttcggaaaacccttcaccttccacgcaccgccggtcgacccgaaccccggtttcagcatgaccgacaagccgcaatcggtgatcctcagcatgtcggctgaggactacttcaaccggctggcgcgtctgatggggacggtggccccgcccgcgccagaggatgggccaatgcttgcccgcatggcacgcattggcatcgctcccggtcagcccttcgatgctgcaaagttcaaccctgccgtgcgcgaggccctgcgcgaccttccgcagcgggcgctggccgtgatcggagcgggacgttccagccttggcaacgaggtgaatggctggaccgtgacgaagggcctcggccgctacggcaccgattacatgaagcgcggcgtagtcgccgccttcggctggcccgccaatcttgaggaggacgcagtctaccctaatacgacagtagacagtaagggccgcgtgctgaacggcgcgaacaagtacacgctcactttcgccgccgggcagacgccacccgtcaacggcttctggtccatcaccatgtacgaggtcggccaaggctggtggtttgtacccaatcgcctcaacaagttcacagtcagcctgcgcgatgacctgaagcgcaacaccgacggctcgatcacgctccattttcagaatgagtcgcccggcccagaacgggagagcaactggctaccggcaccgaagggagattttatacccatgctaagaatgtactggccaaaggccggaaacccgtcgctgctggacggcagctgggcgccgccttgggtgcagcgcgtcagttga

SEQ ID NO: 7903 - DNA, 411 bp, Methylobacterium sp.
atgtccgagaaatccgaaaatcccgcggtgcccgcgttgctcgaaacggaaccgggaaccagcccgctgtccggcaagcggccgacgctgcagcagcggttcgtcacccgggtcagcccggagctggcccaggccatcgtcgtcgcgtcccgccgcgaggggctgagtgccagcgcatgggtccgacggctcatcctagagaggacgccgctgcaatccgatgtcgacgcgcacagcggccggcccgtgcgcctgcccaaggaagaagtcacggcgatcgcggcggcggtgcgagagctcgcctcggtcaacgccgcaatttccctgtccgacggacgggccgcccgcgccgggctcgaccgggcgcgtgatctgctcatccccgtgctgatgcggcatgcccggcgatga

SEQ ID NO: 7904 - DNA, 537 bp, Methylobacterium sp.
atgatgccctctatttccccggcatcgcggaagcgaaccgacgtcaggcccgtcccgctgccctccgactgcgccgtgacctcctggtacgccggcgccgacctcgccgacgccttcgcggtgaggctgcccgggccggggccgcacgatttgtccaggcttgccgaggatgcgctgtcgaacccggcagcctgggtcaccctggccatgtggttgcgcgacggggccgtgcgccccttcggggtgcggacgtcgggccaaatccggacccggttggagaccggcggacgggaccggatcggtttcttccccgtgctctcgcgctcggaccgggagatcgtgctcggcgaggacgaccgccacctcgatttccgcctgtcgctgcttctggtcacgcgcgacgatggacgggaagacctcaccgccaccagcgtggtccgttgccataacctgttcgggcgcgcttacctcgccgccatccaccccgggcacgtacgcgtcgtccgctccgccctggcaagggccgggatgcgctga

SEQ ID NO: 7905 - DNA, 177 bp, Methylobacterium sp.
gtgaacgacctcccggcctggaccatcagcctcggcgtcagtgcggtcgaggcgggcgagacggatgtttccgcctccattgagcggcccgaccgctccctctatcgcgccaaggcctggggcgtgaccgcgccgcggcctgaagccgcctctggattgccgctgtgcccgccatag

SEQ ID NO: 7906 - DNA, 1323 bp, Methylobacterium sp.
atggacgacgctccgcccaaggccatcgccctgcaattcgggatcgcggccgccctctccttctcggccatggcactccccttcgtcccggaggtgatcctggcttacgcgggctatcgctacctgagccacttcacctacggctggcggacgtggcgcgcaccggcgcgcattccgctccatttggggaagcgcggctatcgcgacgcgaccacccgtcggcgcggcgatgccacttggccgctcggccttgccgccaccgggcaggtctggctccggcgcgaggacctggtgcaggggctgagctttttcagcgacggtcctgactggcacagagaggtcgcggccaacctcgtgttcggcgcttgcctcaaccggatgggtgccatcatcgtccagagcgccgccgcggacatgatgaccgaccaactggccgaggtggcccggccgttcggtcgggacggggagatcagggctgtcgatctcaggcaggccccccggccgcccttgctgatcaccaccaccaccctggccgccgcgatcgacgacctgaggctcgggcccgaggccagcaccgtgaaccgggcgctgctgccgatcatcgaaatgttggctagccggtatcggaagagttccctcgatctctatcaggccttcaccgacgaaaccgccttcaagcgcctcctctccggcgagtacgaaatcgaccacgagaacgtcagcgccgacatggcgtctttggctgacggcgccgccttccgtgcggtgctcaaaccgctcaaggatatcccgaaggaccagcgcgagaccggacggaaggccctcgtcgctcacgccggtgaactcgcggccttgaccagtatgtcgttgacgaacggtctcgatttaaaaaaggccctgatggcaggcggcctggtatgcatccggccgtcctccccccttaccaccgcgctggtgatcgcgcgctgcaccgaggcgctggcctccctgacgccaggccgagccggtcacgcgctcgtgcatatcgcctatcccgatgcactctcgggcatctcagcgcggcgcttccgagaagccgccaagaaggccggcgcgattggatcgctcgcccatccggcgagacccacgaatcacatccaaaaagcgttccggaagggcggagccctgcggatccatagctggaaggctaaaggaggaatcgtccctctcagaggcaagttcgtgtctaccgtcaaagattgtccgttcatcttggacgttggtctgccgaatgctccagaaacaatgaactcgggaacggacgcctatgcttctgtcagctga

SEQ ID NO: 7907 - DNA, 1329 bp, Methylobacterium sp.
atgaacgacgccactcccaaggaagtcgcgacgcatttcgggatcgcggtcgccttcgccttctcggcgatcgccgcaccgttcgtccccgaagccatcctggcttacgcgtgctaccgctacctgcgccacttcacctacggctggcgcacttggcgggcgccggcgcgtgtcccgctccacctcggccggcgcggctaccgcgacgagaccacccgccggcgcggcgacgccacctggccggtcggccttgcagcaaccggccaggtctggcttcgccgcgaggatctcgtgcaaggcctgtctttcaacggcaatgatccgctttggcaggagcaggcgatttgcagcctcgtcctcggttcctgtatcaaccgtatgggtgccatcgtcgtacagagcgccaagcagccgatgctgtccgagcgattcgctgaggtggcgaagtcatacggccgggacaacgagatctattccatcgatctcgcggccgcgccgcggtcgccgctgcggatcaggtcttcgaccctgtccgccgccatcgcagatctggggctcgggcccgacgctggcgccgtgaatcggaaattgatgccggtcatcgagatgctcggcgcccgccacgggaagaacccgctgtcgctctacgaggcgttcaccgacgaagccgcgctcggccgtttggtcaacggggagtacgagatcgaccgcgaggaggtcagcgctgcacgcctctcctcctcggatggcgccgccctcagggcagcgatcaaaccgctcagggaacttaaggaagagacgcgggagaacgggcgaaaggcgctcgctgttcatgctcgggagatcgccagcctgactaccgtctcactttccgagggcttcgatctgcgctccgccctgtccacggccggactggtctgcatccgcccgtcatcggcactcaccaccgcgctcgtgatcgcgcggtgcgtcgaggttctcgcggagggtgatgccgggcacgctgcgaacgccctcgtccacgtcgtctacccagaggagctgtcgggaggctcagcacggcgcctgcgcgccgctgccatcgcgggaggagcggtcagcagcctctccctacccgcaagatccgcgaatcacgtctacaaggccacccggaacatcggcgccatcagcatccaggaaaagccgattgccgcccctctcgacggcacacctctcggctgcaagatcacgtccgcgatcaaggagtgcctattcacgctggatatccagctacctaaagcacccaagctacaatccgcgaatgttccaacaaatacagatcagcgttag

SEQ ID NO: 7908 - DNA, 177 bp, Methylobacterium sp.
atggcgggcgccgcggccctcgcagcgatcgcgactgggctgaacgagcggcagcaggccaatctgctcgcggcttacgatgaggatcaggcccgcgaggcctcccaccagcgacctggcgggccgccggctcggcagtggcgctggatcgagtatggccccgttggccacagatga

SEQ ID NO: 7909 - DNA, 417 bp, Methylobacterium sp.
ttggccgagcgcggtcttctgagcacgagctacgcccataccggcctgattgacacgcgcagccgctggcccatcagatccctcacagtgcgcctgacgaccgacggccggaaggtcgctcgcctcctgcggggcgagccgccgacgcggccgcggagcaaggagccgaagccgctctccctgtcggccctgcggatggtggcctacggccagcagcatccgaaggagacgttcgattttcacgcgccctggggcatctgcccgctcgactaccttgtggccctcgggatctgccgcggcctcgtcaagcgtggcctgctcgatggagatcctccgacgcacctccggatcacgccggccgggctcacgctggacgtttcatccatcaacatcaaccgccgagccacaacagcttga

SEQ ID NO: 7910 - DNA, 2520 bp, Methylobacterium sp.
gtgcatctcaaccgacacgcgccgacgcgtggacgcgtgcggggcgtaacgacggcacgcgccgcgtcggtcgcggtcgccgtggaatcggccacctcgcgatcacggacgtttcaggccggcttgctggcgcttctgatgggagcgagcccggcgccgctgctcgtcctctccgcgtcgaagagctgggccgctggcgagatcgtgttcgacatcccggccggcgatctcggtggcgtattggcccagatcgggcggatcggggcgcagccgatctcgttcccggcggatctgacgcgcgggcgccgggctggcccgatcgtcggacgaatgggtgtccaggcagctctggcgcgtgcgcttgccggcaccggcctcgtgatcgtgccaggccccgccggcgccctgaaagtcagcgccagcagcgcgcccgcgcctgcgcccgccgccgtggcgggcgacatcgcggccatcgatgtggtcgatgccaacaccggctcgccctacggtgatcgcggcttccaggccggtgccgcgggcgacaccctccggatcgcagacgcgcccctcaaggaaactccggtctcggtctcggtggtgacgaacgaggtgctccggtcccagaacgtcaccaaccccctggacgcggcgcgcaacgccgcgggcgtggtcgtcacgcccacggcgaacggtcagccgagattcctcatccggggcttcgagaccaggggcttctcggtgaacggcgcgcagagcgtcacgctccagcagctcccgatcgacgccgtcgatcgcgtcgaggtcctgaaggggccgacggcaatcctgaccggggtgaacgccgacggcggcggtctggtcaacctcacgctcaagaagccgacgagcgagacgatccgcgagctgacggcccgctacggaaccttcaactacaagaccatcgccctcgatctcggcggcgtgatgccggaactcgaagggacgacctatcgcttcgtcagctccctcaaccatgccgaccagtcggaattcggctaccgcgatccgagcgagtttctcgtcatgccgagcgtgcggtggcagggagagggcctcaccttgaccaccggtctgcgctacatccagacgcgcggcgtcccacaggcgcgcttcggctaccgcgccctcgatccgatcaccggcgagccctcaatcttcaagatccccggcaacggccccggcaatcccaacgcacatttcgacggcaaggaactcacctacgacacagaacagagctatcatgccggaaccctgttcggtctcttcgatgtgaccttcaacaatatcttccagcatcagtcggcccgctatatcggcccgtccttcgcatttgggacaagtggcttcggctacgatcagcctgtcgtccaaatcggatcggactcgcgcaacgagaatatcaccgagcggttgagcatgtcgctccggtatgaggacgaccttttcagaagtacgacgaagtttggcttcgactacctatcgcaagggagcactacgcggaatagtaattcctcgttcgatcctgatttcaatttcctgaccaacacaccaaggcagcaactaatcagctcagggtacgaattttacagcatttccaacaatatctatcgcggcggctatatggtcgagaagctcgatcttttcaacaacaagctccacatcctgggaatgacgcaatgggactggttcagccaatccggccggggcgggcaggatgggttcggcgacgatcggtattcaaacagcaaaaaccaagccttagcctacactttcggcgccctcctcgatcttccctacgatctcggtgtctacatcaaccgcagcgacgggcgcattccgcaagttccagtcgccggcatcagcatcccaccggttgggcgcacgctcaatgagttcgggctgcgttcctccatgttcgacaacaggttcaataccacgctgagcttcttcgaactcagggagtcggatctgactctcgtcatacagaactcacccggcttccccaacaacatcgaagtcgtcaacacccagggcctcgagtcgcgcgggatcgagctcgaagggcaaggcgagatactgcccggctggaacgtgatcgcgaacgtaacccggctctggacgcggtccctcgatccggaaggacgcggtctcgacccgagcgccggacggccggcctatcagggtagcctctggacgacctatacgtggtcgtcgggctgggccgagggcatcaccatcggcgggggccttcggggactgactggtttcaaggtcaacgcctcagaggaagaacccctgttcaggctgcccggctacgcgatcttcgacgcgtccatcggctacgtctccggcgacttcgccgccaacctgaagatcaacaacctgttcgacacgaaagcgttctcaatcacggaggcgagcaactacctgccgctggagcgcgggcgcaacgtgatcctgcaggcgagctaccgcttctga

SEQ ID NO: 7911 - DNA, 2328 bp, Methylobacterium sp.
gtgtgcgggtctcaaccggccttcgcgcaggcccagtatgacttcagcgtcccgcgcggcgatctggcgaccgtcgtgacggagatcgggcgcatggccggcacgatcatcgtaattccccagtcgctcgcagctggccgcatggccgggccggttcagggccgtgaaaccgtcttcgacgccctggccaaggccctggccggcaccggcctgcgcgccgattccggccagggccggagcatcatcatccgggcggcatccagcacatcggcgattcctcccgctggcgggaatgtcatcgaagccatcgatgtgaccgacaacagcggtgtcaacgccttcggcgaccgtggatttcaggccggggcggccggggagacggtgcggatcggaggggctccgatcaaagaaatcccgcttagcgtcagtgtcgtcacccgggatgtcgtccgctcgcagggcatcaccagcacggccgatgcggtgcgcaacgtggccggcgtgtcggcgagcgccgtctcgaccggccgcccggagttcacgattcgcggcttcaagcaggccggctacgcgatcaacggacagatcggctcgaccttcgcgcaggttccgatcgacggcgtcgagcgcatcgaggtgctgaaggggccaacgtccattctgaccggcgtgagcagggagggcggggtggtgaacgtgaccctgaaggagccgaccgccgagccgatccggacgctgacgatgcggtatggaacctacaactacaaaaccttggccgccgatatcggcggcccggtcgagggcgtcgatggtctgaattacaggtttgtcgcatccggcaaccatgccgacgagaattacggcggataccgagatccgagagagctgcacatcgcgccgtccgtacggtggaccggcgcggatctcagcatcctcctgggtatgcggtatgatcgggcgcaccttgtcccggcgcccatcaccttcgcacccttccttctcgagggcggcctcggccgtcccttgcggcttccgcgcgaagtccccatcggcagtccctatttcggtgggtcgaccgaggagatcgcgttcaacacgcggcaatcctacgatgtcggaaatgttctcggagccgacgtcacggtcaacaacagcacgcaatacctgatctcgcgcgcgaagctgctcaccggccttctggatgccacagaggacgaggttcagggcttgttcaacagcccatcgaatgtttccatgcgtgatctgacaaaccgcctggatgtcacgacggaatacaatgccggatttgcaaggaattttctgaagctcggatacgattacatcgaccgcaccaatcgtccgcgcatcgggggggagcctctcgggaatgtcaacattcgcacgggcctgccctactttcctctacgatttgcgtacagtcccaatttgcgcgaggattcatcaacaattcaaggaatttactttatcaataagttcgatacatttgacgaccgcctgcatatcatggggtcgtaccggtatgattggcaggcgaccaactccgtcacgcgaacccccctggagacgaacagggtcagtgggcgaaacgagggcgaatcctgggtcgccggcgccgcgttcgatgtgacgccctggatgacggtctatggcaatcgcagcgtcggcttcgtcccctccgtactcggtacggtcgccggcgcattgccggcgccggaaggacgcgacctcgcggaggtcggagcgcgctacttcctgttcgacaagcggctttctctgacgacctccttgttcgatcttgcccgtacgaacgtcacgattaccgatccacgcgatccgacgggtcaaacacgcatcctggtgggaggcttgcgcagtcgcggcaccgaattcgagcttcagggcgaaatacttccgggtctcaacgtcatcgcgagcttgacgatccaaaacatcgctgtgaccgatcgcgcgacggaagaaggtggcgagttcttcggagtgcctaagaagaccgcgagcctgtgggttacctacgcccttcagtccactccgttcgccggtctcaccttcggggtcggtgcacgtggcaactcacgaagcacgacgggcatcggcacggactccgtctacgttcctggatacgtcgtcgccgacgccatgattgcctatcagcgggacgacttttccgtatcgttgaatgtcaaaaacatactcaatgaatattcattgagtccatcttacttcagcgactacatcggcatcaatcaggggcggagcgccctgctccaggcggattacaggttctag

SEQ ID NO: 7912 - DNA, 81 bp, Methylobacterium sp.
atgctcaaaggtggacttctctggttgatcggcattccgctgccgatcattcttctgctgtggttcttcaacgtcttctaa

SEQ ID NO: 7913 - DNA, 696 bp, Methylobacterium sp.
ttgccggtcgccgcggccatgaacgcgtccgcccgcccgccggaaacggcgctctacgcgccggtgaagggcttcctcgaaaccctcggctttgccgtcaaaggcgagatcggcggctgcgacctcctgggcgtgcgcgagggcgagccgccggtgctggtggtgtgcgagctgaagcagagcttcaacctggaactcgtgctgcaggccgtggatcgcgccggcgcctgcgacgaggtgtggctggcggcgcgcctgtcggtgcgcggcaaggggcgggaggccgatgcgcgcttccgcaacctgtgccggcgcctcggcttcggccttctcggcgtcggtgccgacgacggcgtccatgtccttctcggccctggagcaccgatgccccggcgcgatcccaagcggcgctcgcgccttttgaacgagcatcgccgccgacagggcgaccccgtggccggcggcggttcgcgcgcgccggtgatgaccgcctatcgccagcaggccctcctctgcgcccgcgccctggcgcccgggccgctgcgcccgcgcgacctgacgagcgccgtcccgacggctgccgccatcctccgccgcaacgtctacggctggttcgagcgcaccggccacggcgtctacgcgctgacgccggccgggcacgaggcgatcgcgcgatggccttcgacgccgccctga

SEQ ID NO: 7914 - DNA, 657 bp, Methylobacterium sp.
atgacctcgaacgctccctcgtcgccgaccatcacgtactatttcagcttcctctcgctgtggtcctatgtcggcagtcgcgccttccgcgatctcgccgaacggaacggcgcgcggatcgtctacaagccggtggatctgatggcggtcttcgccgccggcggcggcaagcccgtcaaggagaggcccctgcagcggcaggcctaccgcctcgttgaaatgcagcgctggcgccgcatccgcggcatcccactggtgctgcacccgaaattctacccggccgacccctccctcgcccaccgggtcctgctggccgccctcgacgagggcagcgcggtcgccgacttcgtccatgccggcctcagcgccgtctgggcggacgaacgcgacatcgccgatcccggcacgatcgtccggctcgccgatgcggccgggctcgacgggaaacgcctgctcgcccgagccgacgagccggcgttccgcgcggccgaggcggctctgacctgcgaggcgatcgggcggcaggtgttcggggcgccgttctatgtctaccgcgacgagccgttctggggtcaggaccggctcgacctgctggaggcggcgatctcgggctcggacgcgccgatcgcgctgccggacctctccgcttccggctga

SEQ ID NO: 7915 - DNA, 243 bp, Methylobacterium sp.
atgaacaaggcctacggtgtgcaggtgacggcgcgggggccggacggaggcgacccgaggaccgtgccggttctggtggtcgcaggcgacgagcaggacgcccttctggtcgtctccgaggcggtcggtgccgacgccgaatccgaggtgctgcgcgaacttaccgacgcggagatccgggagcacagcctcgacctggagcagcgcggcgccgcgaaatcgctcgcggtgttgaaactctaa

SEQ ID NO: 7916 - DNA, 852 bp, Methylobacterium sp.
ttggccttggccgcggccggcatagtgctggcaacgccggccggcgcggggtcggccgcgcagcccggcggatcgattggcattcccgcgggtgcacagatacccgtcggtctgtacttcgtcgccgtgccgaattacggcgtccggcccacgttcccggcttcgtcggatctcaacgtcaacacggcgaccttcgccctgtcgaccccgtggtccgttctcggcgcgcggctgcaattcatcgtcttcaaccgctccgccgtctcggcgagtgcgcggggggctccctcgtccaccggcctgggccagagcctgtacgcgacgcagctcgcctggaacctcggcaacgatgtcggcgtcagctatttcctgggcggctatgtcccgaattccacccgcttcggccctcaggagggctcgctctcgcaccggttcgccgtgagctacaccgggaacggctacaatctgaccgcgaacctgctctacggtcacttcctcaccgaccgtgccctgaacggcacgcgggcctttcccgactatctcaacatcgatctcaccgcgacgaagagattcggtaagttcgaattcggtcccgtggcctatgcttcgaccgatctgccggtcggcaacgtggcgggctaccggcgccagagccaactcgcggtcggcgggctggtcggctacaatttcgggccggtcaacgttcaggcctacatcacccgcgatgtcgcggagcgtcattacggcggccaggagacgcggggctgggcgcggctgatcgtgccgatctggcaggacaagggcgaggtcgcgcccaaccgcaccctcgtgacccgccagcaaggacaatag

SEQ ID NO: 7917 - DNA, 270 bp, Methylobacterium sp.
atgaagcggctattgctcgtctctgccctcgttctttccccgctcgccctgtccgcgacggcccaggcgcaggggaccatccgcggcgccgaacgcggcgtcgaagacggcaaccgcgccgccggcccggtcggcggcgtcgtgggcggtgctgtcggggccgcgaccggcaccgtcggcggcgtgctcggggtcgatcccgatgcccgtcgtgaggagcgcatcgagcggcgcgaagagcggaccgttcgcgagcgtccggcccggtaa

SEQ ID NO: 7918 - DNA, 156 bp, Methylobacterium sp.
atgacgatcaccaccatcctcctgatcctgctgatcctgctcctgttcggcggcggcaacttctacggcggcggtcgcttccgcggccccggcttcggcctcggcggcctgctgatcatcatcctgatcgtgctgctggtgacgaaccgggtctaa

SEQ ID NO: 7919 - DNA, 876 bp, Methylobacterium sp.
atgaagcgttgcgcaatccttactttgacagtgctcgcgatcggcccggcatcagccgacccggtggaactcgcggactttcgtgacctgttgcgacctccgccgaccctgcagctcacctacggtgaggccccctctcaaggcatcgatgtattcctgcccgcaagccctggcccacacccagtcgcggttctcatccacggcggttgctggagcgctaccaccgtcgggcgcgagcagatgcgtcacctaggacccgatctaacgcgtcgcggcgttgccgtgtggagcatcggctaccgccgtgccaacgaggccggcggtggctatcccggaacttatcaggacgtgggcgccgctctggaccgcctcgctgaagaggcaggagcccaccacttggatctctcacgagtggtgttcgtgggccactcggcaggtggccatctcgccctctgggcggcctcgcgcggcttgcttcccgccacgagccctcttcacgcagcgaccgggtttgtcccgcgggcggtgatcagcctgggcggcgtgggggatcttgcgacgttcgcgcggttcatcccggtgctctgcggcccgggcattgtcgagcggatcgcaccagcagacaagctatcggaggtgtcacccgctgccctcccgcccgcaggggtgccgatctttctggtcagcggcgtcctggaccgactcacgccgccatgggtcgcctacgactatgcccgcgctgtacgagggaggtccggacctgcgccgcaactcatcaacgtctcggatgccggacacttcgacgtggtcacctcgtcgacactggcttggcaggaggtgcgtggtctcatcgaggcatccttggaactccagtag

SEQ ID NO: 7920 - DNA, 1251 bp, Methylobacterium sp.
atgatctccggggccacgcgcggccaaggcatcggcgatgcgctcgcccggcacctgttgaacccggagaacgaggcggtcgtcgtcatccccgcacgcggcctcggcagcaccgacctcacggcgcaggtgcgcgagctggttgcgctgtcgctcggcggccggaccgatcggccgatctaccacgtccacctcgacccggatgccggcatcgccgacgaggttggggcgcgggcgcggtggtgggcgctgttcgagatcgagttcggcatggaggggcagccgttctgcggtgtcgagcacgtgaagcacgggcgccaccacgagcatcgcgtctacggcctcgtccggcccgacggttcggtgatcgatctggcctgggactacccgcgccgcgagaaggtcagccggatcgtcgaacacgcgttcggtatggcgccggtggcgtcaaaacacgcacggagcctcgcacggcgcctccgcgacgagggacgtctcgacgttgccgactggctgacgcggtccggaagcctggaacggacgcgtccgatcgctccgctcacgccagccgagcggctgcagcaggaacgcaccgatacgcctctcgacgccgtgcgccgggcggcgctggcggcatggcgcgagagcgccgacgggccgaccttcgtggcggcccttcgcgcacgcggcttcgatctgcggcgcgggcgcaagggccccgtcatcgtcgacgggagcggcggcgcccatctcacgacgcgcgtgatcggagcggcggctcgccgcttcgagggaaaacggatcttggccgcgaccgtaaaggaacggatcggcggcctgacattggaggcgttgggacatggatggagtggaaatcgcgcgccggttcgacgcgcaggatcggctgctgcgggcgatcgtcggaatgctggcgccggagccgagcgagacggaaggctcgggattcgaggacctgatcgaggtgctggcggacctgacggaggcggtggccgaggtgacggcggcggtgcgggccatgcgctcgaacgcctgcgcgcccttcccacaggccgggccctgatcctgcgccgtcgcctctcgggactgcatccggccgtggcaaccttcttgtcggcggccgagcgcgcccgggcggccatcgcccggatcgaggagcggaatgcctacgagaaggagcgcgcctggaggttatgggggctcaccgacatctggggcctccccctccgttga

SEQ ID NO: 7921 - DNA, 804 bp, Methylobacterium sp.
atgcttctcacctattcccgcctgggcggcctgcgcttcgtgctctgcggcatcggcctcgtggtcgggctgttcctgctcctcccgatcctggtgcttgtcgccctgtcgttcggcgactcgcaatggatgcagttcccgccgccgggctggaccctgcgctggtacgcggacctgttcgacgaccccgattggatcttcgccttcctgacgagcctgcggatcgccgcctgggtcacgctgctgagcgtggcgctcggtctggtcacctcgttcggtctggtgcgcggccgctttccgggccgggagacggtgcgggcgctgttcctgatgccgatgatcctgccggtggtcgtgctggcggtggccctctacgccctgttcctcaggctccggctcaacgggacggagctcggcttcgtcctcgcccacctcttgctcgcgctgcccctctcgatcatcgccatcagcggtgcgctcgagcggttcgactcctccatcgaggatgcggccgtgctgtgcggcgcctcgccgatggaggcgaagcttcgggtcacctcgccggcgatcatgccgggcatcgccaccgcggccctgttctcctttctcgcctcctgggacgaggtcgtcgtggcgatcttcatggcgagtccggacatccagacgcttccggtccggatctggggcgtgctgcgccaggatctctcgcccgtcgtcgccgccgtctcgacgctgctcgtcgcgctcacggccgtgctgatgctgctctccgctgccctgaagaagaaggacgtccgcgcatga

SEQ ID NO: 7922 - DNA, 1419 bp, Methylobacterium sp.
atggcgccggacacggtcgccctcgatctgccggaactcggcaagggtcgtcacaccgcccgcctcagcctgatcggcgtgatcgccaccttcggcgggttgctgttcggctacgacaccggcgtgctgaacggggcgttgtcctacatcgccgactatttcggcctgtcgccgctccaagaggggttcgtcaccttcagcctgctgatcggcgcgaccctcggcgccctggccggcgggcggatctcggaccggatcgggcggcgggtcaccatcacaggcctcggcgccctgttcttcgtcggcgcgctcggctgcgtcctggcgccgacctacgacatcctcatcgtcttccgcgtcgtgctcggcctcgcggtcggcggcgcgtcggtcacggtgccggtctacctctccgaggtcgccccggcggagcagcgcggcagcatgatcggccgcaacgacatcatgatcgtgtccggccagttcctggccttcctgttcaacgccgtcatcggcaacgtgctgggcggcaacgagcacgtctggcgcatcatgctcgccgtcgcgctcctgcccgccgtcgtcctgttcctcgggatgcgccggatgcccgagagcccgcgctggctgatggcgcagggccgctcccccgaagccctggacgtgctgcgcacgatccgctccgaggcccgcgcccaggccgagatggaagaggtgcgcgtcctcgcgcggctcgacgcggtcaagcgctcgaccagctggcgcgacctcgtggcggagccctggctggtgcgcctgctcttcgtcggcatggggctggccgcgctcgcgcagctcaccggcatcaactcggtgatgtattacgggacgcaagtccttgagcaggccggcttcacccggaacacggccctgatcttcaacgtgctgaacggcctgatcagcatcgtggcgatgctcgtcggcgtgatggtggtcaaccgcgtcggacgccgctcgatgctgatcctcggcttcggctgcgcgacggcgctgcacgtcttcatcggcgtgatcggcatcgtcgtgccgctcgacaacccggcccggccctacctcctgaccgtcggcatgttcggcttcctcgcgatcgtgcaggggaccatccagctcgtgagctggatcatgatgtcggagatcttcccgctgcgggtgcgcgggctgatgatcggcgcgagcgtcgcggttctgtggctcaccaacgcgctgatctcgctcgccttcctgcccgtcgtgcagaccctcgacttcgcgaccttcttcctgttcggcggctgctgcctgttcggggtggtcttcacggcgcgctggctgccggagacgcgggatcggagcctggaatcgatcgaggcggagctgtccgcgggaggcgcccgtgtctga

SEQ ID NO: 7923 - DNA, 1272 bp, Methylobacterium sp.
atgttcgcgatgctgtatgtgatcgctgatacgaattggcttttgcttgctttttccgctcttatgttcgatctgccccgctacacgttttcgctcctttcctggtcattggtcggcatattcgggagttctcgacccggcgataggcgggtcgaggcggccgtgagcgtgatcatcccgaccttcaatggtggttcggggcttgctccgacgatcgcctcactccgccagcaaaccttgtcgccacttgagattatcatcgttgacgatggctccacggacgatacgcgcgccgtcgcaaaccgagcgcgccaagacggcttggtggatatggtcatttgccacgggacgcgctgcggccgcagtgctgcgatcaacgcagcagcgaggttcgcgagcggcgatctcatcttcacaatcgatgctgatacagttcttgagcgcgacgcgatcgcacggcttgccaatgcgttcaatgatccgcgcgtggccggcgcctgcggcaacatcgcgatacgcaacgagagcgcgtcgctatggaccgggctgcagagcgtcgaatatatgatgtcgatcagcgccggaaaatctattctcgatgttgtcggcgcgattgcctgcctgtccggcgcatgttcgatgtaccggcgcgatgtcttcgcgcggcaaggcggccttgatgtcggccctggcgaggatctcgagttcagcctgaggttacggcgccttggttatcgggtccgctttgtgccagatgcctgggctgaaacggacggtccggtggcagccgtcggtcttctgcgccagcgcgcgcgctgggatcgcgacgcgttgcgcatccgctccatgatgtatggagagcttagcttcttccatccactggagcgactgccggacaccctccagcgactggatttcatcgtcttcgatttgatcccgacgatgagcctcccgttttattcaatgtacattgtgattttgttcggaccggctcacgccatcttctttattgctgcaatatatttccttttactttggatttcaatttttaatatggcgctggcgttcgttctattcagcagatctccaagttttttcagccttggagctgcatttatattcccattataccaaggaatttatatgaaatgcgcccgcttcgtttcctattcgtcggaaatcctcttcgccacctcgcggcgtgatgactacgtgccgccgcgcgtccgccgtgcgctcttcgcagacgaggttggaaaggtggtctcatga

SEQ ID NO: 7924 - DNA, 951 bp, Methylobacterium sp.
atgctcaacacgctcttggatttctcgcgcctggaggccggagtcgtcatcccgcggccgagagccttcgaacttcaaccgctcctcgacaaaatcgagaacgacctcgcccatctggccgatgccaagcacctgatctaccggactctccaaacaaatctggcgatcatttccgacgctgcgctgctggaactggtcctgcgcaatttcgtcctcaactccatccgctacacggatcgcggcggtatcctcatcggctgccgccgacgcgggaccgacgtttcgatcgaggtttacgatacgggaatcggcatcccggaaggcaagcgagaggacatcttccgcgagttctatcaactcggcaatcccgagcgcgatcgccagaagggcctcggactgggactcgccatcgcgcgagggatcacgacctcactcgggcatacgctgtccctgtcgtcgaaggaggggcacggcagcgtttttcgcatcctcgtccctggaacggatgagaccgttcccgatgtcgatgtcctagctgacatcccgaatgttggcggactggtcggcgcgcgcattctggtcgtcgatgacgacgccatcgtgcgcgacgcgatggtggcgctcctgaccggctggggatgccggtgctgggtctacgaaggcgcagacgacgtaaggcggcaccgctcatccgagccggctccagatgcgctcatatgtgactttcggctgcgtgagggtcaaacgggcactgaggccatcgcactgctgaggcgccattgggggcgaccgatccctgctattctcatcaccggcgacacggcacccgctcgcttgcgagaggcctcggacagcggaatcccgcttgttcacaagccggttcgccccgacatcctccagaaagcgctgctgactttgatcgcgccggagccaacgagcaaaagcctttga

SEQ ID NO: 7925 - DNA, 426 bp, Methylobacterium sp.
atggaaccgcgtctcagcctcatcaccctcggtgtgaccgacctggcgcgtgccacagccttctatgaggccctcggctggccccggaaggtgcaggccgcgcagggtgtcgcgttcttccagctcggcggtctcggcctttcgctctacccccgggccgacctcgcgcacgatgccggtgtgccggtgcaggcgcagccctcgcagggcttcacgctggcctacaacacccgcagccgtgcggaggtggagtgggtgcttgccgccgcagaggcggcgggtgggcgcatcacgcaaccggcgcaagatgctgtgtggggcggctatcacggccactttgccgacccggaaggtttcctttgggaaatcgcctggaaccccggctttgcgctggccgcagatggttctttaagcctgcccgactag

SEQ ID NO: 7926 - DNA, 1017 bp, Methylobacterium sp.
gtgtctgagcgtatccgcttcggggtcagccccatcgcctggatcaacgacgacctgcccgaactcggggccgggacaccgctggagcggatgttccacgaggccgccgcgatcggctacgacgggatcgaactgggcggcgccttcccccgcgagcccgcggcactctcggccctcctggctccgtccgggctggccctggccgcgggctggtacgccagcagcctgctcaccgtcgatgccgaggcggagatcgaggcgctccagccgcatcttcggctgctgagggcgatgggatgcgacgtcttcatcgccgccgaatgctccacctccatccacggcctgcgccgcgtgcccctggcccaccggccggtgctggactgggcgggctggcgccgcttcggccgggagctgacgcacctgtccgagtacctggcccgcgagggcttccggctggcctaccaccaccatctcggcaccgcggtccagagcgtgaccgacctgagcgcgatgctcgcccacaccccgagccatgtcggcctcgtgctcgataccggccacgcggtgttgggcgggatcgatccggtcgcgctgatccgcgaacatccggaacggatcgcccatgtccactgcaaggatgtgcgcccaccggccttcgccgccgtcgaggccgcgggaggcagcttcctcgacggcgtcctggcggggatgttcacggtgccgggggacggcagcctcgccttcggccctgtgctccgcgcactcgccgacatcaagtatcgcggctggctgatcgtcgaggcggagcaggatccccagatcgccgatccgcgcatctacggtcggatcgggctggagaccgtgcgtcgggaggcgatcggtgcgggcctgacgacatggacggggtcgctcgcccgcgcagcggtcggagcgccttcgccccgcaacgccccatcgcaatcgcccgcagcgacgctgttcccgctcgcggagctggccctgtccgggctcgcatag

SEQ ID NO: 7927 - DNA, 645 bp, Methylobacterium sp.
atgatgagcacgatcaacacgcatcatcgcgatgacgcgcagagggacgcggggatctacgtcgcgatcgtctaccacagcggctacggacataccgctcggcaggccgaagccgtgggagaaggagtatggcagtccgggggggcgacacctgtgctcctctccgtcgatgaggcacagcatcgctgggatgaactccatgccgcgcatgcgatcattttcggcgcaccgacctacttgggcgcggcttcggcatcgttcaaagcctttcaggaagcgacctcaaaggtgatgatggctgaaggctatcgctggaaggacaagattgctgccggtttcaccaactccggcgcgcggtccggcgacaagctgtcgacgctgctgcagatggttctgttcgccgcgcagcacggcatgcactgggtttgcctcgatctgccgcccgcgaacaactcgacgaccggctcggaagacgacctgaaccggttggggttctggatcggtgccgcagcgcagtcgaacaccgacgaaggcccggacagagcgccaccggaagccgatcttgccaccgctcgccgtcttggggagcgggtcgcacgggtcacacgcgacttcgttcgcggccgaaacctcgcaggcacatag

SEQ ID NO: 7928 - DNA, 885 bp, Methylobacterium sp.
gtgatccatccgccgcccgaagccttcgtgcgggccgccgagcggaaccgcatgcatcaggagagccgcgaatcctcgtcggcggtcccgatcctgggctgggcggtggcgggcctgctgacgctcggggttcatgtcggcctctacctcctcctgacccgtcaggccgagacgccacccacccccctcgaaatgcccgcggcggtgatgatcgacatgtcgccggagcccaccgtggctcagtcggcgacggacaacgccagcaacgagccggaggcacagaacaccgagcaggccgaaccggagccggcggaggaagcccctccgccgcccgatcccgagccggtcgtcgaggccccgccccctcctccccaggtcaagcccgaggccgtactgccgccgacgccgcccaaagaggtgaagaagcccgagccgaagaagcccgaacccaagccgctcaagaagaaggcgcagaagaagcccaccaagcctgttgtccagaagaaggacaggccgagcgcggcctcccgcaacggcggcggcccgcgctcggaccagcagaacgccgctcgcaccgcggcatccgcggccggtgccgcggtcagccaggcgtcgcgggcgtcctggcagaacgagatgcggacgcggatcgtgcgggcgaagcggtttcctgccggggccgccggcgcgtccgggatagcggtggtgagcgtgacgttttccggcaacggcagcgtgagcagcgcccagctgatccgctcgtcgggcaacgcggcgctcgatgccgaggcggtggcggtgatgcaccgcgccgcgcccttcccgccgccgcccggcggacaggcgatcacacagaccatcccgctcaacttcagtcggcggtga

SEQ ID NO: 7929 - DNA, 507 bp, Methylobacterium sp.
atggcagacgacaacttcacgaagtggcatatcgccggcctgcacgcgctgcgctcggcgagcgagcaaggcgatgcggctggcaaggcgttggccggcaaggtccgcaatgcggacctcaaggcgcttctcggagagtacagcgagaccgccggcaagcaggagacccatttcgtcggcttcctgaaagagctcggcaccgagccgaacggcttcaaggatcgcatcatggaaggcgtcggcaacgggacgtccgagatggtcaaggccgcgcccgatcaggatctgctcgacctcagcgccgtcgccggcacgcagtccggcttggactattatgcgggtgccttcaaagggcagggggcccttgccaagcagctcggctacgcggaccaagcggacaccttcatggccatgagcaaggcctgtgaagccctgcgtgagcggttcaccaaggttggcgacacgatccgcgccaaggccgccggcgaagcgcgcaaggccgcctga

SEQ ID NO: 7930 - DNA, 300 bp, Methylobacterium sp.
atgcacatcgtcgaccgtcggctcaatccaggtggtaagagcctcccgaaccgccaacgcttcctgcgccgggtcaaggacgtcgcacagcgcgcggttcgggaatccgcccgagagaaggatatcaagaacctcggcaaggacgggcgcatcaccgtgcccggcgacggggtgcgcgagccgcgcttctcgcgccagccgggcacgggccatcaggactacatcctgcccggcaacaagacctacgtggagggcgaccgcatcgagcgcccgccgggcggcggctccggcgagggcggg

SEQ ID NO: 7931 - DNA, 225 bp, Methylobacterium sp.
atggacgaatcgatggagagagccgtggacgagatgaagcgcgcctacctggaggcttccggcggcgacgcgagggacgccctgcgtcgggcgctcgccgacgccatgcaggagatcgccgacgtgtcgagccacgtcagccgcggcttcgtgcgggcctcaaagccggcggacctggcgcgcaagctcgggccggagcgccgggcgcgcgaggcggctcggtaa

SEQ ID NO: 7932 - DNA, 303 bp, Methylobacterium sp.
atggatctcaaaaaagcaacagagacactgatcgttttcgccgatttggaccttctcgttgaacgggtgcttgcgctggtgagggcgcataatgcgctgaggcaggacggttttcacctaatatccgatgacgatttggtcgagatctatcgattgctcaccgagcttcatgaggtggcgatcgatggcgttgatccagagttagtcgcgccgaccattcttcagctacgcctgaagctcagcgtcttggaagtgacgatcagtgcccatctcaacgcgccaagcccccaatatttgcattga

SEQ ID NO: 7933 - DNA, 804 bp, Methylobacterium sp.
atgccgccgggccagagcgaaagccggcggcttgccgccttgcatcgcttgcagctgctcgacacaccaccggatccagccttcgaccgcatcactcagctggcccagaccctcttcgatgtcccgatcgcgctgatttccctgctcgatgaggaccgacaatggttcaaggccaagtgtggcctgcacgtctcgggcacgccgcgggaacaggccttctgcaactatacgatcctgcacgacagcgtgttcgtggttcccgatgcgcgcgcccatgctgatttcgccctgaatccgctcgtgaccggggaacccttcatccgcttctatgcgggcgcgcccctcatcgtcgcaccggggacaaggatcggctcgctctgcctcatcgacaggaagttgcgcgccttcgacgaagaagacagccggctgttagcccgattggcgcaggtgattacagatgaaatctggttgagaacccttgcatccggacaaaacagggtcttcccacatttcgcacagggtaggccgcgtaccgaaacgccatccctgatcacaggcctgcaggttcgtgcggccagggcgatgctcggctggtccatcgacgagctgagcctgaaaaccggcctctcgccgaacaccatcaaacgaatggaggcggatgagcaaagccgtccaagtagcccgtccacgacagtaaaaatcaaggaggctctggaaggcgaagggattgtatttctcgggcatgatgcggccgatcccggcgtacaacttgtgagaaaaatcagtaacaacaaagatcaatag

SEQ ID NO: 7934 - DNA, 279 bp, Methylobacterium sp.
atggcgagtgactatgccttcaagctacacaatcgtgcggaaggctattcgattgccgggttctatacgtaccagaatggacgctggagccggaattggatcggcggatcgatcaatcccggacagtcggcatcgctggactggaatagcaacgatggcgactgcgtcgtgccgttccgcgtgaaatggcgtgactatggcgcggacgatttcaagctcgattggtgcaagggcgtgtccaacgtctacatgaaggacaagggcttcacctacgattga

SEQ ID NO: 7935 - DNA, 84 bp, Methylobacterium sp.
atgctgagccacgaatggctcgcgccccacctcgtctgctggccgagccggatcccggacgcccgaatgcgcgacgaggcctga

SEQ ID NO: 7936 - DNA, 180 bp, Methylobacterium sp.
atgatcatgcgtgctatctacgtgttcctacttgcgctttccctcgccactggggcgttctgggcaacgatgctcatcagcccaccgaagacaagagcggcaccgactgccttagccgatacgtgggtggtcaagacggatcagccgccgatcgcggacgactacgatccagagttctga

SEQ ID NO: 7937 - DNA, 105 bp, Methylobacterium sp.
ttgcgcaattccctgatccttgccggcctcacgggcattctcctgtcgggcacggcgctcgccgccgacctcccgcgccgcgcggctccgccgccggtgttccag

SEQ ID NO: 7938 - DNA, 768 bp, Methylobacterium sp.
gtgctctgcgcaggcgcgctagcaggactgttcgcccgcttcagcttcgatggggccaccctgacgaaatccctacttttcgtgccctactacaacgccgaaggtcagatctggccgttggcgatctcgggttggacgctcaatgctgagatgctgttctacgtcctgttcgccgctggtctctggatcggcgcgcctcgcaccttctgcgcggcagccctggccgggctcgtgatcgcgggtgcgattttcgcgcccgagaacgccccgctgcggttttggacctcggcgatcatgctcgaattcattgcaggccttgcccttgccgggccgatccgtctcgccggtctcggacgcgggctgagcctcgttgccgtcggcgcgacctgcctcgtcgcggccgagctcgcttggcactacacggaagccctacggccgctcgtatggggcggcccggccttcctcatcgtttgcggcgcgctggcgatcgagcgggctgggcgctggccccggcgcgccctcgccgccctggagcggatcggagatgcctcctattcactctacctcacccatgggttcgtgatcgcgctcgtgcatcgcaaggtcggcacgaccatcgccgccaacgcgatggctgtgccggcctgcctcgtgctggcgttcctgacctattacggcttcgagcgtcccgtcgggcgcatgctcaaccggctcgctcgaccgcacccgagaagcgcgctcgaattggcggcaacctccacgcattga

SEQ ID NO: 7939 - DNA, 243 bp, Methylobacterium sp.
gtgccgggcggcggcgctgcgtcaacgctgatggatccgccgcgcgcggctgcgcttcttgtgctcgccccgcacatgcccatggtcatgcacgtgcgagtgcccgtgcccgcggtagtggcggtgacgctccgggtgatgtgcgtggaaatgatgatcgtggtggcgggtgttcggatgccaatccacggctccgaccggactgccggccaggacaccgccgaacaccacgccggctgctag

SEQ ID NO: 7940 - DNA, 1167 bp, Methylobacterium sp.
gtgacggtcggcctctgctgcctcgtgaccttgatcgaagggttcgatctccaggcggccggcgtcgtcgccccacggctcgtttccatcttcaacctcacccctggccagctcggcctgttcttctcggcaagcacgatggggatgctgatcggcgccgccttcggtggccgcttctccgaccggttcggccggaagaagaccctcatcgtctcggtcgccctgttcggcctcatgtcgatcctcacggggctggcgcacagcttcgaggtgctgctcctcgcccgtcttctcacgggtgtcgggctcgggtccgccctgccgaacctgatcgccctcgtcaccgagagcaccgcgccggggcggcgcgcgagcgccgtggccctgctctatgcaggccttccggccgggggcgcgctggcaagtctgttcacgcttgtcggagcggaatcccaccactggtcgacgatcttcatcaccgggggtgtcgcgccgcttctggtcgtgccgctgatctgggcttggctgccgcacagcagcacggccagcgcacagcggggtgggggcagcgtgaggagcgtcccgacggccctgttcggcgaaggacgggcagcaacgactctgatcctgtggcttgccttcgtgctcggactgctggtcctctatctcctgctcaactggcttccatcgctcgtcatcgcccgtggcatgagccgggccgacgcctcctgggtgcagttcgtgttcaatctcggctccgccctgggcagcactgcgaccggtctcctgatggatcgctggggaaaagtgacgaccgcggccctcgtgttcagcgcgagcgtcgccgccctgatcctgattgccttggttccctctgacctgtcggcgctggtcttcgcgggcttcttcctcggggtcgcgctggccggaacgcaggccgtgctctacgccttggcgccgagctgttatccgaccgatgtcctcggcacgggagtcggggctgccgtctcgatgggacgtttcggctccgtcctcgggccgatgctggccggaacgctcgtcggcgccggccggagcgacgtcgaggtgctcgtcgcgctcattccgatcctgatggtctcgggcggcgcggccacgatcctgagcctccgtatccggtcagcgtaa

SEQ ID NO: 7941 - DNA, 762 bp, Methylobacterium sp.
gtgatcttttcccgcgaagccttcgagggacgtgacttcctcatcactggagcctcatcgggaatcggtcagcatacggcggtgcggctcgcggaggccggagcgcgggtggctctgattggccgcagcaccgaacggctggctgcaaccgctgccctgctcgcgggcgacggccattccagccattccgccgatctgagcgatgccgaggtgactgcggacctcgttcaagggatcgccaagcagcacggtcgtttcttcggcattttccattctgcgggcacggcgttgatccttccggcgcgggccaccaagaaccgccatctcgacgatgtcttcgcggcgggcgtccgcggcgctttcggcgtcgcgcgggcggcggcgaagaaggacgtcgtggtggatggcgggtctctggtgttcatgtcgtcggtgtcgtcgatgcgcgggcgccccggcatgagtgcctattcggctgccaaagccgcggtggacggcatggtgcgcgcgctggcttcggaaatggccgaccgtcgcatccgggtgaattccatcgttgccggcgggatccagacggcgatgcaccgtgatttcaccgaatcggtcggcagcgaaatggtgcggaactacgaggcgctgcacatgctcggctttggccggcccgacgatatcgcccatgctgcgatgtttctactcagcgatgcttcgcgctggatcaccggcagcaacatggtcgtcgatggggggtataccgctaagtga

SEQ ID NO: 7942 - DNA, 792 bp, Methylobacterium sp.
gtggccccgagcggccggcaaatcctgccgggaggccggcagatcccgccgggtcgacgcgaggcggccttcaccgccaaaacgtttcttgttctttatcagcaacttgcccgtcatcggcagatggtgcgcggcttgctctggtctcctccggcttcggcgacgaaggagagggacggcatcgtggtttcgcgcgcagatctggcggaggcgtttttcaggcagaccctgcggcccgcctcgtccgcggcgcggggggccgagggcacggcgcggttcagcctggaagccacggagcagcggccggcggcaccggcccggcccgcatcccgccgcgacgacaccgcctccgcccgcagcgatgccatcagggcggataggatggacgcggcgagaacagagaacgccaagatcggggctgccagaacgggggcggccaaaggcgacagggcgaaaagtgacaaggccgagagcgggccgtccggggctttgcaggaaagccgcgcccaggctgcctcggcccgcagcaagccgctcgcggccaggacgggacgcgacggcgcggaggccgcctccgcccgaaatccggccgccgcgaagaccgcgaattccaccgcgcagcggccggaacgcccggccgccgacggcgcggaaccggcgcaggaagccgcagcggaagaggccgccgccaaagaagccggtgccgcggaggtgtccgaggaccagacaggagagcgggacgagaccgatcccgcatcgccggaggccgccgctccggccgctgcgcggtgg

SEQ ID NO: 7943 - DNA, 1227 bp, Methylobacterium sp.
atgccagagtttcgcttcatcgccgcgaccgggaccaacgagcgccgggagggactgctcgaggccggcggcgtgagtgaggcggccgccgagttgagccggcgcgggcttctcgtcatccgcatcaccccgcaggcgcggcacaggtcgctctgggcgctcctcaaccgggaagtggccctcacggccccgatctctgcccgcgagcgggtatccctgaccctcgaatgggcgaacctgctcgaagccggggtcccgctcgacgaaatgctgatgctgtccgcgaccggagtgcgccgcaagggcgtccggacggtcgtgaccgcgatccgcgaggcggtcaaaggtggcgcttcgctgcacgaggccctcaaggcgcattccagctgcttctcgccgatctacgtggccctggtccaggccggcgaggcagccggtgccctgggaccggccctgtcccgtttggctcgtgatctcgaggcgggacaggatttctcggccaggatccgcggcgccctgctgtaccccgccttcctggtcgttacggccacgggggccatcgtcgtcctcctcaccgtcgtcgtaccgagcctcgaagccatggtgacggaacgcggatcggaggccctgccgttcgcgacccgggccgtgatcgccacgagccacggattgcgcgactacggaatgcctgcagccttcgtggccgtcatggccatcctcggtgccgtcgccctgtttcggctaccatccgcgcggcggcgcttcgaccgcttcgtgctcgagttgcccggtcttggttcactcgcccggaccgccgatgccagccgctacctgcggaccctctccgcgctcgtggccgggggcgtcgcgctgccccgcgctctgcctctggccgttcccgccctgcggaaccgggcgctggccgcggccttcgagacggcacacgcgaaggttctggtcggagccgcccttggggacgcgctgaacgagagccggacgctgccctccgacgcgctcgtgctggcccggctcggcgaacgcaccgggcgactcgccgaggccctgggacatgctgccatcctgttggagaagaggcttcggctgcgtcttgaagcaatcgccaccctgatcggtccattgctgaccctgagcttcggcctcctcgcagggttgatcgtctacgccatgctctccaccattctcggcatcaacgagctcgtgcgctga

SEQ ID NO: 7944 - DNA, 3495 bp, Methylobacterium sp.
gtggcctctgttctggcctccaatgccaagcatgccttcgtcgtcgatggcggcgagacgggccgacttgtccgctcgcgggattggtccgcgaccccgctcgggccgattgaggggtggccgccgaccctgaagaccgcggtcaacatcatgctcacgtcgccgggcccggtctcgatcctctgggggcctgagcgcgtccagatctacaacgacgcgtacattccgatcgcggcggagcggcacccggacgcgcttggccagccggtggcccagaattggagcgacgcttacgaggcgttcctcgctcccatcctcgatcgtgtgttcgatggccagacggtccggatcgacgagtatgcggtgccgctgcggacgctgtcagggcgtgtcgagcagcggttcttcaccggcagctttcagcccctgcatgatgagaccgggacggtcgaaggtgtctttcatccgctctccgaggtgaccggcaacaaggcggccgccgacgatcaacgccgcgccgaacaggcgctgcgcgagagcgaaattcgctaccgacagatcgtcgaaggtgccgaagactacgcgatcgtgcgcctcgacgatcgcgggatcatcaccacgtggaacacgggcgcggagcgtctcacgggctttacggagcgcgatgcgatcgggcagcccggagatatcctgttcacccccgaagatcgggccctgggccggactgaggccgagttgaaccgggcgaggagcgacgggcgagcgctgaacgaacgctggcacatgcgcaaggacggcagccggttctgggcctcggggctcatgatgcgtctcgacgcggacggcggcagctatctcaacatgttccgcgaccgaaccgccgagcacgaggcggaggcggcgctggccgccgaagtcgcggcgctcgggcggctgcaggaggtgagcacccggctggtcggcgacgaggctccgcaggcgctctacgacgcgatcctgaccgccgccgccgacctgatggggtccgaatgcgcaagcatccagatgctggatgcagccggtgacctcaagctcctggcgcatcgcggctacgacccgcgctcggcggcgtattggcagacggtcgatgcgcggtccgagagcacgtgcggccttgcgatgacgacgggcgagcgcgtgatcgtgcccgacgtggaggatagcggcctcgcccaccgcagcggcgaccttcagtcctaccgctggacggggatgcgcgcgatccagacaacgccgctgttgtcacgttcgggcaagcccatcggcatgatttcgacgcactggaaacagccgtacacgcctccggagcgcgacctcaagctcttcgacgtgctcgcccgccaggctgccgacgcgatcgagcggacgtcggctcaggcaaacttgcgcgaaagcgaggcgaggcaggcgttcctgctctcgctctcggacgcgatgcgctcgctcaagacgccggcggacatcgcctcgctggcggccgagcgtctcgccgagcgtttcaacctgagccgggtgttctacgccgagttcttcggcagcctgatgcgggtcgagcgcgactatacgagaggtgtcggctcgctcgtcggtgagcacgacctggcggcgttcggaccggacctgctgcgcgcctatcacgatagcccgatcgtcaaggtcgacgacgtccgcacggacctgcggttcagcgaggacgcgcgatcggggctccttgcccggcaagtcggggcctacctcgatgtggtgctgttcgagcacgagcggtgggtgagcgtgcttgccttgcagagcgccaaaccccggaattggacatcctccgaagagggtttgttccgggaggtcggcgagcgcgtcaaagccgccatcgaacgcgcgcgcgccgaggatcggcttcgcgagctgaacgacacgcttgagcggcgggtcgccgaggcgcttgccgagcgtaacatgctcgcaaagctcgtcgagatgaccgacgtcatgatcatggcgatcgatctcgactacaacatcctcgccatcaatgccgcgaatgccgacgagttcgagcgcatctacggtgtgcgcccgaaggcaggcgacaacatcttggcgctgctcgccgaccagccggagcaccaggagcaggtgcggattggctgggcccagggcatgcgcggcgagccggtcaccttcgttgaggattacggcgacccgacccgtgtccgtccctattacgaggtgaacttccggcccctacgcaacgaaagcggcgagctgatcggcttctaccaatttgtgaccgacgtcacggaccgcttgcgccgggaggcgcaactcgccgaggcgcatgacgccctgcgccagtcgcagaagatggaggcgatgggtcagctgaccggcggcgtcgcgcacgacttcaacaatctgctgacgccgatcatcggctcgctcgacatgctgcaacgaaagcagctcggaaatgagcgcgagcagcgcctcatcgccggtgcgatgcaatcggccgagcgggcgaagacgctggtccagcggctgctcgcgtttgcacgtcgtcagccgctgcagccggtgccggtcgatgtggcgaagctggtcaccggcatgggcgaactggtcgcgagcaccaccggtccgcagatcaagattgtggtggaggccccggacggcctgccgccggccaaggccgacccgaaccagctcgagatggcgcttttgaatctcgctgtgaatgcgcgggatgccatgatggagggcggcggcacgctgcgcatctcgacccgggtggaagacgtaagagcgggtcatcgtaccaagctacggcccggcccgtacctttgcttgtcggtcgctgacacgggcaccggcatggatgaggcgacgatcgcgcgcgccgtcgagccgttcttctcgaccaaaggcgtcggcaaggggacgggtctcggactttcgatggtgcatgggcttgcgtcccagctcggcggcgcgctcgtgattcagagccgacccgggctcggcaccaatatcgagctgtggctgccgcaaagcacggcggggcaagaagccgtcaggcctgcggctgggacgtccgagctgccggcgacgcgcggaacggcgctgctcgtcgacgacgaggaagtcgtgcggatcagcacggcggatatgctgactgatctgggctacgcggtggtggaagccacctccgcagaggaggctctccatcttgtcaacacgggcgagcacttcgaccttctcgtgaccgatcacctgatgccgggcatgagcggaaccgacctggcccgcgcgatacggacggccaaacctggcatgcccgtcctgctggtgtccggctacgccgagcgcgagggcgtggacccagacctggcgcggctgaacaagccgttccgaaaggacgaactcgcctcgagcctcgcccagctcatgaccgaacattga

SEQ ID NO: 7945 - DNA, 258 bp, Methylobacterium sp.
atgcgccggccgttcgcggcagcgcctcaagagctcaacgacacggaggaacacatgcgcgccatcaagctgatcccggttctcggcctgctcgccctcggcctcgcagcctgcaaggacgagaagaaggacaccacgggcacgaccacgcctccggccaacaccacgaccaccgcccccgcgacgccgcccgccgccggccagaccacggcgccgaccaccccgccggcgaccaacaagcccgctggccagccgtag

SEQ ID NO: 7946 - DNA, 177 bp, Methylobacterium sp.
atgaagacggcaaccctcgcgttcgacgacggcgcaacgacaatcgatcttcatgcagccgatgaacaagcgcacagaatcaggaacgacgacatctgggccaacttcgacatcgacaccatcgggtgtctcgtcccaaatgaggcatccgatatcattgcggatacccgaagatga

SEQ ID NO: 7947 - DNA, 111 bp, Methylobacterium sp.
atgaaaatcctgcttcttgcttcgagcgcgctcgttgccgccaccgtcgccgcctcggccgccgacctcccgcgccgcgcggctccgccgccggtgttccagccggtgccg

SEQ ID NO: 7948 - DNA, 360 bp, Methylobacterium sp.
atgcttagatcgttcgaggagagagaacgcgccgaagagcttttatttgtgatcggcgaggaacgacgctttctgaaccgccgcgctggcgcccaagcattggctgatttcgcgatccggaaacttggctgtgatgctcggacgagccgcgcctacgctgacgtgctgatcgatgcaatgatccatggcgccagcaacgaggccttgctcgaacgggtgcgcgccgatctggcagccaacctcgcagacttcagcctcgaagaactgagagccgtgatgttgggcggcagcgatcctgctctcagatccaggccggtcgtgacaccgcgctcgccagttcgcagctcttcccgtttgtag

SEQ ID NO: 7949 - DNA, 231 bp, Methylobacterium sp.
gtgctcgaggcccgccatgacaccttcatgacgacgcccttgcctcacgacgcctccgccccttcccgtcggcgcctgcgaccggcgccgctgccggcgcccgcccccatcctcgtgtcccggccgcagcgctcccccatgacgatcctgcgcctggacagcggaccggacgggttgcccccgatgacggccggggaagaaatcgtcctggagacctgccttggcgtctga

SEQ ID NO: 7950 - DNA, 1719 bp, Methylobacterium sp.
atgaccgctctcggcacgctcaagggcatcacggcgcaactcgccacgaccggcaaccgcctggcgaccggccagaggattgcggccgcctcggacggtgcagcctactggtcgatcgcgacggcggtccggaccgacaacgcctcgctacgcgcggtgggcgacacgctcggcttgggcgccgcggcgttcgatgtggcctatgccggcctcgacagcgtgctctccgacctccggtcgctgcgcgcgacgctccagaccgccttggcgcccggcatcgaccgggccaaggtccagaccgaggtcgccgcgatccagaaccggatgcgcgcgaccgccgacacctccgtgtcggccggccggaactggctctcggtcgattccgcttccgccacctaccggccgagggaagacatcgtggcggggctctcccgcggctcctcgggcgcagcgactttcttgacctttccggtcgaggtcgaggcgctgaagctctacgatgccagccccacggtcatccgcaccgcaccgatgccggcctcgctgtctggcgacatccccttggcgataacgagcgccttcggtggcagaggacgcgccgacttcacgaccgccatcgaagccagcttccgcctatcgacgggaagcggctcggacgtcatcaggctgaatgcggtgaacctcgcctcccaggtcggtgacctgtccgcagtcacgccagccgagctgacggacgctatcaatgccgagattgcccggtcgccgacgctcactggtaacgttaccgcgtccctgacggcggatgggcgcctgagcttctccacgatggcgacaggagcctccgcgtcgctcaccctgcatcacctcgtgccgtccctgggctacacaacagccgacctcgccatcgcctcggtcgatagaaggcagttgttcagcccggccgcgttcgcgccggacctctatcgaaacgtcgatctgtcgggctcgaacacgaagtccatcacgctcggcgacggcaccgcgtcggtcacctacaccttcggcgcgaacagccaacctccgccggccgacctgacctccgtcacgttcgacgagatgtcggccatgtttctgcacgaacggcgccgggtgaacgccgacttctggatgaacatcggcggtggggcgggtgggcacgtcttcgtcgcgaccggcagggcggaggggccatcggccgtcgtcacggtgagcggccccgacgttgcgaccttcggcttcacaacagggcagtccgccgtgggaagcgagtatgtccagtacgggatgccgaagagcgcgtccggccgcgatggcacacagatggcatcgacccgcgggctgctcgacacccccggcgcctccggctacgccgttgccacgctcgacgtgtcccgcttgaggggcgcttcaggcgacgccacggtccaagcgatgatccgggacgtcgaggcggtcatcgcccgcgcgaccgacaccggtgcgcagctcggcgccggcaagctcttcgtcgagggacagcggatgttcctcgacgcgctcgtcaagaccaacgagcgtactatcggcacgctggtcgacgcggacatcgaggcggaggcgagccggctgaaggcgctacagactcaacgggatctcgccgcacaggcgctcaacatcgccaacgccgcgccgcaagccatcctgaccttattccggtcgtga

SEQ ID NO: 7951 - DNA, 1749 bp, Methylobacterium sp.
gtgacgagcctttcgacgaacactgtcgccctgacggcgctcgggacgctcaagggcatcacggcgcaactcgccacgaccggcaatcgcctggccaccggccagaggatctcggccgcctcggacggcgcggcctactggtcgatcgcgacggcgatccggaccgacaacgcctcgctgcgcgcggtggtcgacacgctcggcttgggtgccgcggcattcgacgcggcctatgccggcctcgacggcgttctctccgatctccggtcgctacgcgcgacgctccagaccgccctgacaaccggcgtcgaccgggccaagatccagactgaagtcgccgcgatccaggcccggatgcgggccactgccgacacctccgcgtccgccggacggaactggctctcggtcgactccgcgtccgccacctaccggccgcgagaaaacatcgtcgcggggttctcccgggatccctcgggcgcggcgaccttttcgacctttgcggtcgaggtcgaggcgctgaagctctacgacgccagtcctaccctcatccgcaccgcgccaaccccagcctcgctgtcgagcgtcatccccatggcgatgacgagcgccttcggcggcaacggacgagccgacttcacgaccgccatggaggtcggcttgagcctatcgacgggaaacggctcggtcgtcatcaggctgaacgcggcgaacctcgcctcccgggtcgctgacatttccgcggtcacgccggtcgagctgacggaggccatcaacgccgagattgcccggtcgccgacgctgtcggggcacgcgaccgcatccctggcggcagacggacgcctgagcttcgcaaccatggcgacgggggcctccgcgtcactcaccatcgatcacctcgtaccgtccccgggttacacggccgccgacctcgccatcgtctcggtcgttggaaggcagtcgttcagtcccctggccttcgcgccggatccctatcgaaacctcgacctgtcgggctcgaacacgaaatccatcacgctcggcgacggcaccgcgtcggtgacctacaccttcgacgcgagcagccgaccgccaccggcggacccaacctccgtcacgttcgacgagatgtcggccatgttccttcatgagcggcgccgggtgaacgccgacttctggatgaacatcggaagtggggcgggtgggcacatcttcgtcgccaccggcagggcaacgggtccgatggcggtcgtcacggtgagcggccccgacgttgcggccttcggcttcaccttggggcaatccgcggtgggtagcgagtatgtgcagtacgggatgccgagggtcgcttccggccgcgacggcactcaggtggcatcgacgcgcgggctgctcgacacgcccggtgcctctggccacgcggtcgccacgctcgacgtgtccggcttgagtggtgcttcgggcgatgctgtgctccaagcggtgatccgcgacgtcgagacggtcatcgcgcgcgcgaccgacaccggtgcgcggctcggcgccggcaggatcctcgtcgagggacaaaggatgttcctcgacgcgctggtcaagacgaacgagcgtactatcggcaccctggtcgacgctgacatcgaggtgggggccagccggctgaaggcgttgcaggtccaacaggagctcgccgtgcaagcgctcaacatcgccaacgccgccccgcaagccatcctgatcttgttccggccgtga

SEQ ID NO: 7952 - DNA, 597 bp, Methylobacterium sp.
atgctggcccgactcctctccgtcttccgtcggcctgccgtcgccggcgcgcccgtcgtccggaccccggcgccgatggcggccgcggccgcctcgccgaaggttcgcaaccgcatcgcggcggccatcctagccggcacgatggcgaccggcgtcggcggccttgccgtcacgaagatcggtggacacgaaggctactccgagaaggcgatcatcccgatccgcggggacgtcccgacgatctgcttcggtgagacccgcggcatccggatgggcatgacgcgcactcgcgcccagtgcaacgccatgttcctggaggccctaagcacgttcgccgacgggatcgagagctgcgtcaagcggcccatgagcgacgagacgtacgtcgcattcctgagcctggcctacaacatcggcgtcgggtccaagtccaggccgggcttctgccagtcgaccgccgtgcgcctctacaacgccggcgacaagcgcggcgcctgcgaggcgatcacccggttcaaccgggccggcggccgcgtcgtgaagggcctcgtcaaccgccgcgccgacgagcgcgccctctgcctgaatggcatctga

SEQ ID NO: 7953 - DNA, 108 bp, Methylobacterium sp.
atgtccggcttgctcacatccggtctcgccaccggcccgggtgggatcgttggggcgatcctcggcctcgtcagcgggggcggctcgatcctcgcggtcctcgcctga

SEQ ID NO: 7954 - DNA, 141 bp, Methylobacterium sp.
atgtatgatctgcagggaaagggccgtaaatctgagcagcaactgcacgccggcagtttggacgccatcgcgcttgcccaccaccttgtgagcaccgtgatcgttagggatcaccgtatcgccgggcttcaacacaggtga

SEQ ID NO: 7955 - DNA, 318 bp, Methylobacterium sp.
ttggtccaggcctacacccggctgatcctgctgcccgcgcgggcggacggctccaagatggccgtgatcgcccggttcggcacccgggacatctgcttgatcgagacactggcagccgacgcgccgcctgagagtgtggcgctccgggtcgaactctacgatcgggcacgcggtcacgccgtcgagagcatggcctgcaacgatctggaggaggcagaggccgcgacgaccgaactcatgaaggatgcacgagaggcggtctttggatgtttaccgccaagctcgggccagccctgcgcggacgcagcagggcgctag

SEQ ID NO: 7956 - DNA, 861 bp, Methylobacterium sp.
atggtcggcgcgcacgagccggaagggagcctgaccatggcgagccccactcctgcgagcggcctgcgcgagggcctgagctacgcgccgccgcaccgcccgtcggaccggctcgcgggcgagacggccgtgatcaccggcgccggcagcggcgtcggggcggagacggcccgcatcctccacgccgagggtgcccacgtcgtcctgaacggcctcaccgccggccgcctcgaagcgctcgccgccgaactcggcccccgcaccaccgtcctgcccggggacgtcaccgacctcgcctacctggagcgcctcgccgaggaggcgcaggccgtcggcgggggccgcgtcggcgtcctcgtcaacaatgccggcgccacgatccgcggctccctggcggagaccacccccgacaacttcatgtcgacggtggaactcaacctgaacggggcggtgcagctcacccgcctcctggcgccggccatgtgcgaggcgcggcagggatcgatcgtcaacatggcgtcgatcacctcgctgaaggggttgggcggtgccgtcgcctacaccgcctccaaggcgggcatgacgggggtcacgcgggcgctggccgtggagctggccccgttcaacgtccgcgtcaacgcggtctgtcccggcgtgatcgatacgccgatgacctgggagcacgccgaggcgcagcccgatccggccgcccactacgcgatgctccgggcccgccagccgatgaaccggctcgcctccgcccgcgactgcgccctggcggtgctgttcctggcgagcccggactcggccttcatcaccggagccgcgctcccggtggatggcgggcgccacgctgcctga

SEQ ID NO: 7957 - DNA, 189 bp, Methylobacterium sp.
atgcgcgtatcgctcggcttcaagctggcaatggccgtcgggctcctcggcctcgtcggagcgggcatctcggccttcgcgctgcggcaggcatcgcaggaacaggcccgcgccgccctcaccgaatcgttctggaatgccgggcttcaggcccgaggtctggcccaatccatcgaacacgccgtctga

SEQ ID NO: 7958 - DNA, 882 bp, Methylobacterium sp.
atgcagtccgacgagaagctcaagtatagcgccccggccgccgcctgcgccgccgacctcctgctcgccctcgcgcgggcggacggcccgatgacgctggcggcgctgatcgagcggacgacctattcgcgctcgctgctctaccgcaccctcaagaccctcggcacccgcggcttcgtcgtcgaggaggccgcgcccgggatttcggggagcctgcactaccgtctcggctcggccgcggcggagatcggcggcgcctaccagagcaacgtcccgttcgaggagagcgtccgctccgccctgcgcgccctggcgcagcggaccggtgagaccgcgagcgtggcgacgatcgagggcgaggacgtgctctacgtgatgcgcgaggaggggcgctactccgtgctcgcggtctcgcgggtcggtaagcggctgcccgcccacgccaccgccatgggcaaggccctgctcgcccggttcgacgacggggagatccgcgccctctacgggcggggcgaactccggcgcttcaccgggaacacgatcaccgattccggcgccctcctgcgcaacctcgccgaggtccgcctgcgcggctacgcggtcgagcattccgaactggtccagggccgctgctgcattgccttcacgctccaggccggccccggtccgggcgacctcctggggatcagcctctccaccacggaggcgcggttcgaggtcgagcatgacgcgctgatcctggaggttctctccacgcgcgacgcgctgctggcggacctgagccggcgccgggtgccgggagaccggaaggtcgcgcgcgacctcaccgcctccctcggtgcgatctcgcgccggtcggtgccggcggcggccggcacctga

SEQ ID NO: 7959 - DNA, 432 bp, Methylobacterium sp.
atgatccgcgtcacgcgcctgcatcacacggcgatcgccgcccacgacctcgacgcgatgcgacgcttctataccgaggtgatcggcctcgacgcgcatccgacaaagaccaactggctgcgggccgggaacggcttcgtcgtgcacctgatgccgtcgcccgacgcgcccgcctcgggccggatcgagcagcacttcgcgctggaggtcgagagcctgcgcgagaccgcggcggcgctgctgcgccagggcgtgacgccgtacatggcaagcctcgaatacgagacccacgccgtgaccgatgccggcgacccgctcgatttcgggatcggcacgctcttcgtggccgatccggagggcaacacgatcgagttcgtcgagccggatacgggcatcttcgccgaagtcccgctcgaagcgcaggatacgtag

SEQ ID NO: 7960 - DNA, 1134 bp, Methylobacterium sp.
atgacaccggagcatctgtgcgaacgggacgttgaggccgtcgtcgcgacgacgcccgagagcgtgtttctgctctcgggccatctcacgtggctgggcgagcggatgcgcggctggatgggcggccccgcgggcgacgccgccttccaggccggatacgccgtcctcacccgggacggtcgcgtcgggctggcggcgcgtgcggtcacccggatggcggccgaggcggcggcgccggacagcctcgtgctgtacggccgggcctgcccggccgccgacgccgacgccgcgctgtccctgttgctggccgagatgggcctcgccggccgcaccatcggtgtggaatgggacggggccggccgcggcctcgcccgaagcctggagccggtggcgacccgggacgcctcgctctggctgcgcagcctgcgcgcggtgaagaccgaagcggcgctccggacgatgcgggaggccgcgaccgccaccgaggcggcgatggaagccgtcttcgccgcctggaccgccgacgccgatccgcgggcgctgcggaccgtgttccgcgtcgccctggcggagcgggactgcgacttcgaccacctggtcttcggagcgcccggcggcggcgtgtgcgacgccgcgaggccgccggaacccgtcacggccctcttcttcgatgccggtgcccgctgtggccgctactactcggataccggcacgacgctgacgcgggccggcttcacggccgccgaccgcgagcgtcacgccggcgcgctcgccgcgctggcggcggccgagcgcgccctgcggccgggccggcccgcttcctcggcctgggcggcgatgcaggacgaggcgcggcggatcccgggcctcgtcgcgcaggggcacggcctcggcctcggcatccgcgaatggccgctgctcgggccgccgagcgacgccgtgctgagcgacggcctcggcacctacccggtcgatgccgtgctcgcccccggcatggtggtgaacctcgaagccggcgggcacttcgccgacggcacctccgtgcaggtcgagaagagcttcgtcgtcggcgccgacgccgccgtcccgctggccgcgcagccgcgcgacgccccgatccgcctcccggcctga

SEQ ID NO: 7961 - DNA, 1875 bp, Methylobacterium sp.
atgacccgacagaagaccatccggctgacgaccgcccaggcgatcctgcgctacttcgcggcccagcacacccggtgcgacggacgcgaacggccgctcatcggcggcgtgttcggcatcttcggccacggcaacgccagcggcttcggccacgccctcgcgaccggcgcgggcgggctgacctaccatcagggcaagagcgagcaggcgatggtccatgcggcgatcggctatgcccgcgcccacaacctcgcctcgaccctggcggtgacggcctcgatcgggccggccgccaccaacctcgtcaccggcgccggcaccgccacgctcaaccgcgtgcccgtgctgctcctgccgggcgacgtcttcgccagccgccgtcagggcccgatcctgcaggggctggagatggcgggcagctacgacatgaccgtcaacgacaccctgcgcccggtcagccgcttcttcgaccggatcacgcggcccgagcagatcatccattccctgccgcacgccaccgccgcgctgctcgaccacggccaggccggcgccgtgaccgtggcggtctgccaggatgtcgagggcgaggcgttcgacttccccctggcgttgttcgagcggcgcgtccacgacctcgagcggctcgcgccctccgagaccgccctggcggccgccgccgaacgggtgcgggccgcgcgcaagcccctcatcatcgcgggcggcggcgtccgctattccgaggcggaggcgagcctcgccgccctgtccgacgcctgcggcatcccggtggtcgagagcttcgccggccgcggcgccggccgggaggcgcgcctcaacgcgggcggcgtcggcttcatcggatcgccggccgccaacgaactcgcgaccgaggccgacctcgtgctcgccgtcggcacccgcctgtcggacacgctcaccggctcgcacacgctgttccagaaccccgatgtgaacttcgtgacgctgaacctcgccgagcgcgacctgcgcaagatgggcgcactggcgctgcgggccgatgcaagggccgggctcgacgggctcgcggcggccctggagggccataccgccccggccgaatggcgcgaccgcgccgaccgggcgatcctgcgccatgtcgcgcgggtcggcgagatcgtcgggaccgagaatccccgcatgaccggctacgaggcggtcgccgagatcaaggacgccgcccgccgcgaagaccgcgtggtgttctcctcctcgacggcgatcgggcaggcccacaccatctgggacagccgcagcgatgccccggtcgacatggaatacggcttcagctgcatgggctacgagatcccggccgccctcggcgcggcgatggccggcacggtgaagggccgcatcctcgcgctcatcggcgacggcaccttcctgatgggcaacaccaccgagatcgtcacggcgatccaggagggcctcgccttcacgatcgtggtggtggtcaaccggggctggcagtgcatccgcggccaccagctcggctcctacggcgaggagttcggcacgcagttccgccgccgcgagggggacgcccgcaacctgaccggcgagacgctcgcgatcgactacgtcgccaacgcccgctcgctgggcgccgacggcctcgacgtgcacagccgcgccgagttgcgggacgccctggagcaggcacgccgctccgaccggcccttcctgatcgcggcgcatgtcgaggacgcaccgctgccgatcgagaacggcgcgtggtgggagttcggcattccgcaggcggatgcgcccgagggcctgcgcgagacccgcgccgccttcgaggcggccgccgcgaagcaccggtggttcgtctga

SEQ ID NO: 7962 - DNA, 1416 bp, Methylobacterium sp.
atgaacgccgtcgcacggtgctggtgggaggatgaactcgctgcgtgcaccttcaacgatgcccgcctgcgacagcggctgcaccgcctcgtcgcgcagatggaccgcagcctcggcgccagcttgccgttcgcctgccaggactgggccaacaccaaggcggcgtaccggttcttcgccaaccggcgtgtcagcgaggcccagatcctgtcgggacacttcgcagcgacgggtgagcgcgtccgggccagcgatggccccgtgctggtcttgcaggacacgaccgagttcaccttccagcgcgagagccgtgagacggtcgggatcacccgccgcgtcaacagcggtcgggacaaagcgggccagttccgcatgcacacgctctgcggcctgctcatgcacgcctcgctcgccgtgaccgccgacggtctgccactcgggctggcagcggtgaagttccggtcgcgcgacaagttcaagggcacgaacgcgctcaaacgcaagatcaacccgacccgcgtaccgatcgaacagaaggagagcttccgctggctggagaacctgcggcaatcgacgtcgctgttcggcgcgccgagccgctgcgtccacgtcggcgaccgcgagagcgacatctacgagctgttctgcttggcccacggcctcggcacgcacttcatagtgcgcagctgcgtcgaccggctggccggcgacggtcggcacacgatcaccgacgcgatgagcgaggtcgccgtccagggcctgcatcgcgtcgaggtccgcgaccgggcggggcggctcggcacggccgcggtcgaactgcgctaccgccgcatcacagtgccgccgccgatcggcaagcagcaatgctatcccgcgctgtcgctcaccgtcctccacgcccgcgagccggggacgccgaaggaccgccccgcgatcgactggcggctgatcaccgacctgcccgtcgacgatcccgaccaagccgtcgagaaactgcgctggtatgcccggcggtggaagatcgaggtgttccaccacatcctgaagaccggctgccgcgccgaagatgcacggctgcgcacggccgagcgcctcgtcaagctgatcgcggtgttctgcatcctggcgtggcgggtgttctggacgaccatggtgggccgcgcggcgccgggtgcggacccgcgcttggccgtcaccgctgccgagatcgcgctgctcgatcgcctcgtccccgatcgggcggccggcgggcgaactctctcggcctacgtggtgaaggtcgcgcgcctcggcggctacctcgcccgctcacgggacccgccgcccggcaatctcgtcatgtggcgcggcttcgcccggctcgccgacatcatgctcggtgccacgttcgcccgagcatcaccaggatgtgggtaa

SEQ ID NO: 7963 - DNA, 723 bp, Methylobacterium sp.
ttgagccggccgcaagcgagcgaaaacgacgagatcgtgcggtgcacggttcagatcgtgaaggggtacgtcgccggcaacaggttaccgccggaggcgcttgccgcactcatcacgacggtgtccagggcgctccggtccgcgcccgacgacgagatcgagccggtcgtgccgcaagatgtcttgccgcaagatgctttcgttgggtcggaccgcccccgcatgcaggccgcagcgcgcgccctcacgcgcaaggagattgcggactcgatccacgagacgttcctggtctgcttcgaggacaacaagccctatcgcatgctcagcaggcatctgcgtctcttcggcctgacgccggatgcctaccgcgcgaagtggggcctgccggacgactacccgatgatgccggcattcgacatgaagcatcgcgccgaactcgctcggcagaggaagctcgggaagtacgatcgcagcacggccaagccgcgaaaggcctacgtcctcaaagccaaagccaaggcgacggtgcagcacgacgggaccccggccaagccgaaggcgtccagctcggatcgcatccgaggcgagcggccccggccggagcgtcctctctcgctccacgaccgcagcgcagccaaacccgacacgaagaaccccgagcccttcggctcgggggaatggcaccggcgcgcggcgccggcgcaggtcgcgagcgccgtctga

SEQ ID NO: 7964 - DNA, 477 bp, Methylobacterium sp.
atgggcgagatcgtgatgaccaccgtgaccattggcggccccctacggggccgggatgccgtcgcagcgctggtcgaggcggcagaggcgtacttcgccgaggccgaaagcctcgtgcgcgacgccatcgccgacgacacgagcgtgaccttcgagggcgaacagaatttcgggctgaccccgggcctcgacgcgttctgtcgggagtacgggctgtcctaccaccgagcctggatcgcacggcccggcgtgttcgaggcgggcgtgaagcactggaagccgggcatggcgagcccggtggtggaggcggccgacgagggcggcgacccggtcatcaccctggcggcgctgagaaactgcaatgacgccggcgagaccctacccgacatcctggcgcggctcgagaaggctgaggctgccgccgtgccgccgctgaccctggtcgaggacgccgacgcctggcaggccgctgcctga

SEQ ID NO: 7965 - DNA, 453 bp, Methylobacterium sp.
atgttcagtccctttgtgtggtggtacgcctgggcgtgcatcgagagatgcgctataggacaggttctccacggcagcgccacaacgactgaggcgatccgtcgggcaatccaagctcgtcaagagagcgtgagagcggcgtccaacgcgacggcgtcagcccggccacacttcagaagtggcgtggtcgggagacatcggcggacgcgcgcatggggccgaatagaagcgcggttcaccgtcctgagcccggaggaggaagccatcgtcgttgccttccggcggcatattcttctgccgtcggacgattgccttgatgcgctccaacccagcgtcgagctcgccttcgtcgatcagggctacaccggccagaagccggccacaggcgcgcgagtggagggggaatcaataccagagattttccccctccaccgccgcgcgcagaggtcttga

SEQ ID NO: 7966 - DNA, 1194 bp, Methylobacterium sp.
gtgagcgttccgcttcattccgcccccgaaatcggaggagtcaggccctccttcgatcgctcctggctccgcgacgccgtcgattccatcgccgctgaggccgcacgcagcgccgacacccatctcctccgtgtgccgctcggcggttcggcgggcatcgatctctacgtgaaggacgagtcgacgcatccgaccggcagcctgaagcatcggctggcccgttccctgttcctctacggcctgtgcaacggccggatcgggccgcgcaccacgatcgtggaggcgtcgagcggttcgacggcggtgtccgaggcttacttcgcccagatgctggatctgcccttcgtggcggtgatgccggcttcgaccgcgccggccaaggtcgccgagatcgcccggtacggcgggagttgccacttcgtcgagcatccgggcgctgtctatgccgaggcgatccggatcgccgaggagaccggcgggctctacatggaccagttcacccacgccgagcgggcaacggactggcggggcaacaacaacatcgctcagtcgatcttcgagcagatggcgcgagagcgtcacccggtcccggactggatcgtggtgggggccggtaccggtggcacatcggcgacgatcgggcgctacctccgctaccgcggccacgccacccgcctgtgcctggccgacccggacgcctcggtgttccaccgacacctcgccgacccgtcggtcaccgcccggtccggcaccgcctcggtcgtcgagggcatcgggcgggcgcggctggaaccctcgttcctgccctcgctgatcgatcgctgggtcgcggtgccggatgccgcgagtctgggcgcggcgcgggcgctgacggaggtgatcggacgctcctgcggtgcctccaccggaacgaacctgtgggcggcggccgagctgatctccgagatggccgcgcagggccggagcggctcggtggtgacgctgctgtgcgattccggcgagcggtatcgcgggacccatctcgacccggactggattcgggcgcggggcctcgacgtcgatggcccgcgggatgccatgatgcgcttcctgacgaccgggtgtgcgccgtgcgctgaagcggggccggcggcgtcggcgcatccgtatcgtgaaaccggatcaagctccgcgacccggtcgtcggagcaataa

SEQ ID NO: 7967 - DNA, 267 bp, Methylobacterium sp.
atggctgatcctaaccccaccgtcggcgaactgttcaaggccaaggtcgtcacccatgacgatttgaacgcgctggtcgacgctgtgctcggcggccggatggaggagcgggcggaactcggcgagggcgacacggtcgacgtggcggccgccgtcaaggcaaacgccttcgctaccgctgttctacgtgacaagacgagcacgaccggcgctaggcgcaccgccacgcgcacggcgatcctgctggcccggacccagaaggcgtga

SEQ ID NO: 7968 - DNA, 81 bp, Methylobacterium sp.
atgtttccgcttctacggatcaccatcacgaaaaacccgagcggtgagtggtccgtgaccatcacgctcgggctcatgtaa

SEQ ID NO: 7969 - DNA, 291 bp, Methylobacterium sp.
atgaaaaaccttctcattctcgcaagcgcggccggcctcatggctgcgagtctcgtccctctgactgcgacatcggccgatgcccgctcccgtcacaagagccgtgggatcgtcacgagcgacggcagcgtgaccggcggacgcggccggggccaaacgatctcccgcggcgccacgggagccagcaccatcagccgcaattccgcggcgggcggcaatgccaatcagcccgagcgtgcggtcccgcaggggagcggtggtggcggaagcggtggcgccggcgcgcagtga

SEQ ID NO: 7970 - DNA, 198 bp, Methylobacterium sp.
atgactgaagccgagcgagagcacgagtggaaccgggatcgattgctggtcgagattgcagaggctgtcgaaagaatgctggagctgacacggcacacgcatccttccgggtcaatgcttacgctcggcgcaactcaacagcaggataggctggaagcggctcgagaacggttcgtgggttcgatggagaagcagtag

SEQ ID NO: 7971 - DNA, 99 bp, Methylobacterium sp.
atgttctttttcttctccaaccggttgggttgtctcggctcgatcctgatctccgtgctgctcacggtcatcctgatcgggatcttccgggggggttga

SEQ ID NO: 7972 - DNA, 717 bp, Methylobacterium sp.
atgccggcgaccccatcccgctcgcagaacacatcccgccgcgccgccgcaccggtggcagcccagcgcgacctcgatgcgatctacggcatcctgagcaagacctacacgaccttcgatgaaaccgacgatccgtggatgaccaacggcctgtcctcgacgccgttcaagagcctcgtgtcggtgtgcctgtccacgatgacgatcacccagcgcgtcgtgaacgcggccgtgccgctctatgaaaaggtttcgaccttcgaggagctgcgcgacctgccggacgacgaattgcgtcgcatcatcaagccggtcgcgcattacaaccgcaagaccaagaacctgaaggaaatggcccgccagatcatcgaagactacggcgggaaaatacccggcaaccgggacgacctgatgaagctgcaaggggtcggccgcaaatgcgtcgatatcctgatgaacttcaccttctcggaagacagcatcgcggtcgatacgcatgtccttcgcgtcctgaaccgtcttggtgtcgtggacacgacttcggccaagcaagcggccgatctcatcaatgcgcaaacccccgcgcgctataagcgccatgcgcatgaatggctcatccagcatgggatgaagatctgtgtcgcccgaactccgaaatgcgcagactgcccgctgacgaagcattgcgactggtacgccgaccatcgcaccgcatag

SEQ ID NO: 7973 - DNA, 1047 bp, Methylobacterium sp.
atgaacgttcgtatcaaccgcctggacccgcatgtgccggatcccgtcgagagccgccggcgcgccgccgggcgggtcgtgcgcattgcctacgccgtgggcatcttcggcgtccttggtttctttgtcgtctatttcggcgcacccttcgtcttcctcagcggtcccggaatcgtctcctccccgcgtcacgtgctgtcgcttcccttcaccgtgcaggtcaaccgcatgaacgtgaggcccggctccaccgtgaaggccggcgatgaaatcggacaggtgtactcgcccgagcaggagaccatcgtcgcgacctacatgcgcgcgctgtcggatatcgccggccgcagcgccgaactgcgcgtcaaggcgcgcgtagccgcggaatcgctcgaagcggcgcgggcgtatcagcgcgaaaccgagacggctctggaacgcatcgctgcgatggccagcacgacgacgacatttcgcgtccaaattctccgtgagcgcgcgctcgcgaacaaggacgtcatctcgcagcaggccgaggccgaggaggccacgaaacagcttgtctctctcgatgcgttcagcaaacagatccacgagcagctggacgaggtgaagcaaaatttcagatccggtcgggtattcgctccagtcggcggcatcatctcgacaggactggcccagaccggccagtcactcgtcgccggcgcgccgatcgctgacatcctcaacccaaacgatttctatgttgactggtatatccccaacgagcgattaatcgatcctcggattggaaatgatgtatttgtgcttttcggacaccgccgcattcccggaaagatcacagagattctgcccgtttctgccgtattcggaagctcacagcagctcaccttgcgggatcgtccggcgactcaaattgctcgcatacgtttcacctctgatgcgtcaacgccagcccttaactctacagtatgcgttcatatgcattacagcaaaatttcaacagatatctcccgttcactgataaaaatttgtggcctagattga

SEQ ID NO: 7974 - DNA, 372 bp, Methylobacterium sp.
atgggtattcccagaccgcatttgcccttgttccacggctcgggcgacatccgggttgcaacgcaggtactcgtcttcgtcgaacttagcctcaggctcctcctgggacccacgatgacgcttccgttcccggtcatcagtgtcgtacccgcgaccgggctggcgatcctgatcttcatcgtatcggcgacgccgctcgttaccgtagccattatcgtagctgcggccgcgttcacgtggccgatcatcatcatcatcatcgtcatcgtcatcgtacccgcgaccacgaacgccgccgtcgcgctcgccatagctttgacgaccatactcccgctcgtcgtagccgtagtcacgcccccctcgctgggctga

SEQ ID NO: 7975 - DNA, 81 bp, Methylobacterium sp.
atgaccctgttcacgatcctgctcgcctgcaacctcgccctcgggctggtcttctcactgatcgccgcgtcggttgagtga

SEQ ID NO: 7976 - DNA, 885 bp, Methylobacterium sp.
atgccgagtgcgccgtggccgctgatcgagatctccgtcgcggcggtgtccgacgataaccggagcagcctgcgcagcgcattgctggaattggtggccgagactccgggcctcgatttctcgaccgattcgacaaccggccaattcatcttcaaagccgggaccgagcggtgtctcggcgccgcactcgagcgtctccgagccggtccgatcgccttcgagaccgggcggctgcaggtcgcttatcgcgagagactgacccggcgacgtgagatcgacttcctgcacaagcgtgtgatcaaaggcaacgaaagccagttcgcgcgcgtgaagctccggttcgaaccgagcgagcccggtgtcggcaacgtcttcaacgcgacgatcaccgaagggattctgccgatcgagtacgtcgatggtatcgagaggggcgtcgcttcggtgctgaccgccggtgtcgtggccggctgtcccgtgatcgacgtcaccgctgaactgatcgacggcgcttatcacgagatcgattcttcgcccctcgccttcgaaatcgcagcccgcgcagctttccgtgaggcgcttcacggcagcgccgtgctcgccgagccgatcatggcagtcgaaatcgccgtaccggagcgatccgccgcatgggtgatcagcgacttgcaaggtcgccgcggcctgatctgggacagaagcgtgcgcagcgacgcgaccctcatcaccgcgacggtgcctctcgctgagatgcttgggtttggttcgcgcttgcaatccgtgcccggcgacgaagcccgcttttcaatggcattcagccattatgcacccgtcccatcgttggatctcgatccgccgccgatggttgctgcgctaggcgcgtga

SEQ ID NO: 7977 - DNA, 354 bp, Methylobacterium sp.
gtgatctcgaagctcgcccttcttcccatggccgcgctcggcctgaccttgtccgcttgttccggcgagccctcggaagccgagatgcttcaggccgtctctcgctttacgtcgagcgtgtaccagcagcaggcggccgcgttggcgttcatggtggggccgtcgcgcggcggcgtgcctcaagtgcccaccatcacggccttccggaagctcggttgcgagccggctacaggcggcgcctccggacacgtctgccagttcgagatgaccatgaacaacggcaagggcgagacgcgggatcgcgctcgcttcttcaaagcggccgacagctccctggcgatgtccatcaactga

SEQ ID NO: 7978 - DNA, 957 bp, Methylobacterium sp.
atgccgcaaaacgccttcatctcctatgcccacgccgacgagaaacggctggagcggctgcacaagcatctggtcatgcttcggcgggacggcagcctgcaggcctggtccgatcatgccatcgtccccggcgataacgtccgccagaccatcagcacggcgctcgagcagagcagcctgttcattgcgctggtcagcccggactacctggcctcgaactactgctacgagaaagaattccagcgggcgctggcgctacaggccgaaggccgcctgcggatcgtggcggtaatcctggaaccgtgcgactggctcaactcgccattcagcgagatcctggtgctgcccaaggacggcaagccggtgtctgactggaccaacgagaacaccgcctacctcaatgcggtcgaggggatccgtcgggccctgacggcagccccctcccctttactggaagctgcggttgaggctgccggtggatctgcctccagccctgcgcgccgggtccgggtcaagcagcagttcgacgcgatccagaaggctgaatacgccgagcaggcgtttcggaccctgcagatctacttccagaacgcctgcaccgagctgcatgaggccagtgaccagatccgcgcacggttcgagtcgatgggtcccacggcgttcacctgcacggtggtcaaccgggcgctgatgcgcaacggcgaagcccatatcacggtccggcatgcccggggcggccgcatgcgcgtgggcgatatctcgtacgtgtaccagccgcatgccgatgacggttcgtcgaacggctggatgagcgtgcaggccgacgattacaacctgttcctcaacgcggtcatcggtcatcttggtatggatcgtgaggagaaggtgacccctgagcaggcggccgaacgcctctggaacagcttcgtgaccaaggccggtatcgagtacgagtag

SEQ ID NO: 7979 - DNA, 129 bp, Methylobacterium sp.
atgctgaatcggtgggagagcttcgagacgctcgacgccgtgatcggcctgcccgccatcggagcgcggctcgcgctcgccgacatttacgaggacgtggccttcgagccgggccggtcggtccgctga

SEQ ID NO: 7980 - DNA, 723 bp, Methylobacterium sp.
atggtcgtaagcatacatggtcactacttcgaagagcgctggttctccacgtggatgcaatttgcgcggcgcatgaacaacatctggttcgcgcccctttcccacgctttagccgacacgctgatcactcgcttcggggcacctcggtctcgaacggtggtggtaggcgtcgcggtcgataccacattctacacgcggaccgatcccttggacacgcgttttgttctgagcgcaggcgcagctggccgagactacagtacgctgatagctgccagccgcgggattgatgcgaaatttcggatcgcatccggaagtacatggattggagaagccgcgtcttcagatgcgctcccatctaacgtatcgatgggatcagccgggagcctagccaatctccgcaacctttatggtcaggcgtcgtgcgtcgtcctgccgttgaccgacacctaccacgcaacgggctacgccgtcatggtcgaagccatggcgatgggcaaacccgtgatcgccacgcgaacaggcgctccgagcgactttgtcatttccgagcagaccggcctcctcgtcgaacccgggaacgtcgcagcgatgaagtcggcgatcctgttcatgcttgataatccggacaaagcacgcgccatgggggaagcagctcgcctgcttgtggaaaccaaatacagcatgccgcgttttaccgatactattctcgcgatggccacttga

SEQ ID NO: 7981 - DNA, 1590 bp, Methylobacterium sp.
atgacgacggcggctgcgatcccggagcctgagcgccgccggggacccgcgccgcagcagccgcgcctggttctgcgcagttcgcggaccgacgcgacgcggaagacgatctacatccgcgacggaaagatcgagatctcgacccgcctgcccgagggcagcgagagcgaggcccagaccctgctcgacctgtacaggttgcagaagggggccaaggaacgcggcatcgtcgctccgaggatggtgccggtcgccgcggtgctcgcccatctcctcgaagcggcccgccccgggcggaacgccaccgacgcggaaaaggcgacctactcggctttgacgacccgcctcggaactcttgcccgctacttcggggccaaggttctcaaggacgtcacgaccgcggagtgcaagctctacatcgagtggcgcacgagcctaccggacgcgaggtatcgtgagggggcgcccgacgctcccttggcgaaggtggcctcggcacgggaggacctgttcgagctgcgcaaggcggtccgcctctacgccgacgagcacacactcacgtggcacccgaacgtccatatcccgaaggcaggccccggccggacccgttggctgcggcgttcggaggtcgcacgcatcctctgggcgatccgcggtcgggtctgggacccggcgacaggcacttggatggtcgagaccgtgaccggtcccgacggcgtgacggtcacccggcacgtcttgcgtccgcgccacatggtgctgaaccgcaggatgctccggcggttcgtggcggtcggcctctacaccgggacccgcaacaccgcgtcgcgagagctgtcgtggttggccagcgaggacggcggctgcctcgacctcgacgggtgcttcatccatcggcgcggtttcggacgcgatccgaaggaaggtaagccccgcgcgagttcgaggctggcgcggaagttcgccgcgatggcgattccgtggcgcgacgccgacctcgccgtcggcatcactcacgtcatccaccggccggacggttcgccctacgccaccagcccgagctgcatctgggatgccgtcatcgccgatgccgggcttggcgaggaggtggtgccgcacgtcctgcggcacacggcggcgacctggctgcgggtggggcggaccgacgtgcgtgcggcggccgacctgctcggcatgagcgtccaggccgcggtccggatctacgggcagtggaccctggaggggcaggacaccgccgcggacgaactcggctacggcaagggtctgaaggccgacgtcttcgtgggcggtaaggcccgcaggcccagacgggatccggcgcgtgaggcgaggccggtgccggtggtcgagccggtgccggtgccagttccagcgttcgtgccacgccgaccgccgatgccggcagcggcacagatcgaggaggcgccgcccattttcgcgtccgagctcttgaagaccgatcacatgaagcgggatcgccgtcggcgcgatcgcaggatcagtcgcgagaggtcggccaagcaactcgcatacctgcggcgtgacgcgctcaccctcatcagccgctga

SEQ ID NO: 7982 - DNA, 855 bp, Methylobacterium sp.
gtgacctatctctttcagatcctgaacggcgtcggacttgggttgctttatttcctgctagcagtaggattgagcatcatcttcgggctgctgcaattcgtgaacttcgctcacggggcattctacctgctcggcgcttatttggcctacgaaggggtcgagcggggtctgagtttctgggtggcgatgcctatggcggccgtgatcgtcgcggcgcttgccggaatgacggaacggctgctcctacgccgggtctacaagctgcctcacaccttccacatcctcgtcaccgtcgggctcgcgctcgtggtgcaggaactcgtcatcatcgtctgggggccgctcggcggtaacgtagcggcgcccgacgaactgagcggcgtcatgatcctcggcgacttcatctatcccgagtaccgactcttcgtgatcggcttcacggtgattctcgccgccgccctgtggtggctcctggatcggacgcgcctcggagccatcgtgcgggccggatcagaatcgccgcagaacatggcgctgctcggctacgatacgttgagcatcaacacggccgtcttcgccctcggtgcggggctcgccgggctcgccggtgcgctcgcggctccgatccggggcgtcgagcccttcatgggcgtcgaggcgctcgggatcgccttcgtggtggtggtgatcggcgggatgggcagctacgcaggggcgctcgccgccggcatcctagtgggcgtcgctcagagcttgatggcgacgctttggcccgagggcgcgcgcctcgtgatctatcttggcatggccggcatcatcatggcgatgccgcgcggcctgctcggccgggcctga

SEQ ID NO: 7983 - DNA, 1191 bp, Methylobacterium sp.
ttggttgtcggtgccggcgccgtttccggcgtcgcgcttcctggtttgctgcgaagtgcccgcgcggccgatgggcctctcgtcatcggggcaccgctgcccatctccggagctttcgccgccaacggcaaattcgcatcccttggcgctgcgtttgccgcccggaaggctgccgcggcgctcgggcgcaagatcgtggtcacggacatcgacaccgagggcaagccggcaccggcagctcgcaagctgcaggaggccatggcgcagggaacgcgtctgttcgccggcggcattctatcatcggaagccctggtgatgggcaaggaagcgacgaagtctgagggcgtcttcatcaccacggcgggggcggacgagatcaccggttcggactgcaaccgcggcaccttccgctggagcgtgccgaccttcggggctatcgcgcagaccgtgcggccgctgatcgagcagatgccgcaggccaagcgctggtacaccatcacaccgcaatacgtgttcggcgagggcctgctgagcgccgccaaggtggtgttccaggagaagggcatcgaacatgtcggcaacagctaccattcgctggccgagaaggaattcagcggctacctgaccaatgccatcgcagccaagcccgacgtgctgttgctcctcaattttggttcgcaatcttcggatgcgctccgtcaggccgtcagcttcggcctcaagaagcgcatgaccattgtgctggcctgggcttcaggcctggagcaattcgaggctctgggagcagacctgtgcgagggcgtatacttcggagcgcagtactggcacggcatcgattcgcccctcaacaaggagttggtgtcaaagctccgtgaaagcgcgaagatgacgccgaactactccttcgccggctcctaccagatcaccaagctgctcctcgacgcagtcgcgaaggccggctctgcggaaggtcctgctgtcatcaaagctctggagggcctcggctattctggactgacggggcatgaggagattcgtgccgccgatcaccaggtcatcaaggactactacctgctgaagggcaaggcgaagtccgcaatgaaggataaggacgactttgccaacgtcgtaaatgccggcaagtcgttcctttctcccgaagctgccggctgcaagatgcagcaagggtga

SEQ ID NO: 7984 - DNA, 282 bp, Methylobacterium sp.
atgaccgacgcccagtcctacacgatggcgctcgacctcgcggtccagaacccggtgcgggtgctcaacgaagccgcccgtgagcttgtccggcgccgcctcgccgctttcgatcacgaagccctggcgcttctggccggagacgtgccgaaggcgctcgcgatcctgatcgagctgcacgacctcacctcggccggggcggtggtcctgcacatcgactgcaagcccaatcccgatccgaccccatcgccgaggatcgacgcggacccgatcgccgtctaa

SEQ ID NO: 7985 - DNA, 906 bp, Methylobacterium sp.
atgacactcctcgcagacgcgtcgacgacgatgtcggggctggccatcggccggccccgcgcgctcgcacgccggttcggcaacgctgccgggagccgagcttacgacctcttcgtcccctccggatacgagggagcccccctcccgctggtggtgatgctgcatggcagctctcaatcatcgcgcgacttcgccatcggcacggggatggaccgggtggcggaggagcagagcttcctcgttgcctaccccgaccaaccgaggtcggccaatctcggcaagagctggaactggttcaggaatggggaccagaagcgcgacgagggcgagccgtccattctcgccggcctgacgcgtgagattatggctaagttcaatgtcgatcccgcgagggtctacgtcgctggcctatcctcaggtggggctgccgcggcggtcatggcgctggcctacccggacatctacgctgccgtgggcatacactctggattagcgagtggttcggcaggctcgatgtccgtggccttctccacgatgcgccgaggcgccttgctccgtccgcgtcaagcaacgcatccgctaccgactatcgtcttccacggagaccgcgacacgaccgtctcaccggtcaacggcgatcaggccatcgcccaggcgcagcccgatggggaactgaacatcaccaccgtcgaggggcgttccgatggcggaatggcgtatacgcgaacgatcctaatcgaaccggatggcaagtggtcgtcggaacagtgggtcctgcatggcggcggtcatgcttgggccggcggccacccgtccggctcgcacaccgatccgaccggtcccgacgcaagccgtgagatgctccggttcttcatgacacacgcgaagggcgacggagcgtactga

SEQ ID NO: 7986 - DNA, 489 bp, Methylobacterium sp.
gtgtccgcggccgatctaagcgacgtcgaggccgtcttcgacgaccttcgcggttattccgtgcgggtcgacgacgaaccccgacgtcggggagccgccgaggagtttgcgacggccgttccaccgggatgcgggctccaggacaagcatgccttcgtggccaagcgggacggtctgccggtgggcctgttggacatcatcgacggctatccgggccagggcgtggctttcatcgggctgctcgccgtgaacgagagcctgcacggtgccggaattggccggcggctctacgcggaagcggaacgatacgtgcgagaccgtctcggagcgtacaccattcggctcgcggtcgtcgaagccaatccggtcctcggcttctggcaacggatggggttctcaccgacgggcgagtcgaagccctacggagggggcgtcgtcgcgtcgcgcgccatctttctggagaaggcactcggatcggagtccgactga

SEQ ID NO: 7987 - DNA, 183 bp, Methylobacterium sp.
atgggcaagggccgcaaggttctgtcgaatgaccacgcgcgtgccctgatcaagcaggccgttgccatagtcttcggtgacgcacgggcggaggcggaagccgcggccgagatcgcgaccatcgaggcggtgcacgtccagacagcgccgaaaccgagacgctttcgccgcccgcccatctag

SEQ ID NO: 7988 - DNA, 459 bp, Methylobacterium sp.
gtgcccgcggacgcgcggtggccagagggcggcagcgacgacaccagacattctccgcgcgctcgcgatcgccgctcgcacgtcagcgtcagcgccttcagcttcagcacgcttttccagatcaagcagctgctgaaaaagatgttcctgctcgctgaggggaaaatcgggttgctcttgcgccaacaacgcaacaagttcgcgcatgaagcggcagccttcttcctgggcttgctcggccatgaccaattctccgacgacgcgtttcgccgattttcctggtacgatggcccatgcctttgcgctccaatccatgttgcttcccggatggatggcagacaggcgatcttggtcccggcgggtcggcgccgcctcctcccatggctcgtgcctacgaaaatgccccgcgcggctgagccggcggggcaagtcttcggagggaccgccacagtccactga

SEQ ID NO: 7989 - DNA, 993 bp, Methylobacterium sp.
ttgtgcaaagccgtcgccgatccgggaaagcatcgtggggcggcatcggctgttctctcggcggcctcagccggcctcaagggaccgcccgtgaccgccttcttctacgcgctgaccgtcctgatctggggcacgacctggatcgccatcaagaaccagctcggggccgtgcccgtcgaggtctcgatcgcgtaccgtttcgcgctggccggatcggtgctgttcctggctttggtcgcgatgcggcgcttccaacccatcgcccttcgccatcagcccttcgtcgcgcttcaggccgtctgcctcttctcgtgcaacttcctgtgtttctacaacgcgacgatctacgtcccgagcggcatcgtctcggtggtgttctcggcggccacgatcttcaacatggcgaacgccttcctgatccatcgccgcaagccggagggccgggttctgggcggtgcgatgttcggcattgcggggatcgcctgcttgttttgggaaacggtgacgagcacgcaattcggcgccgacacggccttcggcttaggtttggcgctgctcggcacctggttcttttccgccggcaacctcgtctcggcccgcaaccagcgccatggcctgcaggtcgcgtcggtgaacgcctgggcgatgctgtacggggccgggatcgtgtcgctcgtcgccctggcgcagggcatccctttcgccttcgaaacctcacccgtctatgtcggatctctcctctatctcgccatccccggctcagtgattggcttcaccacctacctcaccgtcgttcaccgcctcggaccggagcgggcggcctcgatgaccgtgctctttccggtcgtcgccctgacgatctcggtctttgccgaaagctaccgggtcacgccgttggtcggcttgggcctcctgttcgtgctcctcggcaacgggcttgttctcggacgatggcaccgcccggctgctcgacgtcccatggcgaaagcctga

SEQ ID NO: 7990 - DNA, 207 bp, Methylobacterium sp.
ttggcagcggtgccgatctattccatggccaaggcggccatcaacagcctgacccacaccctcgccgcgttccgcccgaacatcggcctcagccgcccatgcaggccggaagacgtcgccgccgtcgtggtcctcgcatccgaccgggcgggcttcgtcaccgggacgaacctacgcgttgagggcgggtcggtgtcgacgctctga

SEQ ID NO: 7991 - DNA, 858 bp, Methylobacterium sp.
gtgcgatgccgggccctgtccgtcacggctgcctgggggcttgccttggcggccgcactggcgtttccgagcgcaactgcggcacaggacgagccgatcaccctggcggatgatcccttcgaggtcaccgacccgcacgccacgccgcccggagaggcggcctactccatcgtcggatcctatgaacgagccgcgacaggccgcgtgcgaagcacctggggcgccgagaccgaactgagctacggcgtgtcacccaatctcgacctccgcatcggccaaacaggcgcttacggtaacctggacgtgcgccgtcgcctcggaacggtgtcgaccgaagtgggtggacccggctcggagcaggagcgtgcagctctcggcggaacgacccggctgggtgcgctctaccagttgacggaggagagcggctcctggccgattgtcggcttgctcggccgcgtgcgctccctctacggaccgggtggcacggcgtacgaaaccgaagcgacagccctcttcggcaagacactcattgcgggcgagcgtccgctcggcgtgagcctgaacataggtaccgtctaccgcttcgatccagcccctggggagcgcatgacccgctatctcgtcaacgcctcagccggacaggttcttacccgcgacacggctctggtcatcacctacgcacgcgagcagcaggagaaggggcagccagattacagcttggcgcaggcgggtgtgcgacaccgcctgagagaccagcgtgcgatcctcggtgcagcggtgggcttcggactcaaccggaacacaccgcagttccaagtcgcgctcgccgttcaatgggagcttggcgcctcgaagtaa

SEQ ID NO: 7992 - DNA, 102 bp, Methylobacterium sp.
atgaccaagcagatttcggccgccgaccggatcgtcgtgacgaagggcgaccgcatgacgccggcgaggtccttaccagccttcgctgtggcgacgcactga

SEQ ID NO: 7993 - DNA, 384 bp, Methylobacterium sp.
atgaaggtgacggtttccatcgacgtcccgtcgatcgaagagggtctgaagttcttcggtgatgtcttcgggttcgtcgaaacggcgcggcctcaccccggctacgcgacgttggcatcgggcgatgcgacgatcgggcttctcgcgaagccggccggatcatcacccgcgccgggaagcaacgacctccgccggtatgagcgccattggacaccggttcacgtcgatttccgtgtcgatgacttcgaaggaacgctcgggcgcgctttggcgaatggcgcaagatcagaacaggtgcaccgcgtgccgggctttccccccgttgcgttctgcagcgatcctttcggacatgggttctgcattgttggcatgaacacgctttag

SEQ ID NO: 7994 - DNA, 354 bp, Methylobacterium sp.
atgcaacgccgcccgaccgatcgcactgcgctgccgcgctttcctgcgatcctcggcctcctcctcctcgcggcgctgtggctcacggcggcgtggtccgccctgccgcagccggccgcggcgcaatggggcgacagctacgacgcacccgcggccgatccctacgccgcgccgccaccgcgccgccgggcccgcggcgcctatgccgacgagtacggctacggccgggcccccgcccgccgggccgcgccgccgcaggaggcgccgcgccagttctactggccgtgggaggaccagccgcgcgcccagccgaccccgccgccccagcccgcgcccggctatgcccggccgtag

SEQ ID NO: 7995 - DNA, 249 bp, Methylobacterium sp.
atggcttacgcgtttgacacactcggatattccaaggccctgcgcacggctggtatccctgtcgaacaggcagaggcccatgccgaggcggcccgggagttcatcatgcacgaactcgtcaccaaggaagatctgcgcacggcgatggagcttcagacgctccagatgacggtgcgtctcggcggcctgattgcggctggcttcgtggcgatgttcggagcgctcgcagctttgatcaagctgacctga

SEQ ID NO: 7996 - DNA, 249 bp, Methylobacterium sp.
atggcttacgcgtttgacacactcggatattccaagaccctgcgcacggctggtatccctgccgaacaggcagaggcccatgccgaggcggcccgggagttcatcatgcacgaactcgtcacgaaggaagatctgcgcacggcaatggagcttcagacgctccagatgacggtgcgtctcggcggcatcgtcgcggccggtttcgtggccgggtttgcagcgcttgcagccctcatcaagctgacctaa

SEQ ID NO: 7997 - DNA, 1083 bp, Methylobacterium sp.
atggagcgcgacaacctcggccttcgagttgctgccatgaccctggccgttgttgctgcccgtcggctcgatctgcggatcgtttccagacgccgcctcggtcggccgctgcgaaccttgatcgttggtattttccaggccgctggcgcgaccaccctgttgatccgcgggaggatcgccggtcacggcctcggcccgtgcgcttcccggaccagagacgctggcatggccttcattcgggccggtccgcacgatcggcgggttctgtgccaccgcaggctcagcctgcgagccccgctcttgagcagcggcaccggcgttgccgctaccacggctactcgcctcgaccggtgggctattcgcaccttcagcctgagccggcgcggcgtcttcccgagcgacaacactggaatggtcctggccgcggccgggctgcgcgggcagcggatcacctcccgtcgcatgctcggcctgcgcgccccggtcctgagcagcggcgctcgtgttgccgttgtcacggccggtctgctcgaccggtgggctgttcctcgtctcggcttgagccggcacggcgtcttgcccagcggcaacgctggattggtcctggccgcggccgggctgcgcgggcagcggatcacttcccatcgcatgctcggcctgcgcgccccggtcctgagcagcggcaccggcgttgccgctaccacggctactcgactcgaccggtgggctattcgcagcttcggcctgagccggcgcggcgtcttgcccagcgaccacgctggattggtcctggccgcggccggccggcgcgctcggcggattacttcccgtcgcaggctcagcctgcggactccgctcctgagcagcggcaccggtgttgtcacggcgggtctgctcgactggtgggctattcgcagcttcggcctgagccggtgcagcgtcttgccgagcgacaacgctggattggtcctggccgcggccggtctgcacgcttggcggattacctcccgtcgcaggctcagcctgcgggccccgctcctgagcaacggcgccggtgttgccacggctactcgcctcgactga

SEQ ID NO: 7998 - DNA, 372 bp, Methylobacterium sp.
gtgatcgaggcgctggccgacgccatgtgcctgcatggcatcccagagcacatccgctgcggcaatggccctgagatgatctcgaaggcactgcgcaagtgggtcgccaaagctggctcacaaatccagtacatcgccccgggctcgccgtgggagaacgggtactgtgagagctttaacggcaagctgcgcgacgagtgcctgcgccaagagatcttctactcgctcaaggaagcccaggccgtaatcgccctatggcagaacacctacaaccgcgtccggccgcattcgtcgttgggctaccggccgctcgcgcctgtcagcttccccgatctggccttccggctacccatggcagcggccatgcagtag

SEQ ID NO: 7999 - DNA, 1227 bp, Methylobacterium sp.
atgatgcgtaccaaccacttacagaatttcgagacccgtcttccgcgtgccctgctgggcctaccgcgggctgagggcgatccgcggcgcgtgctcagcgagatccagggtgcattctccgctttccaggctcggcaccgtaccgagatggacggtgtccagagcgcggtcgacgatctgaacggccgcctcgctgcggttgccacgggcggccttgccatcggtggcggcgagccggtcgacgcgccctattccgcggcctttggcgagtggttccggaccgggcacggcgaggccgatcttcgggccgcgcatgcctctggcactcgggcgcggatcatggccgcgatgtcgtcgggctccgaccagaatggcggatacttggcgccggtcgagtgggatcggcaggtcaaccaagcgctccggccggtctcgccgatgcgccagatcgcgaacgtgcagagcacgactgtcggcgccttcagcacgatttggtcgaacggcgagtggggttctggctgggtcggagagactgcaccgcggcccaacacgaccaacccgcagctttctcagatcgtgttccggtccggcgagatcttcgccaacccgtctatcacgcagacgctgatcgatgatgctggtttcaacgtcgagcgctggcttgccgatgaggtggctgatgtgttcgcgttgcaagagggtgccgcgttcatctcgggcgacggcgtgaacaagccggcggggctccttggttatgctccgggcggcgggttcacccatcccggcggggcaattcctgtcgtcaactccgggctggctgccaacctgacggccgatggccttcatgatctggtctatgcgctcccggcgccgtatcgcgccaacgcgacctggatcatgaattccacgaccctggcgcgtgtccggaagttcaaggacaccggcggccagtatctctggcagccgagcctcgacaaaggtcagccgtcgacgattctgggatatgccgtggtcgcggacgagaacatgcccgatgtggccgagaattctcttccgatcgcattcggagatttccggcgcggctatgtcatcaatgatcgcgcgggcatccgtgtcttgcgcgatccctacacctcgaaacccttcgtgtcgttttacacgaccaagcgtgttggcggcggtgtgctggatcctcgggccctgcgcttccagcgcgtcgcggcctga

SEQ ID NO: 8000 - DNA, 1242 bp, Methylobacterium sp.
atgcccacgccctattccgaacctcggccctggcgcctgaagacccacgagatgctgcccggcgagaggatcgtcacggtcgtcgaccgggtcggcatgccggtctggtgggcgaacctgttccacgcctacgaggtgcgggacgcaggcagagcgtacgcgacccagaagcggacgatgtcggccatcgtcatcgccttcaactgggcggcggagaagggcatcgacatagaggagcgcatcgcgaccttcgagttcttctcctacgccgagaccaagaaccttcaggcccgactcaggtacgacgcctccggcgaggcgaccggccaccgccgcccggtcggcaacggctactgggacgcccgctgccgcgccgtacgcgactacgtccgatggcgcgctggcgaagccatgcagcggctcgcgaggccggacgcgtccgacgcgtcggcgcacctctacgcgatggcgggcgatgggctcgatcgcttctgcgagaccctgctctcgggcatcggacgggacatcgagcaggacgtgatggggctcgacgaggaacagcgcgccgcgctgctgcaggcgatcacgcccgggagcgagaccaacccgttcgaggagcgccaccagtacaggaacttcgcgctgatcctgaccctctacgagatcggagcgcgcaacggcgagatcctcggcctcaagggacgggacctccacgccctcggcccagcgcctgcggtggagatccatcgccgccacaacgatccggacgacacgcgcagccgcccgcccgcgtccaagacgaaggcgcggcgcctcccgatttccggaccgctcgcgcacgtcctctcgacttggatgaccggacaccggaacaagccagggctctatcccggcgcgaagcggaacccctacgtgttcgtgtcggaacttggcagacccatcgcggccaacacggtcgagtccatcttcatcgccctgcgacaggtcgaagggatccccgactggctgacggcgcacaagctgcgccacaccttcaacgaccgcctctccgagatgatggacggtctaccggaggacctgctgcgcccggcggtcgagacgcggatgcgcaacttcctcaacggttggagcccgacctccgatcagggcgagcactacaggaagcgcttcgtccagacgaaggcgcacgagttcctgctcaagctccagaacctcagcgcccagggagcagcccggtcatga

SEQ ID NO: 8001 - DNA, 288 bp, Methylobacterium sp.
atgcgcttagccgacctgccggcgctcgtgacccagcgtgaggaggcagtgaccctgcttcaagccatcgccgagggcgtcgacgagcgtgagctggcccccttcgtgtccgctctgaccaccgccgaggacgagcaggcggtcgcgatcatgcgcgggtcgggcaacgaggtcagcctgcgggtgcatctcggtgccatgctgaccgatgccggcctcgtcacccaggacgaggtgttcgcggcgctcgacgcccgccgggccctcggtcggggagagacggcatga

SEQ ID NO: 8002 - DNA, 444 bp, Methylobacterium sp.
gtgggttactcttccaccatcaagaccaaggttcgcatcggcacgaccaagccggccgctgcgctcgcggactacacgtccgacaccttcacgcccatcgccggcctcacggacatcggcgagttcggcgacgagttcgaggagatcaagttcaacaccatcgaggacggccgcacgcataagctcaagggctcggcggacgccggcaactgggacgtggaagtcgcccgcaacccgaacgacgccggccagatcgcgcttcgtgccgcggccaagtcttcggatggcgtctacaactttcacgtcgagctcgctgacggcacggacttctatttccgcggcaacgtcatggccggcaagaacagcttcggcagcaacgacgtgaacaagcagaagttcaccgtcggcatcacttccgaaatcctcgaagtcgccgcggcctaa

SEQ ID NO: 8003 - DNA, 267 bp, Methylobacterium sp.
gtgaggcggcccgaccgcaccttcgccgactggatcgccgaagggctgaccacgatggccctgcattgctcctgtgggcactatgcaacggtgacgctggccgatctgccgccgaggctgacgcgcacctgcctcgggcagaacgcatgttgcgccaaatgcggcaagcgaggcgcccaggtgatgcgggacatgaaggcgcacaacgcctttctcgaggcgaccggctggagctgcgagccgaagccgtggccagccagatcatga

SEQ ID NO: 8004 - DNA, 750 bp, Methylobacterium sp.
atgcgccgcatcaaactctccgaccagattgccgaggacctgtgtaggcgcatcgcccgcgaccgtttgctgccgggtgatcgcctgccgaacgaacgtgccctgatgcagcattatagctgcgctaaggggacgatccgagaagcactgaaggctctcgaggtccagggccttgtggcgatgcagtccggtccgaatggcggcgccgaaatccgcccgatctccactgatgccgccgcacaacaattgcgtcgcttcttccacttccaggaacttgattttgcccatgtctacgccttacgccgcagtttggaggtagcgctgagcatcagcgtgatcgggcgcttgaagcctcatgacttccaacgtctggaggcaaatattgcagagtgcgaggcagctaacacgagcggtcagcgcaggatcggccgtattattgaggtcgattttcacgacatgttatgtgatgcaagtgataatcacttgttagtgtttatgtgtcggttcctaaacagcctgctacgcgacttggttgagtttcgcagtgaaagcctagttgaacacgaagcctttggaagtcacaacgttgccagccatcgggcacttgtcactgccttacgcgcggaggatgcagatgcggtcagcgttgaaatgcacaaacacatgtgctgtgctgagcacttcatgcagcgtctcgacgcaaagtttcgagaggatctcctaagctcgtctagtccagatcgagcataa

SEQ ID NO: 8005 - DNA, 3873 bp, Methylobacterium sp.
atgcggccgatcaagacaatccagaccggggtagcgcgcagcttgcgcggtgggtggctgctcgccccgctcgcgctgatgctgctgtcggcccccgcatccgcggagatcgacttcggcacccgcaccggttcgggcgcgatccgggtctcccattcggggatgtgcctggccgtccccggcgcgaacccggccgagaccgtccagatcgagcagcagccctgtagcggcgcccccgaacagacctggcgggcccagccttccggcaacgggttcaacctcgtcaatcaggcgactggcctctgcctggattcgcaggcacggcgggacaacggcagcgcggtctggcagatccgctgccagacggcgacgcagcagacgtggtcggcccaaccgcagagcgacggcacgcgcctcgtggccgccttttccggcaaatgcctcgacgtcttcgccgtctcccgcgatccgggcgcgaagctgatccagtgggattgctggggcggcgccaaccaagccttctccgccgtcgcatcgccggccggtccggctccggtggccggcaccacggtgacgctgacgccgaccgagatcaacggctggtacgccaaggagatcttcctgttcgtccgcgacggcagcggggcgatcacccgccagacgacggtcgcctcgtacaattccggcttcaccaccgccggcctcaacacgccttcgccgccggtctcggtgccggccggctcgagctggggcgtgggcatgcgagtctgggccaacgccgacaagtcgcgccgcggcacgccgatcctgtactacagcgacacgccgggccagcgggcgcttcagagcacgggcgattgcgccaccggcggccggcggcaggatgcgtggggcgacgcgggcaatgcaggccgcaacgtcctgtacacgctggcctgcacggcggcgaccggacccgacacgagcggcaccgggaccggtggcggaacgggcggcggcacggataccggcggtgagacgggggcgggcggaggcaccgcgggtggaaacggcaccggcgggacgggcggcgggaccggaacgggcggtggcaccgggccgggcggcaccacgcctccggctgccgcggccacgaaggtttcgatcacgctgacggccgccaatggctggtacgccaaggagctgttcctgttcgcccgcgacgccaggggcgcgatcgtctcgcagacgaacctcgtgagctacaatttcggggtcgcgacggcggggctgaacacgccctcgcagccgctcacccttccggccgaggcgacgagttggagcttcggcctgcgtgtctggggcaacggcgacaagtcacgcagcggcacaccagttctctattacggcgacacgccgggccagcgcgcgctccagaccgcgggcgattgccggatggggagccggcgcgaccaatggggcgacgccggcagccccggccagaacatcgtctacgccgtcacctgcacgacgggcacgaccggcaccgagccgactggcccgaccgccggcacgagcctgtcggtcacactgacgccgacgctgatcgacggctggtacgccaaggatctgtttctgttcacccgcaacgcggacggctcggtcggcaccgagatgccggtcctgtcctacaactggaacacgatgccggccggaatgaacgttccctcgcagcccctcggcgtgccggcgggcgcgcgctgggccgtcggcatgcgggtctgggccaacccggacaagtcacgcggcggcacgccgctcgtctactacagcgacaccgtcggtgagcgggcgctccagacatcgggcgattgcgccgccggcggtcgccaggatgcctggggcgattccggggctccgggccgcaacgtggtctacaccctgcgctgcaccagcagcggcacgggcggcggagccgacaccggaggcggcaccggcggcggcaatgccggcggcgagggcgccggcacggccggccccacgcccggcgagagcgcgccgagcggcaccttggtgctgatcaaccggcgctccggcaactgcatcgattccgcgggcggcgtcacccagcagatctgccgcgacctgccgagccagaactggaccttcgtgccggccgcgggcggctaccagatccgcagcggcaccaccggccaatgcctcgccgtcgagaacggcagcatgggcaacggcgcccggctggtgcagcagggctgctcgggcgcggccaacgccctgttccgcctgcgcaagctggagaagtggacggaggttgtcgccaaccactcgaaccgctgcatcagcccgacgggtgccaacgacaaccgcaattccggcagcgccatcgtgcagtgggactgcgacggcgccgacccgcagcgctggacgatcctcgggccggaggggcgtgcgccgtccgcctggaccgcgccgcgcgagatcggcatcgtcccggtctccggggcggtgctgcccaacggcaagctcctgttctgggcggccgagcagcgcagcgccttccagaccggcgccaccgacggaacctggacgacgctctacgatccggccaccgaccgggcggtcgacacctacatccgcaacaccggccacaacatgttctgccccggcacgaacgtgctgccggacggccgcatcctgatcaccggcggcatcgcggcgggcgcctcgacgatctacgatcccgaggcgaacacgtggacgcgcgcggcgaacatgaacatcacccgcggctacaacgccaacgccacgctctcgaacggcgattccttcaccctcggcggctcgtggtccggcgggcagggcggcaaggatggagaggtctggtcgcaggcgtcgaaccgctggcgcgtcctgcgtaacgtcaagggcaatgcgaccgccgacccgagcgtctcgatcctctacggcgacaaccactattggctgtttgccggcgccaacggctcggtgttccaggccggcccgacgagcgagatgtactggatcgacaccaacggcgacggcaacgtccgctccgtaggccggcgcggcagcgaccgcttcgcggtcaacggcaccgccaacatgtacgatgtcggcaagatctataaggccggcggggcgcccgcctataccggtgtgccctcgctcgacaccgcctacacgatcgacatcagcgccggccccaacggtcccgtcaccgtgaccgaggcggcgccgctgctgttcccccgcacttacatgaacagcgtcgtcctgcccgatggcgatgtggtgacggcaggcggccagatcgtggcggcgcagttcaccgacaatctgccggtgatgacgccggagatctggtcgccgaagaccggcaaggtccggcggatggcgccgatggcggtgccgcgcaactatcacagcatcggcatgctgctgctcgacgggcgcgtgctgttcggcggcggcgggctgtgcggcggatgcggcggtgcggaccatctcaacttcgagatcctgaccccgccctacctgctcgacgcccagggccgggcggggaaccggccgggcatcaccgcggcgccggcctccgcccccgtaggcggcacgctcagcgtcaccaccgaccgggccgtggcgaccttctcgctggtgcggctcagcagcgtcacccactccaccaacaccgaccagcgccgggtgccgctggccgtggccggcagcagcggcacaacctatcgcctgacgctgcccaacgatcccggcatcctgcttccgggcacctggatgctgttcgcgatggacgaggccggcgtgccgagcgtcgcgaaggtggtgcggatccgctag

SEQ ID NO: 8006 - DNA, 270 bp, Methylobacterium sp.
atgacgaaaaccacgggcctcgccggggcggctctcctcgtcgttcccctgctggcgccgctcgcggtgtccgcccaggtcgccgcgccccagggcgggactgcgacgcgccaggatcagcccgccccggcgctgccgaagggcgcttgccgcgtgacggaccggctcggcggtcgctcctgcaccggcgacgtgcccgagagcgcctgcgccgcgatcgccaaggaggcgaagggcgaatacgcctggacgcaggacgagtgcccctga

SEQ ID NO: 8007 - DNA, 645 bp, Methylobacterium sp.
atgacgcccccgccgcgccaccgatccgttcgccgcctccgtccgagccgggcacgcaccgcatccctgctcgcgctcctcctcctgccgctcgcggcgccgggcctgcgggccgaaccatcggcccggcccggtcccgccgccgcgggcgccggccttctcgccgggcatttccggctggtcgatcccgccggccgcacggtcgattcggacatgctggcgggcaagccctatggcgtgttcttcggcttcacgcattgtcccgacatctgcccgacgacgctagcgcagttgagcacggccctgcgcgggatcgccgatccggatctgcggatctacttcgtcaccctcgacccggagcgcgacacccccgccgcgctcgcttcctacatgcagagcttcgacccgcgcatcgttgccctcgggagcgagcgcgcagccatcgacgaggcggtggcgatcttcggcgtcgtcgccgagcgcaccgctctgcctgagggccgctacacctacgcgcacaccgccgccgtgcttgtggtggacgagaacggcctgatcgccgaccgggtctcggcggacatcgagcccacggccctggccgcgcgcctcgccccgctcgcgcggctccccgaggccgcacggtga

SEQ ID NO: 8008 - DNA, 444 bp, Methylobacterium sp.
atgggcacgttcgagacggcgcggcccaccgacctggatccgctgatcgcggcgatgggaccggagatctggggatggcagtatgcccggcgcctgaccgggcaatccgcatggcgagctcgcccggacgtcgacgagcgtcgcgagcgcatgatcgcggccgaccagatgacggccgacatcgaactctgggaacgggcgatcgccacgcacgaccgccttgccgagcgtgcccgccgctacggcgatcggccgcccgatcccttggccgtcccgtccctggtccgggacattctcgccgaacgccaaacggcggctctgcagcgggccgagcgcaggcggcggcgcggcgagggagagggcggcggcccggagccggtgcccgacgaggcggtccggcatcccgtccctccgaaccaatccaaccccaaccccgcagcttga

SEQ ID NO: 8009 - DNA, 720 bp, Methylobacterium sp.
atgcgctgggagaccctcaatgcctacgtcgatggggaacttgatgcgcaggaccggcgcgcggtagcggagacgctggcccgcgatccggtcctggccgcgcgggtcgcgaccctgactcggctgaagcagggggtgaaacgggaggtgaaggctgcggccgtgccgccccggcgcgcaccgatcgcccgcgcctccctcggatgggcgtgtgccgcggccctggtcgtcctcgtcggcaccggctggctggccctgtcgtctcgcgcgccgaccgaccccgcgcgcgcggccttcacggcctggagttcggcgggctcgccctcgaacgacgtgcggctcgcgggcggcctgaatggcttccccctcgatcttggggcggccggcttccgcttggtctatgtgtccgagggtaacagttcggtcggtcgcctcgccggttacgaggggcgtcacggctgccggctggccgtctggagcggaccgtcgcgtgcgcaggccggccttgagatcccgcaagggagcggcggcggcctgcgtgtggcacgctgggacagcgggcgccgccgctacgtcctcctgtccgagacggtgccggtcgagcggttcgcgctgctggccgaggcggccgtgctgctcaccgaaccgaacgagacggaccgattgcggctcgccctggaccgggccaccggcctctcggaacgcccctgcaccggctga

SEQ ID NO: 8010 - DNA, 489 bp, Methylobacterium sp.
atgcggtccatcggtcagcacctcgtcgaagcgtggccgcgcctgttccgctacgcgctgacgctgacgcgggagcccgacgccgcgcgcgacctgatgcagcagagcgccctcaaggcgctctcgacggggacgacgccgagcgagccgcgggcggcccgcgcctacctgttccggatcgtgcgccacgcctggatcgatcggctccgccggaaccggacccgccgcgaggacgatctcgtggattggcccgacgaagggttcgacgaccgcctgattgaggccatcgccgtgcgccaggctttcgccaccctcgatgcaccctgccgaaaggtcgtgacctgcgtggatgtcgaaggcctgagctaccgggagaccgccgaacggctcggcattcccgtcggcacggtcatgagccgtctgcacagggcgaggcggatcatgctgcaccggatcgccgggccgtccgatgggagcgaggggccgtga

SEQ ID NO: 8011 - DNA, 138 bp, Methylobacterium sp.
atgccgcgcgtgcgggccgcttttgacgccgcgttcattgccgtcgccgtgcaaaagaccgccgcgcggcgcccgcttttgagaatttcgcttccgcggttcggcgagcggagcgaaaaccccgaccatccggactga

SEQ ID NO: 8012 - DNA, 1728 bp, Methylobacterium sp.
ttggatttccgatttctgacctacgatcccatattcgaacgcaccgatatcaattttgcggagacgctcggcgccttctggaagctggcgcgcagcggcctcggcggcttgtttcgtcagccgcgtggcccggtcagcaatatttcggaccgactccgctggaccgccggctacgtcgttgcctgggtggaggatgaacagttccagcaagagacccgcgcgctcgtgctcgatacgctgcgcgactacaagcccgacatcgtccttgctcatagcctcggctctctcgtcacttacaatgccttctcacacgcggatgcggcggaaagcgaggcggccaaggcgctcgcgggcacacactacgtgacgttcggatcgcagatcggaaatccttttgtcctgggaaatctgacatacggccgcgttcaacgtcttgccgtcaggcattggcaccatctctacaacgaacacgacgatgttttcaccgcacccctaaaagttcaaggtgtcgacaatttcaatcagcttctgacgccgttcgatctccccggtttcggagatcatgatgcggccggctacctcacgcatgccgtgacccaaacctccttctggacgccgatggtcgacctcgcggcccgtcaatccagggcggtgggtcgcaaagcggtggcgggcgtcgatcgttggaatcgctcgcttccgaccgcggccccatccacgcggcgcaaagcactcctgatcggaatcgacgattatcccgatcccgccaatcggctgtcgggttgcgtcaacgatgttttcgcgatgagcgcgaccttgcaggattgcgggttcgagccggagcagattcgcgtatgcctgaacgagcgcgccactgcggacggcatcatctctcggctcgaatggctggtcgatggtgcgcaacccggtgaccagttggtgttcttctactccgggcacggcgcgcgcgtgccggaatacggccaacagcaggagccggaccgtctcactgagacgctcgtgccgtatgacttcgactggacgccagagcacggcgtgtccgatgagcagatcaacagcttctacgcgcaacttccctatgagacccacctcctgatgattttcgactgctgccattccggcagcatgcatcgcgatggcgccggtcgcgcacgtgggatcacgcccccggacgacattcggcaccgccagctccgatggaaccgcgaagcggagatgtgggtcgagcgtgacttcaccccgctcaacaaggccttttcgagccaagcggcgaaacggcaggctttcttcggctccaacctcgccacggtccgcctgggacgcgccgccttgctccgcgtcaacgaccagaagagctacgaccgggccaagaaagcacgcggagcgccgattggaccgttcctccccgtcatcatcgaagcctgtggagaggagcaatactcctacgagtatcgtcatggcgcgaccagctacggcgccttcaccttctgcctcacatccatcctgcgcaaagagaagaatattaccttccagaagcttgtacagctcgcgactgagcgtctggaacggctcggctataaccagaagccacaaatcctggggccagccatcgacctcgatgcgaaggtgccgttcgagacagggcgagtcggtcagccgcccgcccgcaacctgcccggctcagcgacgccgcgaacctccgggtga

SEQ ID NO: 8013 - DNA, 714 bp, Methylobacterium sp.
tcctcgcccttcttccggttcagcgatacgcaggtgacctacacatacctgaacgatctccggcagccgggcgtcaccggcggccgggccggacgctccatcgaaggccgcagcgcgccgggcaacatgctgagcctcacccatgtcaatggctgggagtacggcaccaatttcgtcaacctcgacctgcggcgctacggttcgcagatcccggccggcaggccgccctatcccggaccggccacgaccttcgattacggccagaccaccctgttcctgacctatcgcggcaccttgagcggcaacgccatggcgggaacgccgctcttcgtcctgcccggcatcatcaaggacgtgtcgctggcctacggcgtcgatcaccagagcgacaacacgcggctgtcgctgctgcggacccgggcgatgggcggcctcagcgtctcgttcgatgtcccggtcggcttcttcaacctcgcggtgttcgcccagaaggactggttccgctttgccgatctgctgccgccccttcgccagaccgggacggacatcgtgccccgcgtcgaagcgacctatctggtgcccctgacgttcacgggcctgccgctgtcgctgacgggcttcgcctcctacaacccgccccgcggcgacgacccgaagggcggacggctgaaggccgaggttctgatgcgcagcaacctcgtcctcgacctcggc

SEQ ID NO: 8014 - DNA, 192 bp, Methylobacterium sp.
ttggcccaagcatctgaccccggcggagccggaaacaaaacggaccccctgatcgccatcttcaggctctgcactgaagccgcgcagatcattgatccagccgagacgccgcgcctccacgaggcgatgcaggagcttttgaaggagattggaatggagatggggcgacgcttgaacgctcgccttcactga

SEQ ID NO: 8015 - DNA, 366 bp, Methylobacterium sp.
atgtgtggactgttctcaaatctgccctcgacccagtacgacggagaaacgcgctcggtccgcctgggcgggcattcgacctcgatccggctggagacgatgttctggcgcgtgctggaggacctcgcggcgtcccaggacgtctcgctcccgcgcttcctcacggtcctgtacgacgaggtactcgatcgccacggtgaagcgcgcaacttcacctccctgctgcggtgcgcctgcctcacgcatctggaactgcaggcgacggggggaaccgtctcctggcaatcgcgcgcctgtgccaattcccaggacgctccccgcttcggtctgcgccacggtcgcccacacgaggccaaaatcgcctga

SEQ ID NO: 8016 - DNA, 390 bp, Methylobacterium sp.
gtgaccgtagccgccgacgcgaccataaccgccgcgatagccggccacgccccggcgatagccaccggccccaccgcggaatccgcccgcccggccaccgtgaaagccgccgccatggatgccgccaccccggaagcctccgcctccgccgccacggaatccgcgcgcatctgccgtgacgctggtcaggatcagggctgcgaaagccgcagacgcaatcaggagagttttcatgacgttgtttcctcgcaggaggacaacatggaggtgaggcgcatcagtccccgccggcgtgaccggacccgtaacctgctcgggtcccaaaccctggtcgaccggttcgtactaccgagtctgcagcgttgcttgatcccggaggacagccggtga

SEQ ID NO: 8017 - DNA, 1047 bp, Methylobacterium sp.
atgaagagctgggcggcagtcgccgtggccagacgcgcgctcccgcttttccttgcggtcgcgatattcggggcatgcgctggatgggtcttcgcgggggccttcgagaccggacgccctttcatcaatacaatctatgggatgtttttcagcctcacgctgttcctctacgagcgcggaaaacttttacccggcctgcgtgcccgcgtccgccgggcggcgacgccaatcttctttgccgccacactcctgatcttcggctgcacattcgtcgtcggaacgactgtggccggaaccgttctatgggcggtcggcattgcgagtaccccaatcctcgacgtcgctccgaccgctcaaaaactcacctacgccttcgtcactgcggcactcctcgtggcagtcctccgcatgcgcgacctgattggaccgcggatgttcatgagcttcctgctggggcgctaccataagccacgccgcgaggagcgggttttcctatttctcgatcttatcggctcaacgcgctttgcagaggagcgtggcgaccttgaagcgatgctctacctaggtcacgtcttcgaagttctcgccagacctgtggaactctatcgagggtcgatagacgattacgtgggtgatatggcgttggttacgtggcgtatgggcccggacctggaggatgcggctcccatccgctgcctgttcacattcctcgaccaagtggagcgagacgcgggggaatggcgtcgcaggttcggcgaggtgccccggttccgcgccgcgcttcactgtgggccggtgatgacgggcgagattggcgtcgaccggcacaaaatcacgtacttcggcgatgttatcaatacgacgtccagacttgagagtctggcaaaagcgctcgatgagcctgtcgtcgtctcggccgaactcctcgcccgcctcgggccggtacccgagggcgtaacggtcaccaacctcggtcggcactctctgcgcggacgcggcgaggcgctggaagttgtggggctgcgccggtcgatcggtgaagattaa

SEQ ID NO: 8018 - DNA, 366 bp, Methylobacterium sp.
atggcaacacgcgccgtcaccgccctgttcgacaatcaggacactgccgctcgtgtcatcgatcgcatcgaggcggagggggtgccgcactcggatatcggcatcgtttcgctgaacggcgccaatcggccggccggtgccttggccggcggcgccaccggtgagcccgtggcgcagggccatgcctcgtcaagcgagcacgagggttcggcggcggaaggggcgggtgcgggtgcgacggtcggcaccgtcctcggcggcggcgcgggcctgctcgcgagcctggggctgctcgcgattcccggcgccggtccggtgatcgcggcgggctggctcgtcgccgccctgtcgggggcaggggtgggg

SEQ ID NO: 8019 - DNA, 420 bp, Methylobacterium sp.
atgatcatcctcgacacgaacgtcgtatccggtctgatgcgcgcgtcgtcggatccgattctcgtcagttggctcgacagccaacccagaaactccgtctggatcaccacgattaccgtcctcgagatccagttcggcctcgacctcatgccggatggccggcgcgccgcaggcctgcgcactgcgttcgatcgcctcgtcgcagaaatgctccaaaggaggatcgccccgttcgatgccgctgcggccggcgagacggcaaccctcatggcggctcgacagagacggggccaaccgcaagagctgcgcgacagcatgatcgctggtaccgccatcgcgcggcgggccaccctcgcaacccgcaacgtccggcacttccccgacctggtcgtacctcccgtcaatccctgggacgagtga

SEQ ID NO: 8020 - DNA, 1143 bp, Methylobacterium sp.
atgtccgccgagttcatgatccctgtagatcacccaggaacgttcatcgttgaggagcttgaggcccgtggttggcagcaggttgatctctcgtatgttctcggcatgtctccacagcagttgagcccgctgttaaccggcaaggcacgcattacgcctgagctagctacggacctcggggcggctttcgatatgcctgccgatttcttcgccaatttgcagaagatgtacgatctctccattgcgaagccggctgaccccggcgtgcgcctgcggtcgaaatggctttcgacttttcctgtccgagagatgatcaagcgcggctggatcgaggagactgagccgagtcttcttgaccttcagatgctgcggtttttcaataaacctaccgtggacgacattccgttcattggaagcggatcggtcatcgctcacgcagcccgaaagctggactacgatggaaccactgccatccagtacgcgtggcttcatcgggtcatgaagatcgcgtccttgatgagtccgccgccctattcggccaatgctctcgcggcgaacttggcggcgattaaggctcacatgctcgataaggaggacttagtcaaaattccttccatactttgggattgtggtgtgcgcttcgtacttgtcgaagcattgccgagttcgaagattgatggtgtttgcgtctggcttgacgggcagcccgtaattgggatgacgacacgcctagatcgcctcgataacttctgcttcgttctgcggcacgagattgagcatgtcctgcagggcgacggacaagcggagacgtttgcgccgatagatgagtttgacggcaattacgagagtagcaacgatctacctgaagaggaaatccgtgcaaacactgcagcaggcgagttctgcgttcctaggcagcagctcaattcttttattgcacgaaagagcccatttatctccgaaaacgacgtacttgttttttcggctcgccttgaagttcatccggcaatcgtgatcggacagatacaaaacaagacgaaaaagtacaactggctcagaaagtaccaaaagggtatccgccattatctcatggattggcagtttaaggacggctggggattttacgcgccgaccggtctttag

SEQ ID NO: 8021 - DNA, 387 bp, Methylobacterium sp.
atgaccgctcgcgtcgggcacaacggcgggccggccctcggtgagctggccgacacgcgccccggccggtgcaagcactgccggcactggatggcgccctcggacgaggagcagcgggcttacgagtggttccacctcggtctgtcccgccgccgcgtccggcggccgacgggcgcctgcgaccgcgtcttggtcggcaacaatccccggccgcccttctcggccacctcggccgagttcggctgcgacaacttcgaggcggctccgccgctcccaatccctcgcggcggcggttttgtcacgatctggcaggatggacgcatcgcctggcagggcagggaggaggacatcccggcccgcttcctccaacaggacctggatttgtga

SEQ ID NO: 8022 - DNA, 1125 bp, Methylobacterium sp.
gtgatccgtattctcgttgcgaccgcggccgtgctcacgatggctctgcaccctgccgtggcgcggccgcccgagcgcctcagcaccgagaaggccgagatcgtcgtagagcccgttgcctgcaatcttgaccatccctggggtctagcctttctgccggatggaggcatgctggtcaccgagcgcgctggccgcctgcacatcgtctcagcagggggacaagtctcggcccctctccgcggaactccacccgtccataccggcgaaggtgggcttctagacgtagcggcagatcccaacttctcagagaaccgctttatctatctaacctacggcgaaccgcgcgagaacggagcggctacagccgctgggcgcggaaggctcaactcagaccaaaccgcgtttgaggatttccaggtcattttccggcagcatccggtgggtagcagtgacgctggtcactttggctctcgccttctcttcgcgcccgacggcaagctcttcatctcaaccggggaccggttcaatccgggccttgcccaggacctctcgaccgacgtcggtaagctcatccgcgtcaacccggatggctccatgccacccgacaatccgttcgcgaaccatgagggcgctcggcccgagatctggtcctacggtcaccgcaacatccaaggcctcgcggtccagccggaaaccggcgctctgtgggcaggcgagttcggaccgaccggtggtgacgagatcaacatcattgagcccgggcgcaactatggctggcctctggtcagttggggtcagcacatggatggaagcgcaattccaaggccaccggcacggccggaccttgccgatgccgcttaccattggtcgccctcgatctcattctcaggaatagtgttctactccggcagctcttttccgagctggcgtgggaacctgtttcttgctggactgacgtcacaggctgtcattcgtctgaccctcgtcgcgtcgcgcgtcaccggtgaggagcgcattcccatgggtgagcgcatccggcaggttgttcagggaccagacggtctcctctacctcctgaccgacgaagatcagggatgcatcctgcgtttcaggccgggccgctga

SEQ ID NO: 8023 - DNA, 108 bp, Methylobacterium sp.
atgcaggcgctcgccggcgatcggctcgacgagacggtgccgttcggcgcggcgttgccagccatcgaggaatcgccgtggaccgacgttccgtcgcctggaaaatga

SEQ ID NO: 8024 - DNA, 984 bp, Methylobacterium sp.
gtgtggcgcgccgacgaggagacgcggcctcgcgcctcgaaggtgccgcgccggggcatggaccccaagaccgcccgcgcggcggcggccgagcgcggccgcgagcgggtcggcgcgatccaggcggccggcgagcgccgggtgctggtggagcggcttcagccctcgcccgagaagcccgcacccgagccgcatcgccgggtccgcttccgcaacgaggaggagcggtccgcgccccgcgacagggcgcgcgaagacaggccgcgccaggatcggccaggtcaagatcggccgcgcgatgacaggccgcgcagcgagggaccgcgcgagaaccgcgcccgcgacgagcggccgggccgggacgagttccgccacggcgcacccgcgggcgatgcccgtccccgccgccgcgaggccggggaggccgcaccggccgagcggcgcgggccgccccgcgagcgcccgtccgatttcgaggggcgtccgccgcgtgagcggagcgagggccggcctcagcgtgacttccatggtgactcccgtgagcgcggcgagggtgcaccccgccgcgagcggccgagcgaagggcgcccgcccgagcgtcgcggccccccgcgcgaccggccccgtgccgccgaaggcgagcggccggcccgccctccgcgcggcgccgaggcgtccgatcgtcccgccttccgcaagggccccggcaaggggcccggtggtggtgcaggcaagagcttcggcggcaagcccggcttcaagggcggtgaccgcgacggcgccaggggcgatttcaagggcggcgcgaaaggtggcccgcggggcgacttcaagcccggtggtggcggccggcccggtgggcgcccgagcggacgtcccggcggcaagcccggcggtgcccctgggggacgtcccggtggtggcggcaagccgggaccgcgcgggggcggacgtccgagccgtccgccgcgcggcgagggctaa

SEQ ID NO: 8025 - DNA, 885 bp, Methylobacterium sp.
atgcttcgcgtggctctcaccgcatgcctgctcaccgcgggtaccgtcctggcgtcggcgaacccggcgcggttggagaaggggatcgtaccgtccggaccggcgaaggccgttgtcgagcgctggttcaccgcgggctccggaccgatctgctccgatgcgaacggggccgatgccccctgcgatctcggacgggcgctcgccttccggacgttctacgctgccggcgggacggacgcgctggtcttcgcccactactcgccgtccgtcggcaatgccgtttccttggcggtcgcccagttccggcgcgccggacaggattggaccctcgttcgcaccgtcacgggcgtctacggcgaaggaccggacagcctgtccttcgaaggcggccgggcgaccttcaccatggacgccttgatgccgggggatgcccgttgctgcctcaccggcaagcagcgttacacgctcgacctcgcgacaggaacggtgacggcgggtccgaagaccgcggccaaggcgacgccggcgtccggcaagcggagcttcgccccgcgtcccgagggtttcgagggcgccacctacttccacaacggcagcgaggtcttggtcgacgagcgcgtcggcgtgatccgctacgacgtgccgaagacctcgatccgtgcggcagtgagcaagggcacggtcctgttccgcggaaccttcgccgcgagcggggcggtgaccggcaccgcctacgtgttcaaggcgggatgcgagccggctccctacgccgtttcaggtcattcgaagggctcgaccatcactctgaagggcaatgcccccgtcgcgatccgaactcctgtgccatcaccgggacgactgcgcgcggcgcgcacactgtcctga

SEQ ID NO: 8026 - DNA, 1278 bp, Methylobacterium sp.
atgacgatccatgtcggcagcatcgctgcctcatcctccctggcgtcccgcgtgcaggtggtccgcagccccggcggcgtcgaggccctcctcctcgaagaccacgcgctgccactcgtctcgatggcgttcggcttccggggcggcgcggccctcgacgaggacggcaaggccggaaccgcgcggatggtgggcggcctcctctgcgagggagccggcccctacgacgaccaagcctttcaggtcgcgctcgcggaccgggcgatccagctttcgttcgggatcgagcgggaccggctcaccggttcgctcctgacgctcgcctcggatctggatcaggcctgcggtttgctgggcacggccctcagggagccgcgcttcgccgtgcccgagctggagcgccgccgcggggtctacgcggcggagctgcgccgcagcctgaatcaaccgggggccgtcgccgacacgatcttctgggagcgcggcttccgcggccacgcctatggcaggccacccggcggcacgctgagcgacctcccggcgatcgatcgggaggccgtcgtcgcgctccacgccgcgctcgtcacccgcacgtcgctgcgcatcgccgtcgtcggggccgtgaggccggaggatctcgcagccgccctcgacgaggcgttcgctggccttccggaaggctcggcccactccctgccggagacggccctcgggggtgtcggcgagagcatcacccagttcgtcgagagtcctcaatcgagcgtcttcttcggacgccccgccatcccgatgcacgatccggactttcccgccgcgatggtgatcaaccactgcctcggcggcagcccgtccgcctcccgcctcttcgccgagctgcgggagaagcgcgggctctgctactccgtctggacgggtttcgacgtttcagagggggtcgcctccctcgtcggctccacctcgacgcccaacgagcatgtcggccaaagcgtcgagctgatcgggagcgagatcgggcggctcgcgcaggacggcctcgacgacgacgagatcgacgcggctcgccgctatctgatcggctctcacgcggtgcgtctcgatacctcggccgcgatcacccgcctgcttctggcgatgcagttcgacgggcgctccctgtcctggctcgacgagcgcggaccccgcctcgcggcggtgacgtcgcaggacatcacacgtgcgaccgcccgcctcttcggcgacggtggcttgcttgtcgtcagcgccggcggagcgcgctga

SEQ ID NO: 8027 - DNA, 1326 bp, Methylobacterium sp.
atgacacgtcatacgcgaccgcttcggaccgacatcccggaggcggccggctcctccgtcgcgccgccggtcgtgagcggccggctcgacaacgggatggaggtgctcgtcctcccgagctaccggagcccgatcgtgacgcacacgatctggtaccggaacggtgcgatcgacgatccgcccggcaagtccgggaccgcccacttcttggaacacctgatgttcaagggaacggagcggtatcccaccggccatttcagcaagggcgtctcggccgtgggcggcgaggagaacgcgttcacgagctgggcctacacctgctacttccagaagatcccggccgggcacctgcgaacctgcatggcctacgaggccgaccgcatgcgcggcctgcgcttcgacgagggtgagatcgcttccgagcgcgacgtcgtcctcgccgagcgcggcatgcacgacgactcgaaccccgcgcgccttcttcaggaagcgctccacgcggccgcgttcccggcccacccctgcgggcggccgatcatcggctggcgccacgagatcgaaaccctcggccgcgccgatgtcgaggcctattaccggcgcttctacaggcccgacaacgccatcctcatcgtcgcgggcgacgtcgagccggtcgctgcgttggatatggccgcggagatctacggcgtgatcccccgcgacgaggggccgctcgatcggtcccatccgatcgatccgccgcggcggggccgtcatcgcctgaccgtcgccgagcgatcggtccgccagccacggctgcgtcggctccacgtcgtgccctcgccccgcctcgccgcgcccggcgaggccgaggcgctagagctcctggcctatctcctggccggggacgagacctccgtcctccatcgccggctcgtggtcgagacctccctcgcgacctccgtcggcgccggctacatgggcgacctcttccgcgaccggacgctgttcgccatgagcggcacgcccaatgccggcatcacgccggagcagctcgatacggccatcgacgggatcgtcgcggaactgaccgggaccggcttttcggaacaggatctcgcccgcgccaagcggcagacggtggcgggcgcggtctacgagcaggacgatcagtccaccctcgcccagcgctacggcgcgttcctgtgctgcggcctgtcccatgaggacatcgcgctctggcgctcccgcgtcgaggccgtgacgggcgatgacctcctgcgcgcgctccggcacctcgacccgcgcaatgcggtctccgggcatctcatcgaagcagcggcctga

SEQ ID NO: 8028 - DNA, 1149 bp, Methylobacterium sp.
atgctgccttgcgcaaattactaccgtcccgagatccttgccgacgaactggacactctgttcgatccactctggcaattcggagccctggcaggagaactcgccgcggatcgcgatttcgtctgcgtcgattacaagaacacggcgaccgtcctgcagaacttccgcggcgagatccgggcattcgccaatgtgtgcagccatcggttcaaccgcatccagccgggcgagcgcggcaaccggccgctgatgtgtgcctatcatggctggagcttcgacagcaccggtttcccgcacggcatgccgcgccgcgacggattcgcgcttgatgatcgcgagcggttatgcctgaccggttacgaaatcgagatgtgtgggattttcgtatttttccgcaagcggagcggcggaccgtctctgcgcgagtatctgggcgcattctatccactgcttgagcagattggatcctatttcgggccggaaattgatactggaacaatttcacacgcggccaattggaagctgctcgtcgagaacgttcttgaatgctaccattgctcggtcgtccatcaggacacgttcgtgaaaacgctcgggattggcagagcaggcatcgagcaggaacggttcgacggaccgcattccagtagccacttcccgcgcaccgcgacggccggagaggcccggcggcagaaggcgctcgcctatctcgacacccgcgccttcacccacgactcgtttttccacattcacatctttcccaacctgttcatctcatcgacgcagggtctgtctttttatgtcggccacgctttgcctctgtcggcgacggaaaccggactgcgctttcggctattcgaaccgaagctcgacctgacccgcgcgcagcgcgcggcacaggatctgatcaaccagtcgggcaaggcgctgggtcgtgcggtgatcgacgaggaccgagcgatcctggaaaatgtccagcggggcgtcgaattgtcggagaagcccggtgtgatcggtcgcgacgaaatccggatcgccgcgttcatgcgcgcctacacgcacctcatgggtggcggctcacttagcggtataccccccatcgacgaccatgttgctgccggtgatccagcgcgaagcatcgctgagtag

SEQ ID NO: 8029 - DNA, 240 bp, Methylobacterium sp.
atgacaatgagcggcttttacgaagaactcgcggagatcctggaggtcgagccggaccaagtgacggccgacctgcgcctggagagcacgtcgtgggactcgctggctgtggtctccaccattgccctgatcgatgagcagtatgacaaggcggtcaacgccacggccctcgctgcgtgcgagacggtcggcgatatcgagcgcttgattgcagcacgccagaccgagagcgaggcgtaa

SEQ ID NO: 8030 - DNA, 1041 bp, Methylobacterium sp.
atgatttctgccattcaatccgaaggccggaccgtcggcgcgcgtattgccgcaatcgcgacgcatctccccgagcgcgtcctcacgaacgaacatctcgccgaactctatcccgattggtcgtccgaaaagattctcgaaaagaccggcatccgcgaacgtcgcgtggctgcggagtacgagacggcaggcgacttggcctttcatgccgccgagaagttgtttgctgcgggcgattgcgtgcgcgaggacatcgacttcctcattctctgcacccaggcgcccgactatctgctgccgaccacggcctgcctcctccaagaccggctcggcctgggtcggcatgtcggcgcgctcgacgtgaatctcgggtgttccggtttcgtctacggtcttgccttggcaaccgggctgatcgcggcgggcgcagcgcgcaacgtgcttctgctgacggccgacacctattccaagttcatccatgagggcgacaagagcgtccgaaccttgttcggtgacggttccgcagcgacactgatcaccgcgagcaacgagtccgtgatcggcccgtttgtgttcggcaccgatggcgcgggtggaaaggatctgatcgtcgaagcggggggctttcgcacgcctcgggggccggatactgctctggcagaagcggattcacacgggaatgttcgttcgcgtgagcacctgtacatgaatggtgccaacgtgatgagcttttccttgcgggaggtgccacgcacctttgcgcgtctgctggaaacaagcggcgttactcagtcggatgtggatcacgtcgtccttcatcaagcgaacaagcttatgttgaacgcgctgcagcgcaagatgggcctccccgccgaaagggtgccgcatcaccacgaggacatcggcaacacggtgtcgtcgaccatccccttcgtcctggcaaacctgcgggataaagggcaaatggcacccggtcgccgcctcgtcgtgatcgggttcggcgtcggactctcgtgggccggggcttcgatcgtctgctga

SEQ ID NO: 8031 - DNA, 102 bp, Methylobacterium sp.
atggacgagcacgcgggtcagcacgaggtgcttgagcacatccgcgaaattgccggcgtggaaggcgtgacggtagttcagggtatggtccccactgagtga

SEQ ID NO: 8032 - DNA, 165 bp, Methylobacterium sp.
atgagctgggaactgcgccggccgggagccctcgaggccgccacctgcttcgtgcgagccgatgacatgcctgcctgcgtacggatctctcacgacctcaacagggacaccgccagcccctcacatgcctcggccaatttcatggacctccagcgagtgagctag

SEQ ID NO: 8033 - DNA, 438 bp, Methylobacterium sp.
atgagtcgatacgagttcgatcaaccgggcgtcagtctcgcgatcggctgggatgccccgctctccactttctacctccagatctggaacgaggcgctgcacaccgccgagatggacgatgaggagcgcgcctcaccacagatctggttcggaaccgagtacgcggagcacctcagtcccagcctactgctcaccctggctcgccaacatctcccgagcctccccgaggacatcgaagaatcgctgatgcgcgatatggtcaaggagccggcccggccgctctcggccgatcacgccgagatccgcctgatgctggaggcgctcctgggcgagggtccatccgtgatggaggccccgcagcgcacccctgacgagaccgctcgcctggagatggaggcgctcctgaagggaacgacctccgagacgaggcgccagtag

SEQ ID NO: 8034 - DNA, 126 bp, Methylobacterium sp.
atgggaacgaagcggcacaagccggaagacgtggtcgccaagctgcggcaggtggatgttctggtctcgcagggccagagcgtggcggaggcgatccgggccatcggcgtgacggaagtgacctac

SEQ ID NO: 8035 - DNA, 1599 bp, Methylobacterium sp.
atgaacgcccccctgaagggtccgccgaagcggcatatccccatcgtggtgcccgcgccgcgggagacgcatcccggcgactactatggaaaggaggttttcctggaccgaccgatctggcagctgaacgacttcgcccatcccgaactcaggctggactgggcgtccctggagttctcccatcgcgggatggtcgaggccactgcggacttcatcgtcgatcttctctcgacctcggccagcaacgtggcgaaccacttcaacgccatcgcccgcctcaagacgctgcgggcgtttaggctgtggtcgcaccctgtgatctctttgaacagggccgacctcaaccagtcgttcttctacgaggcccgtgacgtcgcgaagttcacccgcggcgagctcagccatctgcagcgatggtaccgcttctgcgccaagcgggagggctcgggcgtcaaccggacgagcgcaagcatcgtcgatgcgatctcgatcggcggcggtccgaaggccgtcgccgtgttgacccgggatcccaagggcggcccgctcgacgatgccgagaccacggccttgctccaggcgctggcggccgcccgcgaggcgggcgccgtgccgatccaggggctcgtcgcggtctggctctgcatcgtactcgggccgaacccgcgcatgctctcgatgatgcgcgaggaggacttccgccgggtcgacggcaggcatcccgagctgtccgtcccgaggatcaagggcaaggatgctttcggccgtacccagttcaagacccgcaagctcgacgagccctcggccacgctggtcgaggagctgatcgcggcgaacgccgccgcgcggaaggcgcatccgtgggacgacgatcgatacggcaaggccctcttcccgcggacgaagccggatgcgaggctcgtcggccgtccgcagcacgcctacgcgatgcaccggtcgtcggccctgatcagccgtctcgtcatgaggacggtggtcgccctgggcgtccggtcgcctcggaccggagagacgctgaaggcgggcccccgccgcttccgctacaccttcgcgacccgcctgctgcgcgagggggcctcggccgaggtcgtcaaggatctgctcgaccacaaggacctgcagaccatccgtgcgtacctgaatctccgcggcgagctcgtcgagaagctcgacgcggccatggcgatggaactcgcgccgatggcccaggccttcctgggcatgctcgtcggatccgaggccgaggccgtccgcggcgacacccgggcgagccgcatcttcggggccgggccgtccaaggaggaggggctcggcacctgcgggagcctctccttctgcggcctcgccgcgcctgtcgcctgctacacctgcatccgcttccagccctgggtcgaaggtccgcacacccaggtcctcgacggactcctgcgccagcgcgaggagcgccgcgagcgcggcctcgacggccgcctcgtcaccatgaccgacaacacgatcctcgcggtcgccgacgtcgtccgcctctgcgaggacgcgaagcgtgcgcgcgacgccgcagatccggaggccgcccgatga

SEQ ID NO: 8036 - DNA, 426 bp, Methylobacterium sp.
atgaatgccagtcacgctgcatttttcgagcggccggatgcccggcctatcaaggacgttctgagccgtgcggagatgctcccacaatatgagttgctcagcaggctcgagatcccagcggtccaggcggccgtttgggagatcgagccgatcatcgaaaagctcgatcccggcattcggaattatgcgattcagtcggctggggcgctgatcggtgatcttctgacggcccgcgggtttcggattgcccgggatgctcgtggcgagaagcgccgtggacgcgtgcggaaagcacggttcgtgaaatccggtacgatttgggagcttcctgcggagccggatggcggccatcgggacaaggtcgccaagatcatggaagatgtcatggtccgctaccggtcaactctgaccgagttggcgaagtga

SEQ ID NO: 8037 - DNA, 462 bp, Methylobacterium sp.
atgttgtccctgaagcctcgcgggatcggccttgccgtcgtccttctcctcttccaggcgggaaccgcctccgccgtcgagctgccggaggccgtacggacctggttcggtaccgaccgatcaatcgtctgtgtcgatccggacggtaacgatcgtcgctgcgcgatcgatgtcgacacgcatgtcgaattccggcgctcgccggacgcatcgacggccatcgtcttcgtgacctacctgccggatcccaccggcaacgcgaccgagaccagggccgcgatctttcgagccgccgggaccggctggcggcatgtccggaccctcacggaggtccggaacccgctggcgggcaaggtcgccttcggcgaccggaccgcgaccttcgcggccgccgtgccgcaacgcggcgacagccactgctgcccgaccggccgcaggatctaccgcatcgccctgccctga

SEQ ID NO: 8038 - DNA, 780 bp, Methylobacterium sp.
atgacgatgaaacagattttcctggcctcggccgtccttgcgggcgccctggcctatcttccggccagcgcggacgcgcgtccgatcggtgtcggcggctccggcggcctcggcggcggcaatttccggagcgcgctgggtgcgggcggtgtgagcgggttcggtcgcggcggcggctttgccgggggcggcttccgcggcggcggagccgggatcggcggtggtggtttccggggcggcggcgccggtctggccgggggcggcttccgcggtggcggagcgggcctcgctggcggcgggttccggggtggcggcgttggcctcgccggtggcggcttccgtggtgatggctttggtggccgccctggcttcggcgcaggtcgtccgggcttcggcaacggcgtggcgggcgtgcgaccgggctacggcggccagcgcggctggtacggcggcaaccgctggcgcaatgccggctactatcgccggggttacggctacggtggtgtcggcctcgggctgggactcggcgccggtctcggcctcgcggcgggcagcctctacggcagctacggctatccgggctacggctatggcggatacggctacgatgacggttactacgcaccggccggctattacggcaccgagacggtgaccaccggcgtcgcgcccggcggcgacgaggacttggtggccgagtgcgcgcgccgcttcaagacctacgacccgcagacgcagacctacatcgtgcgccgcggcgtgcgtcgctcctgcccgtaa

SEQ ID NO: 8039 - DNA, 348 bp, Methylobacterium sp.
ttgaaggccaacgggatcgatcagctgaacgcaaccatgagtcggattgcggaaacgggcctgcttcgggttcagtcggtgacgttcaaggtcgagaatgagcgggccgcgttgctcgaagcgcgccgtgcggccatgcttgatgcccgccaacaagccaaggtctacgcggaggccgccgacgtcacgctcgtcgagatcaatgcgatcacagacggagaagccagcccttccgaagtgggagaggccgatatgccgcgatcgctccgccgcatccaaatcgtgccgccagcggccatttctttcaacgccacggtgaacgtgacgtggcgcatcgcgccgcgctga

SEQ ID NO: 8040 - DNA, 375 bp, Methylobacterium sp.
ttgaggcagcgtgagaggtcggcccgcaacggcagacgcgcaccgatcgcagcgatccagcaggcggcgggcggcacgagcggtgccatcggcgagaacgggcaaacgatcgcccagctcagcctcatcgccgctgaagtcgccgcggcggccgagcagcagggacaggccagccacgagatcgcatgtgccattgccggggccgcagcggatgcccgcacggtgtcgcggagcattgcggggatccgcgccgcggccgcctccaatgaggagcgttccgacgaggtgtgctccggtgccgagcgagtcgggcacggcagcgccgcgctgcaggtcgcgatcgggacgttcctgaagcgggtccatgccgcttga

SEQ ID NO: 8041 - DNA, 114 bp, Methylobacterium sp.
ttggcggatcgctcggcggtgacgctcatcgtccgggcggtctcccgaagctcggcggcggaggtgccgaccgtgccgacgatgcggccgaccgacgccgcgaagccgtcctga

SEQ ID NO: 8042 - DNA, 423 bp, Methylobacterium sp.
ttggcttgcgcgagccagccggccgagcgatcgacccgggttcccccgcggatcgccgaccggcccggaccggaggagtggaccgatgacgaactgctgaccctgcccgaggccgccgccctgttctggccggcaggcccgatcaccacgaacaccctgaggacagccggccgtgacggcagtctcgcgatcaccaaggtcgcgggcaagttcttcaccaccccgatggcgatccgccggatgggcctcgacgaggccgatgcggtgaagccgggtgcggcggagaccgtcgaaacgtctcccgaggcgatgttccagatgaagctggccgaggcgaagaggctcggtcgagagcgcgcgcgtccgagacgtgcggcgaagagatctgtcttgcccgccgtcagcggcaaggcgggacagtaa

SEQ ID NO: 8043 - DNA, 405 bp, Methylobacterium sp.
atgcccaccgcagtcaccgccgtgccacccgccccaagtgaactcgcccgcgagcattttgcggcagagttcgcgtttgagaccgactgctgggacgtgcacgacactttggcccaaggggcggacttcgtactgctcgacgtgcgtagccccaccctatttgctgctggtcatgtccctggcgcgaccaacctcccgcacggtaagatcgtgcgctccaagctcgaacattggccggagggtacggtgttcgtgacctactgcgccggaccgcactgtaatggtgccgccaggggcgcgttgcggctcgcagaactcgggcgacccgtaaagatcatggcgggcggcattactggctggcttgatgagggcttcgacttggtgcgcattggggccacggggtga

SEQ ID NO: 8044 - DNA, 1323 bp, Methylobacterium sp.
gtgagcacccctgcaaacgcctcgggcgagcgctaccagctgttccagcgcgccggcagcacccgatggcaggtgcgcttcagcatcaaaggccaggggcagttcaagcgatcactcgacacggacgaccgcagagaggccgagcgcaaggcagaggccatctggtacgaggccacctaccgcgccaagcagggactaacagccaaaacccataccttcgagagcgtggccgaggcgtacatcgcgcagatcctgcgggaggtggagcggggcgagcgccgtgcggatcagggcaagagcgagccggcagtgattcgccgctacttcgtgggctacttcggcgacaaacccatcgacgcggtcacggaggccgatctggagcgctacgcggagtggcggcgcacctactggacggagggccctggcaagctcgtcacgcacatcgagtacgagagggacggacaccgccttcgccgccccgtacgacgctctgcgccgtccctgagccgccagcgcggtgagaccgtggtgctgcgtgggctgctgcgttgggccgctcggcagggctatctgaagaccccgccggagatcagcatcaaggcgcgccgttcgccggacaaccggcggccgagcttcgagccccacgagtttgctcggttggaggcggtgagcctcagccgtctcgtcgaccccatcatggacggcaccggcgccgaggtgcgggccagtgaccggcgcagctggcgcatcaagcggctagacgaccatacccggcgtgaccgcaccgtgctgcacgcctacgtgatgatcggcgcgttctcagggttacggcccaccgagatgtacaacctgacctggggcgacgtgctgggctaccgcgccggcaggaaaaagagcgtggatgaccgggacatccggctgcaggtgcgaggtaagggcaagagcggcaaggcgattccgcagaaggcagcgatcccgtggttcgacacgttgtggatgctgttcgagcgcagcctaggccgggaacccgttgattcggacccggtgttcgcgagcgagcagggcaagcgcatcacctcggtggcgaacggctttaccgagctgctgaaggcagcgggcctggagcgggatcaccgcggcatcaagcgcacgccgtactcgctgcgccatttctacatcagcgagcagctggcgaacggggccgaggtgctcgacgtagctcgcaactgtcgcacttcactcgcgatgattgacaagcattatggccaggtccgcctcgagcgagtggttgaccggctccggccggagtggacgcgcgcttag

SEQ ID NO: 8045 - DNA, 129 bp, Methylobacterium sp.
atgatgccgacgagcgtgatcagcgagcaggatctgagcgtaatcgtcaggcagatccctctcatcggaccatccgccgggggattggcgcccaaagcctcgatgtgccgaagatatagaatgatgtag

SEQ ID NO: 8046 - DNA, 147 bp, Methylobacterium sp.
gtgcggacggatggcttcgtgtgtctgcccgagaacacgctgcacgctcttcggacgaccaacgaaccggtggtccttcaaggctacggaagcgggccgtttggcgtgaacgacccgcatccggccgacgacccgagcaaggcgtag

SEQ ID NO: 8047 - DNA, 642 bp, Methylobacterium sp.
gtgccggtcttcacggtgccggcttcgaccgtgccggtcccgccgcccgctccgatcatcaccgcgaatgtctgggcaccatcacccgccccggagcttggtccggtcatgccgctcgcgatggtgacgtacgcccaggcggcattctgggacaattcggagaagccgcagacctaccggtgcgagatcaccggcaagacccgaaagcggaaaggcccgtaccacaagctcagcctcgatctctggacggctccaatcgatcgaatcgtcaaagcgtacagcggaaaagcgttcatccgacatattcaactccggcacccgccgcagttcgaagttgccgtgctcgataagaacctgaaatcggggaagatcaccgaggattactatcgagagattcggtcaatcctcatgacatgcgatctcaatcgagacttcctcggcgtcatcatcgaccgggatacgtggacgtaccacccgcaccagttcgtgcacgtccgctggtcggacgatgatcgcccggtggtcgatctctacgtcaacggcgagtgcatgacgatcgacacattccacaacgacgacctgtcagaagcacaacacgaaaaaggcgtccgcttcatcgctcaatttcatcccaacgcataa

SEQ ID NO: 8048 - DNA, 516 bp, Methylobacterium sp.
ttgcgcagcctcgagttcggaaatggcgcgatgaacgacggaagctggcccatcctcgacaacctgaccgccaacgcggcgattctcctcgacgatcatccgtcgatgagccggtgcgccgtcgccgtcatccttgcgaccggttgctacgtctgcctcgtggcgccggcctggtcgcgggtcgtctgctccgatccctccttgcgccgggtgctgcatgtcggcgggttgggtgcgggcgggtgcctcatcctgaccggcctgttctacgacagcctgctcagggggctcgacggggcgatcacgtcgcagccgctgatatacgtctactatccggccagcatcatgctgtcgtgcgcggcgatcgtctttgccgggttccagctctactgcgcgctccacgtccggcaggccccgctgatgcgggcggtcattcccggtcttctcggcgcctggctctttgccctctcggtgccggtctaccagttcgccgtgatcctggggctccatcaatga

SEQ ID NO: 8049 - DNA, 261 bp, Methylobacterium sp.
gtgacgcggctgccggccggcagcgacgcccgctggcgggccgattaccgccaggcgcagtacgagcgagccttgatcggtatccaaaccgacctgctcggcgggccggtcgtcgaggtgttccgcgcctcgcccaaacagccggcaccgccggcctggacccccaactacgaggtgaagttcttccacgatctgtcccccgagcaacaggggcggcggctcgctaccgacccccagacgcccttcgcccgcaccatctga

SEQ ID NO: 8050 - DNA, 231 bp, Methylobacterium sp.
ttgcaacatgtcgaatcccccaccgtcgccgacgagcaggtgaacgtggcggtcgatgcgtacctcgccgattctggcatcaccgctgactcgaacgccgacggctacggtctccacctcgccgcggccgtcgccgggcatggctgggcgagttcggtcatagccagtcccaagagcagtccaagcttgacgcgcggggcgatcctactcgtacgggcgcagaaggcgtga

SEQ ID NO: 8051 - DNA, 1014 bp, Methylobacterium sp.
atgacgaccggacgcccgctcacgcctgaagaacagcagcgcctcgcgcgccgcgagcgcacgctcaaaaaccggcgcggccggcgcaatccagcggtgatgcccgaccgcctggcgcgcacctcggcgttcgtgccgcgcaaggtcaacctgatcaccgacagcaatttcacccgcgtctacgaggtgccgggctactcggtcgttgaggtgaaggggcgcgagctgggcagccagcaccgcgacgcgatctacgccctctttcgcctcaagcgcgaaaaggtctcgatgcccaacccggactaccggccgggcacgttcatttcgccgacgcggacctactacgagacgcgcaccagttggcgtgagctgatccgcgtgatgggccgcaccgagcacgtcaacaacctcctgagcctcgtgcacgtgttccaggagatccagcaggtcagtgtgctgatccacgagggccgctcgctagccgagctcgacaagatcaagaaaacccgcgcgatcggtgccctgccggacagccgcggcagcgccgcgccgctgatcaccgaggtcagctgggaaggcgcccagctcgatagcagcgtgaccgtgcgctacggcccgagcgtactgcagatgatcgagaaggcgcacttggtcagcatcaacgccgacgtgcagttccgcctcaagggcgaccacgccaagacgttctggcctttcatcgacagccagccaggctttgcctggatcgacgaggagcgtctggcccagctcgccggccgggatctctggtccgagcgggagaccagcgccacgcgcgcccagttccgcaaggactgccggcaggccttcaacgacatggtcgccgccggcggcttgaaggagtggcgtgaggagatcaccggctccggctggcgcaagtcccgccgctaccactacacccacgcggcgccgactcagctcgagatggatctggcccgcgctgccgggcaggccgctgcccagctcacagcataa

SEQ ID NO: 8052 - DNA, 612 bp, Methylobacterium sp.
atgcaggccgaagactcggcatgccgtgccgaggacgagaccgccgcggcccaggtgcgccgggtcgaccgcgacaccagccggatccgcttgcttggcgcgcagttcacccgcctgcgcaagcgcctgcccctgcgccgccgtttcgtcggcggcttcgcccacggcgtcatctccgcggtcgccgccatcgccgcatacctgccgacccatctgcttggcctgcgtgagggtttctgggcggcgatcacagcggtcgccgtcgcccataccgagttcgacacgacccgctccaccgcccgcgaccaactcacgggcgctttgatcggcggagccgccggtctcggtgcctacctctcgctcggcccctccctgccgacctacgcatcggctgtcctgctcgcgacccttgcctgctggctcgtcaatgtgtcgagcgcgtgccgtgtcgcgagcatcaccgccacgattatcctactcgtgccccatatcgggccggtggagcgcatggcgggatcgcgggtgctggaagtcggctggggcgtttgcgtggccgtggcgacggtctggatcgtcacccgcctgaaccgggggattggaatcaagctctga

SEQ ID NO: 8053 - DNA, 1293 bp, Methylobacterium sp.
atgcgtgcccataatcgggcagacgcggaggaagtcgttaatcaccttcctacccctgccaacaccaatacgaagaccagcaagaccacaccgaccgagaccaaccccaaagccaggacgcgcgggatcgcctcatgggacgacgccggggagcttccccgtgtgatcgccatgaaccgcgccctggaccgcttcggcgtgccgatggccttcagcgtcaacttcgacccgaggctcatccaggctggcaacgacaacgcacgcggccaactcgactactaccggcgtcggatcgccctggcgctcaagcgagcccttggcgaagcgctgaccatgtggatcgccgtcgagacagccgacgacggacgccagcattgccacggcggaatggccctcaccgagcggcacgacccggctgttgcgctggatgcgcttgcacgtgccggaggaaactggacgacccagggaagcgccccggccgacctgcgcccgcagcacgacgcggacgggtgggcggtctatccgttcaagagggcgccccggacgcgccgcgacctgcgagaggcggccggcttggacgccgacgcccgtgtgacgctcaactcctgcaccgacgaccttcggaccgaggccaagcgcgtctacgaggaagcacgacgggtcatcggctccgatgaccggaagcatgcgcgtgaccggacggcccggtgcgatcatcaggaggctcgtcagcgggcggcatcgcttcaggcgaccgagactgccccggtgctgcccgagccgccctgcgagcccgcagcgattccggaaccggcatccggagcagacgctgctactccggcagaactggcacagccggcacgggtcgcgtcagcgcacgcatcggatgccgagcttgctttcaccgtcccagcgctgcctgcgctggacgagccgttccggatgccagccacggcccggtcacgaggaccgccaagttcgccggacgtcagccagccaccttgcccccatcgcacgccgcaccacattgagcgcccaacgaaacgaggagcgcccatgtccgaccagaacgagccgaaagtagaagctactcacaagaccgtccggacggccgagctgaaagccgaacgtccgtcagccagcaccgcgatctcgtcggtcacgtcatccaacatgacggtcggtgagccgaaggttgatacgaagcacacgacggaaacggtcgatccagtcgaggaggcgaagaagaggcccgaggatcccgacaaagcggctcgggacggccaggcgtaa

SEQ ID NO: 8054 - DNA, 1089 bp, Methylobacterium sp.
atgctcgcctcggcgcaagcatcttgtgatgagtatattgcgaagatacgcgcaaccgggcgtatcccgcagttgctggactacgctcatgcacgtcgccatgccgccgaagagcaggcgcgacaggcggcagaggcagcgcgagttgcggaccgcgacccgcacggcttcggggcgcttctcgccgagctacgcgccctcgaacctgcgaacgatgacccggagctagacgcccttctcgatggcctggacgccgctgttccggccaatgaagccactcccttggtcgcggcggacaacgatgatgccgcccccgcgccgctggcaggaaatccgaaaaagcgcgccgccaagcctcgcgtttcgttcgctcgtgataagcggcatctcagcgttttcaatgacttcgtgcccgacgtgcggtctccgcgcacccgctcgctaaccggccctttagtaggcgacaccacccacccctctacctctcccatacccccttccacaccctctctcaccaccctcaagcggcagcaggcgaacgataacgacacccgcaaggctccggcctgggaccgcacgacggagatcatcaggggtcacacctacgcgcggacggtcagcacgaccggcggcggcgtctcgtggaccctgaaccttggcggcaagatcgcgaaggcagcgaacgacaacccgcacggcctgaaggataagctacacgaccggctcgtgaaggcgctcaaggcgtccgcgctcggagcccgcgagttcgtctttgccgtcgaacgcactcgctccggccgctggcaccttcacggcattctcgacgtggccgacgatgagcgtggggcgctggaggccatcttgcggcaggtgggcggcacctggggctcggagcaccacagggacaagcaggtgcagacggacgtgctgtgggggccggacggttggcttcgctacatgcggaaggactcggctgcgacgcgccggctactcggcaccaagtccatcctcagcgtcacgcgcggatgccgtcagcgcgcggaggagctttgggaggcatcccggcgccgtcagagaagcgcgaactga

SEQ ID NO: 8055 - DNA, 1107 bp, Methylobacterium sp.
atgtcgcggctcgaactcctggtcggtgatccggcccctgcctttcccacggccgtgtttctcaagggcacgccgttctccgccttcgagcccggccacgtctacgtcgtggagtgctgggccacctggtgcggaccgtgcctgtcgaccatcccccacctgacgcagatgcagaaggatcatccggacgttcgcttcgtcggggttgcggtgtgggaggacgacatcaaggccgtccgcgccttcgttgccgagaaaggcgacgagatggggtacgcggtggccttcgacgtcggggagccggccgcgagcgggggctggatgccgcatcactggctgctccccgcctatcagaacggcattcccaccgccttcatcgtcgatcgcgagggtcgcatcgcgtggatcggccatccggcggtcatgaaagaggttctgccgtccgtggttgacggcaccttcgatatccgggcggccacggaccggtatgccgcctggatccgggagagcatgactcgcgagaagtcggcccttcaggcggcggtgcagagccatctgaaggcggatgataacgctggcgccatccaggcctacgatgccgccatcgccgaatgcccgcgcctggaatccgaggtggggctggagaagctgcggctcctccttcggacccctgattccgcggccctggcctacgggagccgcctggtcacgaccttcggctccgacttccccttcctgaagcgggcgaccgcatcggagatcgtcggcgcgctggaggacgacaccgttctgcaccaacggcagccgctcgcccggttcgtcatcgacctcatccggaatctcgaggcggagaagagcgaggaggacgcttacgaagcctgcgtccgcgcgcgctgcctcgcgatcgccttcctggaggaaggccagccggccgaagccctccgccaggccgaggcggccatcgttcacgggcggacggccgaccttcacgagagagcgctcgacggtctccagtccctggtggaccgctgcgccggcagcgtcgcgacccacagcccgaagacgccgaccgtggtctgcgacggggatgtctgccgcatcgtctga

SEQ ID NO: 8056 - DNA, 90 bp, Methylobacterium sp.
atgctcaccgtggtcgtcgtcatggtgtggtccgattacgagccgatgccgcatgatgacggcaaagcgagcggttcggcaacggcctga

SEQ ID NO: 8057 - DNA, 864 bp, Methylobacterium sp.
atgccgaaacctgtcgtgccccggtatttcctttacggcgagccaccgcagactgcggatgacgggtttctgcacctcgaagacctggacgatcgcagccgcccggcggcctggcggattcgtccgcacgcccatgccgacctgcaccaagtgttctgcatccggtacggccgcggcaccgtcacggccgagggcgaggagaccgctttcgcggcaccctgtgcgctggtcgtcccggcgggcgtggtgcacggcttcgtctacgaggcgggcagcaccggccgcgtcctcaccgtctcggacgcggtcctgcgcgggctcgggcgggacgagcgcgcctttgcggccctgttcgagggggtgcgctgcctcgctctggacggaaccgcgcacctcgatgcggcgctcgacgggctggaccgcgagcgggccagcgcggccccggcccagcgggccgccctgaaagcgcatctcacgctgctcctcgtcgaactggcgcgccttgccgacgcgcgggcggccgatggtcccactcgcctggccgcccatgcaaggatcgtcgcccgcttccgagcggcgatcgaggagcattaccgcgccggcctcagcctggagcagtactgcaaccggatcggcaccacggtcgggcgtctgcgcgtcgcctgccgggctgtggccggcgcgacgccgggccagctcatcgccgaccgggtcatcctggaggccaagcgctccctgcgctactccgacctgccggtggcggagatcgcctacgacctcggcttccacgaccctgcgtatttctcgcgctacttctcgcgcgtcacaggatcgagcccctccgcattccgtcgtgccgactga

SEQ ID NO: 8058 - DNA, 888 bp, Methylobacterium sp.
atgaaggttctggtcatcggcggcacccgcttcatcggcgcgcacgtggtccggcagctgcatgaggccggatcggcagtgacggtcctgcaccgaggtcgcagcacgaacccgatcctgccggaggtcgagcacgtcgtcgacgctggcgccgcctatcccatcgtggcctttcctgaaacggttcggcgggactgggacgtggtggtccacatggtggccatgggcgcagcggatggagcggctgcggcgcaagccttcacggggcgcgccgggcgccttgtcctgatctctagcagcgacgtctatcgcgcctatgggcggctcacgaaagccgagccggggccccccgaaccaactccgctgcgggaggacgcgcctctgcgctcggtcctgtatccctatcgcgggatggaggaacagatcggagcctacgcgcgcgactacgagaaaatactggcggaggaggcggtacgcggggcggtgggcctcgactggacgattgcgcgcttggccaaggtctacggccccgaggacaatgccgacctaggcaccctttacggcttcgcgggcgttcccgactggcgctggacgcacggccatgtccaaaacgtcgccgccgcgatcgcgacggccgcgacgcatccctccgcgcgcaatgccgtcttcaacatcggcgaggcaacgacgccgaccatgggcgagaggctagcccgcctgcccgcccggagcggcgaggcgcccgtgccgccgcccttcgactatgaccagcccttcgttatcgacacgtcgaagatccgccaggacctcggatataccgacctcctcgacgagcccgccgccatgaaccagatcgcgtcgcaggcgagcgcctccagtgtcccgtga

SEQ ID NO: 8059 - DNA, 147 bp, Methylobacterium sp.
atgcccgacgggctgcccgcctccctcgtcgcggtgctgcgcgccgcgcacgcgcaggacgccgtctggatcctctccgacaccgagctggagccgacgacgttcgacctgcccgtgttcgatcattccagccccaggcagggatag

SEQ ID NO: 8060 - DNA, 501 bp, Methylobacterium sp.
atgacgcctggagccgtcgacgccgtaatccgcggcctgaagcgggcgggcgtctcgatcgtctgctacctgccggattccctgttcaaggaactctacccggccctcgacgcggatccggacctgcgcaccatcccggtcaccaacgagggcgagggcgcggcgatctgcggcggcgtcttcctctccggcaagcgcgccgtgctggtgatggagaattcgggcctgcgcgcctcggtcgagccgctcgcccgcatgggcctcggcgcaggcatcccggtggtgatgctgatgagctaccggggcgatctgggcgagaacaactggtgggcgatcccgcacggcatcaccatggagccggtgctgcaggccctgcgcatcccctaccgggtggtgcgcgaggaagccgccatcgagacggccatcgcggacgcctacgcctcggcctacgcctcctactaccacgcggcggtggcgctgggcgggagcatcgtgcgatga

SEQ ID NO: 8061 - DNA, 642 bp, Methylobacterium sp.
atgagcgtcgaacccgaagcatccggccggccgatgaagcgctacgcctgtatgcagcgcctcgcggcgcgcctgcgggacgaactcgtgatcctgtccctcgggggcagcgtggacgagtggtacaatgcggcgccgcatatgcgcgccgccagcctgttccagcagcagctcggctgcgtcacgccccaggccttcggcctcgccgccgggctgccgcaccggcgcatcgtctcgctcgacaccgacggggggctgctgttcaacctcggcattctcgccactttgggcaacgagcggccgaagaacctgtttgtcgtcgtctgggacaaccagtgctaccagtcgatcggcgggccgccgacccacaccgccaagggccgcgtcgatctcgcggcgatcgcccgcggcgccggcgtcgagcacgcctacacagtgcacgacctcgatggtttcgagcggcactgcgccgaggggctcgcggccgaggttccttatctcgtcgtcgcgaaggtggccggcaccgtccagcccggcatccggcggaagcacagcgacgggcgcgaggacaagtacatcttcgtgcgccacgtcgaggcgagcgagggcgtcaccatcatgggcccgagcgagcacaactaa

SEQ ID NO: 8062 - DNA, 606 bp, Methylobacterium sp.
ttgtcgctgatccgcacaaaacatgaggttttcgtgaagcaggcgcgtgtgcccacagaacaggaatttaggcgcttggtcgccgtggtggtgagccagggcaagtatgggccacgtaatcgcatggccctgatgctgagctatctcgcaggcctcagggtgggagagatagcatcgctctgctggagcgatctcctcgatagcgatggcaaggtgcgtgaacagctcagactgagcgcagcggtcaccaagggagggcatgcccgcgtagtgttcctgaacgctcggctgcggaaggaggtcgggctgtatcgggcaaccctcgcgcaaccccctgctctgctacagccggtgctggtcactcaaaagcgctcggccttcagcgcaaacacgctgtgtcaactcatgcggggctggtacgacctcgccggcctggacggcggctcaagccacagcggccgccgatggttcatcactcgcttggctcatgccgggatctcgcccaaggccataatgatgctcgccggccaccgacatctctcaaccacgcagcgctacatcgatgtcaatgacgagatgatgcgtaaggctgttgagctcctgtaa

SEQ ID NO: 8063 - DNA, 288 bp, Methylobacterium sp.
gtgccgagcttcgcaggtctcgcgttcgttgccctcgtcactatggcggctgcgggtggaaagccgccgacgtttgatatcgcggcaacgtgccgggcggctccgacgctgggagcgggtgacgagaataccgaccggaactgcttgagggacgaggagcaggctcgtgggcagcttagcaagctctggtcgagcttcgatgcgcagcgccgcgagacatgcatccaggaagcgggcaacggagggtcaccgagctacgtggacctgctgacgtgcctgcagatgtga

SEQ ID NO: 8064 - DNA, 534 bp, Methylobacterium sp.
atgcaggacaaggagcccgcgcgcctatcccgccgcgtgttcctgggggcggccggttccacgctgctggccgtggcgatcatgccggatgggctcgtgaccggcagggcctgggcgcagatgccgaaggcgacgaagcccgagacgttggcgtccctcgtccagatgtcacgcgactgctaccctcacgctcgcgtcgccgaccggttctatgccgccgcggtccggatcctcgacgaggcggcgcgcgccgccccggtggaactcgacctcctcgaggacgggatggccgccctcgacagggaggccgctgcccgccatcgcgtgccctacgccaagatcgagcgagaggcggaccgggacgccctgctcaaggcgatcgagccgactcccttcttccagaaggtgcgctccaacctcatcgtcggcctctacaaccagaaggagctgtggccgatcttcggctacgagggtgcctcgttcgacaagggcggctacctgcatcgcggcttcgacgacattaactggctctga

SEQ ID NO: 8065 - DNA, 402 bp, Methylobacterium sp.
gaccgtgcgctgctcgccgcgttcctgcgcgacgaggggaccgactttgccctcaacccgttcccgtcgaccacggccggcgcggcgcgcctgacctgtgccgggctggccttcgagtatccgatcctcggcatcctctcggccggcctgccgtgtctcatggaggcgctggcgcagttgccgaagacgacgccgctcacgcggtgcattctgaaatccgcggcgcatacctgcatcgtgtttctgactaccgaggaagcctgtgtcggcgcgtacctccacgggaaggccggggtgcctctgccggtattcgcgccggctgcgcccaagccggcgccgcgcaagggccggacgcgccagacgaaggccgagcagctcgatctcttcttcgacgttgcctga

SEQ ID NO: 8066 - DNA, 4098 bp, Methylobacterium sp.
ttgcaagagaaggcgaccgtggccgacacccccctccccctgagcctcgccgacgatccggtcgcgcgcgccgtcctcgcccgcttcccgggcgcgcagatcgtcaccgacacggcgcccccagccggcgcgctgcccgtcgtcggcggcatgcaccagatcaacgccccgtgcttcagcgcgctcgcaccggagctcgtgacccgcgggtggtcggtcttcccacagacacgcgacggcaagcgcggctccggcctcgtcgacaacgccgccctgaagtggaagccgtaccaggacgtcctgccgacgctcggcgagatcgactggtggagccgcttctgcccgtcccacaacgtcgcctgcatcctcggtgccgcctcgggcgggacgtgggccctcgacgtcgacgtctcggacggcgagctctcgcacgcgatcgtcgcgctcgccgacgagcacctcggctatacgcccttccgccgcgtcggccgggtgccgcgcatcgtcctcgtctatcggcaggccccggcgagcgaggtcggcgcggacgcggtgattcgtgtcagcccgccccggttcaccgcccgccccggcgaggacagccccgggcagatcgaggtcctcgggcacggcaagccggtcacgttcttcggcctgcaccacggcaccggcaagtatttcatttgggtcgacggctcgccgcacgtcctcacgccggagcacgctcccctcgtcacccgccagcagtacgacgccttcctcgacgcggtgaacgagatccgccccttcgcgcgtcgggccgtgcacgagtccccggacgcggcctggacgttcgatccggccgctggcctgcaccggccgacggctctaggcgagccagactggcaggtcagcgagggcaaggtcgtcgacgggcgcaatcgcttcctgatccgcctgaccagcaacacggtccgggcgaacgaggcggcggcccgcgacgctggggccggccgggcgcagctctgcgccctcgtcgagcaggagttcctcgcccgggccgagctgagcggtacgtggacgcccctcaaggtgaagaccgagatccggtcgatggtgacctcctcgtgcgagtggcacatccgcgaggagcggttcacccgaatccgccgcggcgcgccgcttgcggtcgatggcgagggggatgtccagcacgctccatcccgcacggacgacctggccccggccgacgacatgccggagctggcccacatccggtccgacttcgcgcgcttcctcgcccggtccggccgcaagggctacacgctgaaggccggagcccatccgatccgggccctgaagcgggctctgctcacggacgagctcttgcgcacgcaggccgcccaggccgccaccgcatcggtccgggatcatcaggaccgctggatcgacggcctgtacgagcgcgccgccgagcgccgcagccgggagcttcgcaaggacaagacgcccctcgacgccggcctgatctcgatcctgcgcggcgacgccggcgtgggcaagacgtcgacgttctggcgggccctggcgcgggccgtcgacaagcgcggccgcctcggcttccccgtaggcttcgccatgccgacgcacgccaacatcgaggactccctggagagcgcgtcgaaggcgcagctcgcgtgggagcagagcgtctccgaagcggtcgaggcgggcgagaaggccggcctcaaggtcgtcgtgttccgggggaagctgcgcacgaattgcggcttcaaggagcagatccggtccctgaacgcggcctcgatccaggccgagcgactgtgcaagagccgcgtcaacgtcaacgagaagatccccggcgccgagcccgaatgggaggagcgcctctgcccgatggtcgaggcatgcgagtaccagcgcaccctcgccgaggtcgccaccgccgacgtcgtcctgttcgcgagcgcctacctctcggcgaaggcaccggccgccctgacgaaggccttgctcgccctcgtcgttgatgagcgcccctacaacggcctgctcgggacgaactcgcggaaccccatgccggtgtcggtgctggagctgccgcgcccggcgccgcgcctcctcgacgaagagatccaaccgctcctggagcaggccaacccccggcaggcgatcgaggaccggcgcgagggctacctcgccgaccggcacgccgcggtccagatcgtgctgccccacctgcgcaagcgcgacgccggggccgccgtcgtggcgctgcaccggacccggaatggcaaccagcgcaccggcctggagatcgcccgcagcgcctacgccgtctgctcgcgcggctcgaatctcgccaaggacgtcgcgcccggcatgaccgaggaggccgcggccgcgctcgccggagcgccccgcggcgagggcatctgggacgagcgccggttctggagcctcgtgatcgagcgcctggaagcgctggcgcacgatgaggagaacccgggcacgccccggcagtccaagggcgcgagcgacgcccgcctgcaggtcgtctcgggcgagaccggcccggcgatccgcatgagctggcgcggcacccccggcttccccgggatcccgctcctgatgctcgacgcctcggccgccccggcgatcgtcaagaagatctgggccgaccgcgaggtcgaggtgctcgacgtccaggccccgtgccacctgcgcaccgtgctcgtgaccggttcaacgttctccgacttctcgatgctgccgggccggagcaggagagcccgcacgatcctctcggcctcgaagcgggtccagatgcaccgcgaggtcgtcacccggctcgccggcgtccacggctacggcaagctcctcgtcggcggcaacatgggcccgatgacggtcctgcgcgccgggtggcagccgccggccaacaccgacttcgtccacaacggcgccatgcgcggcctcgaccagttcaagaaccacgcggccgccctgttgctcggccgcctggagctgccgccgcgggcgatcgacgccttcgtggccgccctgacgtacgacgacgacgccccggagcagccggtcgaccgcaacggcgacggcctcgacgacgagggcaagcccctgcagcccctcatcggcgagaagctcatcgccatgcgcgacggtcgcgacatcgccgtcgacgacgccacgtacgagggcgcctgggcccgcctgatccaggggcagttccgcgaggaagaggttcgccagttcgtcgcccgcctccgcccggtgcaccggctcggccgcgccccggtcgcttacgtcgcctgcaccgcgattccggaagggctcatcgtcgacgacgtggtcgacatccgcgacctgctcaccccgggcccggacaacggccagcgcccgttcgagctcgcccgcgccaccggcggcgtcctcgacgcgcgctacggcgtgcaggaccgcgaggatctcgtcggcccgaaccgcacggtcgagagccacctcgcaggcgcgcgcctggagcgtccgggcttccccgagagccagggcacgtcccgcatccgctggcggctcccaggcggcgagtggacgacctcttcggtgctgacgtggcccgagaacccggtcgcccccctcgcccgggcgatcgccgccgagcagggcctcacggtcgaggaggccgaggaagccctggagtgggagatcctttgggaggggacgccccgcgccgcctccggcacgaaggcgcccgacaagatcgatcgggcgaaccttggtttgaagccggatgccgagctgacgcacgaggacgcccggcgcgcccacgcggaccaggaggcgaccgagcgcgccgacatgatcgcgcgggtgaaggccgagctctccggcctgccgatcgacgcacccgacgaggcgatcgaggccgccctgcgccgcaagcggatcgccgcgatcgactggagcaagctcgccccctaccccggggccgaccgcaagctgcagggcgtctcgctcgccgagctcgtgatcgcccggcgctacggcctggacgacgccgagatcgaggaggacgaggactga

SEQ ID NO: 8067 - DNA, 351 bp, Methylobacterium sp.
gtgagcctcgacaccttctatccgcccgtcgccccgtcgcccggcacgtctcgcaagcccgagctccggcttctcgaagcagatttcggcgaaggctatagccaggccggcgcggacgggatgaaccacatccgcgacgtgctcaccctcaagtgggatgtgctcactcaggggcaggccgacgccatcgacgccttcctccgctccaagcgcggcaccatgccgttcctctaccagcacgcccacaccccggccccggtcaaggtgacgtgcaaggagtggaaccgcgacgacgaggccgctggcctgtgcaggttcaccgcgaccttccggcagagcttcgcactctga

SEQ ID NO: 8068 - DNA, 999 bp, Methylobacterium sp.
atgagccacgagagcgccgccgggatcctcgatgtccccgccctgatcgacgcccgcccgatcggcgcggcgcaggtcctgacctttctcctctgcttcctcgtggtgctcctcgacgggttcgacaccgcggccatcggctacatcgcgccctcgctgatgaccgagtggggcgtgggccgcgccgcgctcgccccggtgctgagcgccgccctgttcggcctcgcgatgggtgcgctggcagcggggccgctggctgaccgctacgggcgcaaggcggtgctggtcgcagcggtggtcgaactcggcttggcctgccttgcttccgccttcgaggctgatctcccgcaactcgcggccctgcgcttcctcaccgggctcggcctcggggcggcgataccgaacgccgtgacgctgacgagcgagtacggcccggtccggcgccgggcgctgctcaccaacatgatgttctcgggcttccccctcggcgcggcgctcggcggcttcctcgccgcctggatgatcccgacgctggggtggcgcagcgtgctcctgctcggcggcgccgcgccgctggccctggctgcgctgctggcgctgctgttgccggaatctgtgcgctacctcgtggcccgcggcgcggcgccggcccgcatccacgcggtgctccgcctgatcgcccccgggactggaccggccgccggctacgacctcggcgcggcggccgcggggcccggccggccggccggcctccgcctcgtcctctcgccggcctaccggatcggattggtcatgctgtgggccgcctatttgatggggatcgaccggttcggcggcatcgccggctccttcctggtggcggaacttgccgggacgagcctgccggtgaccttcgcgttagtcgcggttccggccctgctcgcggccgccgccgtcgccaccaaacgcaacgcccgccgcggcgcggccccggcccgcgccgccgccctcggccactga

SEQ ID NO: 8069 - DNA, 3195 bp, Methylobacterium sp.
atgtggatgccggttggccgggacggctcgggcatgagcgggcaggccctgcgcgtcctgagaccgcgcgatgccggcgaggcgctcgccgccctgtcgcggcacggcggggaggcccggctcgccgccggcgccaccgcgctccagctcgactgggcggcgggcgcggagcggcccggcctcctcgtggacctctccggcttgccggagctgcgcggcatcgaggcatggggcggcggtctccggatcggcgccgcgacgccactcgctgagatcgaggccgacgcagacgtcgcgcggcgcgctccccttctgagccgggcggtgcggaccgtcgccgccccggccgtgcgcagcctggcgagcctcggcggcaacgtggcggggcggaccggctgctgcctgcccgctctggtcgccctcgacgcggccctcgacatcctgacagcggcgggccgggagcgcgtggcgctcgccgactggctcgggcaggcagcccgccccgcgagcctcatcctcgccgtcacggtccccgagcagccggagggatcgcccgcgacattgcgcaaggtgggcctgcgggccgccttcagcccgagcgtcatcggcgtggcgggcctgctccccctcgacggaggcgtcatcggcgcggcccgcctcgcggccgggggcggcccggtgcgcccgcagcgtcttccccgttccgaggcccttctcgcgggccggtccctggccgccatcgactgggcgggcctccacgccgaactcctggccgagatcgacgcgccgggcgatgacctgcgcagcgcccgctaccggcgctgggcggcggccaacgccctcgtcgccagcctcggcggggccgacaggctttcgggcgcgcgagccaccccacggcaccggcccgtcggcgcaggcgcgcccgcgggcgagcgcgtggtctcgcgcgcggccggtccggcgggatggcaccagcgcccggacatcgccgacaaggttcacggccggctcgcctatcacaccgacgcgcgggtgccgggcatgctcgtcggccgcatcctgcgggccggccggcctcacgcccgcatcctggcgatcgacaccgcggaggcggaagccttgccgggggtggccgccgtgttgacccaccgcgacgtgccggggctcaacgcctacgggatcgtggtgcaggaccagcccgccctctgcggcgagcgcgtgcgctatgtcggcgacgcggtggcggcggtggccgccgtggacgaggccacggccgaggccgccctcgccctgatccgcgtcgcctacgcgccgctgcccgtcctcgacaccccggaggcggcgctggcccccggcgcacccccgctccatccggagggcaacctgcgccgcgaggtccgcgtcgcccgcggcgacaccgaggcggccttcgcggcctgtgcccacgtggtcgagggcacctacgtgacgccgcggcagatgcacggcttcctcgagaccgagggcggctgggcgatggtcgaggccgacggcagcctcacgatccgcgtcggcgggcagcacggggcccgcgaccggctccagatcgcccgcatccttggctggccggaagcgcgggtacgggtcgtcaccagcccgacgggcggcgccttcggcggcaaggacgagctgaccgtgcagccggccctggcgctgctcgcggtgaagaccgggcggccggtgcgccttcatctcggccgggcggaatcggtggcggcgggcgtgaagcgcaacccgatgcgaatccgcatgcgcaccggctgcgacgcgcagggccgcctgctcgccgtcgccgtcgagctgattgcggatggcggcgcctacgcatccttgagcccagcagtgatcgagaccgcgctggagcattgctgcggcccctacctcgtcccgaacgtcgcgggggtcgcgcggctcgtggcgaccaacaacggcacctgcggcgccttccggggctttggcgccaacgagatgaccttcgcgatcgagtgccagatcgggcgcctcgcggaggccgtcggctgcgatcccatcgctttgcgccgccgcaacctgcgggcgccgggcagccccggcttcttcggccagacggtggggccgagcgagcgcctcgccgagatgctcgacgccgccgcagcgagcccgctctggtccgccggtccggaaggcgcgggagcggcgatcggcgtcggcctcgcgctcaactatcagggcaacggcctcggctcgctgccggaggatcgcgctgccgtggaactgcggctcgcggccgacggcgcgatcgaggcgctctacggcctcgacgagatcggccagggtctccaggcggcgatctgcagcgctgtggctgcgcgcctcggggtggaccgcgccgagatccgtcccgtgatcggcgataccgggcacaccccagattctggctccaccacagcgtcgcgcggcaccttcgtggtctgggagggggcccggagcgccgcgcccgccttcgcccatgccctcctcgacgcggcggcgcgccgcctcggcctttcggcggcggatctggcgctcggtcccggcggcatccgcgaggcgcgctcgaacagcgggcgccccctcctcggcttcgccgaactcgccgccgggcttccgcccgaggccctaccccaatcccgcgccgccttcgagtttcccaaggccgactacgtggcgggcaatgctcgctacctcttcgccttcggcgcgactctggcccgcgttgccgtggaccgtgtcaccggcgaggtccgcgtgctcgacctccaccagcacaccgccgccgggccggtactcgatgctgccgcctatctcggccagatcgagggcggcggcgtgcaggggctcggcttcaccctgaccgaggacgcgcggatggaagcgggacgctacgcggccgcgaatctcgacggctacctgatgcccaccatcgccgacgcgcccgagcggagccgggtcctcgccctggaggatctcgattccggcgacccctacggcccgcgcggcatcggcgaactcggcatcggcgcggtgactccggcgatcgccgcggcggtggccgacgccatcggccactggccctgcgccgcacccttctcgcccgagacgctcctgtgcgcgctcggcgacggagcggcggcgtga

SEQ ID NO: 8070 - DNA, 1761 bp, Methylobacterium sp.
atgcttgagcgcgccgcctccgtcatcctgacggacagcgccggccggcgcaccgccgtcgcctcagccggcaccgcgaccggcgcgaccccgatcctgttcatccacggggtcggcctcgaccacaccgtctggcggccgcagatcgccgccttcgccggacagcggccggtgcacgcctacgatatgatgggccatggcgcctctgaccggccgaagggcaggccggaactggcggactacgccgcccagctcttcggcgtgctcgacgcgctggggatcgagcgggcccacctcgttggccactcgatgggggcgatggtggcactggaggcggccctgtcgcatccggcgcgtgtcagcagcgtcaccgcgctcaacgccgtctaccgccgcaatgccgagcaggctcaggcggtccttcgccgggtcgaggcgctggaggccggcgaggccagccctgggatcgagacggccctggcgcgctggttcggctccccggtgccgccgcatctggcggacgaggcggaacggatgcgggcgctgctggagcgggcggacgagcagggctacgctctggcctaccgcgtcttcgccacggccgacgccgcctatgcggaacgcctcccgaccctgtcggtgcccgccctattcatgacgggccagcacgatcccaactcgacgccggagatgacgcgggcgatggtcgccgcggtgccgggcgcccgggggctcgtcctgtcgggcgagcgccacatgatgcccctggttggggcggcccgggtcaatgccgagatcgcgcgtttcatcaccggcctcgaggtggaagaacccgccgccgccaagcgcttccgcaacgcgctcggcaccttcgccaccggcgtcaccgtcgtgaccacgttgcaggagaacggcgagccgcggggattcaccgcgaactcattcagttcggtctcgctcgatccgccgctcgtctcgatctgcatcgcccgcacggcatcgagccatccgatcttcaaggccgcgccgcggttcgccgtcaacatcctggcgcaggaccagcgcgatgtgtcgggcgtgttcgcctccaagcggccggacaagttcgagcaggtcgcctgggtctcgggtgtcaccggcgcccccgtgctggagaattgcgccgcgtggttcgattgccgccttcacgaggtggtggcggcgggcgaccacgacatcctcatcggcgaggtggtcgatttcgacgccagccctcagatgccgctcggctattgccgcggcgcctatgtcgacttcggcctcgcccaagatgcgctggcagccagcgcccgctccatcgaggtccgggcgatcctcgaatcggagggcgatgtccttctagtcaaggagcgtgacggccagttcgccttgccttcgggcacctgcatcgaaccggcctcggaccctaagagccttcacggccgactcactgccctgggcttcgctgccgaactcggcttcctgttcgccgtgtacgagaatcccgacgcggcgggcgccccgacctcgatcgtctaccgcgggactttcaccggccatgccggtcccggcacatgcctctggccggtcgcggatctcgcgaactgccccgttcgggatccggcgagccggacgatgctggagcgctacgcccgcgagcgtcgggagaacgccttcggcatctacgcgggcaatgtcggcggggggacggttcaggccctgcacccgggtgcggcggcctga

SEQ ID NO: 8071 - DNA, 474 bp, Methylobacterium sp.
gtggcgaaagcgacagaactggttattgccccggcggatctccagccgcggctcggcgcgatcgaggatcttgtgggctaccatctccggcgggccagcacggccgtgcggaacgactttgcccgcgtcatcgaaggcagcggcatgcggcaggtgctgttcggcatcctgtcggtcgtcgaggccaatcccggcatcaaccaaggggcgatcggccgcgtgctcggcatccaccgcgccaacatggtcgtgctggtgaacgagctgatcgagaagggctggatctcgcgccgcgccgacgaggccgatcgccgcgccttcgtcctcgacctgacccccgagggacaggcggtcttcgcggaggtgcggcggcagctgcacgcccacgaagcgacgctgctcgccgagctcgatgcggcggagtgcgcccagctgatcgcgctcctgcgccgcatcggtagcaaggatgcctga

SEQ ID NO: 8072 - DNA, 210 bp, Methylobacterium sp.
gtgctcgtgcagaggtttcagccgaacccacaagccggggcgacgctcctcccgctccaactcgttgcggacagcgagcttgacggcttccgtgagtggaacgcccttccgctcggccaagaggcggacgatgcggtccgtctccgcagcgccgatgtgcagggccataagcgcctcctggcgggccgtgtagaaagccggtgcgcatga

SEQ ID NO: 8073 - DNA, 177 bp, Methylobacterium sp.
gtggcgatcgtgacggaaatcagaagctggcatcgtgcaccgcgggacaggggtgtctcggacgttcgcgcgaggctcgcgcggacactgacgacggcgctccggcggatggccgaggcccgctacgcgcagcaggtcgatcggctcgcccgctccgggcatggcggcgtgctctga

SEQ ID NO: 8074 - DNA, 129 bp, Methylobacterium sp.
atggttgtggccaccaccgcgccgaaaaatccgccgttcaacaccaggattcgcgagaagatccgcgagcggatcgcgctggccggcattctggatctgagcggtcggatgaagcgtgcggatcgctaa

SEQ ID NO: 8075 - DNA, 1155 bp, Methylobacterium sp.
atgcacgttgcggcgcttgaaggcgcccccatcgagttgaaggacgccgagggcgagaccgacgcggccgaggccgtcgccaaggctctcggcgagatcgagaccaagctcaacgcccgcttcgacgccatcgagaccaagagtgccgaccggctcgaccggctcgaagcgcgcctcaaccgccccggcctgtccgccccgaaggccgacgacgccccggccggcgagatcgagcgcaaggcgttcaccggctacctgcgcgccggtcccaacggcctcggcgccgaggagaagaaggcgctcagcgtcggtgtgcagactgccggcggctacctggcgcccgatcagttcacgctcgacttcgtgcgcgacctgaccctgttctcgccgatccgcggcattgcggacgtgcgcaacacctcctcgcacaccgtgctctacccgaagcgcacggccatcacgaacgcccgctggcagggcgaggctcagcccacgaccggcagcgagccggccttcgaccagggcgagatcgaggtgaagaacctcgccactcacacggacatcaacaaccagctcatcgacgatgccgtcgtcgatatcgaggccgaggtgcggctcgccctggccgaagacttcggcgtgaaggagggcaaggcgttcgtctccggcgacggcgtgttggagcccgagggcttcatgaccgcggccggcgtcccggtcacgctcaacggccacgccgcgaacctctcgacggaccagcttatcgtcatgctctacagcctggcgccggcttaccgctcggccgcgacgtgggtgatgaacggcaacaccctggccgtcatccgcaagctgaaggactcgcagggtaactacctgtggcagccgggccttgtcgccggccagcccgagacgatcctcggccgtcctgtcgtcgaggccgtcgatatgcccgacgtgggcgccaacgccttccccatcgcgctcggcgccttcaaggccgcctatcgcatctatgaccgcaaggccatggaagtgaaggcgaacccgttcctgctcatgacgcaggaccagacccggttccacgccttccgccgcactggcgccgccgtggtgcagccggccgcgctccgcaagctcaagatggcgacctcgtaa

SEQ ID NO: 8076 - DNA, 1173 bp, Methylobacterium sp.
atgacctttcacaaccccatccacgaaggcacgcccctcgaaaccaaggccgagggcgatcaggcagagaccgacaccgaaggtgcgaccggcgttgccgacatcgtgaccgacgcgctcgacaagattcgtgaggagttggtcacgcggctggagaagctggagaccaaggccgaggcgaccgaccgccgtctctcccgtcccggcctcatcacgagcccgagcgaggctcccggcgccatcgagcgcaaggcgttcagcgccttcatccgtcgcggcgtcgagaagctgtccgccgacgagaccaaggccctcaccgtgtcggtggatgcggacggcggctacctcgcacccgtcgagatctccagcgagcttctgaagctcaccaccgagttctccccgatccgccagtatgcccgcgtcgtcacgaccggctcgcaggcgaccaagtatccgcgccgcgtctccggcgtcaccgcgacgtggacggatgagacggccgagcgcaccgaggacgagccgacctatgagcaggtcacgctcacgccctacgagctggcgctgtcgatcccgttctcgcggcagcttctcgaagacaacgcctacaacctcgaaggtgagctggcgctggagttcgccgatgcgttcggcaccgccgagggcgcagccttcgtgaatggctccggcgtcggtcagccgaagggcttgctcaaggccgccggcatcgccgatttcaagacgggcgccgccactggcttccctgccgccaacccggccgatgtcgtcatcaatatgttccacgctctgccgaccgtgcacgcgcagaatggcgtctggctcatgaaccgcaagacgctcggcatgatgcggacgtggaaggacggcaacggtcgctacttgctcgccgacccgatcaccgccgacgccccgacgaccctctacggccgccccgtggtgcagtgcgtggacatgcccgatgtggccgccggctccacgccgctcgtgttcggcgacctgtctggctaccggatcgtggaccgcatccagccgaccttcctgcgcgacccgttcacgctcgccggccggggcctcatccgcatcgttggtcacaagcgcgtcggcgcggatgtcacccaccccgaccgcttcctgaagctcaaggtcgcggcctaa

SEQ ID NO: 8077 - DNA, 393 bp, Methylobacterium sp.
gtgaagggccgcaagcctgtcggcctcgtgaccgcgagcgccccgcccacctctctgccgcgcactccggcatggttcgggcgggaggcaaaggccgagtggaagcggatgctcccggtgctgatgaacgagcgccgcacgctcgatctcgccgacctggccgccttcacgtcctactgcctggccgtggagcaggttgccgttgcctctcgggagctcgggaccgcctacacctaccaggccaacggcctcacgaagaagcacccactcgtcgatattcgcgacaaggccatggcgcaggtgcttcggcacgccgccgagctcggcatgaccagcgtcagtcgctcccgcgccgcgatccgcgacgacggggaagacgaccttttagcctga

SEQ ID NO: 8078 - DNA, 402 bp, Methylobacterium sp.
atgaagggtcgcaagcccggcacgatcacggccggcgccgatgcgcttcagcgtgtgccgtcgccgccgtcgagcctcaccggcacggcccggaacgagtggaggcgcgtggctcgcatcctcgtggcgcgtcggcacctgaccgccgccgacctgggcgcgctggagagctattgcgtggctatcgggatgcgcgacgacgcccggcagacgctcaccgccttcggcggcacgacctacacagccggcaccctcatcaagcagcatcccgcagtcggcatcctgaagagcgcgctcgatgcctgcgcccgcttcggcgccgaactcggcctgtcccctgtttcccgctcccgcgtgacgaccctggaatccgatgccgacgacctttcccacctggattga

SEQ ID NO: 8079 - DNA, 207 bp, Methylobacterium sp.
ttgggcctcaatcgccggcgcccgcctccgcgggctcaggcttccgctccgctcgacggacttccagaactgaagttctggaagtccccgctgcgcgcggcgctcttcgcgccgcaaagccgccatgcggcttcgagcagcggccctgcctggagcttggccttcggcttgagccgccgggccgttccgcgctacctcgtgaagtga

SEQ ID NO: 8080 - DNA, 468 bp, Methylobacterium sp.
ttggcggctctggtgttgttggttttgattataacttgcgccatcttgtataatttcgagacttacatagagtatccatcgatattcgggggaggtgataggttcttcgttctcaatgggagttggatgctcatgcttgcgctgtacgcattcctgctcggagtgctcatgcacgcggcaggttgcgcggcctcgggggcccaggcgatcgaaacggaatggtccgcgcgactcaggctgtcttggacggaaacgcgcattgaccatcggggcgtcaccgtcgagggacccgccgccgcagtctttcaggcttggtcgaccatgacggaggtccgatccgaggcgggcctgatcgctttcgtgacgaacggcgtgattctgctggccgtccccgaagcggtgatatcgactgaggaacgcgatcgcgtcgtcgcctactgtgccgccaggatcgccgaggcccgctag

SEQ ID NO: 8081 - DNA, 708 bp, Methylobacterium sp.
atgtccgacgccacgttcgaccacccgcgggatgcgggccagccgccctcgctgttccccgcctaccgctcgaccgttctgcgcagcccgcgcgagccgctggtgcgaatcccccacacgcttaccgagaccaccgggccggccgggacctgggaggccctgatgggcccggccatcgccgacctgacccgccacgaccgggggccgggcgtggcgatcggtcagcgcatcgtggtcaccggccgcgttctcgacgaggcggcgcggcccgtgcctgacacggtggtcgaggtctggcaggccaacgccgccggccgctacatccaccgacgcgatcagtgggatgcgccgctcgatccgaacttcaccggcaccggccgggtcgtcaccgatgcgcaggggcgctaccgcttcaccacgatccggcccggagcctatccatggggcaaccaccgcaacgcctggcgcccggcccatatccacctgtccctgcttgggccggccttcgccacccggctggtgacgcagctctacttccccgacgacccgctcatcgagatcgacccgatcgccaatgccgtgccgatgccctaccgcaaccgcctcgtcgcgcgcttcgacatcgacacgacgcagccggattacgccctcggctacatcttcgacatcgtgctgcgcgggcgcgacgccacgccgtgggagcattga

SEQ ID NO: 8082 - DNA, 714 bp, Methylobacterium sp.
atgaccgacgccctcgaaggcctgccccgcaacgccgctccccgcgccgacaaccaggacccagccttgttcggccagacgccctcgcagacggttggtccgttcttccattacggcctgccctggaaggggggcgccgacctcgtcggcgcttccgacatcggcgcgcgcctcgacctgtttccggaggagcatgacgtcctccacctagcccccccgcgcgggccggtgacgggcgagatcgtctccgtcgtcggtacggtgcgggacggggcgggcgagccggtcaccgacgcgatgatcgagatctggggtgccaacgccgccggccgctaccacggcgccgccgacacccgggcggagatccccctcgatccgggcttcatcggcttcgggcgagcggcggtcgatgccgcgggcggcttccgcttcctcaccctgcggccgggccgtgtgccggtcgcggtcgagagcaaccgctggcaggcgccccatctcgccatcggggtcttcggccgcggcctgctgaagcggctcgccacacggatgtacttcgccgacgggaccgacaacgacgcggacccgatcctcgccctggtgccggaggcgcgccgccgcacgctcatcgccccgcgcgtcgccgaggcaccgccgacctatcggttcgacatcgtgctgtgcggggcggacgagaccgtgttcttcgcgctgtga

SEQ ID NO: 8083 - DNA, 306 bp, Methylobacterium sp.
ttggcccaaggcgtgagcgaaagcacggacctgtgctgggttcacgatcacggctggcagcctccaggtggtgagagcacgtgccaccatggcttccaaaccgccggttgcctccaggacgacgagcttcggcttcaggggccggaggcgttcgcacagttgctccacgccctcggtcgtacggtcaacggcgaagttcgctccagagggatgaacgtgaatatcgaggcggtcacgggccacgtcgatcccgacaacaggagcgtccatctgatcccatccttgcgcaagcgggcttcgcgttga

SEQ ID NO: 8084 - DNA, 1524 bp, Methylobacterium sp.
atgcaggcgacgctggcagcagcgcgcactcgctcgaaggagaagcagaccgtcgcgtccccggcacgccgtggtcgtccgctcacagcgcagcagatggcccgacagcattacctctcacagatccagttcgatcaggaggtccgtgagaccaaggagcaggccagtatgggcttcttcgatgaagaagcgctggctgggcttgcgcgggctatgtctggtgcggccgagaaccccgaactggaagcgctcgtgggtcgtatcctgacgagcttccggttgagagggcatacgaccatcacaccggcttcaccggagttcaggaggacggcgatggcgctcgcggtcgcagaacatgaagccattgccgtgtcagccgctcgggacgatggcgacttcacagcggcaacgatgcacccgcttcttgcggaggaagcgcccctcgaccccgtgccagcctcgccccgcatcctcggtccactcagcagcaagcccctgcatgagattgtcccgttggtgatcgccgaaaagaaggcaagggtagcaagcgccaacgagtatgaagtcgcgatacggatgttcgaggaacaccttggcgaaccgcgcgctgtctacaccatcactcggcgcgacgtgatctcctacaagaccgcgctgatggaaacgccaacgagctacacactgcgattccctggcgttccgctgccggaagcaatcaagcgcaacaaagcccgagcatcgcctttcccgacccttcaagccaagacaatcaacgcgaagtggttgtcacgcttgaactcaatccttaagtggtgcgtctcgaacgacgtgctaccggacaacccggcaagcggtatcaaggtcgatcagatcgcggggacggcggcgccgcgcgtgccgttcactcccggcgacctgtccaagattttcgcgccacccctgttccagaggggagccaccttgggggagcgccagtgggcgaccctgatcgcgctgcataccggcttccggaccggcgagatcgctcaactgaagctggatagcgtgcgacatgaacgcggcgtcctagccttcgccgtagaggaagacaccaaaacgcggggctccgtgcgcctgacaccggtccattcgaccctggtccggctgggcatcgaggcgcgcgtcgcggcgctacgagccgctggcgagacgcatctgtttccggaatggtatcgaaaggcgaacgtcgtcccagcctccggtgcccagcgcgcgcgcaacgcgccctactcgcaagtgatcccgcgctggttcaaccgaacctacctgccgtctgtcgggatcgttgatgatcgcaaggtcttccactcgttccggcacaccctcaagacagcgctctcgcgtgcaggcgtgccgcgttcgatcagcgacgacatcaccggccacgacgaccaaacagcgggcggtcgctacgtccatgaaacgtcggttgaggcgatgcgcgatgctttggagaagatccacttggatggctttacgctctga

SEQ ID NO: 8085 - DNA, 1674 bp, Methylobacterium sp.
atgcatcttctggatcgcgatgggcgctactcagcccgcgtggccgtgccgaaggcgctacaccacatcgtcggcaagcgggagctgttgcaggccctcggacctgaccggacactggctctccgcgcgctcccggcggctgttgccgccatgcaggcgacccttgaggcggcccgcgcccagttgaaggggaggcagagcgccagcgcaccggcacggcgtggtaagcctctcacgccgcagcagatggccttgcaacactaccggactcagatcgccttcgatcaggaagtgcgggaggaggggaggggacacactcacggcttcgtcgacgagttctacgcggaggacttgaaacgcgctgcctcgggggcggccagcaacgaggagctacaagtcgtcgtcggccgcatcctcgacctcttccgcttccagggtcacacgaaggtcacgaccgacgatcccgacttccgcaaggccgcgatggcgctcgccgtcgccgagcttgaaagcctgcgcgtcgtcgccgctcgcgacgacggcgacgttgcggcggctacgtctcacccgttgctcaaggaggaggcgcccttggagtcggtcgcaggctcgcctcggatcattggccccgacagcaccaggccgctcaaggaagtgctttcgatcttcgccggggagaagggatcacgacccggcacggtctacgaatatgaagtggccgttcgcatgttcgaggagtttttgggcgagcaacggcccgtctacgcgatcacaaggcaggatgtgcttggttataagcgagccctgatggagacgccggccaactacacgaagcgattccctaactcgacgcttccagaggccatcaaactcaacaaggcacgcgcgcaacccttcccggtgctcaacacgactacgatcaatgacaagtggctcgcgcgcttacactccatcttgaagtggtgcgtcagcaatgacgtgatccccgacaatccgtcgagcgggattaagatagagcaggttaaggcggcttcggcctcgcgcactcacttcacaccgggcgatctcacaaaaatcttcgcaccgcccctctttgaggacggcaaatcttacggcgagcggcattggatggcgctcgtcgcgctccacaccggctttcgggcaagtgagatcgctcagcttaagctggacagtatccggcaggaacgtggtgtgctcgtgttcgccgtggaggaggagacgaagaaccgggcctcggttcgcctcaccccggttcacagcacgctcattcggcttggccttgagaagcgcgtcgccgcccttcgcgcaaagaaggaggcgcggctgtttcctgattggtatggcaaagggcaagcactcatgcgctcggctggagagcgcaaggtcaaccagccctattcgcagatcgaaccgcgctggttcaaccgcacctacttgccgtcagtcggcatacatgatgaccgcaaggtgtttcattgcttccggcacacgctcaagaccgccctcgcacgggcaggcgtgccgcgctccatcagcgatgagattacgggtcatgatgatcggacagcgggcgccaagtatgtgcatgagacctccgttgaggcgatgcgtgatgctctcgagaaaattcaactggacgggttctcgctgtga

SEQ ID NO: 8086 - DNA, 837 bp, Methylobacterium sp.
atggatctcgaacctgcgatccgggacgaatggtacgtcgtcggagcgatggcggcctgccgcgaggcccccgtgcggacacgcctcctcgggaccgacatcgtcgtctccgggagcgatccggtctcggcgcggacggcgtgcgggcgggacctgcccgtgcgcacgcgctacggctgcgtctgggtcagcctgggcgcgccggagaccgagccgcccgcgatccccgaggccgacgaggacgaccggcgccacgtgctctgcggcgtcgtcggcctgcgcgcctccgggctgcggatcgtcgagaactttctcgacatggcccacttccccttcgtccacaccgacatcctcggcgccgagccgcacaccgaggtgctgcattacaccaccgagatccgccgcgacgtcgatgaggtctgggccaccaattgccgcttcttccagcctcaggcggcgctctcggccaagggcgggatcgagacgcaataccagtaccgcgtcgccacgccccacgtgaccatgctttacaagacctgccccaatgcggcgaaccggtgggacgtgatctgcctgttcgttcagcccctcgatcccgaccgctgccgggcccatccggtgatgttcctgatcgacgacgcctcccgcctcaccgatctcgtggcgtttcagcaggtgatcttcctgcaggaccgcatcatcctggagaaccagcggccggttctgttgcctctcgaacctcgcgccgagatcccgactcgcgccgactcgtcctcggtggcctaccggcgctggctcaaggagaaaggcgtccgctacggcacgtcgatcgcgtga

SEQ ID NO: 8087 - DNA, 936 bp, Methylobacterium sp.
ttggagctgatcaccggcatcctgtccacggcgctcctggcgggcggggtcctcgccctcgcggcgctgggcgaggtgctcgccgagcgtgtcggcgtggtcaatctcggggtcgaggggctgatgtccctgggcgcgctcacggggatcgccaccgtggcggcggtgccgagcccggccctcggtttcgccgcggcgctgggcgtcgggttcgccttcggctgcgtctttgccgccgccaccgttctgctgcgggccaaccaagtgctgtgcggactcgccctcacgctgctcggctccgggctcgcggcgacgctcggccgctcctatgccggcgccccggccgccgcggcgttcccgcgggtgagcgtgccggtactcagcgagatcccggtgctcgggccggccctgttctcgcagaacgtgctgatctacgcgatctacatcgtcctgccggtcgggctgcatctcctgctgttccggacgcggcacgggttgaacctgcgcgcggtcggcgagaacccggccgcggcggatgccgcgggcatcccggtcgcggcgatccggttctggtacgtcgccctcgggtcgagcctcgccggcggcgccggggcctacctgacgctggccttcgtgccgtcctggtcggagggcgtggtcgccggccgcggctggatcgccgtggccctcgtcatcttcgccggcttcagaccgctgacggcggtggccgccgcgctgctcttcggcgtcattacggcgctcggcttcgtcggccaggcccgcggctggccggtggcgcccgcgatcctctcgatgctgccttatctcggcaccgtcgcgttcatcatcctgccggtggtggcgtggcggcgcctgcgtggctggtttgcggcacccgccgcgctcggcctgccctaccatcgcgacgtgcgctga

SEQ ID NO: 8088 - DNA, 1053 bp, Methylobacterium sp.
atgagctggcggttccagagggttccgagcgtcccggccggcgccgccctggccggacgtgtcggggcaatcgtggcggcgctcgcctgcgtttgggtggtcctgacgctcgccggcctcgcgccgggacgcctcggcgccgaggtgatcggctccgccttcggctccgtcgagggactggaggatctcgggctccttgtcacgccgctgatcctcacggggatcgcggtggcgctgacccagcgcatcggcctttggaacatcggcggcgagggccagttcaacgctggcgcgctggccgcgaccgccatcggcctccatgtcggcggcgacgacgcctgggttctgccgctgatggcgctcgccggagcggccgggggcgcggcctggatcctggtgccgacgctcgcccgggccttcgcgggggtgagcgaactcatcaccacgctcctgctgaacttcgtcgcggcccttctcgtcgcgtggctctgcaccggcccctggcgcgatccgtcgggccgcgcgctggcgaccacggcacgcatccctgccgaactgccgcccctcggcgataccctgcactggggctttcccgccgcggtcgcggtggcaatcctcgcggccggactgctggcctttacgcgcttcggctacgaggtgcggattgccggcgccaaccctggggcggcgctctatgccggcatcccggtccgggcccgcatcgtcgccgtgatgctgctctcgggcgccgtcgcaggcctcgccgggaccatcgaactcgccgggaccgtgcatcggctgcagggcggcatctcgaacaattacggctatctcggcatcatggtcgcggtgctcgcccggggctcctgcctcggcgtgattgcgggcgcggtgctgatggcggccctgctcaacgccggcatcgtgctgcagacccagggcgtgaacaccaacacggtgctcgccatcaccggcctgatcctgctgttcaccgcgatcggcgacgagatcgtgcattaccggcccgtgcgccggacccccatcctgggctga

SEQ ID NO: 8089 - DNA, 1116 bp, Methylobacterium sp.
atgagcgacgccgccctgccgagccgccgccatctgctcagcctcggcgccggcctcggtgccggcctcatcctgccacccggactgagcccggcccgcgcccaggcgccgctgtccgcggttcccgagaaggatgcggtgatcgccttcgggcatgtcggcccggtgaccgacgaaggctggacctggagccacgaccagggaatgaaggccgtgcaggccgccttcccgcaggccaagaccctgttcgtcgaatcgatcccctattccgccgacgccgcgcgcaccttccggaacttcgtctcgaacggcgcgagcctcgtcttcgccacctcgaattacggcgacttcttctccgacgtcgccaagcgcgcgaagaaggtcggcttcctcgaatgcgacggccggaccacgggcgacaatctcggctggtactacttcgcgcattggtacccgacctacgtgctcggcgtcgccgccggcctgatgagcaagacgggcaagctcggctacgtcgcctccttcccggtgccctcgtgcttctcctcgaccaacgccttcctgatgggcgcccgcacggtgaagcccgaggcgaccgtgcaggtcatctcgatcaattcctggttcgatccgcaggccgcgacgcaggccggcgtggcgctggccaacaacggctgcgacttcctcttcggcatcatggacgaggccggctaccttcaggtggcgcagcagcgcggcctcaaggccgcgatgtggaacaccgacatgcgccgcttcggccccgacgcctatgtcagctcgatcgtggtcgattcgcgcaagtactacgtcgatcaggtcggcaagcgcatcgccggcacgtggacgccgggcaccacgctcctgccgatgggcggcggcgtcgatcgcgacgcctggggccggaccgtgccggaggccgtcgcaaaacaggccgacgccgtgcgcgaaaagatcctcggcggcacctcgcccttcgtcggcgagatcagggacagcaagggcaaggtccgggtcgcggccggcaagaccatgagcgacctcgacctctacaactgggactggtcgatcgagggcgtgacgggcctcggtgcctga

SEQ ID NO: 8090 - DNA, 264 bp, Methylobacterium sp.
atgacctttaccggccggttccgggccgcgagcttccgggccttcgcggaggaccgcgcccgcctcctcgccctggactcggcctgggccgaggcgacacccgaccgaatgatcgtcgccatcgcgggccagcgcgatttcatcgatgccttcgagatggcctgcagcctcgggcccatggattgcctcgtccacgagatcgagcggcgcgacacggattgggccgggatcgccaccttcgagcgggagcatgacgatggatga

SEQ ID NO: 8091 - DNA, 654 bp, Methylobacterium sp.
atggatgaaccggacggttggtacgcggtcgcgctgggcgccgacatcgagccctcgacctcggcgggcacgcgcctgttcggccacgaactcgtggtctggcgcgacgccgcgggcgccgtgcatgtctgggaggatcgctgcccgcatcgcggcatgcgcctgagcttcggcttcgtgcgcggcgatcacatcgcctgtctctatcacggctggcgctacgacgcggctggccagtgccgctacatcccagcccatccggatctcgaggtgagcccgatgatccggacgcggacctatccgtgccgcgagcgggccgggctgatctgggtccgctggggaaggccggccgacgccccggagaccgcgcccgacgaggccgaggccgtccccgtctcgcccctgcgcagcctctacctcgacgcgccggccgcgcgcctcgcggcggcgctcggcggtgccgggtccgacgggctcgcccgcatcgatctcggcgggtcgcccgtcctcgtcgcggtgcagccgctcgccgcggaggcgagcgcggcccacatcgtggtgccggccgcgcccgatgcgccgacggccgatctcgcccgcctcgccgccgcctgcgtcgccctgcgccggaccatcgagggagccgcgccgtga

SEQ ID NO: 8092 - DNA, 654 bp, Methylobacterium sp.
gtgagccttgccgtgagccctgccgtgagccttcgcctctacgactacgaactcgacgagaacggctacaaggtccggctcgcgctcggggcgctcgggctcggctgcgagaccgtggcggtcgacatggtccccggcgccgagcagacgcgcgcccccttgatcgacctgaaccccctcggcacgctcccgatcctcgtcgatggcagcacggtgctgcgggaggccgaggcgatcctcgcctatctcgcgcggcgctacgatcccgccggcacatggctgccgcaggagccggcggccttcggcgagaccctgatgtggctcgccttcgccacgcgcgagctgcacgcggccagcctcgcgcggcgcgcggccctgttcgaccatccgggcgacgggccggaccttgagaaccgggcgcgggcggccttccgggtgatggaggaccatatcgtcctgcgcgggttctcgggcgcgagctggttcgcaggcacgggcccgacgatcgccgatctcgccctgttccccgccttcgccctcagccgggatttcgggatcgaccacgaggcctatcccggcctgcgccgctggagccgccgcgtccgcggcctacccggtttccgcaccatgccgggcattcccgactatcattga

SEQ ID NO: 8093 - DNA, 924 bp, Methylobacterium sp.
gtggacccgcaccgcctcggcctcgtctcgacgcggctgcactacttccagctcgtcgcccgcgcgggctcgatccggcaagtcgcccgcgcgctcaacgtggcgccctcctcgatcagccgcgtgatcgtccagctcgaggaggatatcggcaccaagctgttcgagcgcgccaagcagcgcctgcgcctcaccagcgcgggcgaactcctgctctaccgggcgcggctgagcctgggcgaactgagccgggcctgcaccgaggtcggcgaattacagggcctgcaccgcggcactgtcaccgtcgccctcgttgagagcgttgcccgcggcctgttcccggcggtgatgggcgcgttctgggagcggcatccgggggtcgcggtcgatgtccaggtggtgcgctcgacggaggccgccgcggcgatcgcggatggcgagtgcgagatcgccctcggcttcgacctgcgcgcgccgcggggggcccagcgcctcgcggccgccttggtcccggtcggggcgctgatgcgtccggagcacccgctcgcgggccgcgagtccctgcggatgttcgatctggcgcaggaggcggtcatcctctcggacaccagtctgaccctcggcgcggcgatcgaggaggctttggccgacgcctccgcccatgtcgggcggcgcgtcaccaccaactccatcgggacgatggcggcgctggcgagcgcgggtgccgggatctcgctccaggcccggctcggcgtcgaggccgagatcgccgaagggcgcctcgtcttcgtgcccctgcgcgatccgaagctgcgcccgcgccggctcgtgctcgtggcgcgcaatcgcgaccggctctcggaggcgggcgcggcgctcgcggcgatgctggcccgtgccgtcgaggcccagagccaagcctga

SEQ ID NO: 8094 - DNA, 1386 bp, Methylobacterium sp.
atgccccgcacgcgcactcgtggcccgctgatcgacccgacgcagctccgcgagggcttcagcaaccttgcacaggccttcgcgccgccctcggcgcaggagatctacctcggcgcgaagacggcctcggaacgggccagcgcgacgcggatcgccgacctctactccatggccggcggcagcgacgtggatcaggcccggctcgaccggctggccgggatcgcgggcgcctacagcccgaaccagagcctaaccgccgtcggcatgaacaacgccacgtcggtgcggaccaatgcggccgataacgagcgcgctctgacgcagacccgcctgcagcagcgaggcgagctcgaccgcgccatgctggcgccggtgggcgccggcggcacgcgcttcgtgccgggctcgatcgcctctgcctacggcgtttcggagacgcaaacgggcgtggtctcgctcaaccccggcgacacggcgaccctgccggacggccgcaccctgcagggcgccccgaagcccctgacggacgaccagctccgggcccagatccttggcggcctgccggcgaacgagcagcgggcctacgccctgggcggcacgccggtcgagaacgtgcagacgccgggcggcccccgcatcgccttccgcgccgatgccgtggggcaggcgcctgcgtcggacgtgtcgggcaaggtgcagaactactccgggccggacggcagccgcggcacggccgtgccgggctatggcggcaagctcgtcgacacgcagaccggtgcggagctgccggccggctcgacggtgttcattggtcaggcgcagggcactccggatcagttcggcaagacgacggaggccgagaaccgcgacgcctacgccgcgcggatggtggattcggcaacgcaggacatcctgtccgccttcgacacgggcaagctgccaacgcgcggcgacacggccaagcgggccctggccgagaacctgccggtgctcgtccagccggagctgacgaatagcatgtcgccggagggccaggccttctaccagaacgtccgcaccgctctgccgatgcagctcctgacgcagtcgggccagggcgtcacggagcgtgagtacgagcgcaagatggccgagctcgtgccggtggcaggcgaggcgcccagcgtcacagcggccaagcgccgccagttcgcgacctacgcggccgcggtgaagggcctcgccggccgggcgctcgacaaggtcaactccgttcccgcgcaggctcccgccggtaccgccgccccggcggcttccagcggctaccccgacggaacggtcatcgagaacgacaccggccagcgcatgatccgccgcggcgggaagtgggagccccacaatggatga

SEQ ID NO: 8095 - DNA, 2103 bp, Methylobacterium sp.
atgcccaaccttgcccgcctgctccggccccgatcggtcgcgatcgtcggcgcgtccgacaagccgggcgcgctcggctcctcggtcctcgcgaacctgacgcgggccggatatgccggcccgatccacctgatcaatccccggcgcgccgagatcgccggccgcgcctgcctgccctcggtcgaggcgctgcccgagggcatcgacgtcgcggtgctggccatcccccgcgcggcggtgctggagaccgtgcgcgccctggcggagcgccgggtcggggcagcgatcatcttttcggccggcttcgccgagggcggggagtccgggctcgccgagcagcgcgcgatcgcccagatcgcgcgggacgccgacatggtcgtcgaggggccgaactgcctcggcctcatcaatttcgtggacggcgtgccgctcaccttcgtggaactgcccgtgacgcccctggccggccggcccggcatcgggatcgtgtcgcagtccggcgcgatggcggcggtactcggcgtcacgctgctggctcgggatctcggcctgtcctactcgatctcgaccggcaacgaggccgcgagcggcgtcgaggactacgtcgaccacctcgtcgacgaccccgatacccgggtgatcgcgatgatcgtcgagcagttccgccgacccgcccgcttcctggccgcggccgagcgggcgcgcgccgccggcaagccggtcgtgttgctccatcccgggcgcggcgaggcggcacgccgctcggccgcgacccatacgggggcgctcgcgggcgattacgcggtgatgcgcctcaaggtcgagcgggcgggcgtcagcgtcgtcggcaccctggaggaactcggcgacgtcgccgaactgctgctgcgctgcccgcccttcggcgcgggtggcaccgcggtgctcaccgaatccggcgcctacaaggcgctgaccctcgaccttgcggaggatgtcggcctcgccctgccgccgctcggcgacgccgacagcccggcactgcgggcggcgttgccagacttcgtgccggtgagcaacccggtcgacctcaccgctcaggccctggtcgatcccgacctctaccggcgtgcgctagccgcgctcttggacgacgcgcgagtcgccgccgtggtgctcggcatcatccagaccgacacggcgacctgcgccctcaaattcccgccgatcatcgcggccctgcgcgccctgaagccgggaaagcccgtcgtcttcggcggcctcgacgagggcgcggctgtggcgggggagcatatcgcggccctgcgcgccctcggggtcccctatttcgccacctgcgagcgggtgatccgcgcgctagccgtggcggcgcggcgcggtgggacgcccgcggaggccgtgccggtgccgcccctgccaccgcgcttcgccgacgacgtccggggcgtcgcaccggaataccgggccaaggccctgctggcacccctgggcatcccgttcccggagagccgcatggcgacgaccctggcggaggcacacgaagcggccggacagctcggctatccggtcgtcctcaaggcgcagtcggcggagctgtcccacaagagcgatgccggcggggtcatcgtcggcctcgccgacccgggcgacctggcccggggctgggcgcagctcgccgccaacatcgcgcatcaccggcccggcctggtgctcgacggtgtcctcgtcgaacggatgggcgcgcgcggcgtcgaactgatcgtcggcggccgcagcgatccggattgggggccggtggtgctggtcgggttcggcggcgtccaggcggaggtgctcaaggacgtgtgcctgctgccgccggacctggacgaggccgccatcgccgaccagatccgcaccctgcgcagcgccgccctgctcgacgggttccgcggcgctccggccctcgacgtcgcggcggtcgcccgcgtggccgcggccgtgggccgagcgctcctcagcgagacgcgcatccgggagatcgatctcaaccccgtcgtggtgaggcccgtcggcgaaggcgccgtcgccctcgatgcgctcatgatcttcgcgccgccctga

SEQ ID NO: 8096 - DNA, 927 bp, Methylobacterium sp.
atgcttgactgggatgatctgagatttttcctcacgcttgcccggcacggcacgctttcggctgccgccaaggtgctacatgtttcgcaatcaacagtcgggcgccgcctgaactcgttagagacggctctcgccgtccgacttctcaaccgtacgcccgacggctacgtcctgaccttggccggcgaggaggtgcgtcggaaggcagagcacctcgaagcagaagccttggccctagaacgcgacgtcaccggtcgcgacacccgacttcgcggcctcgtacgcgtcacctgcgccgaaacactggccgctcatatccttgcgccgagcttcgccaagctccatgcttcgcatcccgacgtcatgatcgagctcatccccaatccgcgggaactcagcttggcgatgcgcgaggccgacatcgccctgaggatgaggcaacccgaacagaacgacctcgtggtacggcgcatcggcaacatcgcgttcgggatctacgcaactcccgattatctgcgagaccaaggcgcgttggacttcgaggccggttgcgcggggcaccacctaatcacgcagcttgacgatacccaggagatgactcagtccgcttggctcacggatcttgcgtcgcgcgcgacggtggtcctgcagacgagcagccacgaggcggcggcgcttgccgccgccagtggaggcggcttggcgtgcctggcatgcttcaggggcgacggcgaaccgaggttgacgcgcgttccggcgccgaccgctcccccgagtgctgacatcctgctgctggtccatcgggacaatcgggatacaccgcgcatccgggtggtgctgactcacatcacggacaccatccatgaactcgcggcaatccttcagcccggcgacggggttggctcggatgcgcgcgtcgcgggttga

SEQ ID NO: 8097 - DNA, 1005 bp, Methylobacterium sp.
atgcagccggaagtcatagatccgaacatcccgcttctgggagacgagaagttacgccgggaggcgtgggtcgagacggtcgctccgatctgggtttcgatccccgatcgcgacaagccacttcccgataaggtgcacttccgtgcctggaaggtcggcggcatccatctgtacggactgcatgcgtcggcgcagaccgtggagcggacgggtccgcagatcgcctcccacgcggtcgatcacgtctacttccagcaccacctgaacgggcgcgccatgatcgacgcctcgtcgggcgagacgccgatcgacggcggggacattctcgtggtcgatatggcgcagcccgcattcggccgagcgttcaccggcgtcgatgcgatcagcctatgcatcccgcggcgcgccttcgacgctcgcgtgggcgaggtcggcgacctccacaggagcgtcctctcgcgacgcgatcggcccctcgtgcgcttgttctcggaccacatcaggaatgtccggcattgcctcgacggcacggacgaggagcaacggaccctgctctcggtggcgacggtcgccctatgcaacgctgccctgaccccggtgtccgacagcggctacaaccgtccggcggtcgcggcgatcgagatccggcagttcatcgaggcgaacctcgatcggaccgatctcggcgtcgaactgctctgcgcccggttcgggctgtctcgcacgccgatctacgcgctgttcgagccggaaggcggcgtgatgacctacatccgcaatcgtcgtctggcccgggcgatgcgcatcctctccggcgtggaaggcggcgacgcccgccggatatcgagcgtggcctacgcttgcggctacgagaacctgaagagcttcagcaaggcattccatgcgcgctacggcgtgaatcctcgggatgtcgacgcatcgtttcgggtcgggtcccgctgggaaaccgggacggcgctgctgtcctggatcaaggagctctga

SEQ ID NO: 8098 - DNA, 1245 bp, Methylobacterium sp.
atgcgcacgcaggtcgcgatcgtcggtgccgggccggccgggatggtcttggcgcatctgctgcacgcggccggcatcgccagcgtcgtggtggagcgccgcacgcgcgactacgtcgagggccgcgtgcgtgccggcgtgctggagcagggcaccgtggacgtgctcgcgcggctcggcctcgacgggcgcctgcgcagcgagggcctcgtccacacgggcgccaacctcgcggtggacggcgagagcttccgcatcgacatggccgcgctgaccggcgccgcagtcacggtctacggccagcaggaggtgatgcgcgacctcttcgatgcgggcgaggcgcggggcctcgcggtggtgtacgaggcccaggacctgcgcctgcacgatctcgacggcgccgccccgagcctgacctaccgcacgcccgcgggcccgcagcacctcgtctgcgactacgttgcgggctgcgacggcttccacggcatctcccgccggtcgatcccggcggacgtgctgagaaccttcgagcggatctaccccttcggctggctcggcatcctcacggacgtgcctcccgccgcgcacgagctcgtctacgcgagtcacgccaacggcttcgcgctcgccagcatgcgctcggcgacacgcagccgctactacatccagtgcggcatcgacgagcgtccggaggactggccggacacacgtttctgggacgagctctgcttgcgcctcggccccggcatcgcgggcgggatcgtgcgcggccccgccttcgagaaaagcattgcgcccctgcgcagtttcgtcggcgagccgatgcgctggggccggctgttcctggccggggatgccgcccacatcgtgccgcccaccggcgccaagggcctcaacctcgccgtctcggacgtggtgatgctggccgaggcgctggaggccttctacgcccgcggcacgggttcgggtctcgacggctactcggcgcgggcgctggcgcgggtgtggaaggcggagcggttctcgtggtggttcacccgcctgatgcaccgcttccccgaggagaccggcttcgaccggcgtatgcagctggcggagctcgcctatctcggcacctcgcgcgccgcccagacggtgctggccgagaactatgtcggcctgcccctcgatccccccccggtctcgacctctgttgcggactttttctcggccccgagcgcgaacctgcgcgggatgtgcgcatga

SEQ ID NO: 8099 - DNA, 300 bp, Methylobacterium sp.
gtgaaggtcgatagcatcctctcgatcaccgacggattgggaggccatcactacgtctacccctacttcgcagaagcgccggcagtgagtgaggaggccgccaggctcggcctgtgggtgctaggccgggctttgccgaacgtgccgccggagcagtttcggttgctcgatgtgttccgagggcgggcgttctcgatcacggaaacgcctctgcagggggatgaggagcagcggttccaccgcatgtatgccggcctcattcaggagcgaaatggcctgcgtggacctgaagcgctctaa

SEQ ID NO: 8100 - DNA, 675 bp, Methylobacterium sp.
atgatcgttgtcgtcggtgggaccaaaggcgggtccgggaaatcgactgtcgccacgaacctcaccatcatgctcgccgccgcgggcaacgaagtgcttctggtcgatgccgacgatcaggaaacgtcgaccgatttcaccaacctgcgggacgcctcgcggccgggcggcgcgggctatacgtgcgttgctctcaccggcgccgcggtgcgctccggcgtccaacggctcgccccgaagcacgctcacgtcatcatcgacacgggcggccgcgataccgtgagccagcgcgcggcgctgtcgatctgcgatgtctatctcgtacccttcgcaccgcgatccttcgacgtgtggaccctggataaggtcgctgagctcgtcgaggaagcgcgagccgtgaacccagatttccgcgccctggccttcatcaaccgggccgaggctcgaggcggtgagaatgccgaggcggctgaattgatccggtcgaagcccgggctcgaattcgtccccgccagtctgggcgcacgcaaggcgttcgcgcacgccgcggctgccggcctatcggttgtcgagatgcgccccgctgatccgaaggccgtcgaggagatcgagacattgcgcaggcaccttttcgatgcctccgggatatccagcggaaaccaagaggggatctga

SEQ ID NO: 8101 - DNA, 222 bp, Methylobacterium sp.
gtggtgctacacggcgccgcccgcacctggcgcgagcagagcagccagcccgggcgctactcgaaggcgggcgtggtcacgatcgatctcgtgtcgctgaccgcctcgcagcgtgacctgaccggctggctttggaccgggctgattgagaggatcagccaggaccgaaggagtcggacatgcggcgaggacagaagacgagcgcggagcaggtcgttttga

SEQ ID NO: 8102 - DNA, 516 bp, Methylobacterium sp.
ttgcaggcgctcgacttctgggttcggtacccagacttcctcgcgaacgagctcctgaacgagtttgcgcacgggggggcgccggagaacctcgaacttgccgctcgtatcattgatgaccgcgagccggatctgcggagagttccgatggtgcgatacctcttcggcgccttcgaacccctcgacaatccactatcgctccttcggtcgagggatctcgtgcgccagaagaaatctggtcaaccgggacaggtccgcgagacctcgtacctgctgacaaggttgggaggcgacgcattggagcgcctcgccggagaggcggacgagcttgcttggtatcgagacagagcgatcgtggctgcgcgggttgccggtggggttggaggacgtgcgctcaaggggcgacagtaccttcaggatgagtatgcggcgacccccattggcggcgtcattccgtcaatctcggagaaggtaagggaacggctggatgcgatccgccgtatgggtagaggatga

SEQ ID NO: 8103 - DNA, 1443 bp, Methylobacterium sp.
atgctggacaccagcacggagccgggcgccgcgcccgcggatacgtcgtacctggagcggcgtaacccgctgaccggcgcggtcgcgacccggatgcccgcccacgacgtggacgccgcccgtgcggtcgccgacgcggccgaggccgccctgccggcctggtccgagctcgggccgacggcccgacgcaccgtgctgctgcgggcggctgagtgcctgacggcgcgagccgacgccttcgtggcggcgatgacggcggagatcggggcgaccgaggcctgggcccggttcaacctccagctcgccgtcggcatgacccgggaggcggcggcgctgaccacgcagatcggcggcgaggtgatcccctccgacaagccgggctgcctcgccatgagcgtgcgggagcccgctggcgtcgtcctcggcatcgcgccctggaatgccccgatcatcctgggcgtgcgcgccgtggcggtgccgctcgcctgcggcaacacggcaatcctgaaggcctccgaacagtgcccgcgcacgcatgcgctgatcgtcgaagccttccgggaggccggtctgccggacggcgcgctcggtttcgtggcgaaccggcctgaggcggccggcgccgtcgtcggcgcgctgatcgaccacccggccgtgcgccgcatcaacttcaccggctccacgtcggtcgggcgggtcatcgcccggcgggcggccgagcacctgaagccggtgctgctggaactcgggggcaaggccccgctcctcgtgctggaggatgccgacctcgacgaggccgtgaaggccgcggccttcggcgccttcatgaaccagggccagatctgcatgtcgaccgagcgcatcatcgtgctcgacgcagtggccgacgaattcgccgagcgcttccgcgccaaggccgccgcgctcagcgtcggcgatccccgggagggcagggcgcccctcggcgcggtcgtcgacctgaagacggtcgatcacgtgcggggcctcgtggaggatgcggtggcggacggcgcgacgctgctgaccggcggggcggccgacggcgtgctgatgcccgcccatgtcgtcgaccgggtgacgcccgccatgcggctgttccgcgaggagaccttcggcccggtggtggcgctcgtgcgggcccgtgatgaggcagaggcgatcgctctcgccaacgacaccgaatacggcctctcggcctcgatcttcacccgcgacactgcgcggggcctgcgcgtagcgcggcggatcaagtcaggcatctgccacgtcaacgggccgaccgtgcacgacgaggcccagatgcccttcggcggcgtcaaggcctccggctacggccgcttcggcggtcgggccggcatcgacgccttcacggagctgcgctggatcacggtcgagacccagcccggccattttccgatctga

SEQ ID NO: 8104 - DNA, 576 bp, Methylobacterium sp.
atgtcctttccttccactggtcctgtcctgaccggcgtaaagtacttcggcaccaatggagacaattcgatcggcggcacggccggcggcgatctcatcgacggccagggcggtaacgacctgatcaacggcaacggtggcgccgacaagctgtacggcggtgcgggcaacgatcgtctgagcggcggcgcaggcaacgacctgctgcagggcggcaagggcgtcgacgcgctgtacggcggtgccggcaacgatacgtttgccttctcgaaggcggatttcgacctgtcccttggcgctaagccccaggatttcgtgtgggactttgaaggtgccggcgttgcaggcggcgacttcctgcggttcagcggtttcggtgccgattcgacgctgacgaaggtcaccaccgattctgtcgtgaatgcgctggccaagtacaatcctggcctcgactactacacgctcaaggacagcaacgacggcgcatcctacaccatcgcaatcaagaccggcggcgtggtgctgagcgattccttcgactaccacttctacgacacgggcgcactcttggcctga

SEQ ID NO: 8105 - DNA, 297 bp, Methylobacterium sp.
atggcgttcattgtcctatcggcgatcggcggcggcgtggggatcggtgccctgatgttgtcctacggattcggcaccgcgctggcctgcgccattcccggcgggagcctctgcgccgccgtggcagccttcgtcttgatggcgcgtcgcggagaggattgggcgggcgaggattgcgaagacgatgaaccggtcgatgatcagacggaccagatggtgaaagccctgcgcgaaatcgcgcagcggggcgacctggaccgcgcgaagccggcgggcaagcaatcccgcgccgcctga

SEQ ID NO: 8106 - DNA, 654 bp, Methylobacterium sp.
atggagagcatgaacgtgaccgccttgtcagcgaagcgccgctacgtgaggctcactgaggaccagtgggctgaggccgaggccgcgtggacttccggctcggcgtcgctccccgagcttgcccatcgcttcggtgcgaccgagcgcgctctacaggcccacttcgcgaagcgcggtcttgaaaaggggcaggccgcgaaggcgctcgctgctcaggtcgttgccagggtgaagaaggagcaggaagctcaggcagacacggccactgagcgagcgctgacgatccgcgagacgacctacagctacgcgaccaagatcgaacgcatgatcgtggagcgcctggacgctgctgccgcagatccggatcaggtctacgccgccgcaacattcgtcaagatgctagccaattctgctgccgcgctcgaaaggcttcacacactcaagcgcaacgctctcggcatcaccgatgaggacatgaacgccgatgaggttcccgagcttgtcattaaaaatctctctgacgtcgaagtcgcttccatccgtcagcggcagagcgatgaggatgagttcgacaatgatacgattgagggagcagacgaagcagccgaggcgccggaagatgagatcgtgtgcgagagtgacgatgcccactga

SEQ ID NO: 8107 - DNA, 612 bp, Methylobacterium sp.
atgaccttccagacctggctcgccttcgcggcggcgtcctgcatcgtgctcgcgataccgggacccaccgccctcatcatcatgcggtacgccgctgggggcgagcgcgaccgggtcgcgcgtgtcatcgtaggggccgttctcggcgacgccgtcgcgctgacgatctgcaatctcggtctcggtgcgctgctcgccacctccaccgggatcgtcaccatcctgaaggctgcggcggcggcctacctgatcggactcggcctcaagggcctgttcggccgcgggcccgtgaccgaacaggcccggccccgcggcgggcgcccgttccttggcgccttcctagtgaccgccctgaacccgaagggcatcgccttcttctgcgtcctgcttccccagttcgtcgacgggagcgcgccgatcctgccgcagctcgccatcctgcaggcgacgttctgcgttctctccctcattgccgctttgatctgggcgctggccagcatgtcgctgcatcgcgcggtcgtacacggtcccggcggccgcctgctccaacgcgtcagcggggtggtcctgatctgcacggggatcgcgcaggtgtccgggcgagcggcctga

SEQ ID NO: 8108 - DNA, 1350 bp, Methylobacterium sp.
gtgccgcgcaaggccccctccgactctcctccgtcggcgccgtcaggcgtttcggccctggcgcgtgggctcgccctcggcctcgccctcgtgatgagcccggcgcaggccgaaccgggtgtgacggcatccccgcaggccggccgcatcgagggcgtgcagctttggaagctgccgcccacgcccaacggcctcgtcccatcccagagctggcatgcgaccggatcggcgccgaacggcgatctctacgtggccggcatggaccatcgcaccaacgcggccctgtaccgcctgccggcaggccgggatgacctgcgcctcgtcggcgacgcccgctcggcctccgaggccgcgggcaattggcacccgagcgagacggcggagaagttccacacccgcccgaccttcatgaacggcaaggtctatgtcgcgaccatggattcctccagtctcgacgctgattacaaggcgaagcggggcttccactggtacgcctacgatcccgacacggaccacttcaccgacctcagcgcacgggagaagggcggcaccggccttccgcacggaagcgtggtcaccctcgccgcggaccccgcccggaacgcgctgttcggcgccatcgtgccgaccggcgaggtcgtgcgatacgacgcgaccggcggcgtgaccgcatcgcttggccgccccgcgggctacgatcgcccgttcctctacgtgaaccgcttcatgttcaccgacgcgaagggacgcctgtacggttcggccggagcagggccgggctacgcagccgggatctatgcccatctctaccgctacgagccgggggttggcccggtgccgcggcccgacctgccgctggtcgagccccgcgccctcgagaccggccgctgctttcccgatcgccaactctgcttcgccgccgatagccggggacacctctaccgcttcagcgaggatgcggcaggcgacacgatcgcctggactgccatcgggcaagtgacgatggagcggcccggctcgttcctctggatgttccaggtcgatcccgccggggcgacggcctacgcggccgcgacgagctacgcacccgatgctggaccggcttcgctctacgaggtcgacctcgcgaccggacgctcgacgcgcctatgcagcctcgccgacctcgatccccggctctccgccctgaacgtccataccggatacgatgcctgggacgcgcaggggcgcttcgccttcgcgagcttcgccggcgagggcgagagcgaggtcctgctgacgcgggtcgatcccgcgcaactgaaggcggccctgcgcgcccgatgtcgtgatgccgcctgcacgccgtga

SEQ ID NO: 8109 - DNA, 384 bp, Methylobacterium sp.
atgaaagcagaaataaaaccagattacacgccatcggtcgatgacgaggccgagcgcgttcgcgacatcttcgtgaagtcttttcggcgatccgaaagtgacctcgatcgtctcctgccaaagaattttacgagcacgctttcccaacgcgacgaggctgacaagccgactgccggggacgagttcgactggtcggtcaccctcgcgaatgtcgaaaagatcgtcgaggctgcggcttcgagtcggacgtccaccctcgctgccgaacggcgcgcggagatcgccgaggccaaggccaaggaagccctgcactggctgagagtcctgcacgaagccgtgctccgagggcttcccgacgcgacatcggagacggccgtcggctga

SEQ ID NO: 8110 - DNA, 1215 bp, Methylobacterium sp.
atgcagcgcgaggttccgcgaggctggggcgatcgaggtgacgacgtcattccgtccgttgcgggcaagcagacagacgaattccaaatgaaacggctcaagatcctcgcaccccagcgctacccctggaccttcacgggcccgcgggcgtcgcggcatgacatcacgcgcgccttcttcatccccgccaacaagatcagccccaagatcgagggaatcaccgccttcccaaccgtgctcttcaagcctttcgacctcgtccacgccttcaaccgcatcccgctcggccggacgccctatgtcatcggctgcgagtcgcacatcccgcgcggcttcggaatcgagacgtcggccctctacaagcgaatggcgcgctccctcgcctcgcagcggtgccgggcgatcatcccgatctcccgatacgcgagtggcttgatcacacgcgatcacgagcaccgaccctggtggccggcgttgaaggcgaagatggtcgtccgccatccgagcatcgccacgcggccctttcaggttgggccgcccccgagcccgatccgcatcgcgttcgtgggcaatcactttgctcgcaaggggggctgcgtggcggtgcgcatcgccgaactcgcagcccggcgcggcattcccgtcgaggtgcatatcgtgtccgggctcgaaatgggggccgcggtttggaccgatccgacgcgggacgccttcttcgatccctatcgacgcctgctcgacaggccgaatgtgacgctgcacccgaccctgcccaatcgggaggttctcgatctgctcgggatgatgcatttcagcgtgctgacgacgttctccgacaccttcgggtacagcgccctggaatcgatggcctgtggaacgcccgtcatcgcgagccgtcagggcgccctgcctgagttcatccacgacggcgtgaacgggatcatgctcgatctgccgaccaacccctggggggaatggatccatggcggccataccggccgccacacggtggcctatgaggcgatcgtccgtgatgacatcgagcgcttggccgaggaggccctgacagccgtggagcggcacctgtccgatgacgatggctaccgccggatgcgacgggccgcatatgcggagatcgagacccggttcgacattccgagttcatcagccttctgggacgatctctaccagcaggctatttcgaacgggcgataa

SEQ ID NO: 8111 - DNA, 126 bp, Methylobacterium sp.
atgagcgttcgggacgaactcgtcgtcctcgcctttctcggcgcgctgaccggggccggcgcgctcctgtgggcccgcgagggggtggggctctggctgcgcgctgccattcccctctgcttctaa

SEQ ID NO: 8112 - DNA, 333 bp, Methylobacterium sp.
atgatcaagtccgaactgatcctgcgcatcgccgagcagaacccgcacctgtacgcccgcgacgtggaggtggtggtgaacacgatcctcgacacgatcaccgcggctctggagcgcggctgcggggcgttctcggtcaagcatcggcaggcacgacagggctgcaacccgcgcagcggtgcggccgtgtcggtcgaggcgaagacggctccggtgttccggtcgggcaaggaactgcgtctcaggctccagggcgagaccggaggcgtcgctgcacgagcgccccatcgcgagccgcgtcaggcggcctcgccggcctcacccgaaggctga

SEQ ID NO: 8113 - DNA, 123 bp, Methylobacterium sp.
atgagcgaagttcagcgccactacgaagatttgctagccagtcattatttatggatgagtggaatgacatttttggacaaggttgcggagcagcgcaagttgttggaggtgcttggcttccta

SEQ ID NO: 8114 - DNA, 489 bp, Methylobacterium sp.
atgggtgcgctgattgccgcggataccgctgaggcccgtggtggctttggcggcggtggcttccgaggcggcggattcggcggtggcggcttccgcggcggcggcggctttggcggcggattccggggcggcggcttcagcggtggtggctttcgcggtggcggtgccgtcgcaggcggctggcgcggcggcgttggcggctatcgcggcgtggccggtggctaccgcggcggtttctacggcgggcgcggcttctacggcggtcgtggctacggctaccgcgggtacggctatcggggctacggatacggcgtcggtgcgggtctcgctggtcttgcggtcggcacggccgtcggggctgcggccagtaactattacggcggctacggctacggctacgacaatgccggctatggtggctacgctcccgccgcctatggctcaagctatcccgcttacggatacggcggctgtacctgcggctactaa

SEQ ID NO: 8115 - DNA, 3711 bp, Methylobacterium sp.
atgttcgcagcccgccccgacgatttccctgacccgtcgccggatttgccggtcgtcaacgtcgtcctcgtctcgcactcgccccacctgtgcggcgcggagcgcatgctcgtgaacctggcgatcggcctggcggcgacgccgcgctaccgccccatcgtcctgctgcctaacgccaaggccggcccgctcgcgcggatccttgaccatcacggcatcgagtggcacgacaccccggagctgtcttggttcctgtgggccaacgtcgacgcgacgcgcgacttcctaatcaaggccgcggatggggcggcggcgtacgaggccatcctcaggcgggtcggcgccgatctcgtcgtcgtcaacaccttgacctacctggagggcgtgatcgcctccgtgcgggcagacatccccttcgtcctctgggtccacggcattctcgatgccggcatgctgggccgcttcgaccacctcgccgaaatcagcgccggcctgcccctcaagctcgcccggcgcatcgtgtgctgctcggactggacgcggaccttcttcgagttccgagccgaaccgactaagatcgagacgattcacaactggacgcacgttccagtcgaaccgaccccgcgggcgggtcagacgcgcttcgcggccctgtcgaccctggagaagcacaaggggatcgacgtcctcatccgggcggtcgcgctcctgaaggatcgaagcatcggtctcgacctctacggcgacggcgtcgaccggcaggcctatcaggacctggtgcgcaggctcggtctggccgacaggatcgccttccatgggcgggtgacggacgtcgaacgggtctacgacggatccgtggcgatcgtgttcccatctttcgtggaaccctttggcatggtcgcgatcgagagcatggcgcggggaaccccggtgatcgcgtcccgagtcggcggtctgcgcgagattgttgacgagggcgtctccggcctcctgttccgggccggcgacgtcaacgaactggcagcggccatgatccggatcttagacgatccgcccctcgccgaagcgctcggccgcggcggcttcgacgcggtccggcagcgctttgacggctcgcgggcggtggcgcgcttcgaagccgtgttcgatcgcgtgctgacggaattcggggactacgccaacgacgaccgcgacgccctggacatcctcgaagtcggcctctgtcgagcgaggccgcgccatcagaccgactggcccgttgccttgtccggcggaccacgggacggaacggccggcgcgatcacgcctgcgctcacggacatggagctagccgttctggaatggccggagatcggaccggacacggagtttcggggaaggctcgaggaactcgccgaaggcagcttcctgaagggctgggccgacctcccggggatgggcgaggcctgcaccctcgatgcgttcgtggacggcctcttcgccggacggttccgggccgacctgcaccgtccggacctcggacaggccggtttcccggacccgcggcgggccttcttctatcccgtgcccgcggccttcctggacgggcagacccatgtcttcgcggtcaagcttgccgccaccgatcgcccgctgtccggttccccagcagtcttcgcgacggagaacgtccatgaccgacgcgtcgtcgagtccaacttggaggaactggctcttggcgagaccctgaagggctggtccgtcgtcgacgggctcggggagcacgccctgcttgaggtcttcgtggacggatgcttcgccggccgggtcccggccgacatccggcggcccgatctggagttcgtcggcctcgagaacggccgcggattcgagttccgcctccccgcctttttcctcgacggggaacgccacgccttcgacgtccgacaggcggtgaccggaatcccgctgcggggatcgccgatggtcgcgcgcagttcgcacgacaggggcccgtcgcgcgagaccgcggcgaccccggcactggcgaactgggccgagcggctcttcccgcagcgacgtgccgccgccccgacgatcaagcacgcgtggcgcgccggccgcaacgacgggaaggcgccggtcatcgtcgccgtcgccgatgccgccatcccgtcgacggagatcctcctcgcccagccgctggcggcgatgaagcgcacgtatgggatcgattaccggatcttcctccaggatgccggtcccgacgcgaccgaactgtccggggccgacatcctcgtgctcctgcggacgacctctgacggagccgtcgcgaccgcggacgcggcgcggcgtcacggcatccccatcgtctacatcacggacgacaacctcgccctgctcgggcaggaggtgggcgtcgctctcgccgccgccctcacccggcgggcgaacatcgccgcgatgatgcgggccgcccggcaggtcgtcgtgacgaccgacgccctgcgcgccgagttcgcccgatcagtgtcgaacatctcgatcattccggccgcggccgacatcgagttcttcgatgcgatcgagatcgacgagcgcgaggataccggcgagatccggatcggctatgcggggacgaagacccacggcgaggatatcaagctggtagaggacgccctcgtgcgcctgctcgacgcgtacccgacggtctgggtcgagagcatcggccaggtcttgccgcgcttgtccgaccacgcgcggtaccggcagttcgacgagatcgacgggatccgccccttcgcacgcttcctccatacccggaactggacgatcgcgatcgcaccgctcgcggcgaccgccttcaacgagggcaagtccgacaacaagtaccggatgcatgcgagcgcgcggatccccggcatctactcggatctgaagccctacgagacggtggtggacggccagacagggctgctggtggacgagccgaccacgggggcgtggttctccgccctggagcggctggtgctggacccggacctgcgcgggaccatcgtcgcgaacgccctcgcggacgtgcggagcaagcacgcgatggtgcaggtcaccgcccggttccacgacctcctgagatcggtcgccgaagtcccgaccgtgatggtcagcggcggccgcgcggcgacgctgcccggagggttgcggagtctggacagaggccgcacgatcttcgtcaggcaggcggaaagcaaccggctcgccgaccgcgacctggactgggccgacatcctcgttatcgcgatgacggacgacgacacctaccacccgttgctgtctcgggcgcgaagcgccggctgccggatcgtcgcgctctacgaggtcgcggcgaacgacggcgcgccccgcgggccgggcttctcccggaatgcgatcgtcgcggcgtccgacatcctgatcctgcgccaaccgtcctcggggaccacccgggcggtctcggtattcgcgcagaatctggcggagatctatgcatcctcgaacggcgccggcgactggcaggcccgtctcgccggcatgatcgacgaccgcgcgttgggctcggtcgcacgggacgtcgtgcggacggatttcgccgtgcagggcgaggacgacctccccgtctggcggcacgtgttccgttgcatgggtctgtccgtcatgatgccgcccatcgcgcagcgcgcggagcggtcatga

SEQ ID NO: 8116 - DNA, 1557 bp, Methylobacterium sp.
atgctgcgcgacgctgccgacgcgctggaggccgcctacgacgtgatcgtggccggggcgggcaccggcggatgcgtcgtcgcgggtcggcttgcggcggcgggattctccgtgctgctggtggaagccggtccgccggacagcgccgagcccgccatcgccgatgccggggcctgggtcgggctcctcggcggtccctgcgactggggctacgcctacgcgcccacccccgaggtggccggccgcgccatcgcgatcccgcgcgggcgggtgctcggcggatcgagcagcatcaacgccatgctgtggaaccggggccacccctccgattacgacggctgggccgccgccggggcgacgggctgggacttcgccacggtgctcccgtatttcaagcgggcggaggactgggagggcggggagacacccctgcgcggggcgggcgggccgctgcgcatcgagacgtcgcgcgatcctcaccccgttgccagcgccctgatcgcggccgcggccgaacgcggcatgccggtgctggccgacgccaacgggccggacaatgccgggacggcgctcgccaacctgaaccagcgcggggcccgccgctggagcgtggtcgacggctacatccggccgctcgcggaccatccgaacctccgggttctcaccggggcgacggtcatcgacctcctggtctcgggcgctgtctgctccggcctgcgcctcggcctcgagagcgggatcgtcgcggtgcgcgcccgccacgaggtggtgctgaccctcggcgcgatcggcacgcccgcgctgctgatgcgctccggcatcggcgatccggccgaccttgcccggctcgggatcgccgcgcgccacgccctgccgggcgtcgggcagaaccttcaggaccatcccctgctgatggggatcaatttctccgcccgcgcccccctcgggccggtgcgcgacaacggcggcggggcgcagctcaactggcgcagccggccgggcctgcgcgcgcccgacctccacgccttcgtggtccagggccctcatgccggtcccgagatcgccgccaccgccgacctctccggcccggtcttcgccgtctcgccggggctgatgggttcgaccagcgtcggcagcctgcgcctgcagagcgccgaaccggacggcccgatcacgctgcggccgaattttctggccgagcccgccgaccgcgcggctctggcgggcgccatcgacacgattctcgacctcgcggacacggccgcgttccgcgatctcggcgccgtgccgctgaccccggcccgaaggctcaaccgatccgaggccgacgccttcgtggcgcgggcctgctccaccttcttccacagctgcggcacctgcgcgatgggcaccggcccggccgccgtggtcgatccggccctgaacctgcatggcgtggccggcctgcgcctcgccgacgcctcggtgatcccgacgatcccgaccggcaacacgcaggccgccgtggtgatgatcgccgagcgcgccgccgacctgatccggaatgccgcaggatga

SEQ ID NO: 8117 - DNA, 1011 bp, Methylobacterium sp.
atgatccgcatgcttatgctcgcggcgcgggcgcttgcctgggttacatctcccgctctcaccaccgaggtcgccaccgtcgccgataaggctttcatcctgccctggggcgactggctcgacgcgccggccgtgtcgctgtgcgatccagtcctgacgatcctcctgccgatcatcacggcctcgatcgcccgggccgtccgcaaggtctacccgtgggcggccctgttccagtcgcagcgtcgggtcgagatgaggctcgagcaggctgtcggcttcagccgcaaagcattgaacggtccggctaaaggaaagacgctttcggtcaccgtcgcggtgccggtcatcgccaagggcacgcagtacgtcatcgacaccgtgccgcccgtggtcatcaaggcggccggcggtgctgatggcattgcagcccggatcttccgcaggctcgacctcgacgaccgcgccggcgaggcaaccgagctcttcccggctcaggagcaggtcggcgcgggcacggtggctgcccacgagctgcgtcgcacggacaagatgaccccggcgatcagcaggaggcgcgcatgcccggctcgaacggaagagcgcgccggccgctcatccgtcggctcgatcgccagcgtccgccgtggctcgtgggcgcgatggcctcctgccatgcccgcttcggacgcggcagcgtcgtgccggcccgggcgggtctcgcgccgcagcggcggccttggacgacgttcgaaaagcgcacgccgcgctacacgaatcaggtggatgaatagccggtcgcgcacggctggccgtttcgtacttcagcctcgccagcggcgacgaagcttcggtgtttgctgctcgcgcgctatgaaccggcccgcaatcaaatgttgcggaaaatatcttgctgatgggcgtgtaatctcaatattggcgaccatcagagatcagtcctgcgatccgaatatcatccttctaacatttgtcgattcgcgattattgtattga

SEQ ID NO: 8118 - DNA, 273 bp, Methylobacterium sp.
atgacggtcgtctttcccgagcctatggcgacgcagatccgtgcggccgtcgaagccggcgaatatgcgtcgaccagcgaagccgtgcgggatgccgtgcggctgtggtccgaccgccgcaagttccgggacatggagatcgagcggcttcagcgggcctgggacgccggcaaagcctccggccggcacggcgtgctggattttgatgcgctgcgccgcgaagcccgttcccgcctcattgggccggacgatgaggacggtcgtggcggctga

SEQ ID NO: 8119 - DNA, 939 bp, Methylobacterium sp.
atgacgcgcctagtcctcggacggctggtccaggccgcgctcgtagcgctcgtcgtcggcggcctgtgctttgccctcgtttgggtcttaccgggcgacgcgtccttccgcatcgccgccgaccgttacggccctgacgcgctcaccgcccaggccgcggaggccgtccggcaggagctcggcctcgaccgaccctggccggaactgctgctgcgctggttcggcgagctcgcccaaggaaacctcggcaactccttggtcagcggcgaaccggtctccgaggaactcgcgagccagctcgggccaagcctgtggctcgccgccagcgccctcgtcctgtccctgctgatcggcctgccgctcggcctcgtgagtggcctgcgcgccggatcgggcctcgaccgcctcgcgctgatcggagccgtggcgctgcgggccctgccacctttcgtcctcggccttgtgctgatgctggtcttcagcatccggcttgaatggctgccgcccgccggctacggcacttggcgcgagatggcgctaccgagcctgaccctggcgctcgggctcgccgccgtattgagccgcgtcgcgcgcgacgccgtcgccgaggtcggggccacgacctactaccgcttcgcccggctcaagggcctgcctgagcgcgcagtgctcgttcggcacgggttgcgcaacgccgccatcccgatcgtcacctacctcggccttcaggcggtctacctcatcgaaggcgtcgtcgtggtcgagtcgctgttcgcgtatccaggcatcggccacgctctggtgcacgccgtcatcgcccgggacgtgcccatggtccagggcgccgcccttgtcatgggcctgatgttcgttctcctgaacctcggggtcgacctgctctgccggctcctcgacccgcgcctgggggccggccgatga

SEQ ID NO: 8120 - DNA, 6162 bp, Methylobacterium sp.
atgtcggcgcgtgtcgccgggcagggggcggacccgttcgcacccgacctgggctcgggctcgatgcgccatgtggcgcagacgcccgagacgcttggctttggtgcctttgcgcagagccacgcgatcgaggtacccaagttccgcgggctcgaacccaaactgtcgcttcagtacagctcgggcggcggtctcaatgccggtcgcctgatggccggcttcatcggcgtcggctgggagttgcagggcctgcccgacatcgtgcgcacagcccccatcaacgggaccccgcgcttcgacgcctccgacgtgtttcagctcgacggcaaggatctcgttccctgcaccgatggcatgaccagcccgagctgcacccaaggcggcaactacaccggcaaggtcgagagctacgagcggatccgctacgataccgaggccaacacttggacggtctgggccaaggacggaacgcgcacgctgttcttcgcggcggcgcactggggcggtaccgtcgaggcggatgacgatgctcccgacctgatccgctatcagtaccgttggctgccgatcgaacgcgaggacatccacggcaacaaggtcagctacaactacacctgccggacgctgccggtgtgttacccggagcggatcagctacaataacacggagatccagttcgtcgcggtcgaccacccggcctatcagacacgggcgacggggcggagcctagcccggctcgaccagcagctccggcgcatcgagatccgcaccggcgggctcggcgtccgcgcctacggcctctggcaggagaccagcccctcgacgggcctgcagcggctcgtcgatgtccgtcggttcggcacggcctgggggctcacggaggatgcccggccctccggcgagaacatcctcatcgggcactacgcctacagcgactccgatatccagttcgcgccaggtgccgaaacaatacatacggatacagtagagattttcgatctaccaggcgatttcgacggagatggccgccaggacgttctaagcattcgacagtcttctcagatggacctatgtactatcgacataagattgtcgactggttcgggatttgctcaacctcagatcgttcaacccactcctaatggaattttttcatgctgggcaagcggcgtcgctttgatgccaagcttcggcttcaggcttggtgacttcgacggcgacggattgacggatatctcgatctacaaacagccgaattttggtgtctatctgacgagatatgatcgatctacgaacacaatttcgttcgaagataaatcctttcctctatctcatccggtctcgacaaatccgacattcagttcgtatgccgacatcgaaggtgatggtgcgaccgaaatcattccagtcgggcatagtacaatctacaaatatgatggcttgtcttttaatccggttcagtttccacccgttgcgatgcaagcggatagcttcgaggaaaggctgacatcgagtggcgatgcaaatggcgacggccgggccgaggtcgttacctaccacgtcctcaattacgcaaacccggcggagtacctggccacccgctaccgatgggccgggatgctgttcgagagcctgttctcgtatcagttctcgcgcgcggccgacccaatggtcggtacggctcaccccgtctacgacctgcccggcgacctgaacggcgatggggcgacagacgtcgtccgctaccatttccccgacggaatgagcggtgatccggtgatcgatcgagcaggtctgccgtccatcggcgacatcggcctgcacgtctcgaccggccgctcgttccaagccgtcgcccagctcgcgccacagacgagttgcgcccccatctatcgcttcaccgccagcgaatatcccggcggtccaaatgtctgcgaagtgcgcgtcatcgacatcgacggcgacggccgcggcgacgtcgtcgtgtcgacgccgatcggcacggacgggcagacggcgcccgtcgagctgtttctcaatcgcggcggcggaacctgggagcgccgggtgcttccggcgatctcgatctatacgttcgcggacctgaacggcgacggcaagccggacatcatcgcccaggccaacagcaccgggcagaggggaacctttccgtccggctcagtcctgtacgcgacggggccgatcccggacttgatgaccgcggcaacctcggcgctgggcggcgtcacccgcgtcgagtacaccccctcctcggcctggggcaccacgccgggcacgcgcatgcccttcgtcacccagaccgtctcgaagatcaccgtcgaagacgggcgcggccagaccgccgtcaccaccctctcctatcgcggcggacgctacgacttccccaatcggcgcttcctcggcttcgccggcctcaccgccaccctgccctgctccgaaggcgagaccgcctgccccggcctcgacatcgccttctcgcaggacttcgcctccgccggcaccccgatccaggtcgagcgccgcgacggcgccggcaccccgctgcgccgcaccaccaccgcgctccaagccaacaacgccgcaccgccctacaccgccttgccggtgacccaggagagcatcgagttcttccccggcgccgccaagacgactcgcctcagccgcagcttcgacgtcttcggcaacgtcaccgccgagaccagccacggcgacgtggatcgtgccggcgatgagcgccaccgcgcgatcgtctacgccgcacccaacgtcggatcctacatcgtcgacaagccggcccgcgtgcacctccatgccggcgacagtcctgcccagccggtcgtggccgacaccgtcactctctacgacggctcgaccaccgagggggccgcccccacccacggcaacccgacccagatccgccgttggcgcgacaccgccgacgactgggtcagcgccgcccgcgaatacgacaccttcggcaacctcgtcgccgagaccgacgaggtcggcgccaccacccgctacacctacgatcccggtttcaacgtgttcgtggtcgccaccaccaacgctctcgggcaggccaccgccaccggctggaacgtgccctgcgagcagcccgcgacccagaccgacctcaacggcggcgtcaccacctggacctacgacggcctgtgccgccgcagccgggtgacccgtcccggcggcgacttcaccggatggctctacgtcgatatcggccaggccaaccagcagtacgtgcgcgagacccgtcccgctcccaacgacgcgcccggcgagatctacgccatcaccgacatcgacggcctcggccgcacctggcgcacccgcggtcgcggcccgggcgagcaggacatccatgtcgaccgcgtcttcgacggccgcggcaacctcaccaccgagaccctgccgtactactacggagcgccgagctacggcgtcaccaccgcatacgacgccctcgaccggccagtgcgcctgacccagccggacggcgcggcgaccaccctggcctaccgtgcctccggcctgccgaatggctccacagccgtagaccgggtcgatccgctcggacggacctccgcggccgaccgcgacgcctacggcaatcaggttagcaacggacgcatcaccgccggagcctggtcgacggtctacagcagctacgacagcctggatcggctcgtacaggcgagcgatccggtcggcgcggtctggcgctacgcctacgacagcctcggacaccgcatccgcgccgaggatcccgacctcggcctttggctgtacgactacgacgcggccggacggctgagccgccggaccgatgcaaaaggtacgatcatcgactacgcctacgatgccctcggccgcgagacgcagcggacggtgacgcaggtcgacggcgcggtcgcggtcaccgccagcgtctacgaccaggccggcccgggcaccgacccggacggcctcgtcatccgcaacgtcggccaccttgccgagcagcgcaacgccaccgtcacgctctgtcgcgaccacgacgaggccggacgcctgatccgcgagcgttggctcaccgcggcagatgcccgctgcaacgccgaggcgacgaccggcgaggcctaccgcaccctgacgcgctacgacagcggcggccgggtgacgggccgggcctacccggacggcgacagcgtcggctatctcaccccctccgaccccggcgcctggcgttacgacgccgccggacggctgttctcgctcccaggctcgatcggcgagatgagctacgacgccgccgggcgactgctgagtgcggcctacaccaacggggtgcaggcgagcttcacctactccgcgacccggggctggcgcgagcaggcggtcagtacaagggacggggcgacgctcctgtccacggtctacgcccacgatgcgggggggcgcatcaccgcggtgacctcgtcggagccgggcgagaactggacctacgcctacgacgacctcgaccagctcaccatcgccgacaaccacggcgacgacagccgcgaccgcaccttcagctacgatgtcggctaccgcctgctgagcgcggccgggctcggcgcctatgcctatcccggcgagggtggcgcacgcccgcacgcgccagccgcaatcggcgcgtcgcagcggagctacgacgccaacggcaacctcgtgacggccacgtccggatcgggtctgccggcccggacgatcacctgggacggcgagaaccgcccgacggtgctggcgacggaaaacctagccggcggcggcggccagcccgacgtcgcggtgcaggcggcctacggtccggaccgaagccggtacagtttgacccggccgagtccgtcactcgcgccctgcgccgatccgccgacggtcgtggtgacgctgtcgctggggccggacctcgagctggtccggcgtccggtttgcgccgatggtgtggtgagcgagcaggcgacgtggacgaagtacctgccgggcggggccaagcgggtcgggtcgggggccggggtgcaggcgcaggtcctgcatcaggaccatctcgacagcgtgcagctggtgaccgacgcaggggggacggtggcggagcgctcgggctacctgccgttcggccagcggacgcaggtgccagcgccgctgccgggggcggtgcgcgcatcgaacctggagaataaggggttcgtgggcgagcgcgacgacggcgacagcggcctcgcctacctgaacgcgcgttactacgatccggtggtgggccagttcctgtctccagatacgctcgatccgacaatgcccggggtgggcacccaccgctacgcctacgccttcaacgatcccatcaacagaagcgacccaggcggacgccaatcctccgttgaactcgacgagatcagtgttacggccggtccggcctcgggcaccggatctaacgttggtgttggcttcggaagctcgattggaggtggatcgggatatgggcaaggtggatatctcgccaatacatttccgcagtcatcagctgcaaacggattggcatcaagtattaatcagacaagattctctgcaatcagcggaatttcaaatcttagatcaccatgtattcctggaataataggctgctcaagcgcggcaactgctatacttggttccacgagcgctgcaggatcagcagatatattaaaagattttggtaggattggcactggactaggagctggcgccgctcgattgcttggtattttcggcgcgatcttatcactttctggcgacaccccccagcagattatattatatagagcggtaaatccagcagagcttggcagtatcatggcaacaggacaattctcgctcggtccatctggcttttcgcagaaacagttttggtttaatatggatgatgcacaatggtacgggcaatggattgcaccatccacaatcgtaagtacccagataactccatcaacgctatctatgggttaccaatttcgtgatgcgggacacttagctgtatccttcgagggcgctggtataacatcacttaatcgcgatgccgccagatatggaatacggatactagacagcatcggaggcaggccatga

SEQ ID NO: 8121 - DNA, 240 bp, Methylobacterium sp.
atgcgagagaccgcgacgcgactccgtctcgacgaactggtgacctccgatcccgctgtcatgggaggtcggcgcgtctttcggggaacgcgcgtgcctgtggaggtgctgttcgagaaccttgccgacggcctctcgctcgatgagatcctggacgagtacgagagcctcgacagaggtgatgtcgtggcagtgctcgaactcaccgcccgttcgctcgccgcgccacgggcggcatga

SEQ ID NO: 8122 - DNA, 300 bp, Methylobacterium sp.
gtgcccgacttctacgagcatcccgcggaatcgataccggggcgcattcgcgaatgcccggtcgagtactgccagcaagacgatgaggtcatggtctgggtgtacgtcgtcgatcgcgcgaacgacgaaggttcgatcaaccttcgcgacgacgatattcccgtctatctcgaatggatcgtcgagaactgccccggtgcgatcctcttcgaccacgcgacccgcgaaagcggcctgaaatcgggaatccggttccccgattacgcgcagcttcaccaccacctgacgcggtggcgctga

SEQ ID NO: 8123 - DNA, 1152 bp, Methylobacterium sp.
atgaccgtgacgacgtgttttgatgaggcgacgtacgtcgatctggtgatcggcgaagcgaagcagcccgcagcggctctctccgatcggctcggccagatcgttcaggaggcggcgcgccacttcatggcgggcgttctctcgaatgccggctacgacgcgatcctcgaagcggtcgaggcgcgcaagctccgccaacgcgcagcgcagcagcgtcagggatcgatcggcgcagccgcccagagggtcgcggagacgatcgggctggaacgccccgcgaagcgtgcgccggatcgtgcggcctcaccctctctcaccgtcgcgccgcgtgtcacccggataatctccccggaagagcgcatcctacgcgaagcgcggatcgcgcgccgtcgctacctcgccaagtgcgcccgtatccccgcgttgatcgcccggcacttcaccgtgggcgagacggcggtgctcggtcaggtcgcctatcaggtcgcccacaacaacggcgaatgcaccctctcggtcgatgccctggcggcatgcgccaaggtctgccggagggtcgtgcaatccgcccttcggcgagccttttctgccggcttcctcatcatccacgcgcgccgtcgtcaaaccaacctcatccgtctggttgcctccgactggatcgtctggaaccgtcgccccaaaactgaaaaaactcaagaaagagaaagatataaggaaccctctcagggtgcagaaatctgcacggcaagcccttccgtgcccacctcggaaacggtcgaagcggagcgggtcgcggcggaggttcgagcgggggaggcggtcgaggaagcccggcggctctgggccgatgaacggtcaaagcaaaccgctctcgcgacggtgcgggcgagccgttccgattggaccacccggcaggaggccgatccctggcgtgagcagtggccgttcgtcgtctcagtcggcgatcggcacatcgacgcgcggggcgatctgacaggggaggcgctgcgctacctcgccgaccatctcagcggacgcttttcgttcagattccagacgacccgctcacccgcaggcgtcgttgtcgatcggccggtgatcggcctgcgcgatcatctcgacgcggtggccgtcaaggtgatgttcgggtga

SEQ ID NO: 8124 - DNA, 1083 bp, Methylobacterium sp.
atgactgcgccgaagccgttcccgatgaacgcatggtacgccgcggcctgggattacgagatcaagcgcgcgctgaccccgcgccggatctgcgacaccccagtggtgctctaccgccgcggcgacggcggcgtcgccgcgctggaggacgcctgctggcaccgccttctgccgctgtcgctcggccatctccggggagacgaggtggtgtgcggctatcacggtctggtcttcaacccggccgggcgctgcaccttcatgcccgcgcaggagaccatcaacccctcggcctgcgtccgcgccttccctgtcgtcgagaagtaccggctgatctgggtctggatgggcgacccggcgcttgccgaccccgcgacggtgccggatttccactggaacagcgacgcgccgtgggtcggcgagggcgggacctattacggcctgaaatgcgattaccggctggtggtcgacaaccttatggacctcacgcacgagacctacgtccatgccggctcgatcggcgacgaggccatcacccgcaaccccttcgaagtcacccatgccggccgcaaggccgtggtggagcgctggatggaaggcatcgagcccccgccgttctgggctcggatgctcggccgccccggccccgtggaccgctggcagatcatccatttcgaggcgcccggcatcgtggcgggcgatgtcggcgtggctccggccgggaccggcgcgcggacgggcgaccgctcgcaaggcgtgaacggcttcttcctggcagcgatcacgcccgagaccgagacgagctgccactatttctggaacttcgtccgcaacttccgcaccgacgaccagtccctcaccaagacgctcaacctcgcccatgtcaacgacggcaacggcgtctacgatcaggacttcgccgtgctggaggcgcagcagcgggcgatcgaccgcaacccgcgccagcccttctacaacctgaacatcgatgccggcgcgctctgggcccgccgcctgatcgacacgatgctggcggccgagcagggcggcccggccggggacccgccgcgcctcgcggccgagtag

SEQ ID NO: 8125 - DNA, 1404 bp, Methylobacterium sp.
atgccgcaggatgagcccgacatgagcgccgaccgtatccttgccgccgacctcgtcctgacgatggacccggacaatcgcgtcctcacagacggcgccgtcctgatccaaggaagccggatcggtgcggtcggcccccgcgaggcgatcatcgccgcgaacccaggcgcagcggtcgtgcgcctgcccgaccggctgctcatgccgggcctcgtcaatgcgcacatgcattccggcttcttgcgcggcaccgctgagcatctcccggtctgggactggctgcggctgcacatcaacccgatgcaccggctgctgcgccccgaggaggcggaggccgcctcctggctctgctacgctgagggcctcctgtccggcagcacgacgatgctcgacatgtggcgcttcatggagggcagcgcgcgggccgccgagaccctgggcaaccgcctcgtctgcgtgccctatgtcggcgcgcatcccgactacgactatttcgaccacctcgacgacaacgaaaggctgatcgagagccggcacggcagcgcgaacgggcgcatcaacgtttgggtcgggctggagcacctgttctacgccgacgaggccgggcagcggcgcgccatcgagatggcccagcgccaccgcaccgggtttcacacccattgcagcgaggccgaggtcgaaatcgccgagttcgagcagcgctacggctgccgggcgatggtcgccctcgaccggctcggcttcttcgagacgccgcacgcgctcatcgcccacgcggtctggctcgacgccgctgagatcgagctgatcgccgcgcgcggcgtggcggtggcgcacaaccctgtcagcaacatgaaactcgcgagcggcatcgcgccggtcgacgcgatgctgcgggctggcgtcgcggtcggcctcggcaccgacggcgagaaggagaacaacaacctcgacatgttcgaggagatgaagaccgcctcgctgctcggaaagctcaagaacctcgacgcggcggccctcgattcctgggaggccctgcgcatgggaacgattctgggcgcgaaggcgctcgggctcgaccgtgagatcggctccctcgaacccggcaagcgcgccgacctgatcgccatccgcaccgacacgccgcggatgacgccgctcttcggcgatggcccctggttcaacctccagcacaacctcgtccacgcggtgcggggctcggacgtcgatctgaccatggtcgacggcgtggtcgtggtcgaggacggccgcctcaagaccgcagacctgcgcgcgctgatcgaccatgtccgcggcctcgcgccgggcctgttcgcgcgccgcgcggcctggctcgccgagaacgagaccggcagcgtccagtggacggaggccggccgatga

SEQ ID NO: 8126 - DNA, 861 bp, Methylobacterium sp.
atgaagaccgacgaccgggtggccctcgatgaatggtacgccgtcgagaccgcggcggccgtgaccgcggcgcccgtcgtgacccgcctcctcggccaggacatcgtctgcgaccggttgccggacggcgcgccgcgggtgcgcgaatgcttggccgacgggttcggcccggctctgccggtgcgcgagcgctacggctgcctctggaccaccctcgggcacccgaaccgcgacgtgatcgcgatcacggaagccgacgagccggaccgccgccacgtcccctgcggctgggtgaagatgcgcacctccggcccgcgcgtggtcgagaacttcctcgacatggcccatttccccttcgtccataccgacatcctcggcgccgagccgaacaccgaggtgccggcctacgcctccgagatccgccgcgacgtcgatgaggtctgggcgacgaattgcagcttcttccagccccgcatcgccgcgaccgagacgcagggcgatttcgtccgcctcacctaccgggtgccctcgcccttcgtggtgatgctctaccgggtctgcccgagcgccccggaccgcctcgacgccatcgccctgttcatccagccgatggaggaggagctgtgccgggcccagcccgtgatgtacctcgtggattcctgctcgacgcacacggcgctgctgaatttcgagcaggtgatcttcctgcaggaccgcatcatcgtcgagaaccagcgccccctgaggctgccgctagagccccgccacgagatcccgacgcgggccgacaagtcctccgtggtctaccggcgctggctcaaggagaagggacttcgcttcggtacggtggggcacggatga

SEQ ID NO: 8127 - DNA, 540 bp, Methylobacterium sp.
gtgcgcgctcggcgacggagcggcggcgtgagcgcgccgcgcttccgcctgaacgggtgcgaccgcgtcctcccggacgatcccgcccgcagcctcctcgacatcctgcgcgaggatcacgggctcacggcggcgaagcccggctgccggatcgggcgctgcggcgcctgcactgtcctgatggatgggcggcccgtcaacgcctgcctcgtcatggcctatcgcctggagggggccgagatcctgaccgcggaccaccccgaggcgggcccggaggtcgcgatcgtgcgcgccgccctcatcgacgagaatgcgttccagtgcggctactgcgcaccgggcttcgtcctggccctcgccgccctgttcggccgcgtgccggaggccggcgaggcggagatccgggccgcgctgaccggcaatctctgccgctgcacgggatacgcctcgatcctgcgcggggcgctgaccgcgcgggaccgactccgcgccgcgcgcgacgccgagggtgcggagccgtccgctcagcttccgcgatag

SEQ ID NO: 8128 - DNA, 138 bp, Methylobacterium sp.
atgggtaccaccaacttcctgacccggaccttggcgaaggtcaggaccgagatgagcctgcaggttctggtctacaacatgaagcggatgatccagatcttcggggtcggtccgttgatggtagcgatccaggcctga

SEQ ID NO: 8129 - DNA, 87 bp, Methylobacterium sp.
atgaccaccgcggacacatcgctgctcgcggcggcattcgtgctcggcctcggagcggccgttcttctcaacgccctgctgacctga

SEQ ID NO: 8130 - DNA, 195 bp, Methylobacterium sp.
atgccggcccttttcgtttgggcgtggtccaagtcggtcttggtccgagggagcgaggcgtcagccgatcagcagcagatccagcacgaccgccgcgatgccgcctgccacggccaagccgaggataacgacgctgctgagctgatcgacggaattcacgtcctgaccgacgcggtgttggaactcattcgctga

SEQ ID NO: 8131 - DNA, 411 bp, Methylobacterium sp.
atgtcccgcatcacgaccctgacgctggccggtctcaccgcggcgagcctgacggtgacggccgtttcgcccgtccaggccgcgcccctgccggcgatgagcgctgcgcaggttggcagcggccccgccgtcgagaccgtcggctggcgccgcggatattacggaggctattacggcccccgttacggctacggctacggttatcgccgccgcaacgtcgcgggtgcgctgttcgcgggtgcggcgctcggcctgatcggcggcgcgatcgccgccagtgcggccccccgctactacggctatccggcctatggcggttactacggctacggcgtccccgtcggctattacggcggctacggctacccggtttatggcggctattacggctacggcccctacggctggtag

SEQ ID NO: 8132 - DNA, 612 bp, Methylobacterium sp.
ttgctcagggagcggcgcctgatcgccggctccgggctgttcgacgagtcgctctacctgttcgaagcccccgacgtgatgcgtgaggaggcggagccgatcgagcatttctgccgtttcggttggcgcgagggccggcggccgaacctctacttcgatccgctctggtatcgcgaccggtatctcgagggagccgaccgggaccctctcgtgcattacctcacgatcggcgagagtgccggttgccgcccggtctgctatttcgatccacactggtacgcgcgaacctaccggctgccgagccgggccaacgcgctggcccatttcctcgcccaccggcgcagtcagcgtttcgcgcccaacccggacttcgatctcgccttctatctcgaccgctatggtgtcgagatcggcccgaaccgcgatcccttcgcgcaccacctgcgcttcggggccgcccgagatatcgacccgtcgccgcatttcgacgcggggcattaccgaaaatcgacgatgaccgatctgacacccgagacgcgcacgccgtgggctgcggccgatctgcgcgtgcccctcgttcattatctggacacgcagtatcgccgttcctaa

SEQ ID NO: 8133 - DNA, 510 bp, Methylobacterium sp.
atgacaaggtggaacttcagggcccaggtcatcgacctgggcgttatcgagttgggcacgcactttgtgacctataacggcgtcaaggtcgtcacccctgacgggaagcgaagcttcctgggcagggtgacgatgcacaatgagatcaacgccctcttccgggagacggaaggggagttcgtggaccttcatttcgtcggtcccaaggggaatcacgtgccgttgctttacggcttgaagactgaccgagagaacgcgcacagccggttcactcacatgtacgaggccaaggcacaggtttacggcgctctgatcctatcgctgctcttgtgctttctcctgatcggcttcgtgatgattccggtctgcctgctttgcctcgcgcatctggcgcgatggaacccgccctcgcggaaggttttcgaggccctgaccgaccggggtacatcatcccctggcaccggctcgggacgcgtcatcgcgcaggagcagccgagccccgtgacatga

SEQ ID NO: 8134 - DNA, 468 bp, Methylobacterium sp.
atgaatatgtccgttctgaagaccctcaagctgagcgccgccgcacctgccgcatcggcgactgatcctctctcccgcgcgcgcgagaagctgctggcccaactcgccgagcagaagaacatggtgagcgccagccttgagggtcgactgtacgagcccccgaaggtagcggccgtccgcaagaatgctgcaggcgagcgcgtgcgggtcgaggtggctcgccgtgcacgcaagggctggttccaggatcaggccagcacggtgcacttcatcatgcgcgtgggcggcaaacccctggagctgcaaccgggtaaggccgccatcagcatcggcagtctcgacaagctgcccggcaccatcgacgcgctgatctcggcggtgagggcaggggagctggacccgcagatccgggaggcagccgccgcgcgcgggctcatgatggctgagcggcggaagaaggctgcttga

SEQ ID NO: 8135 - DNA, 411 bp, Methylobacterium sp.
gtgagcgccctcgccttgcagaaggccatgggcgcccgcctggcaggcttcccggccgtgaccgacctcgtgccggccgagcacatcgtggacgcccacgggcgccctgcgcgcttcccgagcgtcatcctcggcgacgggcaggaagtcgcggccgacctcacgttcgagcgccggcacgtcactgtgttcgtcgatctccacgtctgggatcgctcgccgagcttcacctcgaccaaggccatcgcgggcgcgatccgggccgccttgcacggcgacgatctagttctcgacgagggccggctcctcgacctgaagcacgccggcacccgctacctgcgcgacccggacgggcagaccgcgcacgccgtcgtcaccatcgaggcgcttgtcgaggagacccggccgtga

SEQ ID NO: 8136 - DNA, 417 bp, Methylobacterium sp.
atgtcgccctcgttcgcccttcaggttctcatccacgagcgtctgtccaccgccccggccgtgaccgcgctcgtgcccgctcgcgacatcaccgaccggcatgggcgcccggcccgcttcccgtcgatcaccttcggcgagggccgggagtatcccctgggcggcgtgaagcgcgacagcgcgcgcgtatcgttcgatatccatgtctggaccgatacgcccggcacccgcgacgcgaagctcatcgtggacgcggcacgccgcgcgctccgtgacgccccgtgggaggcggacggtcatgccgtgctggatctccggttcgagggcgcccgctacctgcccgatcccggcgcgaccgacatcacgcatggcgtgctgacgctcgacgccttcatgatcgagctggaggacgcctga

SEQ ID NO: 8137 - DNA, 873 bp, Methylobacterium sp.
gtgaagctgacccagatcgtcgccgtgaccgctgcgctcctggccgggcctgtgacggcgtgggcttcggatcacgcggcccaccgcatcgtcggcgatgaacgggagatcgtcaggcgttacgaaacctcgggtcgaaacggcagcagttcatcgaattcgcggggcagcgacgcccttctcgaacgggtggtcgccgtcagggacgacggcgtggagctggaatatgatctgccgaagaacacgtccgcgccggacagagcgcgccagtggcagtttccggcccgcctgttcaagccgtcgagcgggcctgcaaagctggtcaatgctgacgagatcgacgcgcgcatcgacgcgtggatcaaggcggccgggctgacgcgggcgtcatgcgggggctggctgttcacgtggaccatgttcaagatcgagtgcgatccgcaatccatcatcgcgacggtcgaggcgatcgacctgcgatccctgagggccggcgagggcgaaccctaccgggatatcgaatcgcgggtgtccgggatgttgacgcggacgcaggccggcccacgcggcgagacctacaccgcgcttctcccgatcgatcccgacgcggtccgccgaacacgcgccgaaggggatgttgctgtcgcgcagatcatggataagacgttgaccctggatgacgcgcttcgcaggcgggcgcgggacaccatctcgggtacgatcgcgatcacgctcgagacggatgcggctgggacggtctggcgtcgaacgagggtcacgacactggaagccgtcggttcggacgggacgccggaaagctcgacccatacggagatcgtgacgcatcgggcggcctcggagcagcggccgtga

SEQ ID NO: 8138 - DNA, 81 bp, Methylobacterium sp.
atgccctgccatccgccggacgcggacatcgacccattcgaatcgcctcggcaggacatgttcatgcgcttcaaagtctag

SEQ ID NO: 8139 - DNA, 192 bp, Methylobacterium sp.
gtgatcctcgatcccgatccgctctggtatgaccgtgaagatccggatgagccggtggggcttttgtgtcttgtgctgagcatcgggctcgtttcgctggcgcgcttgtttttcttgcctgaagaaatgtggcccgagatcaagcgcgcgaccgtcgccgccttccgggatgtcgaggagacacattcgtga

SEQ ID NO: 8140 - DNA, 939 bp, Methylobacterium sp.
atgcagccggaccacacgcgcgcgattcccgtcttccgcctctacggcgaggtggcggaggccgccgcgccgaatttcgtgcacgccgagcggatcgggccgagcgcgcgcctgcacgactgggagatcgccgcccaccgccacgaccacctgacccaggctctcatggttacggagggcggcggccaggtccgaatcgacgcaggcaacgaccgcttccgggcgccctggctgctctggatccccgccggcacggtgcacgccttttcgttccggccggagacagagggggtcgttctctccctctccgacgacttcctggggtccgtcatcacccacgaccacgaggccgcgcgcctcgacgcgacagccgcggcggtgttcagcggccccccaggcgcgcccgacgagatcgacatgaacgtggtctcgctgttcgagggcctgcggcgcgaggtcggcggcgcgcagccgggctcgttcagcgctgtggcggcgctggtcaagcttctgctcgtcggcgtcgtacgcacgcacgccctgcgtgccttcaccgagcccgccgcggcggcgcgggccggactctaccgacgcttccgccgactgcttgaggccaatctccggcagaactggccggtcgcccgcttcgcggccgatctcggggtcagccctgaccgccttcacgcggcctgcacacaggtcgtgggtaagccgccgcagtcggtgctgcacgagcgccagatgctcgaggctcagcgcgccctgatctacaccgcgctgccgatctcgaagatcgcgttcgatctcggcttcaacgacccggcctatttctcgcgcttcttcgcccagcgcgcggggatcagtccggccgcctaccgcaagcggaatcgcccggcggacccctctgcccgaggcgccccgcccctgcgcgtccggtaa

SEQ ID NO: 8141 - DNA, 543 bp, Methylobacterium sp.
atgccccgtcttctcgtccttgcctgctcggcgaccaagcgccccgatcccgaacgcatcccggcactcgcgcgctacgacggcccgctgtggcggaccctgcgcgccgccgacccggagggccggcgggcccgggtcgcattcctgtcggcccattacggcttccgcgacgcggcgacgccgatcgcggcctacgacgcgcggctgacccaggacctcgccgagcggatggtcgccgacggcgtgaccacgcgctggcccaggccgccctcgccgcggcggcccgacacctacggcatgcacgccggcgccgagatcgcctcgatgacagggtatggcgccgagccgttcgaggatgtcgcgctggtgggtggacaactctacctcgacgtcatgcaggcattcgtggcgggcttcgtcaccatgggctgcgtctggccgaacgcccgcatcaccgtcatcaacgggccgatcggcctgatgcggcgagatcttcgacattggttgctcgaggccgcctcggtgcagggagggcgatcatga

SEQ ID NO: 8142 - DNA, 1254 bp, Methylobacterium sp.
atgagcaacaggtggccccacctcgactacctcggttggcgcgagacctgttcggccctgcacctctacctgcagatcgcgggcaaataccggctggcgcatagcccgtggctcaaccactcctggaacgcgaccttctacgtcacgcctcgtggcctttcctcatctcccatttctgacgggccggggatcgagatcctattcgatcttcacgagcacagggtcgtcggcacgaatggtgacggccgcgaggcatcgttcgcgcttggcccgtccacggtcgcgacgttccatgccgattttgtccgtctcgtgtccgacctcggcggcacgcccaccttcgacgggcagccgaacgaggtgccctacccgacgcccttccgcgaggatgatcgcgaccggccctgggatcgcgacgccgtacagcgcttccatcgggcattgatggcagccgaccgggtgttcaaggcgttccggacctccttcctcggcaagtccagcccagtccacctattctggggcgctctcgacttggccgtgacccgcttctcgggccggcgcgcaccactccatcggggcggcattcctgcacttcccgacgacgtggcgcgggaagcctacgaccgcgaggttgcctcggcgggcttctggccgggcggcggcggcatcgactatcccgccttctacgcctacgcctacccggccccgagcggctttcgaagtgcatcggttcgtcccgatgccgccttctggctcgaggaactgggcgagttcgtccttccctacgacgcggtgcaatcggcagccgaacccgacgaggctctcatggcgtttctcgtctcgacctacgaggccgctgctgacctgggaggatgggaccgtgacctgctggaatgcgtgcagggtcagccgcgcaaggcgcggcaaccggacgccgagccatccggcgagacatcgcggtcgacccacgtgacggtcgaacgggaagaaagggcaacgaaggggcgctaccggatcgtcgtcgagggcgtcgaggccgaaatgacctacacccgctccagcgagacattgatcatcatcgattctaccaacgtcccggccgccctgcggggccgcaggatcggcgagcagatggttcgccgggctgtcgaggatgcccggcgtgatggggtcgccatcatcccgctctgtccattcgctaaggcgcaaatcgagcgccacccggaatggcaggacgtgctgcgtcgagcatag

SEQ ID NO: 8143 - DNA, 171 bp, Methylobacterium sp.
atgcgcttcgggcgcttgctggtcgttccgctcggccgggaccgagttttgactcgggccgcgatcggcctgctgctcagtcgcgggaagaacggcctcggcctgtgccgccgatccccgctcgttggcatcgcttggggcccgaccgtggccggcggtcggcgcgtctga

SEQ ID NO: 8144 - DNA, 204 bp, Methylobacterium sp.
atgctaggctggtctcaggatcggctgagcaatgcctccggcgtctccctcccaacgatcaagcgcctcgaacccggcgagggatctctgcaaacgcggctcgatacgctcaacaagctgcaggccgccttggaagccgcaggtgtgctcttcatcgctgagaacggcgaggggcctggtgtgcggctaaggaagagcttctga

SEQ ID NO: 8145 - DNA, 378 bp, Methylobacterium sp.
atggtagagcgcggatggcgatggagactccgccggaggttcgctgagcgtccgatcctgactgccgttcagctcgcctgtttcgtgctctgggtcggcgtcgtcggcttgggcacctacttgtccttcgccctgccctacttcccacctcccccgggcgcaaagtgttacttcaccgatgccctaatcatcttcatcgagtgccgagatggtttccccacgttgtggttgaacattgcgtggtggtggacttggggaagcttcgtgacaatcagcttcctgcccttctccctacctgtcgcgttgccggcgctcgtgacgcttggctttgcgcttgggttcgctcgcttgctgtatcgctggcgctggacttcatga

SEQ ID NO: 8146 - DNA, 270 bp, Methylobacterium sp.
atggccggcggcctgttcggcgcgagcaccgccaacgctgccccgctcacgccggctccggaagcggctctcgcctcggaggcgacggtcgagacggtgcagtggcagcaccaccacttcggccaccgtcaccatccccgccattggggtcaccgccaccaccatcacggccattgggggcatcaccgccgccactggggccaccgccatcaccatcacggccactggggccatcaccgcaggcactggggccaccgccaccactggtag

SEQ ID NO: 8147 - DNA, 654 bp, Methylobacterium sp.
atgaacgtcatcgcattcgtcacccagaagggcggcaccggcaaaagcagcctggccgtctcccttgccgtcgcggccgaggagcggggcatcaagacctcgatcatcgatctcgacccgcagggcaccgccaagaactggtacgagcgccgcgaggccgaaggcggccccgaggtcaacgccctccagtccggtcagctcgaggctgccatgggcctgctgaagaagcagggggtccagctggtgatcatcgacacccccggtgtcgatacgcctgcggctaccgccgcgatccaggtggccagcctgtgcctcattccggcccgtccgagcattgccgacatcgaggcggcccgcccgaccgtgcgcagcatcgcccgcctcgacaaaccgttctcctacgtcctcaaccagtgcccgccgggtcgctcgatccgcaccggcgacgccttccgcgtcctgcagctgtccggcgcggtggcgagcacgccgcttgccatgcgcgccgaccacatggacgcgctggcgacagggcagggggtcactgaacgcgacaccaacagcaaggccgctgccgaagtgcgcgagctgctgcagtgggcgctcaccaagatggaagggaagccacatggccaagaaacccgcgtcgcttga

SEQ ID NO: 8148 - DNA, 288 bp, Methylobacterium sp.
atggccaagaaacccgcgtcgcttgaggctgccctcggcggccacacgcaacccgcgccccaggacaccgccgaggtcctgcagcacccggcgacgcagcaggccggccgtcctgccaaaccgcaggacgtcaagctgaccgtctacgtgccgccggccgcgagcaagcgcctgcgcctgatgtgcatcgagcacgaccgcgacctgaacagctacctgcgtgagggcctcgatatggtgctggaaaagtacggtcagccgtccctggctgagttcgccaagaagtag

SEQ ID NO: 8149 - DNA, 204 bp, Methylobacterium sp.
atgagccgcgaaaccatcaaggaccgttaccaacgaacgctcgggtacatcatcaccgagggtagtgggcgtcagaaggcgctgaacgcggcacagcggacgctgggctactactacccgcagcaggacgtcactaaggacgccggccagcgcacgatcgcgcacggcaacgtgctggcatcgctcatctacgacgcaggctga

SEQ ID NO: 8150 - DNA, 504 bp, Methylobacterium sp.
gtgagcctcgacttcctcgaacgcaaggccgcgattagcgcgaccgacgagggcgagatcaccgccctcgcgtggtccttcgcctcggccgaccgctacggcgacatcatcaccaagggcgccttcagccccctcccgaccacgctccccatgctgttcgcgcacgatcccggccaggtggtcggagtgtgggagcacttcgccgagacgcccgagggcctggaagtccggggccgcatgttcctcggtcagacccgcgccgacgaggtgcgcaccatgatccaggccggcgctctcggcgggatcagcatcggcttcgacaagcggcagtgggcgccccgccccgatcaccgcacaggccgcaccatccgctccctgaccctggccgaggtgtccctcgtcagcgtccccgcccatccccgtgcgcgcatccgcacggcgaagaacggcgcggcggccgtcgccatcgcagccgccctcaaccgcttcgcttcgaagctctga

SEQ ID NO: 8151 - DNA, 516 bp, Methylobacterium sp.
atgctcaagcaccgcctcatcacgaagtctctcaccgtcgccgacacgggcgagatcaccggcatcgcctggggcaccggccccgatacggccggcgacgtgatccaccccggcaccttcggccgcgtcacgggtcccgtgaagatgctctggcagcatcggcaggatgagcccatcggcacctgggacatgatcgaggaaaaggcggacgggcttcacgtcgccggccgcctcgccatcgagcattcgcctcgtgcccgtgaggcgcacgccttcctgcgcgacggcatcgttgacgggctctccatcggcttccggctggagaagaaggccgctccccgtgcctacgggatcggtcgcgacatccgccccgagcacgggcttcggctcgccgaaatctccatcgtgaccttcccgagccatcccggcgcgcgggtcatgtccacgaaatcagccgccgacgccaccgctattgcgaaggctctgagccggttccgggcttcgatccgggcctaa

SEQ ID NO: 8152 - DNA, 591 bp, Methylobacterium sp.
atgttcctcgctgacgaggaagtcacgattgccctggacgacgagcgcattcacctgcgcccgtcgctccgggcggcaacgcgcatcgagcggcagcacggcggcttcccggccgtcctgcgcgccctcgacgagtgcagcgtcaccgtgatcgccgacgtgatccgggagtgcgcgagcgtcccgacgaccctccccgaccgtcttctcgcaccgggcattgcgtggcgtgtggcgcctctcgtgcccggccttcaggtgctcgtgctcaacctcatgggctacgatcccgacgccgaggagaaggccgacgacggccaggatgcggacccgcgcagcaccttcgccgaggttcacaccaagctctaccgcctcgcgacgggttggctcggctggacgccggccgaaacctgggcggcctcgccccgcgagatcaagcaggcatacgagggccgcgtcgagctcttgcgcaccgtcttcggcggcggcgaggacaagccgtccgaccaggaccgtgcggccacggccgacgagcggttcgcctcgggcatccgcgccatgggaaccacgaaggtcgcgaggcccgcgtga

SEQ ID NO: 8153 - DNA, 576 bp, Methylobacterium sp.
atgcagctcgcggctgacaacataatcgagttcggccgggtgcgcgtttcgctccggccgaccctatgggccgcgatccgcctcgacagggcgcacgggctccagggcctcgtgcgtggcatcacggacggttcgctgtccgtgatgtccgacatcctccgggagagcgccgacccgtccgagttcgacccgaacatgctgttggtgatcgggccggatgggctcggcaccacccttgcgcagttgcagggaccgatgctccggcacgtcttcgccctctatgggatcgactccgatcatcgcccggcaacgtcgaaggcgcctgcgaaggtgaagctgagcgatccctttgccgagctgttctccatcgcgacgggcgtgctgggatggtccccggagaccgcctacgccgcgagcccggccgagatcatcgaagcgaaccgtggccgcacgcgcttcgtcaacgaccttctccgcacgatcttcggcggcaaggccgaggacgccccggaagctcagcttcacgccgagctggatcgcgagggccttgcagctctgaaggctatggcggcctga

SEQ ID NO: 8154 - DNA, 327 bp, Methylobacterium sp.
gtgatcgacgcccggaagctcgaccgcaccatcaccatcgagcgcctgacgcgcaccctcgacgagttccgcgccgaggtggagacgtgggcgcccgtggcgacgctcgccgcgcagcgcatcgagaacggcacccgcgagttcgtccgcgcctacggccaggccgaggaaggcgccgcgctgttccgcacgcgctacgtcgccggcatcaccacggccgaccgcatcgtgttcgagggcgcggcccatgagctcgtcgaagtggtcgaactcggccggcgcgagggcctgaccctgcgcacgaagacgcaggggatcgggccgtga

SEQ ID NO: 8155 - DNA, 303 bp, Methylobacterium sp.
atgcccttcaagcacgccgtgcagttgatgacgttgcagggcatgatgggccagctctgcggtcggccatcgacggtctactttgggcggtcgggcgtgcacttgccaaacgtagccgtttttaaatatttactgacacctcgcggtcatctactaatcgaagcgttgggccacctcctcagagaggttcctttcgacgagatcagtcaccgcttgctcgctgagttcgtcgccattcgaagcgggaccggcgcgaccgaagccacgatccggcaacgccgcgtagttctagctccgtgttga

SEQ ID NO: 8156 - DNA, 351 bp, Methylobacterium sp.
atgaggacggtcgtggcggctgaggtcgtctggtcccgactcgcgagggcggacctcctcgatatctacgtgagcatcggaagccacgaccctgccgccgcagagcggctctacgacaggatcgaagaacgggcacggcaactcgccttgcagcctcgcatgggtccgcggcgcccggaaatccggccgagcacgcgtatcctggtcgagaccccgttcctcatcttgtacgagacgatacccgacaccgacgacgcgcccgtgcgcgaggttgagatcgtccgcgttctcgacggacggagtgatttgaacgttgtcttgcacgccggagaaaattccgcggatcggtga

SEQ ID NO: 8157 - DNA, 135 bp, Methylobacterium sp.
gtgaattgggctgagctttacctcgtcgaagacagcattccgatctccaaggttgcttggctgctaagcttcgaggaggcgcgttcgttcacccacgcctgcaagcgctggccggcataccgccacgcgagctga

SEQ ID NO: 8158 - DNA, 669 bp, Methylobacterium sp.
atggctcccaaagccctttggaaggggattggttgtaggctgcggcaggtcgttccgagtcggggccgcaggatgaacaaggcaacacgctggacgctgcggacgttgggtggccttggctttctcctgacgttgaacggggcgatgctgctgggcgcatgggcattgctgcaccgtattccttttgccgatccgttcgcggagcaatccgcgtcccactatcggcgagcgattccggcggagatcggcatcacgaccatggttgccgaaggttcggatgcgagtctgtcgagtctgttcctgcctatcacccgcgaagcctgcggtggggtcgcctttcgactctccgactcggcggctgaacagattgcagcacaaggtttggcgcatctcggatcggcccgcatcggacgcggctacgagaatagccccgaggaacattactttacctatcagccctggcaggagacgcccgtgccgagcacttggatcggcgatggcaaatgggccggggcgcttggatgtttgaaacagagcgcccgccagttcgataccgatgtcgtcaccgaagcggctcgtcagccgggcgcgtttttcacaacaggacgtgaaagcgagatcttgatcatcccacgcctgcggcttttgattctcacctacttcggatga

SEQ ID NO: 8159 - DNA, 531 bp, Methylobacterium sp.
atgcggcgggaggaccgctcggggtggtttgcagacctcatcggctccgacatgatcggcggcatgaaggactggatcgagcacttccgagcagcagcgaaagggttggccgtcgctcacgtctggcgaggctacggctcggccctcttcgtcgagtttggtgcactcaggcccacaacctgtatgcgcaaagacggtaggcccagcgcgccctcgggtgagatcggtctgatgatcgaggcggattggcgtatcgaggacgagcgcaccatcgtgtgcggcagcggcagcgatgaggaactctgggaaccgacgttcgccagtctcgtcggcaagcacgtcgtcaacgtggcgacgttcgggcgtttgcccgagatcttggtctcgctctcggatggcttccacgttgcgtcgttctcgaccctggagggcgatcccgagtggacattgttcgaccggcgaagcaccgcgccaatcacggtccattgtcggtctggcgcgatcatcgaggagcaagcaagctctgcttag

SEQ ID NO: 8160 - DNA, 450 bp, Methylobacterium sp.
atgaccgacttgatccagcacttccgcacggcagcttgtgggttggccgtagcacacgtctggcgcgggcacggctcggcgttgttcgttgagcttggcgcgctaacatcagcgacgcaccgcgatggctcccccggtcagccacagggagagatcggcctgatgatcgagtggagttggcggatcgaggatggaaggtccatcgcctgcggcagttggggcgacgaggacctgtggcccccgacctttgcgcgcctgctcggctgtccggtccaggacctctcgatgttcggccgtctgcccgaggtggtcctgtcgctggcaggcgatctgcgcgtagcatcgttcatgacggcggaaggcgacccggcatggacgctgttcgaccggcgcggtcctcgctccgttgccgtgggctgtcgatcgggggtggtcggcgttgagccgtaa

SEQ ID NO: 8161 - DNA, 201 bp, Methylobacterium sp.
atgaaatacaaccaaattagtagcaacgggcttcgcgcgcttcacagcggcatcgtcagcgccctggccgaggacgatgcgcagccgcctcaccgcaaggcatacggcgttcgcgagtatcccgactggcggcggcacgccgactgcatcgaggccgagttggcggctcggggacagtggattgttccggtccgctggtaa

SEQ ID NO: 8162 - DNA, 246 bp, Methylobacterium sp.
atgacggaagccattgaacacctgaagaactggtgcgccgatcagcacaaactgttgtccaaaaacctcgacctcatggagaggggattgctccatacgagcgaaggccgcgtcggcggtggcgtcgtcgatacaacagacgcatcgattgctcgaacgaaggagtcgctcgccgaacttgagagtgtgctccggattattcgcgacgattcggcggagcaggcggcggacggaccgagcgagtaa

SEQ ID NO: 8163 - DNA, 384 bp, Methylobacterium sp.
ttggtcggtggccgctgggtgaccaaccaagcgatcgatctcgtccaactcgcgccggacatgtataaaatcgattggcacgagcccaccggcacctgcgtcagcctgtattttgatacgaagcgccggctggtgcacggcaccatcttcttcccgcagtggatcgcgggtgaaggagcacatcccgagaagacgatctgctaccagaatgactttatggaagatatgcaccgcttccgagacgaaggcccggcatacccatacgtggtcatcggcgagttcgccaagatcacatttatggagcggcgtggccgcgacaacgacgaggtcatcaacgcggcccccggccaacttcctgcgggctatctcgaacgcacgaactga

SEQ ID NO: 8164 - DNA, 267 bp, Methylobacterium sp.
atggcattgagcgggaaaccagcccggccggtcgccaagcctgccgatccggtcgaggccttcatcagcaagggcggctcggtgccggcgcaggacagcccggctgataaggctgcgaagggtgcacagcaccccctgaaattccctgccgacagcgatctgtttgataggctggagcaggcccgtaaagcgagcgtggtccgcctgccgcgcaatacgtggatcctccaggccatcgcggaaaagctcgcgcgggatgccggctga

SEQ ID NO: 8165 - DNA, 615 bp, Methylobacterium sp.
atgacgaatacgctcgacgcagccatccgaagcgcggccctggcggggactgccgaccctccttctcgcagcgtccccgggcggggcggcggcggggcggcgtccgccaaggacgctgcgccgacgccgatcgagttctatgcctcgatctccgtcaaaccggaggcgatggacgggttcctggcggtgatgcgcgcgaacgcgcgcgcctcgcgcgaggaggccggcaccgtctccttcgacgcctaccgccgcgcggactgtggcaacgagctgctcctgatggagcgctgggccaacgaggccgcggtcgaggcacatggccagacgccgcaccttcaggccgtcgtcgaccgcatcgaaagcgacttgaacggggcgccgcaggagctgcatctggtgcgcctctcgccgatggcgccggaaaagccgatcacggacccggccgccacgcgcaacgtcgccgtcaccctccacgtcaagccggagaagcgcgaagccttccagcaggctcttctggacgtggtcgagccgttcaacgcgatctgggcggaattccttgcccgaccgctcggcgaaggtcggcgccttctctcggacgccgcaccgagctga

SEQ ID NO: 8166 - DNA, 1509 bp, Methylobacterium sp.
gtgcaggatttgtcggtaacaacatcgacgctcgacctgggtcggacgtgctggcgcatcgcccgcgccgaccgtttcgccctgatcgtcgacgcggcaaactactttgacactctcaggcatgcgatgatccaggcacgggaaagtatcctcctcatcggctgggacttcgacactcgcgtggcgctgacgatcgacgaggacggtgaatggccgacaacgcttgggccgttcatcgatgccctcgtcgatcgtcggccaggtctcgacatccacgttctcaagtgggacctgggcatcctagggacgctcggccgcgggacgaccccgctgttcgtccttgactgggtgacagacgagcgaatccacctacagctcgaccgcgtccacccggttggggcctgtcatcaccagaagatcgtcgttatcgacgatgccatcgccttttgcgggggcatcgacatcacggtcggacgctgggatacgcgtcagcatctcgacgaggacgcacgtcgtaagagcccatggggcttcgcgcagccgccctggcacgatgcgacgactgccgtcgatggtgaatctgctcgtacgctgggtgagcttgcacgcttacgctggaagcaggcgacaggcgagtgcctcaagactccatcgcggcaatctggggatcgttggcccaaggatctccaaccgaccttcacgaatgttgaggtcggcatcgtcaggtctcagcctacccatggagaagaaggggaggcacgtgagatagaggcatatctgctcgccgcgatcagcagagcgcagcgattgatctatatcgagagccagtacttcgcctccgatattgtgtcccatgccttgctggagcgtcttcgggagcctcatgggccggagatcgttgtcatcaacccatgtacgtccgaaggctggctcgaagagcaagtcatgggatcggcacgacgcctgatcctggagcggatccaccaagcggatcacgcaggccggttcaagatctattatccggttaccgcgaaggagacgccgatctacgtccatgccaagattctgattgtcgacgaccagatcctgaaggtcggctcgtcgaaccttaacaatcggtcgatgggcttggacacggagtgcgacctcgtggtcgaggccgcgggagacgccgcggtggccgagatgatcgagcagagcatccgcgaggttcggcacgatctcttggccgagcatctcggcacgacacgcgcggaggtagccgctgtcgagaaacggcaggcaggctcccaattgtctacgatcgagacgctgaggcttgcgcccggacgcacactcgttccgctcacgcccgagccgatcacggcctctgagcgcgcgcttgccgctcatcatgctctcgatccagcaaggccggagccgatcagccaccacctcggggctttggcctcgtcggccgtcgatgcagtgcgcgtagcgattttgggaaaggacgcctcgcgcacctga

SEQ ID NO: 8167 - DNA, 528 bp, Methylobacterium sp.
atgacgcaggacacccgaacgccccagccgcgcggcatcgagcatgtcggactgaccgtcccggatatggaggcggcggtccgcttctttcgcgatgtcttcggggccgaggaactctacgccctgaccaggaaggaggccgcgccgatcggcgggcccgaggtcagcgcggtgaacgggatctcacccaccagcgtgatccgcgacctgcgcatgctgcgccttcacaacgggcccaacctcgaactcttcgagatgagcgaggtgcatcgcccaacgccgaccggcatcaacgacatcggtctccaccatttctcgatctactgcgacgacgtggcggcgatcgcggccaaggcgcgggactgtggggcgcagcttctcgagggtccctcgccgttgagctcctacgaggccggggacggcaacacgatccgattcatccgcacgccctgggggatgctcatcgaactgatccagatcccctctccgggccgggagatcgcacgccgctggctccccagctcatag

SEQ ID NO: 8168 - DNA, 441 bp, Methylobacterium sp.
gtggctgaggtgggagagatcaaccagagtttcgagaccaaagtcgaagtcgctctgacccgcatcgaagaacgccaagtcgctgcgaaggatgatctcgcgggaatgcgtgagcagatgaagtcgcagtttgagcaagtccgattggaagcaacccataagcacaataatctgcgcttcgaaatggataagtacgagaaagaacttgagagattcgtcccgcgtgctgaagtcgaggcgatgcaccgcgaaacgcagcagcactgcgacacgaaccgcgccgcggtcgtcgcgcgcgtcgatacactgacggagaaggtagaccggttcggcagtctggccgccaaactcttttgggcgcttgtgagcctcgccggatcggccgcgctcggactgctcacatggtttgtcaagatggcgctgagcggcacaacgatctga

SEQ ID NO: 8169 - DNA, 528 bp, Methylobacterium sp.
atgaaggatcgctgcaaccagccgacgcacaccaactacgcctattatggcgagcgccaaatctcgtacgatcccgagtgggaggagttcgcgggcttcgtgagcgatatggggttgcgaccacccggcatgaccctggatcggcgcgacaacgacaagggttattcccgccataattgccgatgggccacgcccattcgccagggtcgaaaccgccgtaacaacgtgcggatcacctatgcgggccgtacccaagttctgagcgagtgggcggaagaaaccggcatcccctatgggacgctctacgcgcgaatctttgagcttggatggccggcagagcgtgcgttttctacgccgtcgcaggaacaacgcaccctatacctgacccataatggtcagaccctatcgagcgccgaatggggccgggtgaccgggcttcccaacgcgacgatccgtttccgtatcaagatgctcggttggagcatcgaaaagactttgaccacgcccgttggtggcgctggactttga

SEQ ID NO: 8170 - DNA, 471 bp, Methylobacterium sp.
atgcattctcaactcatgtctgtagcgtcgcttgaagcgatgttttttgagataagctgggcggagcgggtcgtcgcacttgagcttcgcgcgagggtgcgcggcaagcgtttcaactggatcgaaagaccagcgatctctccgttcgccttttcaatctgccaagccgcagccgatgacttgtctgagatcgtcggggcgaatacggagctttgtggtcgagcactcgatgcgagccaagtgctctgcgagagttgcttctcgcctctggcggctgcgctcgaaacgggctcaaccgaaagcctcaagtcgtcgttccgcgagattatcgaggaagaatggatgtggggagaccttgacgaatcttggcgtctacggtgccgcgatatcgtcattggtctctacatctgtattgccatcctcttgatccataagccgcggacgacggcggggacggtgatcgctgcctga

SEQ ID NO: 8171 - DNA, 159 bp, Methylobacterium sp.
atgcccgtccatatccgcacgatgctcaccgattcgggtctcaccatccccgtgcgcgacggtcgcctcgcgctgggcacgtggcaggggatctacctgatcgagcaccgcgaccgggcgcatcggcgcgagatcgcgctgcacgccgttggcgcctga

SEQ ID NO: 8172 - DNA, 1317 bp, Methylobacterium sp.
atgtggagggtgcgcgcgatggggttgaagtccatgagcggcaaggaattttcgcgcctcgatgttctgctcgacgtcgaggctgggcgccttgctatcgatgatgcctgcgatctgatggggctgcggcggcggcaggtttttcgcctgctcgcggcatttcggaagcaaggcgcagccggtctgatctcgaagcggcgcggtcggccgagcaacaatcgcctgcccgatgaagtgcgtcagttggccatgagcattgtccgagagcgatattcggactttggccctaccctcgcctgtgagaagctcgccaacctacatgattgtccagtctctcgtgaaacgttgcgcaagtggatgatggaagacggtctgtggttggatcgtaggcgccgcctcccttccgtacatcagccccggcttcgtcgcgaccgtgttggcgaattgattcagatcgatggctcgaagcattactggtttgagagtcgtgggccggaatgcacgttgcttgcgttcatcgacgacgcaacgagtcggatcatgcacgctgcctttgtgcattcggagtctgcattcgactatctccgagaaacacgggcttacctgttgaagcatgggcgccctactgcattctattccgacaagcacgcggtctttcgtgtcagcaagcgggatgccgctggcgggacaggcatgacccaatttggacgcgccttggacgaactcaacatcgacatcatgtgcgcgaacacgccctcagcgaagggtcgtattgagagagcattcggcaccttgcaggatcgtttgatcaaggagatgcgacttgcagaaatttgttcgatggaagatggcaacaagtttctggtcggatttatagccgatcacaacgctcgtttcggcaagccgcctttcgatgagcgagacgcccatcgagcgcttcagggcgatatcattctggacgatgtgtttgcttggaaagaggagagaacagtcacgaacagccttacgctccagtacgacaaggtcacattcatcttggagccgactgctgtcacgcgcccccttgctcgtaagcgtgtgcaggtgatcgattatccggacggacgcttcgcgatccgacatcaaggcttggatttaccgtttcgcaccttcgatcggatacgccatgtcgatcaggcggcgatcgtggagaacaagcgcctgggtgcggtcctggcgttcattgccgagcggcagcaggagcgggatcaaaaccgttcacagaaggcgcctcgtcggcaagggcaggtggaccggcacatgttcaagagcgggtga

SEQ ID NO: 8173 - DNA, 246 bp, Methylobacterium sp.
atgagcccggtggtgtgcgagcttcggctcctgcgcgagtcgattgaggaggacctcgaccgcaagcgcatcgacgagaatctcggccgcggcgtctacggatacgtcggctgcctcatccgcctcgtcgaggacggtgatcgcgacccggcccggtccctgaacgaggcccggagcgcggccggatacctgcgcgccgtcccccgcctgcccgatccccgccctcgcacttggagtgcccgctga

SEQ ID NO: 8174 - DNA, 1908 bp, Methylobacterium sp.
atgtcggtcgtcgaggccatctcgaagctcatggtcgagggagcaccagtcacgatggctgcggttggtggccgcgacgcggtggccggggacttcgactgcctcgtcgcatcaccgtttctcgacgtcttcgtgggttgggccaatacggcgccggccgatggggacgccatcgtcgaccggttggtcctcgaaggactgcgccgatcggtatcgcccgccaactttcgcgaggcgtcgcgtaacttgctgttgtcggacccggtgtgcagacgcctcgggaagcaccttccacgggttctggaggagcgcgccagcgcgagggacaccgatccggaggggctcctcgcagcctatgccttagaagcgtggttctgtttggccctgcgcaagtcagtaggccatctaaagcttctgggcgtgatgacggagattgaggtcggcgagaacgagctctttgtccagcacgtcgccaagcttgtgggggcagcttatcatgcatggggcgaggatgacctactgggtatcctcgacagtctccggcggggtgagcatgcaccggaggaggcgacgtttgaatacgcctacgccatcatggccctcgcgctggacgcgcacgacggcgaaagcttgatatcccgcctcgaagcggccaaaactctctttgaggacgttgtgaggctcgacactgagagagcagacgccctcgtgtacgcctcagtgatcgaactcgtgactctctttcaccgcggcgcccgctacgaggaactagcccccgtcctctcaagactggatgcggcagcggcggatcgagcgttcctcctcgcggcaggcccggtccccgactggctttccccaagatcggaccgggatgagcagtggctcggcctgttgcggtgccttcccgacttggctgcggacctgtcacgtccgagctggtaccgggccgggatcgcgctcgaccgcttgctgcgggtctaccaggccgaacgcacgattgaaggccgggtcgggttcgcaggcctcttccaaccgcgtatcgaaagcgctttcgtcatgcaccgaggcctgctcgcccacctcgacgaccacttgcgcgagttggaagacacaggcgaccaagccacgtctgcggctgcattgcgctcgaggatcgcggtactcgccgaggagggcactgcgccgggcaaaccaccggggggcgactactccaagatgcttccggacgcactcctcgatctcctggcatcgtcgggcgtcgacggcaccattgagatcgccagacattacgcgcgggacagaggcgaactcggcaaccgtgtcgtcgaccggatctacctaggtatttgcgatcggttgaggatggaaagcgctgactacgcaggacaagtggcagtcaccttcgatcggctgctcgagcaggtgatccgattctgcaaagaccggcaagacgcgggcaagcgggacttgggcacgcggggcgcgtacctctatgatcccaccgcccacgagctggaactccagcgggacctgcgcgaatttcttgtcgggaacctcgggagcggcgacacccgcaccgagatcgatggcgtcgccaagggccgcgccgacatcatggtgacgcatggcgaccaccatttccttgccgagatgaagcgccaagacggctttgtcacgttggagtcggcacgcaaattcgtcggccaagcttcgagctaccagaacaccaacgtcaaacttgggtttctgggaatccttgagctcgtcgaccgcgctggcccaccggcagcgctcgagtcctgcatctggtacgaccgagtcgtacccgaaggagacaccattcccaggcatctcgtggtgttccgtgtaccgggcaacctcaaccgcccatctgagctgtcaagatga

SEQ ID NO: 8175 - DNA, 1932 bp, Methylobacterium sp.
atgagcgagggctggtacgaggggatcgccgcgcgggcaggcgtcaccgtgaaggaggtggatgctgtccttcggaagcgtggtattcgggcgaaggccggcgtcggcaagccgagggcgttacgtatcacgaccgtgtcattctcgggcgagaagcggggccgcttttccggacgtttccagttctcgtggacgggattgggaaacggggtttgggcagtcgccagcgagggaaggaacctcgttggtaaatcgacggtcctggaggtcgtgctcgcctcgttgcggggtgacgttaggcggattcagagcgacgtcaggaagtggatcgagcatgcgcgcgtggagttcacgctcgatggtcagcggcacgaggtagattatacctttcatcacacggtaccgaggggggcccttcgaagagagcgcctcgatggggttacggaggaaatcgacagcttcgaaagcgctaccgccttcggcctcgtcatggcgcggttcatgatggaggcgctcgacctcgaggccgttccctaccagcatggaaaggacgaggccgctcaactcgtcgagcatggctggcaggcgctggcgatgggaatgtactttggtggcaaccacgatgtcctgctcggacaaaccactttcgggggtctgcctgcgcgcatcttgcagctctacgtgggcatgccgtgggcagcaacggtggtccaggcatccgcgaccttgaagcagttggcgacagaggagttgcgcgccaaagccgttcgggaggaagcgaagacccggaggaccgaggcacgcgagggccacgagcgacaattgaaagccgcgcggcggcgccttgatgagattcctagagagaacacctacgttgatggcatcgccgcccgtgccgaagctgtcgtgcggacgacggaggaactcgtagaactcgaaaggaggcaggccgcgatcgaggatgaggcgagctcgctcaggggcgtcgccgacgcggacgagcgagaggtccgcgacatccgtgagagcgtcgtagcgaccgccttcttcaacggactgcgaccaacctgctgcccgcgttgcgaggcccgtgtcaccgcgggccggatcgagcgcgagcggagcgagttagaatgctcggtctgcgcagagcccatcacatccgagcggatggaggacgtcgatgacgccttgcagcaagcggcgacccgcatggccgcgagcacatctgccgccctccgcgctgagaatttgttgcctgcccaccaggtcgaggtcgccctggctcggcagcgtctcgttgatgcccgcaccgcactcggggcagcacccacgtcggacattcttcgcgagcaccgggagctggaactcgaggtcgcgcgcctcgaggggatgatcgccgccctcgcggacgaaggggacgaggaagtgacctctccggaccgtggtgtagtccaagctgcctacgacatgtcgaaggaggccatggacgccgcggccggagggttgttcgcggcgctcaatgaagagatcgtctcgctcgcccggcagttcggcttcgtcgccctcgacgagacagacctcaggccgaccggtcgcctcgatctcaagaaaggcggcgatcccacgacatttgtggccgtgacgaaaggcgagaggctgcgattgcgtcttgccactgcaatcgcgctcttgagggtgggtagtcggatgggcgttgggcgccatccggggctcctcatcatcgactcacctggcgcggaggagacgtacgacgccgatctcgaagcgctgcttcgagagctccgctcgctggccgatggcgacctcgggatgcaggtgatcgtatcgagtgcgaaggccgatgaggtagtgcccgccttgggggccgcccgttgccgagtcgcccgcgagggagagtatctttggtag

SEQ ID NO: 8176 - DNA, 222 bp, Methylobacterium sp.
gtgtcggccctggcgctcgttcccacgctcctcggcatgaggcttggcggttgggtgcgcggccggatcagcgagccggtcttccagcgctgtttcttcctcgggctcgtgggcctcgggctgcatctcgcctcgcgggccctgctccgacgtggcagacgcgtgaaggttcatttctcctcgacggtctggccgtccgcctggacaccgtgcttccggtaa

SEQ ID NO: 8177 - DNA, 246 bp, Methylobacterium sp.
atggacagactgaacgacgttgccgccggcatccacattgttcgcgtctacatggacagcggcgtcggcggcatacccaccgtgcagctttgggtggccgccgtgcctcgtgaccaagccgaggaggccgtgcagagggcggttccggcgggttggcgggcggagttgaccagggacaccctgactaaagagaccgtcgcccgtatgaacatccttgctgaagaggttcggcaactcgccacctaa

SEQ ID NO: 8178 - DNA, 204 bp, Methylobacterium sp.
gtggcggcggatgagactgcgcgactggcctcagagatccccgacgactccgacgttgaggcgttgcgcgccatcgcgcgcggtcagcgggtgagggcgctcgaactgcaaggccagacggtaaagatcgcggctagggaattgatcaacgcacgcgccctccatggatccatcgatgacaacgggctgtccaccgggcgatga

SEQ ID NO: 8179 - DNA, 117 bp, Methylobacterium sp.
atgaacgaccggatcaccatcgctgcccccggcgtctcggctgcgatcgtgccgctcggagcggaactgtcgtgccgtcccgaaatgcccttggcagaacccgatttgcgcgtttga

SEQ ID NO: 8180 - DNA, 354 bp, Methylobacterium sp.
atgagcaggaccgcgcacgtcgcattcttcggcgaccacgatcacaccttcgacctggcgaagcccgagctcatccgcgagctcgaaagcctgaccggtgtcggcatcggcgccctcgtgggtcgcgtcgtcgagacccgcactttcttccacgccgaccttgaggccgttctccggctcggcctcattggcggcggcgtccacccgaagcccgcgtctcacctcgtcgagacctacctcccgctgatgccgctcgccgaggtgcagaccatcgccatgggcgctctcgccgccctgtggttcggagtgaaggccgcccccgaacatatcatgaacgatgaggttgagccgtga

SEQ ID NO: 8181 - DNA, 372 bp, Methylobacterium sp.
atgcctgccgatcgggacgtctgggcctacctttatcactacagggacgatgaggatttcggcctgctccgcggacggtacgacgctgaattccgcgagttctggtgggctgggggcagcctgacgaccagcgtcctggcctgggtcgacaccgaggagcagcccgcgttctgcatcgaggccgtacgcgcctgcatcgcaagcctgcagcctctcgtggacaactgcgacgacgagatcgcccacatggccgaggactggctgcaccgggaggtcctgcgcgccgtcgtcgccggccatcccgacgcgcaggcgatcgccgcggccgcgctggaatcccgcgccgtgaagttcacccggtattacagctga

SEQ ID NO: 8182 - DNA, 465 bp, Methylobacterium sp.
gtgacatcgccatcgccgacgaccgctgaccggcagggcttcaccctgctggagatgctggttgtcctggcgatcctgtcgctgacgagcgtcctcggcgggttcgcacttcaaccgctgcgacagcgcatggatctgagtcaggcagcgacgcgcctcgacgcccttctgagggcggcacgcgccgaggcattgcggacgggacggaccacgacggtgcggttcgatgccggaacccgacagctgaccctcccatcgcagggacggacctacacgctggcgcgatccatcgccgtctccgtcaccggcgccgcgatcggcaccggttcggacaggccggcaatcctcttcctcggcgacggttcgagttccggcggcgtgatcgaactgcgcagcggcaccttgagaaccgcgcgccgcattggctggctcacgggtcgtatcgatcggagcggagggccgtga

SEQ ID NO: 8183 - DNA, 261 bp, Methylobacterium sp.
atgcacatgagagcgtttgaggttggcgattgtcacgccgacctatgggggaagctgtctatcgtgtcccgtcgcgttgaaggaccggaggaccggactgtcggcttccatcccgacttcggccttgctgtcgtcagccatcacgggctggaaaatcgggttgtctggtggacggcgcgaccgatcccggagcccgaacccgagaccgatgggttagccgagatcgaagcgatgctcgctgagcttggctggtcctcatga

SEQ ID NO: 8184 - DNA, 795 bp, Methylobacterium sp.
gtgaccgcgagcgtagacgaatcattcaagcgtcagtcgatcgtgatggacttcctcacgggcgccatcagtggcgacgaagcgaggttcagcgcggcgctcgcggccctcaaatgggccggagcgttccgcgaggcgttcgagaagctggtcagcgtcggcgcggtccacccgcgcattcgacctgtctttcgcgagtgctggcgccgcatgaaggccgagagctacgcgcgtttggataccggagcgcaggcgccgcctcccgattggcatctggaacgcgacctctgcggccatccccaccttctggctgacggcttgaagctcctgatgccgacgttcgagccgcgccagtatcccctggcgctctacaggggacagcggcttgaggatcatcacgcgggcgcccacggtctctggtgggtctcgtgccccatcttcgcggagatgttcgcgaggatgccgtcccgcacacgccatgggacgggcgtcgtcgtcatgaccgtcgatccgcacgccgcgatcatcggagagatcgacggcgagtatctggtcgatccccgcctactggacggcgttcagatcgtctcgaccctgatgccccatctggacggcgagatggacgaccccggccgcgcgttcactatgaccggcatcccggacggcttcgacggcctcggcctgctcgaatggctggaccttgggatgccagtcgaaggactaccggccatccgtgccaagcgtatcccgttcatcacgacggtagtgctgggtcttgatccgctcttagcttga

SEQ ID NO: 8185 - DNA, 174 bp, Methylobacterium sp.
gtgcaactttcggctggaacttcctcggtagcccgctctccgccgtgctgcttcggcaacgtcggcggcgacgtgctcttcatctcgccggcgtggtatctcatcgaccgtccgcaggcggcagccgcgcgccgcaccgaggctgcgccggccgccgccatggccacccgctag

SEQ ID NO: 8186 - DNA, 264 bp, Methylobacterium sp.
gaggcgagcctgttcctgccggatgtgcccgtcggcgcgctggtgctgatcggcatgaccgcctacctcaccggcgtgctccaggcgccgatcacctccttcgtcatcgtcaccgagatgacccagaaccacgcgatgatgattccgctgatgctcgcggcgctggtcgcggatgcggtctcgaagctggtctgccgcggcggcctctatcacaccttggcggaggtgctggtgcggcgggccgccggagaacgaagcgcgtaa

SEQ ID NO: 8187 - DNA, 117 bp, Methylobacterium sp.
ttgcgcggcctcggccagccctctgcggccgaggtcggcagggtggatgcgaacagccgggcagtccgttcgctgccgacgatgatctcaatgcacgccttcgtccaggtggaatag

SEQ ID NO: 8188 - DNA, 1059 bp, Methylobacterium sp.
gtgataccggcgcgctcccgcctgcatgcggtcgcgagcgtcgtcggccgcgccttcacctggtggggcgacgggctgaagatgacgctcccggcgccgttggtcgcgctcgtcctgggcgacacacgcatcctccacctggatatcgaggacggtgatggtcggatgagggtgcggctcttcgcatcctccttccgtacccgcgtcgtgaccgaggctctcgtcgcggatgatggggatggcccgcgtgagatgccccggtcccttgtcgccgcggcccgttcgcggccggtcgtgctgcacgtatccggtcaggccgtcctcagccggaccgtgacgttgccgacggtcgccttggaggatctgcgacaggcagtccgcttcggcctgtcccgctggaccccgttctccgccgacgacgtagtgtacgatgccgtagtcgtcggcacgaccgctgaacaggcgaccgttcgggttcgcatggttccccgcacgatcctcgaaccgttcgtcgatcgcgctcggcgggccgggctcgaggtcacgcagatcgcgctcggaagtgccaacgtggcttacgtaccgacggcgccgaaggggatgcccgcgcaacgtgcaaaccgcatcgatgcggccttgctcaccagcgcgctcctgatcaccgtggcgatccccatccttctccatctccgtgggaacgatgcgttgagagacctacgagcctccgtccaagccgaggtggcgcaccgcacccgtcaggtcgcactcgagaccgagttggttcgcctcgccggctggcgccggaccgcgctgctcaagcgggcgaaggtgaagcgggtatccagcgtcgtggcggacctggcccgagcccttcccccggagatcctcgttcaagaattttcctggagcggggaacgagggcaggcacgcctgtcgggtgagtcggatcgcgtcaacgctgcactctccctccttcgcagcacgcgactcgagcggctcacggaactcacgaagggggtattcagggcggaactcgttgcgcgggatgatccaccgtga

SEQ ID NO: 8189 - DNA, 588 bp, Methylobacterium sp.
gtgaagaccgttgccacgtccacaactctgcacaaggcttcgtccctgctgcttctcgccctcgtcgtcgtagcgatcgcgcttgtggcgtggccgatcatcggctccttgtcggcgatgcatgaggacatcgcggccgagcgcgcccgtctagcaaacctgcgcgccaagcgcgtcgacctgaaaagtattgagggcgaactcgaagccgagcgttcggaagcgacgggcaggaaccctctgatcctggacgttaccggcagcgccgcggcttgggagcgtatggagaggctcctgagggagatcgcagcccgcagcggcgcgacggtcatatcggtccgcgggctcccgctcgagaacgaggtcgacctgaaggcggcacgcatggaactcatgctgcggacatcgcacgaggggatcaggcccctgatcgagaacatcgaagctgcccgaccgctcgtcttcgtcgagacgatcaccatgcgcggcagagcggctgcaggcgtcccggacagagagacgatcgatgtgagcgcgaccgcgcgcgtcctggccacgatttccccggttcaggcaccacgccgatga

SEQ ID NO: 8190 - DNA, 123 bp, Methylobacterium sp.
atggcgggtgtcgtctcgggaggccctcagtcgagggcgacggcgaccagggaaaaaaggcccgccagcagcaggttgcaggcgatgagggcgacgaccgtcatggattggattcgcgactga

SEQ ID NO: 8191 - DNA, 474 bp, Methylobacterium sp.
ttgctcgcgggaccggccgtcgcggctgaacccatcgtgctggaagggggtgcctacgaggtcgaggtgaagctcgaactgccccatctggatgagataaccggcaagaaggtggcccggctctgcctcaccccggaggccaacggcaacaaccacggcatcgcggtactgagcgataacaacccgctggcccgttgccccgtctcgaacgtccaccaggacgggaacgagctcaccttcgacacagcttgcgagggcaagaactcggcgcacgcgagcgtgcgctacctgctggcgccgacctcattccgcggccgcaacgccatgcagatgggcggcaagaacatgaccatgaccgaggtccagtcaggatgtcagcgcgggcgcttcagcagccagtcgtggatcagcttggtcttgtgggtggccgcgccaccggccccactgaaggcgggccgcaagccggcgcgctaa

SEQ ID NO: 8192 - DNA, 930 bp, Methylobacterium sp.
gtggtcaagctgaacaacatccagaaccttcgggtcttcgacgccgtggcacgcgtcggcagcctgacccgcgcggcccgcgagctaggcgtctccctcacgctggtctcgaaaagactgaaggaactggaggcggaactcggtttgcggctggtgcagcgctcgacccgcaaactcgcgctgaccgaagaagggcatgtcttcctcgatcgctgccgcgacgtgctggatgccgtcgctgcggccgaggacgtgcgtctgcggcagaccgaaagcggcatcatccgcatgtccgctggcgtggccttcgcccatcgccagatcgccccgcgtcttccccccttcctcgaccgccacccggacgtgactgtccagctgatggcgagcaacgagatggacgacctgatccagcatcgcctcgacttcgccgtccgccagctcgacctcaccgacagcgcgctggtgatgcggcggctggcccccgatgcgcggatcctgtgcgcctcgccgggctatctcgcccggcatggcgtccccggccatccgcaggacttgcaggatcatcgctgcctgacgattggcctgccgccgccgcggcgatggccgatgtggcgcggcgaggaggccgtcgagatcgacgtccccagcaccgtgaccggaacgagcggcgagatcgcccatgccgtcgcgctggccgatggcggcataacgctgaagtccgtctgggatctcatccccgacctccgcagcgggcgcctggtgcggattctgccagaatggtggggcagccgggagcgctggcttcacctggtctatcccgcacgccgccaccagccccgacgcgtgcgcgccttgatggacttccttcaggtggaactggcgcaggtcgtggaagagaatgccgatctcgggctgttcgagaactcgtga

SEQ ID NO: 8193 - DNA, 426 bp, Methylobacterium sp.
atggccgaaaccagcaccttcaacacgcagcgatccgtcgatcgcgagacggccaaccgcatcctggcctcgacggtggatgcggcgcgcgagcggaactgcgccgtcagcgtcgccgtcgtcgattgcggcggccatctggtcgcgttcaaccggatggacggtgccttccacggcagcgtcgatgccgcgatcggcaaggcgcgatcatgtgccggtttccgggcgccgctccaggcgttcggcaagctggcgcgagagaagccttggctcggcgatctgcctggcctgatcccgctcggcggggccgtaccgctgacgcatgccgacgcgttcgtcggtgccgtctccgtcagcggcgacaccgaagagagcgaacagtccctggccgagttcgcggccaagaccttcgcaagttggagctga

SEQ ID NO: 8194 - DNA, 1236 bp, Methylobacterium sp.
atgtcccatgcccacctgccgaccgccgcaagagcgttcatcccaaaggccgagcgaacgcgcgtcaacgtttcactcatcctcctgacgctcgcactgggtgccttcgccttcggaaccgccgagttcgccgccatgagcctccttccggagatcgccgcggatttcagcctcggcgagcctgccgcggcacgcgtcgtcagcgcatacgccatcggtgtggtcgtcggcgcgcccctcatcgcgtttccgctggcgcgcgtatcgcggcgacgcctgttgatcggctgcatggcgttgttcgcattcggcaacggcttgagcatgatggcgccgtccttttcgacgctactggttttccgttttgcgagcggcatcccgcacggtgcctatctcggcattgccgctctcatggccgcctctctcgtcgagcgtgacaaacgtgccagtgccgtggcgacggtcatcctcggcctgaccctcgccatgatcgtcggcgtcttcgccgtgacggcgctcggccaggcctatggatggcgctgggcctttgcctcgccgggtcttctcgcggttgtggtgaccgggctctgcatatggcagcttcctcaggacatgccggatcgccgagcgggtgccttgactgaactcaaggggctctggaaccgacagatctggctcgtgcttctgaccggcgccatcggcttcgcaggcttcttcgccgtctatgcctacacggcgtccatcctcgttgccgtcacggggctggagaagcggtgggttccgatcatgatcgcgctctatgggtttggcatgaccggtggaaacttcgttgccggacggctcgccgaccgagctctgttgagaacgccggtgatcttcctgtccgccggtgcactggccctcgtcgggttcgcgctcgcggccgagaacgcgtggaccgtcgggcttgccatgctggccgtcagcttctttagcgccacgagcggtgtgcttcagacacggctgatggacgtggctggaaacgcccagacagcggcggcggtcttcaaccacagcgccttcaacgtggcgaatgcgatcggcccatggcttggcggcatccccatcgcattgggctacggcttttcctcggtaggcttcgtcggtgcggtgctgtctcttggcggtctcgccatctggctgctggcttgtgccgagagccatcgaacgcggacgccagcatcggcccgaaggtga

SEQ ID NO: 8195 - DNA, 333 bp, Methylobacterium sp.
atgaaattcttcccagtcgcgacgagtttgttggcagtcgtaatgcttgcagtaactccagcgcttgcgctgacagtgatcattcagaacaagagtgaacaaaccttaacggttgacagcgggcagacacaggccgatcagaagatggcggcaggtgcatcggctgagatcgagtgtaacgagggatgtgagcttcgtgtccgaggctccggctacgggcgtgcagccgaggctggtgataagctcgtcatcgatgacgagggcatgattcccttcacaagcgaggacatcgtcaccgggtcggtcaagcccccgactaagacaaagcagtag

SEQ ID NO: 8196 - DNA, 1071 bp, Methylobacterium sp.
atgaagaacatctggctgctgcacattgagagcgtagaaacccgctacaccgggcaatggcggcgtcatctgcgtgagcagctggagcacgctgcggctgatcgcgacatagctgcacaagtgatcgacgtagacggcgacgtgccggatcaaatccccaccaaaggcgcgttcctcgacttcgccgccaccaacattttcaagagcacgcaggttgccgagttggcccgccgattccagcgcggtgaggtgaaacccgacgatgtgttcgtgttcaccgatgcatggcatcccggcgtgcatcaggttcgctatatgagcgcgctgctcgataagcctgtgcgcatcgtgggcctgtggcatgccgggcactacgatcccaacgacttcctcggccgcatccagttgaaggacgggccgtgggcgcgtgcgatggagcgtgcgctgttcgaagcctatgacgtgagcgccttcgccacgcaggcccacgttgacctgttccgcaagggcgtggtggtgagcaaagacgatcctcggctggctcaggtcggctggcccatggagtacctagctggggaggtgcagccattcctcggggctcccaaggaaaacattgtgctgtttccgcaccggctcgcgcctgagaagcaggtggacatcttcaacgatctcagcggcgagtttcccgattgggagttcgtggcctgccaggagaccgtgctcagcaaggaggcgtaccatgggctgctggctcgcagccgggtggtgttctcggcctcgctgcaagagacccttggcatcggctgctatgagggtgtgctggccggcgctgtgccggtggtgccggatcgtctcagctatcgcgagatgtaccccaaggagtttcgctaccgtagcgcgtggaccatgccggatacgtacgagcagaacaagcctgccctggtagcccatctgcgccaggtactcgcccgtgcgacggagggcagctttgatctggagccttgtcggcggcagctcgagcctttcttctcaggcgaagcgctctacgatcgggtctttgcggatctctaa

SEQ ID NO: 8197 - DNA, 504 bp, Methylobacterium sp.
atggtcaagaagctattcgaaaacaaacctgtcaacgatagccttcgggatatcagcttctatcctttcaaggggcccacggcgttcaattacgaaaacacggctccgaaacacggtgaggatctgccagatgaggatcccgccaacttttccgatgaagcgctcgcgctgctcgcatggctgcaggtcgggatcgggcacgagagtctaaggctttcgatcaactggccaagcgtggaccgagaacgtcgtggccggaagccaaacaagaccgtcatcccaaaagtgacagaggacgagtttatggaggagatcgagccaatgctggccgagctaggtctgtgccttcccaccgaacccttaggtaccaccgatctgagcgagctgtttgaggcggaagtgaaccaagaggacctagggcggggcgactcgcactgtggggaacgtgaggaagtagccggtattaacgatactgctccatctcctcagaacaaccgagcttga

SEQ ID NO: 8198 - DNA, 1101 bp, Methylobacterium sp.
atggcaaaatgggtcttcgcgtcgccctcgcgctacgtccagggcgccggcatgatcgcccatctcggcgagcatctgtcggccctcggccggaacgccttcatcctggccgacgacaccgcctggggcatcgtcgggcgcgacgccgaggcggcgatgcaggacaagctcaccttccgccgcgaggcgttcgggggtgaggcttcgaacgccgagatccgccgcatggcgggcttggcgcgcgaggcgggcgccgaggtgatcgtcggcatgggcggcggcaaggcgatggataccgccaaggccactgccgacgacctcggcctgcccgtggccatcgtccccaccatcgcctcgacggacgcaccctgcagcgcgctgtcggtgatctattcgccggacggcgtgttcgagacctaccggttctattccaagaacccggatctcgtcctcgtggacacggccgtctgcgccagggcgccggtgcggctgttcgcgtcgggcatcgccgacgggctggccacgaacgtcgaggccaaggccacgtggcgcagccgcgcgcgcacgatggcggggggcgcacagaccatcgccggcggcgccatcgcgcaggtctgcgaggacacgctcttcgcccacggcttgagcgcctaccgggctgtcgagaagggcctcgtaactccggcggtagaggccgtggtggaggcggccacgctcctgtccggcctcggcttcgagaacggcgggctggcggccgcccacgcgatccacaacggcttcacggcgctcgagggcgacatccatcacctcacccacggcgagaaggtcgcctacggcattctcgtccagctcgtgctcgaccagcagccgatcgcggatttcgagcgcttcgtgcgcctcttccgcgcgatccggatgccggtgtcgctgcgggaactgcatatcgagggcgtctcgcgccgcgatctcgttaaggtgggcgaactcgccaacagcccgaacgacaccctgcagaacctatcgccgcacttcaccgacgacgctatcgccgacgccatactggccacggatctcctggcggcgggcgtctcggcggcctga

SEQ ID NO: 8199 - DNA, 1005 bp, Methylobacterium sp.
atgggccggctggacagcatcgacgacctccgcgtgttcgacgccatcgtgcgggcgggcagcctgtccggggccgcgcttgacctcgacgtctccctcaccctcgtctccaagcgcctcaagcgcctcgaggggcggttcggtgtccgtctgctccagcggactacgcgccagctcggcctgaccgaggagggcggagaattcctcgtgcggtgccggaccgccctggaggccattcgggcggcggaggacgtcgccggcgacggggccagcggcgtcgtgcgcgtgaccgcgaccgcggccttcgcgcagcgccagatcgcgccgcgcctgccgcgcttcctcgcccgccatcccggcatctcggtccaggtcctgaccagcgacgacgtcctcgacctggtcgagcgccgcatcgacgtggcgatgcggcaggcccccctcgtcgacagccgcctgatcgcccggcccctggtgccggacgcgcgcatcctttgcgcctccccggcctatctggcccgcgtcggaacgccccgcgacccactcgacctcgccgaccatgcctgcctgacggtgggcgatccccggccgacgcactggcgcctgtgccgcggcggggagtcggtggacgtgtcgatccgctcggcggtcggcggcatcgacggcgagatctgccacgccgccgcgctggcggacggcggcatcgccatgaaggccgcctgggacgtggtcgaggacgtgcgcgccgggcgcctcgtccgcatcctgccggattggtggggcgggcgcgaccggtgggtccgcctcgtctatccggcccgcctgcatcaggcccggcgggtgcgcgcgttcatcgccttcatggaggccgagatgacgcaggcgctggccgcatgcgccacgctggacctgttcgaggcaccggagccggccaagccgagcggccggccccggaccgcccgcaatcgggccgagccgacccccgccgagtccggacccggctga

SEQ ID NO: 8200 - DNA, 414 bp, Methylobacterium sp.
atgccatccgcggagccagaaaccagccaatcgcccagcctcaatggcgtccgtttggccggctgcacgatcctctgccctgcggccatcgcacgggccttcgagcaccaagctaccatctcgaccgctgacctctgccgcctcctcccgatcgacacgaagacgctccgccagcacatccgggcggggcatctggagtacgtgcggctaggcttcggcgagacagcgccccggcggttcacgctggagggcgtgatgagatttcttgaagatcggagcgagcggcaatgtcggtctacaagcctcagaaatccccgtactaccagtacgacttccagcgcggtggccagcggtatactggctcgacaggcgcaaaggaccgaagagaagcggaagctgaagaacggcgcctga

SEQ ID NO: 8201 - DNA, 864 bp, Methylobacterium sp.
atggtcaaggtcttcctctttcccggacaaggcgcgcagcgagtgggcatgggccgcgccgagttcgaccgcttccccaatcttgagcgcgaggccagtgacgtcctgggatactcggtgaggcggctgtgcctcgaggatcccgacaggcaactcggcgacacgcgctacacccagtcggcgatgtacgtggtcaacgcactcacctatcgtgccctgcgcgaagacgggccggcgccagacatggcgctggggcacagcctgggcgaatacaatgcgcttgaggccgctggtgcgttcggctttgccgaagggctgcggctggtcgcggcgcgcgccaccgccatggcggagatttccggtggtggcatgactgctgtagtcggcctcgacgaaacttatctgcgcttcctgatacggcgcgcgggcttcgaaacgctggatctggcgaacctcaacacaccgcagcaagcggtgctggctgggccgatcgaggatctcaccgaaatcgaaacgatccttgaggacgctggcgcgcgtatggtccgacgtctaccggtaagcggtccgtttcattcgcgctatatgacacctgcggccgaggccttcgccccaacgcttcgcgctgcgtcgttcggcagcctcagcttcccggtcatcgcaaactgcaccgcacagccttacaagggagacagcatcgccgagctcttgacccggcagatcaaccatgcggtgcggtggacggaatcgcttcgccccatcatagctcgagacgactcggacttcgtcgaggttggtggcacgacgctgaaaagcatgatccgtcagattcgccagaccgccctcgcgacgggaacagtatga

SEQ ID NO: 8202 - DNA, 7215 bp, Methylobacterium sp.
atgacgaccaccagcacgtatgtcgacaccaacgccattgccatcgttggcttggcctgccggttcggcccgatcggttcagccgaagaactgtgggacttaatggcccgcggcgataccgcgatccgccgctacggcgaggcagagctgatcgcactcgggcacagccccgagacgctgcggcgcccaggcttcgtcccggctggcagcgtgctggacgacatttacgctttcgatgccgaactcttcgactacagcccgcagcatgcagagtggctcgatccgcagcaccggatactgctcgaaaccgcttggcacgcgcttgaggacgccgccatcgcgccgcgcagcaacccactacgcacgggcgtgttcatgtcggtcggacaaaccatcatgccgccagtgtcgatcaccgatctcgacgccgccgggatgatacgcttctcgtcgtccgacaaggacttcgcggcgtctcggatatcctacaagctaggcctgaccgggccgagcctgacggtacagaccgcgtgttcgagttcgctcgtcggaacgcatctcgcagtcgaaagcctgattgaggaagagtgcgatgcggcgatcgtcggcggcgtgtcgctacacctgccgcaggctggctacgtcgccagccgtgacatgatattgtcgccaaccggcggctgccggccctttgacgacaccgccgacggcacgatctttggtaacggtgtgggcgtggtggtgctgcgccgactagttgatgcgctggccgatggcgacccgatccgcgccgtgatccgcggcagcgccgtcaacaatgacggcagccgcaagatggattaccacgcgccgtcgcccgaggggcaggaggcggtcctgcgcgaggcgctcgcgctcggcgacatcgaccccctgaccgtcggctatgtggagacgcacggcaccgccacgcagcttggcgactcagtcgaggcctcggcgttggcgcgggtctatggcaacgcgggacgcaccgaaccctgccttctcggttcgattaagaacacggtggggcatactaacacggcggcaggtgtcgcgggcctgattaaggcggtgctgatgctcgaacgcggcgccgtcccgccgcaaaacaatttccaccggccgaatccgcggctgtcgctcgacggttcgggcctgcaggtcggcgccggcagcgccaaatggccggtgcccaaggggccgcggcgcgccgcggtcagttcgtttgggattggcggcaccaatgcgcatgtggtgcttgaggaagcaccgccgagcgctacgccgcacgcgatcccgacccggcggcagatcgtgcccttgtcggcgcgcacagccgaaagcctgcacgaagcgatgcatcggctggccgaggcgctcagcgccacgcccaccctacggcttgccgatgtggtggccacgctcagcctcggccgcgcgcacgagcgcgaacggctggctgtcatcgctgaggataccacgacgctgatcgcccgcctacgctcaggcgagggcgggattcgcggcgcggcgcgacgcgccgcggcggagagtgctgcgcccggcgatctcgaagcggtcgcagcggcctggacgcagggagttggccccctgcccgacccggtccctagcgcgcggcgcatccgcctacccggctacgccttcgcgcgccatcgctggccgcgtccgccgcgcccctcggcggaacccaagcgcctcggcgcgatgttagagcgtaacgtctcaaccctcagtgcggtgcgcttcaatcggacgctcttcccagaagagacgctggtcgccgatcacctcatagccggcgatcccgttctgcccgcggcagcacagctggacatggcccttgcggcggcagccgaggggctcggccgggcagtcacgggtctggccgacatcactttccaccagccagtgcgagtcgcagcaccgacccgacttctggccgagctgacgcagggaccgtcggggccggccgtccgcatcctatccgagacagaggacggcgacacgatactgcacagcgaggcgcgtatcctaacagaactggcgccagcgccgcggctctatagcagcgacatagatctcgatgcgctgtcgatcgacggcatttatcgccgcttctctgacagcggcgtcgcctacgggccggccttccgcgtgatccgcaagctgagccgaggtaccgggggtgccgtcgccaccatcgcgtcggatcggcggggtgaccacaaggtgtcgccgtttgtgctcgacggcatgctgcaggcggtcatcggctgcctatcggacgacgatctgggcggagagacctttattcccttcgcgctcgagcggttcgacctctacggcaacgtgccctcacaggtccaggtccgagtgacacccgccgcgctcgcgggcaggggacgccgcgtgcgcaagttcgacatcacggcaaccgccgaaaatggtacgcctgtgttgcagctgacaaatctcgccctgcggcccttggcccctggcgccgtggcctctgtttcgaagcggttgcatgtctacgcgccagagcgccggacgcctgaggccgccgtgcatgaggccattggaccggtcgccctgatcgatggcaccgacgcgcaggccgcaaagttgggcgccgcgctaggcgtcgacaatgtgctgcgcaaccttgaggctctgcctgacgctatggacgcgaggccggtcgtgatctggccgctgccggccacagagaccgcagccgaggcgcagaagatcgctctagaggcggtgttgctgctgcgcctgctgatacagcggttgccgcggcgcggggcgcgagttgtcgttacttatccctccgggtcgctggcaggcccggggatcgctgcgatcggccgaagcctagccggcgagaacccgcgcttcgacctcatcgcggccgagttgccgcggcctgagtacgtgacctccatagtgctattggctctggcctcccggcccaaggacaagcacctgcgcgctgatgggcacaccgacgtcttggtaccgcagcccaccccgaccgcacccgtggtatccccattccgccgcggcgggcgctactggatcaacggcatgggccgtctggccgaggcgctctgcgcgcatctactatcccgctacggcgccagcgtggtgttgaccggccgctcggcgttgaccgacgcacgcggcgcggcgtgcaagcgtctggcggcgcttggcggacaggtagaatactaccagctcgactgcaccgatgccgcagttgttacagcctttgcggatgggatcgcgccggtgcacggcgtattccactgcgcgggcgtcctgcgcgacggattcattctacgcaagacacctgaggacgctgccgccgtgatcgcgccaaagctccttggagccgaagcgctcgacctcgccacggcggaatggccgctcgacagtttcgtaaccttctcgtcggtgtccggggcgctcggtagcccagggcaatcggactacgcctttgcgaacgctgcgatggacgccttcgcgcagtcgcgcgcgcagcgccggcctggtcgtacgctgtctgtcgcttggccgtactgggccgagggtggcatggggtccgacacagtcgagaccgtccttacctcacttggcatggagccgctgtcgacggcggacggcttggaaacgctggaagcgcttctcgctgcgcctgacacgccagccgcgctaaccgtgctttgtggaaaccgcacacgcatgcacgcggcgctgccgctcttacaggacgctacagagacgcgcgaacccgagaaatacaacatgcacgcctcgaccgccaaacccgatggcaccttcgccccagcatacgataatgatcgcgacaccctgccgcccatcaagaccaaccatgttcgcgccgaggtcgcgcagagggtcaccgcggcggtgtcagaggcgacacgagcgccactcgacaaggtccgccccgaccggcactttgaggagctaggcatagactcgcttcttgtcatacggatcgtggagttgcttgaggtagatttcggtcctctatccaagacactgctctttgaatgccagacgattgccgaacttatcgaatactttctcgacgaacatgcagagcgctgcgccgagcttgctggccctcacgccctggccctcgaacgagccgggtccacggccgagcccccccaggcagcaacaatgcaaccccagtccaccctcgccaaaccgcatgacgcagaagacgacgctgtcgatccccgcgccatcgccatcatcggcatggccggccgatatcccgagggcgaggaactggatgcattctggcagatgttgctgtcgggcaaggattgcatcgttgaggtaccgcgcgatcgttggaatgccgaggcgatttacgaccccgaccccaggcgcgtcgatcgcacctacacaaagtggggctcgttcctgaacggggtcgagaccttcgatgcaccgctctttaacatctcgccgcgcgaggcgagcatcactgacccgcaggcccgcctgttccttgaaagctgctgggcggtgttggaggacgcaggctaccggccaaaccagctaattcgctccgacgatccggccgagcggcgtaacgtgggcgtgttcgccggcgcgatgtatggcgaatatcagttgcacgaggccgaagaacggctgcgcggcacaccgatacttgccaatgccgcttattggtccatcgctaaccgcgtctcgtatttcttcgacttccaagggccgagcattgctgtagacaccgcctgctcctcagcgctgaccgcggtgcatctggcctgcgaggcgttacgcgcaggaagttgccgcgtcgccatcgctggcggcgtgaatgtgctgatccatcccaacaaatatttcatgctgggacagggccgcttcgccgccagcgacgggcggtgccgcagcttcggcgctggcggcgacggctacgtgccgggtgaaggcgtcgggacggtgttgctcaaaccactgtcagacgcgctggcccacggcgactacatccacggcgtaatccgcggcactgccgcaaaccacggcggacgcactaacggctatactgtgccgaaccccaaggcccaagcaacactaatccggaaggccctagaggacgcttcgctctcacccgccgctatcgactacgtcgaggcgcacggcacgggcacgtcgctgggcgacccgatcgagatccgcggtctgacggccgccttcggcaaaccctccgatcaaactatgcaggccccggtgccaattgggtcggtgaagtctaatctggggcacctggagtcggccgcgggcgtggtagcgctgcacaaagtgctgctgcaactgcgtcaccgcacgctggtgccgtcgatccacgccacgccaccaaatcccgaaattgacttcgccgccacgcccttcgcggtgcagcagcaggtggcaccttggacctcgcgcgacggcgggccgctccgggctggagtcagctcgttcggcgccggtggggccaacgcacatatcgtgatcgaagaggcgccaaagcgtgtcgcgcggagaggcaatgtggacgggccggtagtggtcttcatctcggcccgaaccgacaccgcactctccgcctatgccgagagcctgtgtgcgcatctgacccgcgagcggcccgcacttatcgatgtggcctataccttcgccactggccgcgtggacctgcccaagcgctgcgccattccggctgcgacgctcgacgaattgatcgccaacctcgcgacggtagcgggcggcgggcacctggaagttagcgcggagaccatggattgggttaacggcggcgacatcgaccgaaatgccgtctgcggggctgcggattggggacgacgaatcccgctgccgcattacccgtttgagcgcgtgcggtgctggtacgatctacagatcgccaatatcgaacggtctcgtctcggtggcgaggtccccacgctcggccccttccgcgacttcggcaagacggcgaaagcatccgccaagtcgaatctcgcggctgagctctctgacgcctccgccgcgcgcccgttgccgaagcccgcgcccgaacccggacgggtcaggctgcgcgcacctgctccgcaggcgccccgcgtggcgcatcacacaccagaaagggagttcatgccccgcaatcgcaagatcaccctccggccacttgccgcgccgctagcagcccaaccggcgccgactcaggccgaaccgaccgtgatcagagtgagcgccgcccaagcgctgcgcccgacgaccccagtccagcccaaaacggagcaggttacagccgagatgaccgagatgctggcgtcagtgctttacctttcacccgacgagatcgacccgaaacagtcgttcaacgatctaggtatcgactcgatcctcggcgtggaattcgtcacctccgtgaatgggcgctacggaatcaacattaaggcaacggccctctacgaccactcgacacccgccgcctttgcggcacatgtgatcgagatgctggatggcacttcatctgctgcgcatgtaccggcattagctgcgacacccactgcgctagtcgtttcgggggcggacgcgaccgccggatcggccccgtcaggtgccgtaccgccgcctgcagccgcgcacagaaccaccgcgggcaccgaccgataccttgaggtgcgcgacacgctgcgcgcccagctcgcggacgtgctttatagcgcgatcgatgacgttgggacggaagaaagcttcaacgatctcggactcgactcaatcctaggagtagagttcgtaactatcgtaaaccgcagctacggcctcaatctcaaggctgatgcgctttacgataacccaacaccggcggccttcgcacggcacgtcgcaagcttactgtcaccagaagcgccgccgcaactctcttcgccgtcccggcccgcccccgcgtcggccgtcgccacgacgcccgcagtggtcctgggcgccgcacccgctgtcgcttccccccaatccgaggtggacgcgattctgatcgctgtaaaggaccagaggctgagcgtggatcatgccctcagccttctagagacaatctcgagcaaggattaa

SEQ ID NO: 8203 - DNA, 300 bp, Methylobacterium sp.
atgaaccccttcaccttcctccccctggcgcttcgcatcctctcgacgctccggccgacttccccggccgatgagcccgcacccgctccgacgcccaccaagcgccgtgggaaggccgtagagccggctccggcggtgccgaaggtcgtgcggaagaacttcaccccgctcctccgcgcggtggcggtgctcatcgcgatcggtgccggctactatctcggacagatggacggcaccgccgcactcacgatgctcggtacgatcgacctgaacggcattctcgcgctgttcggtggctga

SEQ ID NO: 8204 - DNA, 300 bp, Methylobacterium sp.
atggcaatccgtgcggaaggcacgctcaagcaggttatcgaccacgcgaaccggctagagcgtcgaacgaatatcaaaggaaccgtatccctcgccccgaatgcgacgcagaccgtcgtcacggttcttcaggcgggatttgacgcgtgcgcgatcctctctccgatgacggcgaatgccgcggcggaactcgcctccggtgggtgtttcgtctcaacgtatggcgcgggcaccttcacgattacgcaccgcaacctcgcgacgaccgatcgaacctttcgctacatggtggcggtctga

SEQ ID NO: 8205 - DNA, 282 bp, Methylobacterium sp.
atgaccgacagcattcaacgcgccaatacgcatcgactttaccgcgaagacccgacttttcgcgagccttgggaggcggtgcgcgcggcattcgtcgcacggtggcagacaacctctccggcggaagccgaaacccgcgagaccatctatcgataccttggcttgatgacgaagctcgatgcgttcgttgcggaagtcattcgtgatggtgagatcgatcaagcgaagctcgacaacctcctgaagcttcgtaacgcgggcgacagcaatcatcttgactaa

SEQ ID NO: 8206 - DNA, 258 bp, Methylobacterium sp.
atgagcgagcttgatcccatcgcctacctcgttgtccccgcgaacggtacggcgaccctcagtcgtgccgcgtccgaggcgatggtcgtgctcgatcgggaggaggatgcggcggacgtgctcgcatggtgctcggcgaacaattgccgcgcggagacggtgttcatcggccgcctctatcgtcgcggcacacgatgctggaaaatcgtggcggtggacgatgatgcggcgttcaacttccggctcaggtgggtgtga

SEQ ID NO: 8207 - DNA, 441 bp, Methylobacterium sp.
atgaacacggaagacattatcatcgaagtcgtcggcgagatcgtcgaaaatttccagaacgatttgaacgaccgcctcaaagcgctcgaagaacgcctcacggtgatcgacaacaccaacaccgccatcctcgaagacgtgccgaaccgcagcggcctcatcgagttcgaggaacgaattcacgatcgaatttcgacgctcgcggagacggtcaccagcatcaccggtctgtccgaagccgacatctgcgggaagggcaaactcgaaacccggctctcccagatggagcagcgcatcgaagcgctcgaccgccggtacggcgacaacatcaccgtgatccgtgattgccttgtcgaggtgaaggggcagatcagcaacccgctgcgaaagaccgctgcaatcgatgacctacgccagaggatcgccaacacctacaagtga

SEQ ID NO: 8208 - DNA, 696 bp, Methylobacterium sp.
atgattaagagtatcttccgcaagttgttttccgagcctgcttcgaagcagaacgagattgaacttcgcaacgcgatcatcgctgagctttacgcgcacctcgaacacatcgggcacccggtagaggcggttcgcgtgccgctcttcgcgatccctgctgccgacgcatcgagcgtgcatgatgccgcgtcggtagttgtgggtttggagcacgtatttgagacggagtacggcggcttccgcgtcttcgccgggctcgacgcctttgggaacaacgtcgtcaccggtcgcaccgccagcgctacggcgacaagctcgacgctctctctggtgggtaatgccgccgccgctgccgagtggcttggccggggtgagccttggacgggtgaggttgccgccacgtgccgcgacgctgaacgtgacttcggtcgcccttcccctgctttgtccccaacatgggccgaggcatcacgcgcttacaacgatgggctcgaccgtgccgcgtctatcggggtcggcaccctcgcgggtgttcccgcacacgcccgcgcgaatcttgccggtgattggcttaaccgccccgccccttggaccggcgaacgcgccggcactcgtgccgatattgccgccaagctccacgaggccggtcttgcggcggagcgcgccgcggaagcccgcgacaagggggcgaagtga

SEQ ID NO: 8209 - DNA, 219 bp, Methylobacterium sp.
atgaagacgcctcaccgcctgttcccattcctcgacggggccgactgccctgagacgatcaaggcgtcaaagtccgccgcgatccattcgggccgtagtggccggaaagagatcgccgggctcgccgtacaagccttcgagaagcttttggctgcggagaacggaatcctaccaaaggattacatcttacgggtcaccgtgaaggtgacgccacgatga

SEQ ID NO: 8210 - DNA, 303 bp, Methylobacterium sp.
atgcgctgccccttacgcagcgggccgaagccgtgctcaccgactcagttatgccgaaccgccgcgcgaccgctcaaggcgcgcacgccgtccacggcgcggccatgcggcggctgggccaagcgctcgcaggagcagcgcgactacatctccctcaagatcgacgatccgagcctgcccgccccgctcttcgccaacctctccgccgacgaagatggcaagaccttccaggcgatctggagccggtccaaggccagccccacgggccgccagcagggccgccagccgagccgccgggactga

SEQ ID NO: 8211 - DNA, 132 bp, Methylobacterium sp.
atgatggcgcatgaccaaaccatcgaaagcctcctcaaagcggctgaggaaatggttcggcaaggcgagcatgaagaggcgttgctgctgctcgaacggatttgtgagatgatgggcgtgaccatccactga

SEQ ID NO: 8212 - DNA, 1143 bp, Methylobacterium sp.
gtgggccgatacacgaagcgcgagcatgcggccggcaagttctggctcgataagcgatcaaacagcccagcctactgcatctgctggctggatggtcgccaggtcaggcgcaagtcgacagggaccgacgacctcgacgcggcaatccgggcgttgaaggcgcactatctgtcggaagactcgcccgaagtccaggacgtcactcgcgttccgctcgcggaggttgtgcaagcatattacctccaacacggccagcatctcgccgcggccaagtggctgagatacgcggttgcccattgggttcgcttctttggcgagacgacaagcgtttggaatgcgactcgtccgcctcagattgagcggttcatcgatgacttgcgggagcgggggctaaagccttcgtcgatcaacgcggtccttacggcgggtaaggcagcgctcaatcggtcgtggaggcgaggcgagctaacccggcaaatccacgtgccgagtgtcaaggtaacgagaatgcagccgaaggggcggccgctgtcggtcgaggaatgtgcagcctggctcgatgcttcgtcccctcacttccacaccttgctgttcgtttgccttgccaccggcagccgacccgaggcggtgaaagagctccggtgggagcaggtcgacttcgaggacggactcctccatctcaaccctgaagagcgtgagcaaacgagcaagcggaggcccgttgtgaagatgccgctgattcttatcgcgtatctgcgtcagcttccgcgagaatcggatttcgtggtcagctaccgaggcaggcccgtcgatcggtactacaccgcgctaggcgagagtcgtaagcgggccgggctcgacgagcgggttaatctttacagtgcacgtcatacggtggcgcgctggatgcgtaaggaacgtgtaccaatcgaggagatttccggccagcttggccaccgcgtcaggggattcgcaatcacagagatttacgctgcgtactccccggactaccaacaaaatgcgacctcggcgctggagcggctgttgcacgcgatcgcgactcgggcccagtcatgccacgccgtccttaaatttagcacaactcatcttggaagccgaatttcagccgcccaacctatttaa

SEQ ID NO: 8213 - DNA, 132 bp, Methylobacterium sp.
atgcagccgcaggtcaacgtttcgagccggtccgaagtcacggtgccttccctgctgatcgcctttctcggctttgccgcgtcgaccgtcggcgtcgtcggaatcatgaccctgcttgggaccctcgcctga

SEQ ID NO: 8214 - DNA, 291 bp, Methylobacterium sp.
ttgtccggatccaaggcgccgtccgcgttcctcagcatcggagaggtcgccgagaagctcgatatcgcgatccacgttctccggttctgggaggcccggatcggcgaggtccgcccgctccgtggcgccaaggggcagcgccggtaccgtcccgaggatgtcgaattgctgatcgggatccggcatctcctgcatatcgagggatactcgatccgcggcgtgcagaagatcctgcgcgagcgcggcatcattcacgtccgaacctgttggcaggatcaaaaagcggcctga

SEQ ID NO: 8215 - DNA, 237 bp, Methylobacterium sp.
atgactggcaagcgacgcggcctgctcacgcgccggcaagccgccgctctctgggcgggtactgcgctggccggattcgcggcgggcccggcctcggccgccgaggggcagatgcgtgtcgccaagccgttcggcatcgtctacctcctccgcaacgtggtcgaagtgtcatcccttccatccagccgcacgctcaagtcgaaggcgacacatttcggctcgagatcatcattttag

SEQ ID NO: 8216 - DNA, 168 bp, Methylobacterium sp.
ttgagataccgcgagaacggcgttcccctgatccctccgatcctcgtccggcttggagcgactgtcttcaaccgtgtcaggccgttgatcttcgccatgccggtgttctttgcttggacgctgctcaccgtcctgtccacgccggcggtgatgctgccgaagtattag

SEQ ID NO: 8217 - DNA, 192 bp, Methylobacterium sp.
ttgtcgacgttgcggggggagtgcgacccaagtctcgccttcgtccacgcaagggcggttgacatttccgcgttgagctatcggcttaaggcgcggatggcgcagctgttgctccctccccgcttcgaggtgccaaccaacctaaaacccagtggccgtctcatcggcggcgcgctgtttggcatcggctag

SEQ ID NO: 8218 - DNA, 171 bp, Methylobacterium sp.
ttggccgacgtgacgggactgacgacggtgcatgtcagccgggcggtgaagtcgctacgcacggacggactcgtcaggctggacgatcgccagttggtgatccagaactggaggcgcctctatgatgcggccgagtttgatttgacctacctgcctgaaaaactgaggtag

SEQ ID NO: 8219 - DNA, 84 bp, Methylobacterium sp.
atggccaattccgagccgagcgcggtcctgaagtgcggcgcgatccgcaccgcgatcctgctggcgcgggcgcagaaggcgtga

SEQ ID NO: 8220 - DNA, 189 bp, Methylobacterium sp.
atgctctttcccaaactcgcgttcgatccgctccccgcagaggccgccgagtggcgcaaggccttcggcgtcctgcgccccaactcttcaccctgctggtatttcggcgccaccgcttgggcgaacatccatgaggcctgcacggacttcatcgagcgcttcggcgctaaagccgtgcgcccaggctga

SEQ ID NO: 8221 - DNA, 222 bp, Methylobacterium sp.
gtgagagcgctgaaccgcaccatccgacacggggacgattacgtgctcagtcccattgcctgggcgctgattgagctggacgagatcggctatgtggtgactgccgcttcggccgccccggcgccgcgctggtacgtcgacacgggctccgtaatgacatctcgccagattatcagcttcgcaatcgaggcaaccgcgcacgcgtcgagccgacgtcggtga

SEQ ID NO: 8222 - DNA, 1242 bp, Methylobacterium sp.
ccgtcgggcacgatcaccctcgacaccaccgcaccgacgctggccctgaccgcagcaccgcccgccacggtcgaggcgagctccgccgcgggtgccgccgtgagctttaccgccagtgccggagacggcgtcgatccggccccgcgcgtggtgtttagggccggcgacaccgtcgtgtcctccggccagaccttcgccctcggcacccacagcgtcaccgccaccgctttcgacagcgccggcaatgccagcgccccggtctcgttcgactttacggtgcaggacagcaccgcaccgacgctggccctgaccgcggcaccgcccgccgccgtcgaggccagctccgccgcgggtgcggccgtgagcttcgccgccagtgccggggacggggtcgatccggccccgcgcgtggtgttccgcgcgggcgacgcggtggtgtcctcgggccagaccttcgccatcggcacgcacagcgtcaccgccaccgctttcgatgccgccggcaatgccagcaccccggtcttgttcgacttcacggtgcaggacagcaccgcgccgacgctggctctgaccgcggcaccgcccgctaccatcgaggcgagctccgccgcgggtgccgccgtgagcttcgccgccagtgccggggacggggtcgatccggccccgcgcgtggtgttccggtcgggcgacgcggtggtgacctccggccagaccttcgccatcggcacccacagcgtcaccgtcaccgcattcgatgccgccggcaatgccagcaccccggtctcgttcggctttacggtgcaggataccaccgcaccgacactcgccctgacggcggcgccgcccgccaccgtcgaggccagctccgccgcgggtgccgccgtgagctttaccgccagtgccggggacggcgtcgatccggccccgcgcgtggtgttccgggcgggcgacgcgacgatggtgtcctccggccagaccttcgcgctgggcacccacaccgtcaccgccaccgctttcgatgccgccggcaatgccagcaccccggtctcgttcgacttcaccgtgggggacagcaccgcaccgacgctggccctgacggcggcaccgcccgccacggtcgaggcgagctccgccgcgggcgccgccgtgagctttaccgccagtgccggggacggggtcgatccggccccgcgcgtggtgttccggtcgggcgacgcggtggtgacctccggccagaccttc

SEQ ID NO: 8223 - DNA, 1002 bp, Methylobacterium sp.
gccgtgagctttgccgccagcgccggggacggcgtcgatccggccccgcgcgtggtgttccggtcgggcgacaccgtcgtgacctcgggccagaccttcgcgctgggcacccacagcgtcaccgccaccgctttcgatgccgccggcaatgccagcgccccggtctcgttcggcttcaccgtgcgcgacaccaccgcgccgacgctggccctgaccgcagcaccttccaccaccatcgaggcgagctccgccgcgggcgccgccgtgagctttgccgccagcgccggggacggggtcgatccggccccgcgcgtggtgttccgcgcgggcgacaccgtggtgacctccggccaaaccttcgcgctgggcgcacacaccgttaccgccaccgcttttgacgccgccggcaatgccagcaccccggtctcgttcggcttcaccgtgcgcgacaccaccgcgccgacgctggccgtggcggcggcaccttccaccaccatcgaggcgagctccgccgcgggcgcggccgtgagctttaccgccagcaccggggacggggtcgatccggccccgcgcgtggtgttccgcgcgggcgacaccgtggtgtcctccggccagaccttcgcgctgggcgcacacagcgtcaccgccaccgctttcgacagtgccggcaatgccagtgctccgatctcgttcggcttcaccgtgggggacagcaccgcaccgacgctggccctgacggcggcaccgcccaccacggtcgaagcgagctccgccgcgggtgccgccgtgagctttgccgccagcgccggggacggcgtcgatccggccccgcgcgtggtgttccggtcgggtgacaccgtggtgtcctccggccagaccttcgccatcggcacgcacagcgtcaccgccaccgcttttgacgccgccggcaatgccagcaccccggtcgcgttcgacttcaccgtgacgaccccggtcgcgccggccacggcgagcttcgac

SEQ ID NO: 8224 - DNA, 615 bp, Methylobacterium sp.
gtgaacgcccttcgcctcgctctcgaagaactccaccgcgctgacgttctcaagcgtctggtggccagcgcgaccacgggtgacgcggacgccttcctcggcgctgccgcccagcttacgtggtcgggcgggtgggcggatgccttgcgcgcgctggtgcccgtcgggaccgtccccgacacgatccgctccgcgttcgagaacgtctggaattccagcgtgtcgcaggagttcggcttgcgtcgcaccatcacctacgaccttttgggccaggaccagcgtctggtggacgggctccggctgctgctccccgagatcgaccagacgcccctgacgctcttccgggtccagtccctcgcggactaccgcgccggccggatcggcgtgtggtgggacggggaccgcagttctgcgctgtcgctctggctcaccacgtcagccgcccgtgagcacgatggcagggctgtccttctgacgaccgaagctccggccgaggcgatcgtcatcggccagccggatgagttcggcgtcgttgtggacccgcgccggctcgggtccgtccgcgcagtcggcgtgctccggttcgatcaggagcccgagcagattgcagcctga

SEQ ID NO: 8225 - DNA, 579 bp, Methylobacterium sp.
gtgacgaccctcaccatcaagcccacgcagtcgagcgtcggcattccctctgaacggctcgcccagcttcgggcgctggccgatcatcatggcgtctcagccgtcgagattatcgaacgcgcgatccggcgcggcgtcgaggccggcgagatcgaggacacgctccctggctttgcagagatcgccgtcgtggatgacgacgttctgttcgtgacggtccggaacgtgagcctgcccttgctggaccggaatcaggccaacctgatcgccgctgtcatcgacgcggcgacgggcgtagcgcccttccccggcttagagttcaagtccggcagcgccaagggcgtcgatctgggccacggcaacaagttctacgtcggccggcacgccaaggctgtcacgttcacgatcgtggatggtcagtccggtcagaccaccctccgcaccgcgaccacggctagcatcgcgaccgacttcgcccggttgcttcgcacgcacgctacctgcctcgggcttcccgtcagcgggatcatgagcttcatcgcgtcgaacaacgcgtccagccaggaggctcagtcgtga

SEQ ID NO: 8226 - DNA, 366 bp, Methylobacterium sp.
gtgtcgcccaagcgcatgatttgggtcacgttcaaggtgcgtggcttccactgctatccggatgcgcccgaagaggtcgcctatctgcgcgagcggcatcgtcaccagtttggcttccgcgtgtggatcgaggtgtggggagacaaccgcgagatcgagttccacatgacgcaggcttggcttgagagcctgtatgcaaggggtggcgcgctcgaagccgacggcaaaagttgcgagatgctggccaatgaactctatgcacgaatggtgcaggaggagcgctttcagcggcgggacatctggatcgaagtggacgaggacggcgagtgcggcgccttcatgcgctatgagcaggcggcccgatga

SEQ ID NO: 8227 - DNA, 447 bp, Methylobacterium sp.
gtgaaattccgcagcacgaagacctatggccacgacatcggcctgtcctgctgtttccggcagtggcggtcatcatcgcattgccggttcctccacggttatgcgctcgctgtgcacctggagtttgaggccgacggtctcgacgctcgcagctgggttatggacttcggcagcctcaaaccggttaggcactggctggagcaaaccttcgatcacaagacgctggtggctgccgatgatccgctgctgtctgagatgcgagcgatggacgaactcggcttggtccagctcgtcgttctcccgcacgtgagctgcgaggcattcgccgagcacatttttgcttgggtcggcgattggctcgccgagcagagcctcagcccgcgcatccgcctcgccgaggttcatgtccgcgagcacggcgcaaacgcagctaaggtgttggcatag

SEQ ID NO: 8228 - DNA, 2259 bp, Methylobacterium sp.
atgccgccggatgatcgtcgcgagcgcccgctcctcaatccagttcttacgttgcgcaaggagccggtgccggaggccgccaaaggcggcggcccgggcgcaaaggacatcgtgcaggaacgcctccaaatgcagagacgggtgctctcggagaggctggaagcaattgccgcgagcggtaccactgccacgcacgcggggcgcatccaactcgccgtggagatgttcgaggactcgttcgcgccgacttggacgccacggcccctgttcatggacggtcgccgtacgcagctcgtcgcgcccgctcgcaacggctacctcgtcgaggctgaagtcgcccatctgccgaatttggctcggcatatccgcaatgcgacggcagtcgatgctcgggtcgccatttcgcgggtgcgtgacattcgggcttacggtgccgacgacctgctccgcggccgagagatcggggcgctctgggaccgagctgcggaggtcgaggggggcaaagccttcgtcctgtggctgctgccgttccgggatgagggcgcccgtgcgtcggtggttcagacgctcatacgcttcgaagctgagggggccgttgtaccgaccttctcggcggtcgagttccctctcccccgccgggacagagcggacgctctcgtgaccatccgtagcgacgagacaaacctcgccaggaccgtgcgtcggtatcacggggcgggccatgcgcgcggcgttgtcacggtaccaagccaggatgcgctccgagccatcgtcctatctggttcgtccgcccgcatcgacccggtgccgcgtattgaggcgacctcgcccgccatcggtgccgagccgacgccgccagtgccgaacgccaactcccagccgatcgtggccgtggtcgacggagggctcaccgcgcagagctatgccggcctagtggcttggcaggcacacgatctcgtgccgccgggaatagccgaccacgtgcatggcaaccgggtgacctccctcgtcgtccatgcccatgcctggaacaacctcctcggcctgccgcgcctcgaatgccgcgtgggtatggcgcgcgccgtgccgcgcgaaggatcgaattacccagccgaccctgcccgtctcgtcgaatacctgcgcgcccttgcccgggcgcatcccgagacaaaagtctggaacatgtcgttcaacgcggtcgagccagaggctgaggccgacctcgtgagcttcctcggcgacgaaatccgatccgtagcgcgtgagtatggcatcctgccggtgatctctatcggaaaccggcgtcgcggcggtaccgatcagctctgtgcccccgccgattgcgaggcggccttgacggtcggcggtagggagcacgctgggaggggtgtcccaggcggtgcttgcagcgtctcgctacgcggccccgggacagatggcatgctcaaacccgacctgtcatggttttcgcgcctccggatgatcgggggcagccaacagaccggcagcagcttcgccacgcccttggtgtcctcgctcgcagcgcacaccttcgccaacctgcgtgacccaacccccgacctcgtgcgggcactactcatcaacgcgactgagctggaggggcacgacgcggccctcggttggggcacgcctcggcatgaccacctaccctggacttgcgcgcctggttccgtgaccctcgcgtggcgcgccacgatgcgaccgggctttaactactactggcgcgacatcccaatcccgccggagcttatcaaggacggcaagctggccgggaaggggcagctcactgccattctcaagccgctcgtcgccgaggacggcggccccaactacttcgccacccgcttgcaggtcgcactgcagtacggcacccgcgccgggggcaccggcaacctacttggttcgatgcgggaggaccgggcgcctgaacaggaggctcgtgccgacctggccaaatggcatcctgttcggcgccacatccgagatttcgggaagcgcgggggcatcgcgtttagcgggaacactatgcggctgcacgcccgcatctatgcccgcgaccttttccagttcgaggatgtcgatagccatcatgacctcggcgagcaggacgtggccttcgtcctgaccctcagcgacgggtcggagggaagcgacctctacaactcgatgacccagcgtcttggcaccttcgtcgagagcgccgtcgtggagcaggtcgtcgaaatcgagcagaactga

SEQ ID NO: 8229 - DNA, 2010 bp, Methylobacterium sp.
atgatccgcaccgtccgccgccatcgcgtctcccgcgtccgcagcgccgtcatggcgacgctcggacagacccccaggcagaactacgagcgcttcgtcgaggccggacgcctgtccgacgcgttcggggacatcgttttcgacgacacgatctggaaggtcccgacccgcacgaacctgcccggcggctccgccgtcggcgagctcgcctttacggtgcactcgacctccatcgatccgggcggtcgtgcgctggacaagcggttcggcgacttcctcaagaccgtggtccgcctcgatcacgcgaagaagccctcgcagatcaacaagcaccgccgcacgatcgccgtcgcccgcatgctccacgaggcctcgtcggacgtcggccacgatccatgcctcttctcgacctccaccttcaagcgcgccctggacatctccaggacgcggcggaccgaggccggcgcgccctacgaggtcggcgtgaacctccagaagttcgggaagatcatgaccgatgccggcatcacgccgcacaggatcgacttcaggaacacggcgcctcgcccgcaggacgtccgttccgacgacggtgaggacaggcggatgcccgcagagggcgccctggcggcgctggcgaaggcctcgcagctcgtgacgacgcccaaggacgtccttcgcatgcggatcgtcgaacttctcccctgcgcgccctggcggatcaacgacatcctccggctgcccgtcgactgcgaggtgttcgagccggccactcggaacggccgccccgtcctcgacgccgacggcaaccaagtcgtgcgctacggcatcggctaccgcggttccaagggcttcgtcgccgacatcaagtggatcccgacggcgatggtcgatgtcgcccgccgggcgatcaagcagatccgggagctgaccgccgacgcgcgcacggtcgcaaaatggatggaagccaatcccggccgcgcctggctcgccgagccctatcgcctctctccggaccgcgtcctgaaccgcgaggagctgcgcgaggccctcggcctgccagccgtcaagctggtcgcgccgctcgcgcgccgcttcggcatcccgcgctcgccctgctcgacggagcggaagtggcggtacagggtgggcgacgtcgaggcggcgctcctcaggcagcaccagccgatccagggcgacgcccccatggagcgctcagagtacctgctcctggtgcagcgcaactgcttcagctccgccagggagacgatcgcctcgatcgtcgaggtcgtcgattacggccacgtcacggacttcctgcagagccggcccggcgtccagtcggtgttcgaacgcttcgacctccgggatgctgacggccgacactacgtcctgaagacccatcaggttcgacacttcgtcaacacggtcgccgcggagggtggcctcggggaaatcgagcgtgcgaagtggtccgggcgcaccgacatccagacgaacgcggcctacgaccacgaaccgggctacaagcttgccgagaaggcgagggcgttgctcgcgcaaggaaagatgcagggtccggtcgccgacacctacgcaggactgccaccggtcgagcgctcggccttctccctggtgcatctggccacgatccacaccaccgagatcgggctgtgcgtgcacgactgggcgaccgcgccttgcccgcaccacggcgcctgcgcggattgccgggactgcgcgatcatcaagggcgatccagtccaccgtgagcggatcgaggtactgctcgaggacgaggtaactctgatcgcgcgcgccacggccgagatggacgacgggacgtacggcgccagcaactacgtcgagcaccatcgccggatggccgccggctaccggcggatgctcgccacgcacgacgacgcgtcgatcgaggacggcactctggtacagattgatcccgagcccgcgcgtcggggcctgctggaggaggccgaactcctctcgtag

SEQ ID NO: 8230 - DNA, 111 bp, Methylobacterium sp.
atgcccgctaccatgttcctcgtatttctcctcctaggaccgccgattggcttcgccgctttcgcaatcgagatgaactacgcacatatcggatttgagcgcgcaatttaa

SEQ ID NO: 8231 - DNA, 165 bp, Methylobacterium sp.
gtggtggccgaaatcgactccgtggtcgattgcgccggcggtgaacttcagcgccgcccccctcccttgagcttcggcgtgaagcgcgcggccctgttcgcgccgggcgacgaaactgtcgcggccttgcgctgcgctgaggtgaccttcgtcgtccgaggttga

SEQ ID NO: 8232 - DNA, 90 bp, Methylobacterium sp.
gtggtcggcgtgagctcgccgcacgtcgccatcggcaccagcgacctggcggtctcggtcagcgcggcgggcaatctcgtttcgcaatag

SEQ ID NO: 8233 - DNA, 96 bp, Methylobacterium sp.
atgagcggcgcacccgatcacctcgtgcgtttcatgcggcacgacgcggacaaccgacatccggccatcgacggaaggcacccgacggatcattga

SEQ ID NO: 8234 - DNA, 780 bp, Methylobacterium sp.
atgctcgggacgatctccgggacgctcgtggcgttgctcgacgaaatccgctcgagcgcaaccgatgtcgggcagttgatcgaggaagcgcgggcgcggggtgtcgcccaagccgccatcgtgcgagccgccggcagcgtgacggcggaagaagactccatcaagggattgtcggaggggagggtgcgtccggttcactggcgcttcgagggcatggatgtcgagctggatctcgaggcggaaggcgacaagatcgatctcaataccggccatatcgacctcatcacctctgttctgacgagaggagacccagaggctgcttcacgcgccgaattgctcgagcgtatccatcaggcacgaaggggcggagagatcttccccagcgtgagggcgctccttgagccctgcgcgagaatgggcgcacttgcggcacgtctggaacgagaactaaccgttctcacgcgtgcccagggcatccaacttcggcgaaccgaccttgcgaacctcgatttgattccgtctatcacacaagccgaacgagacatcatcatccagtcgttcaatagcggtcggtttccgcttgatgaccggcggttgacacatctccggccgtatatgtcgctcaactcatctcattatagattcatcgcgcgaatcaaaaataacaacaatatacctattctggagcgtcagataatggtcgaattttctgtaatgaagccaaacataagaactgtgagtgggcggtggatcataaacgatcctgcggatttctgttga

SEQ ID NO: 8235 - DNA, 666 bp, Methylobacterium sp.
gtgaagccggattttgcctcgggcgggcgtgacgggttcaccctcgccgagatgctgatcgtcatcgcgatcgtcgggctcattctgtcgttgagcagtggcttgagctggaccgtgcagcgtctggatgcgcgaacgcatcgcgaaaccgcagcccgcgaaaacctcgtctcggcagcccggatgtttcgtgcgcttgtcgcgggggcggttcccgatctgcgtaccgcagacggtctttccacagggggaacggatacggagcttaatctggtgtcggtcggcctgccgatcctgggcttcgaccgccccgaacccatgaccttgaaatggcatcccgagcgcttggatggagttctgcttcttcgctggaaggatcgacggtcggagatgctgcgcgaggaaacgatccttcagggcgcacgcgccctgtcgttctcctacttcatcgagaatcccgaccgtgtcaccgcggcatggcgcagcgaatgggtggaccgcgacaggttaccgctcgcggtgctgatgcgcgtcgaagtccccggtctcggaccggccatcgagatcatcgagcgagcgatgggtcatgcgtcggggggctgtgcaggactgccgcatgaggaggcctgtcgaactggtcgccgtggaagccatcatggccgataa

SEQ ID NO: 8236 - DNA, 405 bp, Methylobacterium sp.
atgaacgacgttcccaagctcatccattcgatgatccgtgtccgcgacgaggcggcatccgtggctttctataaaacggctttctccctcgacattgccgatcggctggacttcgagagcttcacgctgatctacatgtcgaacgctcaatccggcttcgagctggaactgacggtcaacaagggccaggacggggcctacgatctcgggagcggctacgggcatctcgccgtctcggtcgccgatctcgaggcggcgcaccggcgcatgggcgaggccggcctcgggccgaaggacatcaagtccctgcgccatccgagcggcggaaccgcacggttcttcttcatcgaggatccggacggctacaagatcgaggtcctcgaacgcggatggcgcttcgcctag

SEQ ID NO: 8237 - DNA, 168 bp, Methylobacterium sp.
atggtcgcgcgctatggcggcccggcctactggctggcccgggatcgggctcgggccgcgcgcggcgcggatgcggcccgggatcggttctgggggaaagtggccgtcgagatcgccccgctcgacggtcgggtgatcggactcgggaccggcgaacgctggcgctag

SEQ ID NO: 8238 - DNA, 465 bp, Methylobacterium sp.
atgcaccgctcgcacgatcgcgaaaccctggaagcgcggacgatcgaggcccagcgcctctacatcaaggccctcgtcgagcttgaacgggtgcaggacgggatcgatgaagggtcgctgatcgtcacccatggcgacctgatccaggccgaatgcctgctcgccgagcgtcgtttcgcgctcgtggatctgctgagcgcgctcggctacacgccgaaaggcttcaccgccaagctgccgcgcaggtcgggcaagggcggccaccggctggacgcgacgtccgatccggacatcgccgctctgcgcctctgctacctcgcatggcagggcaattccgtctcggtggacaccggacggtcgatccgctcgatgctcaacctcggcagggtcctgatcctgctcggagccctttccgaagaggacatggcggcggaggagccgagcggagaggccatccccaactga

SEQ ID NO: 8239 - DNA, 84 bp, Methylobacterium sp.
atggcgccggccgtgacggcgccggattccttgaccttcttggtcggggagcctgcgacgcatgtccaggcgccccactgctaa

SEQ ID NO: 8240 - DNA, 714 bp, Methylobacterium sp.
atgacctatggcttcgccaccagcgcctctgtaatggtcccctgtccttgggccgccgaggcggcacacatgttcgatggattgccggtcggggtccatctgaccctgaccagcgagcattcagggtatcgctggcggagccttaccggggcagcctctctacacgaggccagcggttttctgcctctctcgactgcgcttgcggtcgcgcagcaggatgccgacgacgtgcgcgccgagtgtcttgcgcagatcgagaccgcgttggcatggggcatcgatgtcacgcacatcgacacgcacatggatgtcctccatgcgagcgagccgttgttcacgatttacctcgatcttgcccagcatttcgcagtcccaatccggttgccatttcaagcggccttctctgcgcgtgaactggcggcagcaaggggaatcctgtcggtagaccagctgatctatacttggccgcgcccgacacgtgacgtgatgtttgagatggttcctactatggcttgcggagtgacggagctatttgcccatcctgttttggacggcgaggagttgcgtggctatgaccgtcatcatgcagacattcgcgcgcatgacgccgcaacgctgactgaccccagtgttttagctctgcttgatcgacatggtgtgcggcgaattagctatagagagctgcggtccactcagcgaggaaatcgcagatag

SEQ ID NO: 8241 - DNA, 372 bp, Methylobacterium sp.
atgaccgaccgcattcccaccgatggcacctatcgaggtgtccccctgcatgctggtcagcctgccgagcgcatcgagattgtcgtgaagccagcaatcgaccacgtcatcgacctcagcgaggccatcgcgcttgccgattacgctgccgagggagccaatccgcctgaggcacgcctgttcgccgcggcacgggtcgaagcgatttgggatctcgctgctgagggcagggcggtccggcccctggtcaatctcgtccgggtgcgagccagcgtcgccggcctcgacagcctgacatggcgggatccggaccgttacggcagcgacctggagccgcctcgagaccgtccacagcgtgacgctgatgagtag

SEQ ID NO: 8242 - DNA, 267 bp, Methylobacterium sp.
atgaccgcccgccgccgcgacgttctcctgtccgcaggcgccttcctagccgccgccacgcttcccggccgtgccggctccgcccaggcgaccggcgcggcgggcgggccgcccgaggtcgtcctctccggcggcttggtcgtcagcatggatccgttggtcggcgatctcgaacggggcgacgtgcacgtgcgcgacggcgcgatcgtgagggtccccgagccgagattgccgcagaacaggcgctcgtcggcgccggtggtcttc

SEQ ID NO: 8243 - DNA, 255 bp, Methylobacterium sp.
atgccgaggtggcccgccgaccagcttctccggcacggcccggaactcccgctggcggagcaggtccggcgctaccagcacaacattcgcacgatccgggaggtcggctgcgtggtgccgcgctcggcctatgtcgacacgctcgatccggtcgagatcgagatgtggttcgtcgacagtgcggagaggaagcaccgactgaaggcggcgatccaaggcttggccgccctgccgccggagcccgaaccggagtga

SEQ ID NO: 8244 - DNA, 132 bp, Methylobacterium sp.
atggagatctacaaggctgtcgggcaggaagccgtagcggccagcgccacttacgacgaccgcatggcggaggtgcggaagcggatgctcgctgcggcgcgcggggctagtaagtgcaggagggcacaatga

SEQ ID NO: 8245 - DNA, 729 bp, Methylobacterium sp.
atgcctcgcatcctcctcgtcgcccaggacaagggcggctccggcaagagcacgttgacgcgcgcgcttgccgagtgcctgcccgcggcgcgcctgatcgagatcgaggccaaccgccgcctgatcgagctggaggatcgcgtcagcttcttccccgtccgggccgagcgcggcgagatcaaccgcaccggtggcgccgccgcgcgtgcggagttcgacggtccgctcaacgcgatcgcagccgcgcagggacccgtcatcgtcgatgtcggggctaatacggccggctcgctcctgccgctgatcggggaggcgcaggcgcgctacgcccgccgcggggtcgagttcgcgctcctcgtcgtgctcacgagcgagcccggcgccctggccaacgcgccggtgctgctcgatcttgccaagcctttcacggccgcgcgctttgccgttgagaaccaggtcgagggcccggtcgatccgaaggctctgaagggtttcaccaaggatgtcaccctgactcagctggagaagctgagcctcgacgagcgcgccaacgagctcctgcagaaagggggcctgcggttcatcggcgaggacctcgtcgccgccgaggatcgcctaaccgagcgctacggcttcgccgaggcggggcgtatcgtcgaggatctcacgagcttccgcgccaggaccatgcaggccgtcagcccggctgcgcgctggctggaaggctga

SEQ ID NO: 8246 - DNA, 483 bp, Methylobacterium sp.
atgcccctcgatcccaagcgcctcgcccgcgacgcgaaccgcgcccaggcccagcggccggacaccggcatcggccgggagaccaccggcgtcacccgtgccgtgcgcgccggcctgcccgtcatccggcagctgcgtgcggccggcgtgacctgggctgccatcgccgaggcgatgagcgcccagggtgtgacccagggagcgggcacacccttgagcgccacccgcctgaccgcaatcgtcacccaggtcgaggcgcagatccgccgcaaggccgagcgcgaggccgggcgccgcagccgctccgacctgacgctctcatccggcctcctgcctccgtctcacccggccgcgacatcgctcccggctccagcggctgcgcctgctcctctccctccatccggttccagcgtgcccgccacggaggaggagatccggcgcgccggcctgaacgatctgcaccagctcctgaagaagtcctga

SEQ ID NO: 8247 - DNA, 255 bp, Methylobacterium sp.
ctcgccgcgatcgccctgcggctggccggcgacgaggctgcgcccaccggcaccttccactgcgtcaatgacggcgcgacgacgtggtgcgacttcgcccgtgcgatcgtcgcggggtcggcccggcgcggcgggcgctcggttccgatcgagggcatcccgagttccgcctacccgacgccggcccggcgcccggtgaattcgcgcctctccacccagagcctgaccgacgcctacggcctcgcgccgcgctcc

SEQ ID NO: 8248 - DNA, 303 bp, Methylobacterium sp.
ttgcaggagcgcaccgccttgctacaggccgcagacggcgggctagagccctacaacccggacttcaatccgatcgagcaggtcgtcgccaagttgaagggcctgctccgaaccgcggcggcccgcacggtcccagacctgtggcacaccatccagcaggcctccgattgcgtcacggccgacgaatgccgcaacggcctcgccgcagccggttacaataacgacttagccatcgctgcgggaacggctctaggtgacgtctcaaagccgcgcagcgtcccgcatgatggctcgggagcgtaa

SEQ ID NO: 8249 - DNA, 1704 bp, Methylobacterium sp.
atgtatcgtcccgaccttcccgcccgcatcggcctcgtcctcctcgttttcgccgccacgttcctgctggggtacccggcggcctacctcgccacccacgggctcgacgcgcgcgcttggccggccctgcgcggaactccgggcgattggttcacgcccgaggggggcggcctgggcgcttggctcgacggcctcgtccggatgggccgaacctacgtcaacatggcgctcggcggctcggacgcgctttccggtggtgggcgctcgtccgtcctgttcgtctggagcatcccggtcgccctcggtgtgctgatcctgatgggcggccgcctcgtgccgctgcgtcatcatcttcgccgcttcggcgatgccgccttcgccagcccccgcgatctcgcccgcatgcgcaaggggatcgagctcggcctcgatccggacaccggccgagctgtccgcgtccagcttgagggcaacctgctcaccattgccccgccccgcaccggcaagagcagtggtctgatcctgcccaacctcgccctgccggaacccggcgcctgggctggccccgcggtggtgatcgatcccaagggcgatgtcgttcgcgccgtgcggcggagacgggagagcatggggcagacggtctacgtgctcgatcccctcggtctggccggtggctcggatcgctgggatccgctgctcggcctcgacgccgaggacgtgctggagctgcagagcatggcccgcgccctcctgccggagaccgcccagcccagtgaggccggcgcgttcttccgtgatcgcgccagcatcctcctggtggcagccctgcaatgtgcaatccggtccgggcagggcgtgccggaggccgctgccctggtgcgcaatcccgatgcgttgctggcagccctcgaggggtacgatgacgcggtcgcccaggatgcccgcggtatcctggcctcccccccagacaagagtcgcgccgacatcctggcgacggcggcccagggcttcggctggatgttggacactcgtatgcagcaggtcgtgacggggcacagcgtccgcctcgacgcactctgctcgggcagtgccgacctctacatcgttctgccggccgacgaccgcggcaaggagcttgcgccctacgtgcgctggctgctcgccgctttgttcagcaccgtgcggcgcacgcccgtggccgagcgcctcctggtgatcatcgacgaggcctatacgctcggccgcttcggtgcgatcctgcgcggggtcggcgagctgccgggctacggcgtctcgctgtggacgttctggcaatccgaagcgcagatcatcgatacctacggtgaggcgggcgcggcgatcctgcgcgacacggccgaggcgttgctgctgttcaacctcgcgggtgcgcagggcgcggagcgcgagcgctggtccacggcgctcgggagcttcacgggcgtccaggagacgatctctcgcgatcccaataccggccgggagacgaagagcgtggcgcctggtccggaggcgctggtgccggcctcggaacttgcccgcctgacccagcggcacactctggtcttcctcgccagcggcgcctacaccaccgatccgctcaagctccgcaagacgctcgcccacaatgatgcgcgcttctccggtctgctcgactccgtggcacccgtgcgggctaccggctga

SEQ ID NO: 8250 - DNA, 477 bp, Methylobacterium sp.
gtggacgcgatccgggagaagtacggcctctcggaacgtcacgcctgccggatcgtcggtcagcatcggggcacgcagcgctacgtgcccatcgtgccagccgacgaggatgcgctgacccgggccatcgttgccctggcgtccgagtacgggcgctatggctaccgccgcgtcaccgcgctgctgcaggcagacggctggcaggtgggcaaggatcgggttcagcgcatctggcgtcgcgaggggctgaaggttcctcacccaggggggctggagcgtgctgacgttgtcggggcggtctggtcggacgacgggcagacgccagtggtccgggtcatccgtggccgggacatagacggccccggcctcagccggaccaaccattccatcctaacggcagctgtagggctccaagcggccattccagtgtcttcgttcgaaggtccgctaatggcgcaaccaagaccgacaagctga

SEQ ID NO: 8251 - DNA, 546 bp, Methylobacterium sp.
atgggaacgcgcgagttcactgacggcgaggagcgcgcccggcgcgtcgccctggtgcaggcggtcggcgagcgggtctacggcgggagctggcagacgccgctcgccgacgcgctctcggccgcgacggggcgctccctcgggcgggcccgggtcgctcagtggatgctcgccgacggcgcgaagccggtgccgggctgggtcgtcgacgcgctcccgtcgatcgcccgggacggggccgcccgcctgcgccggcacgccgacgagctcgacgccctattcgccgagggcggcgccggcgccccgccggccgaggacgaacccgacgcggccggggagcccccgctcgaatccgggacggaagccacggcggaggctgccccgtacgatgacgggtccgatttcgacgtggatgccttcgtcgagaagttcgctcacgtccggccagcctcgcccgagccggagcccgcccccgagccgaccggctggcgctcccgcttcgccgaggagaacattggccgcatgcgcagcctcatccaccgctag

SEQ ID NO: 8252 - DNA, 537 bp, Methylobacterium sp.
atggaggtcctgatgtccgatgcttcgattacccccggccaatgccgcgccgcccgcgcgctagtcggccgcagccgcgatgacatcgcgcaaatggccggcatcaacccgcgcacggttgcggcgctggaggccgccgagaacgtcccttcgcgcgcgacggaaaagcgcctagtcgccgtcttcgaaaagctcggcgtgacgctgctgcccgagggggcgagcggtggtgtcggcgtgcgcctgagcgccggagatggagcgtcgctgcgattagtccggcgtgatccgctgaggcagcacgggtcgatcggcgtcatcgccgtcttcgacggcaggccgatcaccgcccgcattgaggtcgctgcgcttgccgagggcggcgacatggatgcggcgatcgaggcgttcgatacgcgccggccggcgatcctggcggcggtcgcccgcaagctggccgatggcaccctcgacggcgacgggcacttgcgcatcagcgccgcggatctcgagtcggccgcgggaggtcagccatga

SEQ ID NO: 8253 - DNA, 108 bp, Methylobacterium sp.
atggtcctcagcctgccccaggtcatcttgttcgtcgccgccgtgctcctcggcatgctgctccaccgttttgcagtcggtcgcgggccggtgtcgcgcaaagcctga

SEQ ID NO: 8254 - DNA, 105 bp, Methylobacterium sp.
atgatccatcagcttgccgagggcgcagatgccctgccgaaggacggcagcaagccgactgcaccgccgacgaatgcgttcgaaggatttgggtccttcgcctga

SEQ ID NO: 8255 - DNA, 945 bp, Methylobacterium sp.
gtgctcaacgcgctcctcgccgaccttccgttcgatctcacgcacgtcccggcgttcatcgtcaccgacgagacgggcgccccggtgacggatgtggtgacaaccgccccggcccctgccgcgtcagcctctcgctcctcggcccctgtcgtggtggcgaaagtggtgacaaaggccccggcccgcactcggcggaagcgcgtccgctcgggtctccggcagagggaagacgcccgcaccatgcgcgccgccgcgcggggccgcgcagaggaagtcgtagagcaccttccccatcactcctcgacctcctcgactcctaccagcccgacgaagaacgccaacgacaatgacgagccggagacgacgaagacctcgaccggccgggggcgcatgatcgccgcgtgggctgacgccggggagctcccgcgcatcatcgccacgaaccgcgccctggaccgcttcggcgtgccgatggccttcagcgtcaacttcgacccgaagctcatccaggccggcaacgacaacgcccgcggcctcctcgactacatgcgccgccggatcgccctcggcctcaagcgcacgttcggcgagaccccgcccatgtgggtcgccattgagaccgacgacgacgggcgcccgcaccttcacggcggtatcgctctcacggaccagcacgccccggccgtggtcctgggggcgctcgccaaggcgggcgggaactggatgcgccaggggagcgccccggccgacctgcgcccgcagcacgacccggacgggtgggcggcttatccgttcaagcggaaggagcggacgcgccgcgacctgcgccaagccgccggcctgccccctgacgcccgcgtcggcctctacgcgaccagcgccgagctcctcgccgaggggcggcgcatccacgaagaacagcgccagttgatcgggcgccgctga

SEQ ID NO: 8256 - DNA, 213 bp, Methylobacterium sp.
atgcgccacgagaagctggtcaatgagtgcggtgagtgcatcacgcgcgggactttcttcttcgcgtcgcagaaagaccgaaactctttcctccattgtgttctgaccagcatcttctccgatccggtggatgaccggtttgccctgtatgtcgagcatcaacaaccagtgattgccgtctgcgtctgcattgaggggctgaaactcttttga

SEQ ID NO: 8257 - DNA, 84 bp, Methylobacterium sp.
gtgtgccgcgcgaccctgcggcgcggccccggcatggacaatcatccggcgatcggccacggtgccgccgtgccgaaagagtag

SEQ ID NO: 8258 - DNA, 177 bp, Methylobacterium sp.
ttgaagctggcgaagcagcggggcgacatcgattgtggcggcgcgcgttacgtgatcgtcggatacggccacttccatcagctcgtcatcgataggccgaacggccacgtctcggtctgtttcgagctcgacgagaatccgattccgttcgttgaaagaatactttcgctcctttga

SEQ ID NO: 8259 - DNA, 87 bp, Methylobacterium sp.
atgcgggcgttggctggcatcctccgcaccctcgctgccctgatcgcgccgaaccgggcggtggtgcgggccctgtcgggaggctaa

SEQ ID NO: 8260 - DNA, 402 bp, Methylobacterium sp.
atgagcggagcatccggacgcgagatcggggagcggcacgtcgcggccctccgcgcctggctcgatggcctcgaagctgccggagagccactcccgacccgaaatggtcggatcaacctctcggccatcgcgatcgcctgcgggttcgatcggcagaccctctacaagaaccccgccgccagggcgctcctcgaagaggccgtcggccgccttggaaccggcgagccggccgccgaggaagccgaggcaaagccacagaccgacaggcgggaccgccgcatcctgcaacttgagcagcaaaacgccgccctcagagccgaggtgcgcggtctgcgggagcagctcgcccgctaccgtcacgtcgaagacgttatgatctccgggcgcggcgtgcgcagctaa

SEQ ID NO: 8261 - DNA, 252 bp, Methylobacterium sp.
atgatccatgccaagatacgagtgccggagcagtcggatttagctggcttggcgatgttcgcgaaccaattcttccattcacgagtacaaggcgaggccgaggcgtcttcgaaaaatatggtctggatcacattctatttcgcggacaaacccgagaaacttgacggtaaggtaaggacgtatcgggagatttttgttcgtgaggcgtcggcttggtatcgtctctaccagggaggcaaacaactcctctaa

SEQ ID NO: 8262 - DNA, 945 bp, Methylobacterium sp.
atggcgactgtcttcttctcatattcccacgtggacgaaggactgcgcgaccggcttgagatcgccctgtcggccctcaagcggcagggcctgatcgaggcgtggcacgacagacggctggtcgccggcgacgatttcgaccgcggcgtgcggggcgaactcgaacgggccgacgtgatcctcctcctggtgtcgcccgacttcatcgcatcggactattgctacggcgtcgagatgacacgggccctggaacgccacgagcgcggcgaggccagggtcatccctgtcatccttcgtgcctgcgattggcatcctctgccgttcggcaagcttctggctgcaccgcgcgatggcaagccggtccggtcgtggcccgatctggacgaagccttcctcgatgtcgcgcagaagatccgtgcagccctcccgaaggccgaggccgctagggcgtcggccccgaccgcggcgcagccagcgccgatggctccgcaaggctcccggtcgagcaacctgcgcctgcgcaagagcttcacggaggtcgatcacgaccggttcctcgacgacagcttcgagttcctcgcccgcttctttgagaactcgctccaagagctgaaggcgcgcaacgaaggcatcgataccgccttccgccgcatcgacggtaaccgcttcacggccgcggtttaccgggatgggaccgccgtctctcgcggctcgatcgtgcggggcggcatgttcggacgagggattagctggtcagccaatgacgaggctgcgagcaacagctgcaacgagtacctgttggtcgagaacgatgagcagggcctgtttctgcgtgctggtgggatgcctcacatcggccggggcaatcctgagggcaaactcacgcaggagggggccggggagtacctatgggaactcctgatgcaaccgttgcagtggcgctga

SEQ ID NO: 8263 - DNA, 144 bp, Methylobacterium sp.
atgtctcaagccgcagatgggcgcggcactttagtggacgccatcatgttgctcttggccagtttttatttggcaggtctggcaattttcctcgagatcatcgcctcggctccgacctcagacggctcgccgcttcgcgattag

SEQ ID NO: 8264 - DNA, 393 bp, Methylobacterium sp.
atgatctcggtgaagttcaccggcctcgacgtgttcgccgcgctgtcacgctccgaacgcctgaaggcgtcggcacatcacgccgttgcagagcaggccgaacagctcgccgacgcgatccgcgaggcggcaccgtccgacaagggcgacctgaaggagtccgtgcgcgtcgagccgactgacgatccgcttcgcgtcaccgtcacggccggcggcatgctcggcaccatcgagacaaacgcggacggcgtgcagttcgatgaagcattaatgagtgagtatggcacgtctcgcagcgcggcccagccgttcttctggcccacagtcgagaagatgcgtgatacaattaaagcgaacattgacggcgccatggaaggcgcattggaggagtag

SEQ ID NO: 8265 - DNA, 162 bp, Methylobacterium sp.
atgcgtcacagcagcccggtcgggttcggccggacgggatgtccgcgctccgatccggccggcggcccgtcccaagtcattccggccaatacgccgcgatcggtcgcgcggctgcgggcctctgccaagccgttgatcgcgaacgtgtttcccgcgccgtaa

SEQ ID NO: 8266 - DNA, 183 bp, Methylobacterium sp.
atgagcgagccggcctctgcgggccggcgctccccggacatcatggggcgggcggacgcatcgtccatgcccggcaaccacggcgaagttgtggatgggccggaaacgccgctccaaccgtcgcgccggaaccgggtggacacgggcgacggccgtctggttttcgcccaaaccctgccttag

SEQ ID NO: 8267 - DNA, 1179 bp, Methylobacterium sp.
atgggtacgacacgcagggcgttcgttctgggcggagccgccctcgcggcgacggccggcgcctcgtcggcgcatcaggcgtggctctgggtggcggagccccgacccggcaaggctccgctcgcggccatcccggtgttcgacctgcgcgggtccgatcccgcaacgcacgcgatttcccgcaaaggcgaggtcctgggcctcgcgcagagctgcgtcggcccgctgacgcccgtggcccgcctcggcctcgacggggccgacatcctcgccggccggtggctgcgcgcctctggctccccgtacgtgggcgagctcgaacggattgccgagggcaccggcgtgtcgggcgtccaccttctcaacgccagttacgagtggggctgcacgtccctggccgccccttcgccggacggcggctcggcccggcttctgaggacgctcgattggccgttccatgggcttggccgccgtgtcgaggcatggatccagtccggccccgcgggggaattcgtcaacctttcgtggcccggctcggtcggcctgctcacggggatggcccccgggcgcttcgcggcggccatcaaccagccgccggtcaagaggcgcgcgatcggcgacagcccgctcctcgatgccgtcgcgggctcctacgcggcatgggagtcgagcgggcgcatcccggccctccatctactgcggcgcgtgttcgagacgacggtggactacgcctcggcccgtcggatgctcgagaccacgcccatcgcggcccccgccatcttcacgctggtcggtgtgaaccccgaccagacctgcgtcgtcgagcgcgacgtggcggacttccacacgcatgagggtgtctccagcgccgcgaacgtctggaggtacgggaccttcccggggacgtggcgaggcgggcgcgcgtccgaggaggcgcacgatagtacccagcgctcggacatgatcgagtcctgggccggcaaggccaccacgaccggcgcgtcgacgtcgaattttgagtgggtgaaggccccgatcctcaacgcgatgacccgcctcgccgtagaggcggatccgggcaagggagtcctacgggcggttgggttcgaggaggcgccgggcgatgccgataccgcggaatgggcgaccctgccgcttgaatgggcggccgggacctaa

SEQ ID NO: 8268 - DNA, 315 bp, Methylobacterium sp.
atggtcggtcgcgtggtttcgtcgagggcagagaggctgacccacgacacggatcgtttgcgggccgtgttcgcggcggaagccatcctgaacaggatcggcctcgaccttccgcttcgaacgcaggatacgagtgggcaactcggcgatggttcccgctggcggatcgtgatccgtccctacatcgagcctgggtttcgtatacaagggcggtcgaaccttctgcacgtttcggtccgggtcgcaccggcgcgcggtgcggaaagaaacgcggtggtactgaataccctgcggctgccgggttctgacctgtga

SEQ ID NO: 8269 - DNA, 297 bp, Methylobacterium sp.
gtgaaagcagcgtcgaacgaccaaccgtcccttcccgcgcctaagccaccgttctggctggtcggcatcgtgtggggggagacgaatcgcttcgcgatcgtccagtcgtcgcgcaccggcccgatccaccgggtacgagccggcgagacgatcgaccgatggcgcctcgagcacatgaccgcacgcgtcgcgacgttccgaatgaacgatgtgaacgtaccgctcgatctccagcgcgcccgctcaccggcttccgatcccgctccgaacacctacggtcgggtcggcagacactga

SEQ ID NO: 8270 - DNA, 477 bp, Methylobacterium sp.
atgaccaccaccacttgttctgggaccgtgaccgcgctgggccagtcggcgctcagcctccaggggaggcgctatgcctacatcgagatacagaggccggacggccgcatcctgcgggccgacgacgtggtcgtattgaacgaggtgggcagcctcttgcacgagggcgtcgagggacggtttcacttcgacgccgctcgcctgaagacggccacgatccggcagctgttcggtatccggcgcaacgacggacgctgggcctatgacgccgcgcaggtccgtgtgacagccgccgtccataacatcgttcagggtgcgctcctggctttcgtcttcgtcggcatcccattcctgctgctcggcctgctgcagctgatctactcgatcggcacggctcgcctgcgccacgacgaattctttggctctgaggaccagggcggaggctctacgcgtcagggtgaggtcatccggatatga

SEQ ID NO: 8271 - DNA, 183 bp, Methylobacterium sp.
atgaaccgtctcacgacacgctgcgcggccgaacggctcgcgctcgcggctggcgccgccgcggcgcaggaggccggcgccgccgcgccggggccgcacgacgggatacgccggaccctgttcgtcgcgcacggcctccgcaggcccgaccacgtcgcggttgattcctccgcgtcgcggtga

SEQ ID NO: 8272 - DNA, 150 bp, Methylobacterium sp.
atgggaatttcgagggtcggtccctacgacgggcttctggcgttcgcgctgaatgacatcgaactcgacatgctccgcgtgaaggagcacgccggtgatgcgaaggggcctgtcgcaaacgcaatagcgccgacgtttactccgcgttga

SEQ ID NO: 8273 - DNA, 333 bp, Methylobacterium sp.
atggccgagacatcacccccggaaaccgggaaaaaccgaaagccccgcgtcgggaaagcccgaggcggccgaccgaaccgaaacgaggcgctacgccgccgcatcgctgaggccggcgtcgatcccgccctggtcgatccccggaagctgttggcggcaattgccctcgacgagaaggcaccggcaaccgccagagtccaggcctgcaaggctctgatcgctgctcaagccggtctcccgccgccgatcgagcttgatccggacgaggtgcccgaagacgatgccgtgacgcgccgtgccctggcgctgatggctgcggggagaccgcagtga

SEQ ID NO: 8274 - DNA, 231 bp, Methylobacterium sp.
ttgacgacgacgaagatcatgtccgggatgagcgtggtggacaccgcctcgcgccgctgggcgtccgccgccgcggtccagaagatcatgaacgccgccgtgaagtcggagggctcagccaaggtgctgggcctgaacatggaccggatgcgggccctcgggctggacgatgagattgacctgaccggctggctttggaccgggctgattgagaggatcagccaggactga

SEQ ID NO: 8275 - DNA, 135 bp, Methylobacterium sp.
ttgggcggcggaatcgcctatgcaatcctcgatgccttcgtgttcatgcgcgggcagaacatcgagcatcgggtagtccctatcttcgcggccatcttcctgaccggcatccttgtcgctgtcgctctttcatag

SEQ ID NO: 8276 - DNA, 279 bp, Methylobacterium sp.
ttgctggtgcccgctgtgcgcaccctcatctcggtgccagcgggcctcgcccccatgccgatgctcccgttcttgatctactccactgtcggaacgcttgtgtggaccacgctcctcgccgtagcgggctactggcttcaagatcgctatgaagaggtttccgcccatgttgatccagtttctaaatgcattgttgggctgatcgtcgtgacgtacctttaccgagtggtcacctggcagcctgatatcgcgagcgctgattctgatcaggcgcattga

SEQ ID NO: 8277 - DNA, 588 bp, Methylobacterium sp.
atggccgtttcgttgaccaagggcagttcgatctcgctcaccaagcaagctccaagtctcgcaaggatcagtatgggcctcgggtgggatcccgcgaagaaaggtggcgggttcctaggcaagctttttggcggcggcggcagcgattccatcgacttggatgcctcttgcctagccttcgcaggcgggcgccatgtcgataccgcctattttggccgcctcgacatccttggtggcgcgatccaccacaatggcgacaatctgacgggcgacggcgatggcgacgatgaggtgatcgatatcgacaccacgcgcctacctgcggagatcgacgccctcgttctgaccgtgaactcctttcgcggccagaccttcgatgaggtcgacaacgccttctgccgggtcgtggaccaatccaatggcagggagctcgctcgcttcactctggcggagaaggggcgccacaccggcgtcgtcatggccgtcctccgtagggccggcagctcgtgggacatgcaggcgataggccggtccgcacacggacgtacggcggccgatcttgtcgggcctgcccgggaatgtctctga

SEQ ID NO: 8278 - DNA, 1227 bp, Methylobacterium sp.
atgaccactctcacgatgggcgggaacgcccctgtgcccagcggcgacctcatggttgtcgtggaatgggcttcgacaccggggctcgacgaaatcgacgcagccgccttcctgcttggcgcggacgggcgcgtgtcgggtgacgcggacatgattttctatggccagaaaggcgatggcgccgttcgcttcgagcgcgtacccggccatgtgcccgaccgcgacgcttccgtcttccacatcaagacggcgctactcccggatcgcgtccagcgggtggcattcagcgggacgatacacggtgcccgggaaaccgggatgcatttcggaaagatcgcaggcctccgcatctccgttcaatcggcacaaggcgatgctgtcgcattcattccacctccggcctccaacggcgagaccgcgttggttctcggcgaactctaccgccgggacgcaggctggaagttcaaggcggtcggacagggttttgccagcggccttgcctctcttgcgagtgcctacggcgtcgacgtggaggatgccgcagttgcatctccgccgccggcacccaagccgcaacctgtcgcccctgcacccgtctcgccaccgacaccgaagccgatcaatctttccaaggtcagcttgaccaaggaacgtccgaccgtttcgttggagaagcggtcggactacggagatgtgacggtcaacctcaattggagcagggcaaagaccggcggactttccgggctgctccagcgcggtggtggcgggatcgacctggatctcggttgcctctacgagttgaccgacggatcgatcggttgcgtccaggcgctggggaacagtttcggccggctcgaccgggagccattcgtggccctcgattccgacgaccgctccggcgcttccgtcgacggcgagtggatgcgggtgaacggccggtacttcaccaacatccagcgcctgctcgttttcgctttcatctacgacggcgtgcccaactgggctcgcaccgacggtgtggtgaccgtgcgggtcccgggcgaaggccccgtcgaagttcgtatggaagagggatcgaacgccaaacgcatgtgcgccgtggcgttgatcgagaacgacgcaggccggatgcggatctcccgggaggtcgcgtacttccgagggcacgacgacatggataccgcttatggctgggggctacgctggaaagcgggttcgaagaactga

SEQ ID NO: 8279 - DNA, 579 bp, Methylobacterium sp.
atggccgtgagcctcagcaagggcggcaatgtcagcctgtccaaggaagaaccaaatctttccaagatcctaatcgggcttggctgggataatcgcaagacggatgggaaggatttcgacctcgacgcttcgctcttcatgctcagcgatgccggccggtgttcgaatgacgcagggttcattttctacaacaacaaggaatcggccgacgggtcggtgaagcaccacggggacaaccgcaccggcgagggtgacggggacgacgagaagatcagcgtcgttctcggcaaggtcggctccgatgtgcagaggcttgcagtcaccgtgacgatccatgaggcgagcgagcgaggccagaatttcggtcaggtccagaacgcgttcattcgtgtggtcaacgaggacaccgggcgcgagattgcccgctacgatctcggcgaagactattcgacggagaccgcgatggtgttcggcgaaatctatcgccacggcggcgagtggaagttcaaggcaatcggacaaggctacgcgggtggcctgaaggccatggcaacccagtacggcatcaacgtcggctga

SEQ ID NO: 8280 - DNA, 570 bp, Methylobacterium sp.
gtgaacctgagcaaggggggcaccgtctcgctctccaaggaagcccccggcctcgctgccattctcactggcctcgggtgggataaccgcgtctcggacggcaagcccttcgacctggatgcctccgtgttcctgctcggagccgacgggaagtgtgccggtgacgcggcgttcatcttctacaacaacaagaagtctgccgatggttcagtcgagcatatgggcgacaacacgacggggcagggcgacggcgacgacgaagtcgtgaagatcgatcttgccaaggttcccgaagcgattacgcgcctcgtgtttgccgtgacgatccatgaagcgaaagagagaagccaaaatttcgggcaggtgcaaaacgcctacatccgcgtggtcaaccaagccgggggcgcggaactcgccaagtacgatctatcggaagacgcctcgaccgagaccgcgatggtgttcggcgaggtttatcgccacaacggcgagtggaagttcaaggctgtcggacaagggttcgcgggcggcctcggggaccttgcccggtcctacggcatcaacgcctga

SEQ ID NO: 8281 - DNA, 1269 bp, Methylobacterium sp.
atggccaagcagctcgccagcgacgccgagatcctcgctgcggtgaagaacgccggctccatccgggccggcgccaaggccctcgggatggcccattcctctgtccgggagcggatctgcaagctccgccaggccgtacaaggaaatgataccgacctggctttcgcttccgagaaggggctcctcggcaccgagccggtcctgccgggctatgccctgaagcgctcgacggcggtcaacggcaaggagggcgaggtcgtccgccaatacgtgacccaggccaaggcgccggggccgcgggctgaaattccagccggccacgtcgtgaagggggtgtcgcaactccgggattcgagcgggcgcgtcacccaggagtgggtgaagacccgggaggccgacggcgacccggccctgctcgccaagaccctgcgcgaggtcatgctcgacgcacgaggaccgtcgggaatcgtgctgcccgaggtggaccgggatgaggacctgctgacggtctacgtcgtgccagatctacacctcggcatgatggcacacgccaaggagtgcggtgagaactacgacctgcgcatcgcctcggagatgatccgccgtgaggtctcccgcctgatggcgatggcgcctccgtccaagcacgccgtcctgctcttcctcggcgacttcttccaccagaacgaccagaagaacgccacgccccgcagcgggcacgccctcgacgtcgacggccgctggcgcaaggtctaccgcgtcggtgcccaggtcgcgatcggcctgtcgcgcgccgttgccgagcgtcacgagaacgtcgaggtcgccttccttcccggcaaccacgacgaggacgcggccctgacgatggcggttgccctggagatccacttcgaggagcatccccggatcacggttgcagacggcgacgggatccactggttccgccgattcggccggtgcctgctcggcgccacccacggccacaccatgaagcccgaccgcatggcgatgatgctcgccactgaccgggccagggactggggcgagaccgaccaccggcacttcttcttcggccacatccaccacgagacggccaaggaggtcggcccggtgcgggtcgagagcttcacctcgccggccgccagggacgcctacgctgctgccggcgggtaccggtcaaaccggtcgctcaacgcggtcacgttccatcgggaggatggcgaggtctgccgccaccgggtcaacatcaagggggccgtgcagtga

SEQ ID NO: 8282 - DNA, 384 bp, Methylobacterium sp.
ttggctaggttccacttccaggtaaggacccagtcgcacgttgccttcaccgaggcggccgaccttccagggctagagaaggctcgcaccgaggcggcgcgccgcgtgcgcgtgttgctgaccgaacacgcgcagcaaatctgggcggataaagactggcagatggacgtgacggacgacagggggctgatcctgtttacatcaatgtttcagcctacgtcgcgccagccgcgcagggcagtgaacgcccgtcggggctgtagaactcagccctcggccttcttcggcttcgcgctccgattcaacgctgcgttgaagtcagcctcgttctcgctcgcgccagactcacgcgcagcttcaatgaagtggctgcgctattcctag

SEQ ID NO: 8283 - DNA, 411 bp, Methylobacterium sp.
atgtccaacgtgaaggaggttgccgaagacaggatgggccgggccttgaacggcttcgtcgctgccataggcgcccttatcgccgcatctccgttcttcctgtcgttctcggacaacgttccagcaaccacgaacgcgctgctctgcggcatagcggtgtcgatcctggcaatcatgaacaagcgcggccgccatgtatgggcggagtggtccgccctggcgctggggccgtggatcatcgcgtcgccgtggctcctacagacggacatcgttccctcgatgaccaccggcgccatgggaggcttcgagccggaggtcgcagctcatgtcgccttcggaatggcgctcctgatctcaagtgccttcgtcatcgtacgatctggatcttggatccttgcaccagacgcttga

SEQ ID NO: 8284 - DNA, 309 bp, Methylobacterium sp.
atgatcgaggccgccgtcagcttcggcctcaacgcggtgaacggcgcggccaagggcaagacgctttcggtcaacgtcgcggtgccggtcatcgccaagggcacgcagtacgtcatcgacacagcgccggctgcggtcatcaaggcggctggtggcgccgatggcatcacggcccggatcttccgcaagctcgacctcgacgaccacgccagcgaggcggccgtgctcatctcggcgcaggagcaggttgccgccagcacggtggatgccgacgagctgcggcgcatggatgagatgagccggcgctga

SEQ ID NO: 8285 - DNA, 270 bp, Methylobacterium sp.
gtgagcgccctgtctcgcatccgggagttccggatccgccgcatcgagaacttccgggccgtcctgctgaaggcctggagcgtccgcctcatcgtgctcgccacgctgctggagggcgcgcaggccggctgcggcttcttcaccggctccgacctcgtcagccccggcacgctcaccgtcctgaactgcggcctgatgctggccgcgctggcggcgcgcctcgtcgcccaggaggccgtcagcggctccaccgtcaagggagacgcatga

SEQ ID NO: 8286 - DNA, 1014 bp, Methylobacterium sp.
atgcaggaacttgaggagttcggcctcgacgagggtgaagcgctcggcaggctcgagacgctctggtccgcctacgaaaagatctctgccgaagccgcccgctacgatgggagcctcggctggaagaccaacgccggcctggactacctcgtccacacggtgaacctccgctacgagggcaaccggcagcgcacgcgctcgctcgggccgcgctccgaagagacggaacgtcggatggcggagttccgcgagggtcgtgatcggtcccgcgagcggctcgctcgagttcaagagcgcctggagatccacgggcgcgtgctcaaggtgctgcggctcggacgcctgtccagcctgactgcgcggttcctccgcgagctccacgccgaaggcttcggcgccggccacttccgcatcggcggcgcagcagccctggccgcctacggggtccgcgcgcgcattcggatgcccacggtcggctccgaggacgaacccgatttcgacctgctgccgacggagctgttcgtccgtgaccagcggctgttcgatgcggtcgcctcccgcaagatcttcggacccgtggagccggacggcgaccgcctcgtactcggacgtggcatcgtgctgcggatgttgtccgaggacgttctcgatggctgggttcggcacatgagccacgtcggcgtcggagaggacgagatcaatgcccttcgatgggccgtcgaggtcccggaagccgtcccgctgctggcggtgggtcgggacggctcgccggctcccgtagcggcactcgatcccagggctttcgccgtcctcgccgccgtcgaggcgcgccatgtcgccgacgaccctacggcggctcggctcgcggagcaggcggccgcggtcgccggcgtcgctgccggcatcgtctccgaaccgttcgagcgcggacacctcgcactcttccccgagatcgccgacgcggtcggcgaaggaggcctccatgcccacgacgcgatcgtgatgcgcccttag

SEQ ID NO: 8287 - DNA, 585 bp, Methylobacterium sp.
atggaagacgcgacgcggttcgggcagggcgatagcgactatgcacgcgaggtgcgtcgggatcgcgagacggcccgtgcatggctgacgaagccgagcgccgacttcaacgaggtatgcgcacttgcggaccgcgaacccgatcaggttcgcaaggatgcgctcgccctcatcgccatggtggatgcgcgtgtcgccgccggcctccgggcgaggccgaggaagaccaagcccaagagcgaagtgcagcgctacgagttccagggcgagcgcctgaccattcccgaatggtcgaagcgcaccggcatctgcgctcccacgcttcgcggacgcctcaacaccggatggccgcttgagctcgctctcaccaagcccgcagtcgtaggcgccttcgggcagccccatacgcaccgggatgccaagcgcatcacctttaagggcaagtctctctcagtgcgcgagtgggccgaggcgaccggcatcaacgccaagacgctccacgcgcgccttgaggcccgttggccggtctcccgcgccctgacggcgcctgcccgctcacgcccgcaggagaccgtgcccgcctga

SEQ ID NO: 8288 - DNA, 345 bp, Methylobacterium sp.
atgatgcacgccttgtcacggctcgacccagccatcgcgcgatgggcccgggccacaaggcgccgtgacatgctcaccatggtcaaacgcatcaccgccgggatcaccggccatttcaagacgcggatcaccgaatggtttgcagccgttctgctgttgcagcttgggtggacgctggtcagtccccccgcgtcgtttcccccgtccaccgcgtggtccgtgatggcggcacggatgccggaggaaacatggggtgcaatcatgctggccatcgccggcacgcgcttgctcgccctcgacatcgacgggacgttccggtcgttccgttactggcctgccccctga

SEQ ID NO: 8289 - DNA, 2064 bp, Methylobacterium sp.
atggatgatctgcccgccggcttccgcctcgtgtcgcgcccgaacgcgccggcgggtgctgacttaccgccgggctttcgtgtcgtctccgacgcaccagccctgccggcgcccgcggcgcagccgagtgtggtcgctgacgtcgccaaggccctgccaaccggcgcggtgaagggcgcgatcggcctcgcaggcctgccgggcgacgtgcaggagatgagcaacagcctgatcgaccgcaccatgctcggcgccgcgcacatgttcatggacgcaaccggcctcggctatcaggccggcacgccagagcgggaggagttcgaccgcttctatctcgggatcgggtcaggcggcggtctgccgacgtccaaggacgtgcgccgcggcgttgagaaggccaccggcccgctttacgagcccaagacggtgccgggccagtacgcgcagaccgtcggtgaattcctccctggcgccgttgtcggctctggtggtgtggcgcgccgcgcggccgagaccatcattccggccacgctgtccgagacagcgggccaagccacgaagggcaccgcggccgagccgttcgcccgcctagccggcggtgtggccggcaacctcggtgtggccacggctgcggcccgggctgatgcgccggcgcgcgccatcgtagccgcgacgcgcggcaccacagaggccgaccttgctgcggcgcgggcgctcggcgagaccgcgcagcgcgttggcgtgccgctcaccggtgccgaggcgatccaaggcgccacgggcaacgcgacgaagctgggcgacctgcagcgggccgtggaaggctcgctcgacggcggtgccattctctcgcaggcctacgcccagcgaccccagcagatgcgcaacgctgtagaggatgcgctcgccgcgctcggcccgcagagtaccgcgccgtccactctcggcccgcgtgcggctcagaccgccgaggcagcaattgacgacctgcggcagagcatcaaccggtcgacgcggagcgactacgcagcggccggcgcccacgtgctcgacccggccgacttcgagccactcgcccgcgatcctgcattccgggaaacgctgcgccagctccgcgccgatccggtgctcggcccgacgtaccgcgatctgccggacagctcgattgcggtcatcgacgcggtgacaaagggtatgcgcgaccgcggcgtcgcgctcggcaaccgcgcgaatcctggtttcagttccgagacagccggcttctacaccgggggcgccgccgaggcccgcgccatcgcccgcgacccggcccgcggcggctcccaggcctacgacgatgcgctgaccgcccaggcgcaggcgcggcgccagaacctcgagccgttggaacagggcccgcttggacagctcgcgcaggtcggcgacacggcagccgcgacgcaggctgtcctgccggcgcgcccgctcgttggcggcgaagctgaactcgccgacgcggtcacccgcctgcgggcccgcgaaccggatctcacgaacgagctcatccggcagcggcttgccgaccagttcgacgccagcgcgacgcggctcgtgggcggcgaggcccagggcggcggggcgcgcttcgccaaggacattgccggcacggagcagcaggcgcgcagcctcgacgccgtcctagatgcagtcggcggcccggccgctcggcagccgatcgccgacgtgctcgacgtcttccgcgccactggcacccgcaagccacagggcagcccgaccgacttcaatcagcagatccgcgaggctgtcggagagatgccgctgacggcccaggccctgacggctctacgcacgggcggcgcttcgctgctgacgcaggctggcgacggggcgcggcgggcgtggttcggccggaataacgcaacgctggcggagatcctgaccgcgccggatagcatcggccggatcgggaccatcctgcagcgtgggacgaccacaccctatgcggacgcggcgcttcggcaggcgctgcagtcacgcggcgcggagagcgccgcgcagcaatag

SEQ ID NO: 8290 - DNA, 138 bp, Methylobacterium sp.
atgacggctttgcgtggctcgttgagcggcatcatgctgccgttcgtgcctcctttccctagcgggggcggcacgctgtggacgcctgtcagaaagccgctcccgaagcgggcgaccctccgcatggcgtggtcctga

SEQ ID NO: 8291 - DNA, 150 bp, Methylobacterium sp.
atgcctggtatctgcctcgaccagatcgcccccgtggttttggacggtacggtgggccgcgagttgaccatgatgcgctggggcatcccagggccgaaggcttacggcgaacagcccgtcaccaacgtccaatgttggatgggcgcatga

SEQ ID NO: 8292 - DNA, 114 bp, Methylobacterium sp.
tcgcgcctctccacccagagcctgaccgacgcctacggcctcgcgccgcgctcctgggagccggcgctcgacgacatcctcgaccggctggtcgggccggttcgctcccactga

SEQ ID NO: 8293 - DNA, 114 bp, Methylobacterium sp.
ttttgcctctccacccagagcctgaccgacgcctacggcctcgcgccgcgctcctgggagccggcgctcgacgacatcctcgaccggctggtcgggccggttcgctcccactga

SEQ ID NO: 8294 - DNA, 372 bp, Methylobacterium sp.
ttgagcatcctcctcttttgcggggaggatggcttgttcgtcctggagttgtcgagcagtttgtttgcgatcctggatggggaatgtggacggaggatcgaggctttggcgatggtcctgccacgatggcttcgtgaccgcctcatgccagcacggttccgccaggaggtcgcgggcaaggccaccgaccttctctccgtccacggcggcctagcctaccgcgtcgcccgcgagcaggcccgaatggaaagggccggcggccgcttgaccgagtgccgcttctggagccgcgtcgcggtcgagatcgcccggcgcgagggacgggccgatcagatcggcgtgaagggcggggatcggtggccagatccctga

SEQ ID NO: 8295 - DNA, 156 bp, Methylobacterium sp.
atgggggcgaccatgtcgcttcacaccgcttccgtgaccgccgatctcatcgtcacagcgctcggattagatcttcgcacgcgcgccgctcagatgccggggcagatgtcctcagtgcgattgatgccggctttcaccttaaccgctgccggctga

SEQ ID NO: 8296 - DNA, 2148 bp, Methylobacterium sp.
atgcgttctctggcgttcgcgcttacaggcaccgggatggccgccttcctcgtggcgacacggacgggcgagtggaatctccacctgctgacgggcttcctcgtcgtggcggcggcttgcgtccttgccgttcgcgacggctcgaccttcctcaagatcccgctcgctaccttcgggtgggaggcggtcgtgctcggcctctgcacccttgcaagggcggagggggcgtggccggcttggctcgccgacctcgccgtcccgagcacggccgtgatgacgctcaccctcctcgtcatcgtgctcgccgcgctctggtccgtctccgtcgtccggcgctgcctcgtcatcgccgaccgctacttcgacagggatgaccgtctcggctggcggctgccggggggggcgatgctgcgcgtccgcgagcgccatctcggacgggcggcggtatcgctcaccatcctgctgcgtcaggtcggcgtgatcctgaccatcaagaccctctacgtcagcgcgcaactcgccgacgcgctccaggccggcgacagggcgatgttctgggacgccctgctggtgcagatgccgctctgggcgatcccctggatgatcctccatctcgcgagcacctctctggtggtcgccttctcggtccgctggcggcaggtcctgtcggaggattacgcccggcgctggttctcgggcgcggctcactaccggatgacgctcgtcaacagcggcatcgacaatcccgatcagcgcatccacgaggacgttccgaacttcatcggcggaacggaaggcggcacctggggcgtgtacagcatcgtcgtgatgatcacgggcatcctcagctcgttcctcatctacgcgatcgtcctctggaacctgtccgagagcgtcgacctgttcggcaacggggtgcggattccgggcctgctgctctggatcgcgatggcctgggccgtgatctcgacctgcctcacgatctggatcggcaaacccatcgtcccgctctccttccgccagcagcatgtcgaggcggattaccggttcggactggcccgaacgcgggaatacagcgagcagatcgcgctctcgcacggcggccgcgccgaggcggcgatcatcgagaaccggctgggcgcggtggtgagcaacgcctaccggctgctcggcatgacgctcgtcatgagcgtcctcggctcgatcctgaacgggttgaaggacaacctgcacatcctcctgctcggtccgctcgtaatcgccgggaagttgacctacggctcgctcacgattgccacgtcggccttttccgccgtgaactcggtcttcagcttcgtcgtcgacagcttcgtctccctcgcgaagttcaaggcggtggtcgaccgcctctcgaccttcgacgccgcactcgacgcggtccacggccgctcggacggcacccgcgtcgagaccggccccgagggggcgatccgcctgtcggacgtcgcgatcgacctgcccgacggctcgcccctctacggccggaccaacctggtcctgcgaccgggtgagaacgtgctgctcttcggtcgctccggaaccggcaagtcgacgctgtttcgcgtcctggcgggcgtctggccgcactggcgaggcacgatcgcgctgccgccgcagggcagcctcctcgtcctgccgcaaaaggtgtacctcccgtcgggcgacctcatgacggcggtgagttatccgcgcgtcgccgatgcctaccggccggacgacgtggcccgggccctggaagatgtcgggctcggcgccctcgtgcccaagctccatcacgatgtgaactgggcgcagaagctctcgggcggcgagcagcagcgtctcgcgatcgcccgcgccatcctggcacggccgcgctggctccttctcgacgaagcgacctcggccctcgacgccgccctcgaacggcaggtctacgaggcgctgcgccgtcgcctgccgacgacgacgcttctctcgatcggccatcgcgacagcctgctcgccttccatccgcggcggctgcgggccgagtcgacgggggaaggcgtcgtcctcaaggacatcacccccgccgaggagatggcgagccgcacggccggcgccacgatggcggaagcgcccgcctga

SEQ ID NO: 8297 - DNA, 165 bp, Methylobacterium sp.
gtgtcggctgcgagctacggccgcgacggcgatcgcaagatcagcgcttggctgaaggcggtcggctggcgggtcaacgacaagcgggtcgagcggatctggcggcgggaaggccggaaggtgccggccaagcgaaccgtcgtgcaaagaccgaccctgtactga

SEQ ID NO: 8298 - DNA, 705 bp, Methylobacterium sp.
atgcagagcttcacgagtggcgggcggcggatcgaggtggaatggttcgctgcctctggcagctttgcagaggccaacgggaagggaacatccaggccagccctacttctccttcatggtgccgacggcctgagctttgccgaaggctaccgccttgccgcacgtaccatcgcagcctcaggctaccacgtcgccttcgtgcactaccttgaccggaccggcggtcggcgtgtcgcttacacgcggctgcggcaggactttccgctctgggcagagaccgtgcgcgaggcagtcgcctggctggcagatcagcctggcaccgatgcgcagaggctcggcatcgttgggatctcgctcggtgcggcgttggccttcactacggcggcggccgagccgcgtgtgcgggcgatcgtcgactacttcggtccgctcccggacgagctcgcgcgtgagcgcccacgcctgcccccgacgctgatcctgcacggcagcgcagatgcgatcgtgccggtctctcatgcacgagcgctggagcggctacttcaggagcagggcgcggcgcacgaggtcaagatctacgagggccaaggtcacgggctcacgggaccggcacagctcgatgccgccgcccgcgtggcacgcttcctcggacagcacctccagcctgcttcagtggaaaacaacgaccgctctgcgtcggcctaa

SEQ ID NO: 8299 - DNA, 1224 bp, Methylobacterium sp.
atggtgtcgcggcgcaaccgcgccaacaccttcatcatcacggacagcggcggcttccaagttcagcagggcaccattgagtggtaccccgaaggccacccacgggacacggttgctacagtgttggattggcaggaggccaacgccgacttcgtgatggcgttggatttcccgacgggcggcatcagcagcggcaacatgctcaagcatatgcgagcactggagaccgagggcgtgcccctgcgccagtggagcaacggcagcggactgagccgggcctaccatgcctgcttggagcacacgatccgcaacacggaccgcatgctgaacctacggcagcagaagggaaccagcacgggctttctcagcgtgctgcaaggtcgcaacgaggaggagagccggcactggtacaaggccacgcgccatttcattcagcaaagtgatggcatcgcgttcgctggcacggggcgcagcgacttctccctcatgctggctcgcctcatggacatgaagcgcgacggcttgttgaagcgtctgcgtcacatccacgttctcggcacaggcacgctcatggccggcgtactgctcacctgcttgcagcggaacctacggcttcacaccgaagccaaggagatacagatcacctacgacacggctacgccgttccaggccgccaatcgctactacgaggcattcacccacttctaccgggacaagcaagccctccaaatcccaccgggcttgcaggtgggcgaggcagagccggacgaacacacgctgtcgctcaacgagtggtgctggcaccggacgcgcgcccttttcgaggctgatcgaccgcgagatgggttgcttcgcgcggagagcggcgtgggtgatagggccaaggtgtacgacattttctacaccaccaagcatggcccacaccgcaagctcaagcccacctggcccggtgcgcttctgctgaccctgcacaacgtagaggttacggtgcgggctcaaagggcggcgattgatgcctatctggccaacagaacagacatgttcccgctcaacgtgcggtctatcgcaggactgatcgaccacgctttcaatcccgaaagaggtgccggcctcctggctgcaagtagaggatacagcgaaaacagcgcgaagcgatacgcagcttcatttaacgttcagcgttatttggccaactacgcaggaacgctgcaggggcttctctga

SEQ ID NO: 8300 - DNA, 537 bp, Methylobacterium sp.
atgccactcctaacgggctcgctcgtccttacatacgttgcgtgcggcgtgctcgtgaacttattcgcacacttgctaccagtatatcacttgcacaatccgttcctaggcaatccctcagctaccttcccaatcatcccgggcacgctgctggtgggactgatcttcgtgctgcgcgattacacacagcaactgatcggtgaaagcgtgattgggtttacgctcttggcttcggccatcgtgtgcgtgctgatcgacggacgccttggcttgtacagcggagcggctttcctcgtaagcgaaggtatcgatcaacttatctggaagcgactgggcaaggaagacatcaaagatcgcatcctgtggtcctctgcagctgcaacatggctggatggtttgctcattctgcatggcctgaatgaacttacgtggcctaacttcatctctcattacatcggcaaaatggtcagtgtgttcgtgatctggctcgtgctgcgtcacaaccacaaaaagaaaatggcactagggagagtgtag

SEQ ID NO: 8301 - DNA, 255 bp, Methylobacterium sp.
atgtcggcagtaactatcgaggaggtgaaggcccatctccgcatcacggacaacggcaacgacgtgcttctcactcagaagctcgccgcggccgaggcgcacgtcgccgcctacatcggcgctccgctcgtggtggacggccaggtgccggccccgatccgtgaggccgtgttgcaggcaacggcgtggctgttcgacggcacgccggccgacctcagcctcctcctcatcccgtatcgcgagtgggcgttctga

SEQ ID NO: 8302 - DNA, 492 bp, Methylobacterium sp.
gtgcctcagtttgtcaagctccccgatcccgtccacgcgcagttgaaggcgctcgcagcagcgcgcggcaagaccatggtcgaggtgatcgccgacaccctgcgccaggccgtcgaggccggcgagatcggcgccgagacctccggtctctccatcgccctgttcctcgacctcgacgccgcggtcgaaacggaccaggggccgttcgcgatcatcaagacggaccagggcgacatgccgcctatggcccgcggcgacgccgaggctgtcgcgaagcaccttgcccttgaggatgactgtcgcgccgcccgctacaaccgcttcggttggtggagcaccgagcagcgcggcacgtccgttaagctcaccggcaccaaccgcgcggacgagaaggccgtcacgatcaccatggcgcccatcgtggcgaagggcctggccgcgcagttgcgcaaggtcgcccccgagctcatcgccgaggcgaacttcgaataa

SEQ ID NO: 8303 - DNA, 84 bp, Methylobacterium sp.
atgcggggtgatgatcaagaagcgcataaggcggtcggcaccgatctgcaaaagatccggttcggcaacgtgaccggctattag

SEQ ID NO: 8304 - DNA, 1896 bp, Methylobacterium sp.
atgtgcccgcccgcgactgctcatcgtcatcgcgaggagattatcgaagccatcaagcggacggactggcgcaccagcgatctgctcttccctgcgctccgtctatgggagcacatcggaacatgcgcgatcttcgtgtccgcgaaggaaatcgagatcacaccgccattcatcccgaccggtgtgtatgacttcctcggtaaaggtgtccgtcgcatctatctatcggcgacgatggaatacgaaacggacttcgtgaggggcttcggccggcgtgcaaagacgccgatcgttcccgacaacgatgcgggcaacggcgagcggcttatcctgttgggaagccgcttcgtggaaaggaccactaaggccgaagtcgcaacggagatcctcaaaagcaacaaactgctcatatcagtaccgtcctatccgaaggcagccgcttggaaggcgcatgggacgcccccaaggcgggagaagttcacggacgagcttcaggccttcagggccgccaaatctggggctttcatattggtgtcccggatcgacggtatcgatctaccgcaggatacttgtcgtgtcatgctgatcgacggcgcaccgtcagggtcgagcctgatggatcagtatctgttccatcatctttccctcagcaatctattctcgaccaagatggctggccggattactcagctattgggccgcatcaatcgcggccgaagcgattacagcgccttcatcatttacggatccgacatcaacaattggctcaaaacagaaagaaacgttgctctgctaccaccgctcatccgcaagcaggtcattctaagccaaaccgttcaagatggtctggagcaggccacccctgccgtcgtaagtaccctcatatctcaggttctatcgcgcgatgcaggctggttgaagttttaccgcgagacggtggacgggctggaggtatcggccgaggcattgaataaggtcaaagagcgcgaattgcagctcgcttcgtcggctgaagcggaatgcaagttcatgacgaggctttggcagggggaccgggaaggagcgcgaaccgcgctgctcgacgttctggacgacacggcgaaggctgatgcgaggttggccggctggtactcgctttggattgcgatgacctacgagatgcagggagatgccaccaccagcatcgcacattacaagaaggccaaggctcgcctatcgcactggctcaacgtgccgcacaagtccgagctggatagacggcttgaagccgaaggccagaccagcgttctgcaaaagaggctgtcggccgtgaaccttgatggtcctcaagcactcagcaacttgaccgccaagctcaaggtccatgccgggatcctcggaaatcgggccgcatcagcgcaagccaaggaagaagcgttgcgtgcctacggagagttgctcggcttctcggcgacgaggccggacaacgaggtcggccatggaccggatgtggtgtggcgggacgacgaagcgcgcacgctgatcgccttcgaactgaagacggagaagaacgagcctgccgagtacaacaaggctgaggtcggtcaggcccacaatcacgtgcaatggctcgcggacaacatgcccgagagctccgcaggcggattgctcatcgttggccctgcgggcacctgcaaagccgaggcaagcccctcagataccatttacctggtcgagacgaagcttctcgtcgagcgcctccttgcgttcgcagcgaaggtcgatgatgcccggggtagaacggacatcgatcggtgggcgctcctgagcgaactgggtctgcgggaggaatggcagcttccgggtctgttcaaagtccttgcaacgaccacgctcaggtcactgcggaaggcttga

SEQ ID NO: 8305 - DNA, 3813 bp, Methylobacterium sp.
atgttcaccgttcatcccgacgagatcaaggacttcaccggcgatcagctcgtcgccctgctacggcgcctgctatacgctgaagcccgcaaagctggcgttcccctgcggggtgtggatgtcccgctccagatcacggtggccgatggcgggcaggacggcagcatcatctgggaaggcggcaacgcctcgaccgactacctcccgagccgggacattatcttccagtgtaaggcgaaggataagggggacgcgcagtggaaacgtgaggtctggactaagcccactcagcgatccgatagcaaggttagggagctaaacgacgctgtcaaaggcgcactcgaccgtggtgccacctatatcgggatcaccgccaaggcacttgtcaaaccgaagccggccgaccgcgttgatgcaatccgcgaagggattaaggccgccggctgcaatcccgacaagctcgcaaagatcgaggtctatgagggcaatacgctcgccgcctgggccagctcgcatccagccgtcgctgtctgggtcaagcagatcaacgccaaaatcgacttggccgggttctctacgctcgaccactggggcaagcgtgcggatattgcgaagccggtattttttgaaagccctgaccgcaagttttcgctcgggccccatgaagctgatgcaatcaatttctcccagcttgccgatcgtcttgccgatgcactcgaccagcctcgcacttccgcgcgcctctggggctcctcgggtatcggcaagacccgagcgctctatcatgcgctcagcaccagcaccggtctgctaggcgagctgaccgctgccaatttcatcttctgcgattttcgagaggtaggcgacgacctatggaaggttgctaatcagatcgtaaaggagcgctcttgcgcggttctcgtcgtcgacggctgcccactcgccgaggcgcgccgtctcaatggcatcgctcgcgccgaggatagcgagctacgcgtcatcacggttggagctgacggcattgatcatgataatcactgtgtcatggtccggccgacgcaggccgatcacgcaaccatcctcggcatccttaaagcgggcctgcttgaggctaaggacgacgaagtcgaatacctcgccaacttctgcgacggctttccgcgcatcgccgtgctcgcgaccgagacttacaggcaaaaggatattctcaaatccgccgacgcagtcgcgcagcagatccttgaggcggctggagccgagcgtgagaccatccgtgcgctagagtgcctgtcacttttcaatagcctcttaccggatgagtccccagatgacttcgacaacatcgccgagacgctcgtccatatgaagggcgagttaatgtacgaaaatctcgtcatcgccgcaggccagcatcttgtcgaacgcaacagtggagcgatggctgcgcagccacggccgatagcagactttctggcgcttcgccgacttaattacctgcggccttcaaccttgattcgattcctcaaagacgcacaaccgcgccatcgcgaagcaatgctcgcccgctggcgcttcctcgcgcgatctcggacgctaagtgatatagtccaaagcttcctgcgtgatttcgatttcaatgcgaacatcgttcatcccgatgccgcgacctatctgccggccttcgtccatgtcgaacctgaccggatgggcttcgccctctaccaggcgatccgtcctataccactcgacgatgtcgccgccatcaccgtcaccgatcaattgctcgatgcactacgcctcctcgcgtcgcgtcaaaacagtttcgctcgctcggcggagatagtgctgcgcttagccgccgtggcaccgacggggggctcacctccagtcgtgagattgttgcgccagctctttcaggtcgcgcttgccggcacgcaggctaacgaccaccatcgccgcgcagcgctggagcatgcgctcgaagaggatgacccgcgcatccgtcgcgtcggtgtcgaagctctcagtgcgatgattcagactcagatctctcgctttgatgagttcgagcagattggcgctgacccctattccccggaatgggcaccgaacgacgtcgggacgatcaatacctatttcgattgggctctgcgtcggctcctcgatgtctggcggaaggatcctgcactccgtcatgtgattgaggagcgtatcgccggcgagatgcgcaatctccttggctctgagcttctgccgacccttaaaatttttatcgaagaagttgttgccgtttctggccactggtttggcgccacccatggcatcggcgactggctctatttcgaccggcccgaaaagccgacagaattctcggctgcggtccgcgacctgttcgatgcgacgctgcccaaggaccctgtcgatcaagtccgtcttcacagccgcttttggctttccgacctccaggatcccgacaagcgctttgcgcaggatcaggaaaatcctgactttgaatattcggcacggcgcattcaagcgcttgcgcccgagatcgcccgtgatcctcatcaactcgcgcgtgctatccgcacgatggcgagcgaggagttgaacacgcctcaagtcttcgcgcacgcgctagctcctgagctgcacgatccgctgggcacgttcgagcaggctgtcgccgcgctcgacgccagcggcacgcgcgtcggcgctaccttcgtcggcgcgcttctttcagcactcgatcgccggctcgcggatcaacccgatgaggttcgcgcgctcgaagccatagcaaagaaatccgaaatactagcgtccaacccaatgcacatcgtcacctcgcttcgggtcacagatgatcggttggacgcattcgcgaacaatgtccgcgaggggaagatcactcctgcgcaaagcgtctccatttcctacggccggggccttgaggaagtctcgccggcggcactctgtcgtttcgttggtgttctcgtcgatcacagtgatggcggatgggcggccctcgaaatcctcttgatggtaacccatgaccagaaggtgagcgccgacgagatcagcgatctcgtgaagcatgccatcctctcgccggcaattgctcgcggcgtcgaaggaaatgcctcaaagagtgactacatctatggccgcatgctacggctgctcgatacgactggtgccatcgataatgatttcgcccgccgcttcgccgagcaggtcgtgcaagcttgccgcacgaccggggcgcggcgcggcgttccctctgatgcgttgcgggacgccctgcccttcgttatgaagcatgcgccgaacgaagtttggcctatcctcgcgagcttttacgagatcgcaacctcagttgagcgtgagtttctaaacgggatcaccggggcgaccaagcgcttcgcctttgatgttgtgcgcaccggtcctgggacgctgttcgacactcggctggagctgatgctcgactgggtcgccaacgatccggaaggccgaatcgaattcctgctaaccttcttccccatccttgagcagaaggatggagcttgggcctggcaccctgcgctgcagacgctcgcaaggctttatggccgttcgaggcggttccgcaacgcgctacgccagcgcatctatcccagatcttggggcggctcgctcaactcgcatctggagagcttcaaggcgccgctcgcagcatggaccgacgatccggatctaggcgattgggcaagcaccatgctcgacaccgtggcacgctcgctggaagatgacttttatgggcgctga

SEQ ID NO: 8306 - DNA, 147 bp, Methylobacterium sp.
gtggaaagaccgatctcactgggccccggcgcctcccgcttcacgctcgcattgggctgcggcgaatccacgggctcctcatgcgtggtcggcgtcggacagtcctcgggcgccggcatggccggcatcggcgtcctgttcggctga

SEQ ID NO: 8307 - DNA, 633 bp, Methylobacterium sp.
atgcagacgcaggcgccgaaggaacaagtgcgtccgtgtgcaccgttcctaaagaaggaatcgccgaggttgatcccgtacgccgggagccctcgcaacatgcgccggaaagcgggtcttccctcggccccgaagaagcagccgcctcgccagcgccgtcagctgacggccgaactccgccagtggttcgcggcagagatcgccgtctggcccgacgacccgaagctcccgttgagctgggagaacgtcgtggcgaaggggtacgccacctattattggacttggagccggagtggcctcgcacgcattcccgagatcgcggccgccttcgccaagcgcacggcggagttgagcgccggacggaaccgaatgcccaggtatccggaacgagccgacgagaagcgcacccgcgcgaggctgcttgcaaccatcgctgacctgcaggccgagaacgagaagctcacgcgacgcctgcgggtctggcagaagagcgcccattcccggaacatcacggtcgagatgctcgacgaggcctgggacgagatagacagggggcagacggatctcgagttgcgtgcgaagaagggactcccgatgccccagcacgtgccgcgtcagccgacgaagaaatga

SEQ ID NO: 8308 - DNA, 204 bp, Methylobacterium sp.
gtgtcgaatcgcgacaaggaaacgcgcagcctcatagtccgactgcgcgatgatggctggatcgttgcccggaaggggccgggtgatcatgtccagtacaaacatcccgcgaagcccggccgggtgacgctggataccgggcgccgcgagcaggcgctggggacgctccgcagcatctaccggcaggcggggtgggactggtga

SEQ ID NO: 8309 - DNA, 1050 bp, Methylobacterium sp.
atgaagcgcaggaccattatcggcatcgccgccgccacgttcggcagcgccgcactcgcggcactcccggcggcatccctgctgccgcgggccgcggcggcggcgggcagcatcgtgttcacgagctggggcggcacgacgcaggaggcacagaaaaccgcctgggcccggccctataccaaggcgagcggcgtccgcgtgcagatggacggcccgaccgattacgggaagttcaaggcgatggtcgagagcggcaatgtcggctgggacgtcgtcgacgtcgagtacgacttcgctgcccaggccgcgcgcgacggccttctggagccgatcgacttctcgctggtcaagcgcgaggccctcgacccccgcttcgtgaccgatcacgcggtcggcagcttttactacgccttcgtcctcggctacggcaccaagcacgtcccggccgcgccgaagagctgggccgacctgttcgacaccaaggctttccccggcaagcgcaccttctacaagtggtcggcgccgggggcgctggaaatcgcgctgctcgccgacggcgtggcgccggacaagctctacccgctcgatctcgaccgggccttcgccaagctcgacagcatcaagtccgagatcatctggtggtcgggaggcgcgcagtcgcagcagcttctggcctccggtgaagtcgtgatgggtcagttctggaacgggcgcgtcgctgccttggaacaggaccggcagccggtcgggatcgcctgggagcagaacctcaccaccgccgacatgctggtggtgcccaagggcagccgcaaccggcaggccgcgatgacgttcatcgccgccgccacgggagccaaggagcaggccgacttcgccgccgccacgcgctacgccccgatcaatctcggctcggccaaactgatggatcctgccgtcgccgagacgctgccgaaccggcacgcggcgacgcagatcaacttgaacatggaatactgggccaagaaccgcgaggagatcggcaagcgctggtacgcgtggcagacgcggtga

SEQ ID NO: 8310 - DNA, 444 bp, Methylobacterium sp.
atgcggctggagaagaacggcaacatgacgggcctgctctccagaagcctcaaggcggcctacgatgccgtgccgagggacgaggacaatctggggccgaccattctcggcttcggatacgacgtgcccgacagggtcgtggaggtttccggcctgcgatacgaggatgcggccaacccggtgaaggcatccgccacggcgacgctgcactacacgaacgaggacgcgccggtgccgtcgttcaaccgcagcatcgtggtcgctttcgtcgaggaggacggctggtggaggatcgacgatgtccgtccgttcgatccgaagggacgccggacgggccgggagttcgggctgaagcgcgcgttcgagaggctggcggaggaacgcgtgcgctccgccgtcgagcgacctggcccggcaaccattcctcgatcggcgtcccgatga

SEQ ID NO: 8311 - DNA, 330 bp, Methylobacterium sp.
atgaagagcgcaaccttcctcgcagcgggcctctgtctgacgctcgcggcctgcagcgacgagccgccggaatcggcgatgagggaagccgtcacgaacgtgatgatggcctcctacaagatccacgtggccgggatggccctgatcggcagccgcccgccgccggagccgatgctcacggccttcaaatcccatggttgcaagcccgccataggagtgcccggccacgtctgccaaatgagcgtcgccatcaacggcgtcgacaggggcgtgagtacggggcgcttcttcaagcaggcggacggaaccctcgcgatcgcggatcggtga

SEQ ID NO: 8312 - DNA, 162 bp, Methylobacterium sp.
gtgctcgtggtgtcatacaaggggcgggctttggcgcctgaccaagccgcgatcgcacacgatgacgcgcccgctctgtccgacgtgacgttgagcgcatcgctctatctcgacaccgaagtcgatgacgcgctgatcctctcggagcagaccgaaatctga

SEQ ID NO: 8313 - DNA, 900 bp, Methylobacterium sp.
atgacccgcgttcttcctgccctctgcctgcacagcgggaactgtctcgacctgtttcgcgacgtgccggaccactccgtcgatctgatcgtctgcgatccgccgtacggcaccaccttcgccacctgggacaagctgcttccgttcgccgagctttggccggagatcgagcgcgttttgaagcccgccggggtgtgcctgatgttcgcttcgcaacccttcactacggatgtgattgcgtcgaatcggaagttctatcgaaacctctggtattggaagaaggatcgccccaccgggcattttctttcgaaccgtcaaccgatgcggatcatcgaagaggtactggtcttcggccgcaccccacgatccgcgacgtacaacgcccagacgacgaaacgggatcgcccgtacaagcattattatcggcgctccgccgggtcgatctataagcccagcccgtggaaccgcctgcccaatgggcgcgatcaccgcgtctatgacacggtgcaaccgcaccatctgctagagttcgcacgcgatccggtgcaactgatacccactcaaaagcccgtggcgctgctgcggtacttgatcgagacgtatacgaatgccggtggggtggtactcgacccaacgatggggagcggatcaaccggggtggcgtgcctggaaacggggcgcgagttcatcggcttcgaattgctcgaaaagcatttcgccatcgcgtcggatcggttgcggagcgcacaagcggcgctgcgccctgccccggtgttggacgaacttgaagaggaactgcgccgggtggtcaagcggaagcccgctcctacggcagaggaacttgacgacgaactgtggcggaccattcggcggagatcgggacggggtgccgtcgcctga

SEQ ID NO: 8314 - DNA, 99 bp, Methylobacterium sp.
gtgatcgtgccgatccctcgcgtcaccgccctgtcggcgctctgggtcggttcggcccaaacgacgagccattggccagcgccggccgcgatgctctga

SEQ ID NO: 8315 - DNA, 318 bp, Methylobacterium sp.
atgcgcgccggccgcctgaagcacgtcatcgacatcacgcgccgcgtcgagaccatcggcgagggcggtatcgcatcggataccttcacgccgattgcacgccttcgcgccgaaatcatcagtcgcgacgcccgcgccttcatcgccgaggccggggagcagaccgaggccgccgtcgtcttccgcgtccgcttccgaccggagatcgagccgggcgacttcgtgaccatggacgaacgcgagttcaccatctccgagctgaaggagatcgtcgcccggcgcgtgctggagcttcgttgcacgggggatcgggcatga

SEQ ID NO: 8316 - DNA, 279 bp, Methylobacterium sp.
atgaagatgacgacgctcgaagccttcaagattcacatgaacatcaccgacgacgcggatgacgcgatcctcgcgcagaagctcgacgtggcgagcgcctgggtcgggcgcatcgtcggcggcccgatcaccgcgaacgatccggctccgatccacgaggcgacccggatgctcgccgcgcatctctatgagagccgcgaggctacgcttgtcggcatcacggcgcaggagcttccgttcggcgtgatggacatgctcggcccctatcgggcgtggtag

SEQ ID NO: 8317 - DNA, 309 bp, Methylobacterium sp.
atgaccgatcgcgtaatctgcgagacctgcggcgaggacacctggagcgaacagcacccgtgctcgaactgcgaccgctgcccaccgacgtcgaattgggggacctcgttcccgttcgaccaggcgctgctgggcatgcgcctcagcaagcgcgtccggcggccgggctgggacaggacgtggagcatcgaggatgggaagctcaccgtccggtggcccgatccggctgggggcgaggacgcagtcgcgctggcctgcgagcttcacgaggacgacatcctcgccgactattgggaggtcgcgcagtga

SEQ ID NO: 8318 - DNA, 180 bp, Methylobacterium sp.
atggaacaggggcttggccttgcgctcctcacgcgtcacaacgcgttccgcgctatcacggagccgcgcgatggcagacgcgaagcgtacctcataaaaatcaaggcgttcctcgtaggcctgcccgtcggatgccagcagatctgtgaaacgatcgaggacgcaatttctcacgcgtag

SEQ ID NO: 8319 - DNA, 279 bp, Methylobacterium sp.
gtgggcgcaaacgagcccttggcacgcgggcccccgccgccgtgccgcaggagcctcgacttcgtctccgacacgctcgacgacgggcggcgcttccgcatcctcgtcgtggtcgacgactgcacgcgggagtgcctggcgctggtggtcgacacgtcgctgtccggccatcgcgttacacgtgaactcgaccggatcatcgccggccgcggcaagccactgatgatcgtctccgacaacggcaccgaactgacctcgcacgccatcctgcgctggtag

SEQ ID NO: 8320 - DNA, 1953 bp, Methylobacterium sp.
atgcgcttaaagcagatcgacccgagcagcgccgaaaaacgtatagcggtgctggaacggatgctgttgtcacgggaatgcgaccgccgctccgggctaatggcacgacagggtgaggcgtggttcacgctttcctctgccggacatgaggcggttgcggcgctggccgacgtgctcgaaccacgcgacttcgtgtttccccattaccgtgaccgcgctctggtgatgtcgcggggcatgagtgtcgaggacgtagcccgcgatcttatggcaaaggccagatcgcattctggcgggcgaggcatgacctcacatttcagccatcgccccggcaacgtgttctctattgccagccccaccgggagccattgcctacccgcagccggtgcggcctgggcgtcgctccgccggggcaccggcgcagtcgttctctgttcgctgggcgaggcgtcgactcggcagggcgagttcttcgaggccctctctttcactgtgcagatgtccctgccagttgttttcctagtgtccgacaacggatacgggatcagcacatccacgaagggcaagtctccccgtgacctgggaatgctgccgggcgagcggctgtcgacagtcgacggtgctgacccagacgcggtactggccgccggccgcacggcggtggagcggacgcgcggtggcgacggaccgacggtactctggtgcgaactcgaccggctagacccacacagctcgtccgacgatcaccgggcgtaccgctctgctgaagaacttcaggcgatgcgcgatccggtcgcgctattttccgaccgcctaatagacgaggctacgatcaccgctgaccagattgacgccatgcggacccggatcgccgaagaggtcgaacgaatcttctggcaggtcgcagccgagcacgtcgcagacgccacccatctgcacgatcatcttttcggtcccgaaaccgccctgccccacccggtcgcgccgtcgggaggcaccatcgtatccgcggtcaaccgcgcgctccgtgacgggctggcgcggcatcccgaaatgctaatcttcggcgaggatgttgaagaccccaagggcggggtcttcggtttcaccaaggggcttgggactgagcgcgtggtgaacgcgccgctcgcagaagctaccatcgtgggcacggcagtcggcttggcggcggccgggatgcgcccagtggtagaactgcaattcgttgacttcgctggaccggcctggaaccagattgccaaccagcttacgacgctgcgctggcgcagcatgtcagactggcgctgccccgtcgtcatgtacgccccctggggcgcttatctgccaggcggcggcatttggcacagccagagtaacgagagcctcttcgcccacctgcccggcctgcgcgtggctgtgccctcgacgcccgaggacaccgaggtcgttttcgcccgggcgttcgcgggcgaggacccaaccttggtgctgctgcccaagcacctgatgcgccagcgccagatggcggccgccgaaccggcactcgctgagggtgcgcgaaccattgtcactggctccgacgtgaccgtcgtgacgtggggcaacggcaccgcactcgctgcacaggccgcagcagagctcgctgaagaggggattggcgtcgatctgatcgacttacgctggctggtgccgtgggatcgcaacgcggtcgcacagtctgtccgccgcaccgggcgcctcgtcgtcgtgcaggaggacacgcggacaagcagcttcggcgccagccttctgagcaatatcaccgagtcggatgacgaattttacgcgcttctagcgccgcctcggctggtgtcgcgcgacgatgtccacgtcccattccaccccgagctcgagcgcgctgtcctgcccggcgcggacgacatcgctaacgccatacgctccgttcttccctga

SEQ ID NO: 8321 - DNA, 657 bp, Methylobacterium sp.
atggtcgacgctgtcttcctctccgcgggcgtccctgatcccaggcgggggccacaatacgcggcgaccgccgacacggtggcgatcaccgcggccgtgtcggccctcgtccacgtgacgctcggccgccgcctcctcgtctggggcggtcacccggcgatcacgccgatggtctggacgatcgcgcaggacgtcggcgtcgactacgggcgctgggtccgcctgtaccaatcgcggcatttcgcagacgagttccctgaggacaaccagcggttccaaaacgtcaccttcacggatgacgtccccggcgaccgcgagcaaagcctcctagtgatgcgcgagcgcatgttctcggaccacggcttccaagccgccgtgttcatcggcgggatgggcggcatcacgcaggagtacgagatgttccgccgcctacaaccaaacgccgtggtcgtcccggtcgtgtccacaggcggcgcaacgctcgacgtggcggcgcgggccgggctgctcgaccccgacctagccgacgacctagactacgtagcgctcctgcaccgtcacctcgccgtgtccgtgcgggaggagcggttcaaggacccggacgaccagccggcgtcgatcccggatcgattctggcggccaggcaagaaggcctga

SEQ ID NO: 8322 - DNA, 1161 bp, Methylobacterium sp.
atgagcctgtacgagcttgcgatcctagggtgtgcgacgccagacgagaggacgaccttaaccgcgacgctgcgcggcatgatcgaagacttcggcctcgcagtcggcactgacgtgcgcgttctcgacagctcgaacgtcgcgggccgcgacaagcgtgcggcgttcgccgcggcctacttcgctggcgacgatcacgctgacgtggaggctgcgcgcgcgctgtttcggtccagcgcgccggtaatccccacggtagggccggccggcgacttcgcccgacatatccccgatttcctgcaatccgcgaacgggttgcggcgtcgtggtgacgacggcgcgctcgttgagctggcgtcggcgctgctcgaatgcgtggggcttctacggaaacagcgccgggtgttcgttagctaccgccgcactgaatcccgcgcggcggctctgcagctgcacgacctcctcactgcccgcggattcgatgtgttcttggacacgcacgacattcgccccggggacccgttccaggacgtcctgtggcagcgcctggtcgacgccgacgttatggtgatgctcgacacgccgacctacttcgagagccgctggacgcggcaagagatcggccgcgcccgcgccaaggacatccacgtgctgcgggtcatatggcccgagcacgtccccagcaggctcaccgacttggccgagaccgtctatctcgaaccggctgagctcgagggctcggacgggccggtaacgcgcgcggtcgcagacgccatcgtggtccgcgtcgagcggttgcgcagccgggccatcgcggcccggtacatggcgatcaccggcaagctgcgggccgacgtagaaaagttcggcgggtcggtggagggcatcggggctcatcgtgccgtcgccatacggcttctcgacgaccggaagatctgggcctacccggtcgttggcgtacctaacgccgagatcctcaacgacatcgccgagaaggcccgccgcgccgaccagggcgagaccccggtgctggtctatgaccacgtcggcatccgcgacgcctggaacgcgcacctggtctggttgggcgagcacatccgggccgtgcgttccatcaaagtcgcggaggccggttgggcgctcgccgcatgggagggatga

SEQ ID NO: 8323 - DNA, 600 bp, Methylobacterium sp.
atggatgtctgcttcgacatcgtgaacacgctgccggggatgaccaactacgtcttctcggacacccgctgcaacgcagcggagcaagcctacaacctctccggctatatggaggggctctactgtgggcgttgcatcaacgttgcggtgcgctttgggtggttcctgcggcccagccagcagaccccgcccatcaatatcttcagcagccagactgacttcttcaacgctgcggtcgatatcacagacatcacgcagggcgcctattacggcaacctgttctaccaccgcgccgacgcgaccacgaacggggtctgctaccagatcacctgcgtgaagaagagccagatcctcggcggcgagtgcgtgaactacgccgacacgactagcctcgtgggcgtcgcgtggtcggcagcgagcgacaacatcgtgggggacatgatcctctcgaaggtggataccggggtcacgaacctcgggggctccaccggcaacgtctaccggcgcggccgatggatcaacgtgaagcagggggccagggattacggcaacgggggcgacagctccaacgtctgcatcggctacaacgcggcctgctga

SEQ ID NO: 8324 - DNA, 147 bp, Methylobacterium sp.
ttggaccgcgtgctcattcagggcaagcgacagagcctcctcgcccgttgcgtcgattacaagatcatagcggtcccaggacagcttctgcgtgagcacattgccagcatagctctctatggccaggggagggagctgctcgagtag

SEQ ID NO: 8325 - DNA, 381 bp, Methylobacterium sp.
ttgctccagtcgcccgagttgatcgcggcggccagcgtcaccgccgggttgatgtgggcgtcgccgctgcccgtggcggtggccacgaagatcgcgccgagcaccgcgaaggcccacccggcggtgatcgcgacccagccgctcccctccgccttcgatccccggagcagcgtgccggccacgacgccgttgcccatgatgatcaggaccatcgtcccgagaagttcacccagaaatggcgatgtcatgctgtcctccccccattcgatcgttgtttcgcgtcgtcccagccgcgtccgttcccgcttccccccgggcgtaggagaggcgcaggccggcgcgttcgccgggaggcttgtcccccggcgtccgtgtcaatga

SEQ ID NO: 8326 - DNA, 252 bp, Methylobacterium sp.
atggcctccgggaaaaccggggcggttcagctggcgccgtgccctgcgggctggagcgcctgcaccggagatgtcgtccccctgggcttcatcccgctggcgctgccggcaccgccctcccctgtccgggccgagccgctccgccccagtgccatcgagatcgagatggccggcggtcatcggctgcgggccgaggcgggcgtggaggtcgttctcctgcagggtctgatcgcaacgctgctgggccgatga

SEQ ID NO: 8327 - DNA, 216 bp, Methylobacterium sp.
gccaccgtcatcaccatcgacatcgtgcgcaaaccgaaggatcaggtcggcttcgccgtgcatccacgccgatgggtggtggaacgcttcttcggatggatcagccgcaaccgacgcctctggaaggacccggaagcgaccctcgcctcggcccaggccttcctctacgccgccgccgtcatgatcctcgtccgaaggctcgggcgagcatcatga

SEQ ID NO: 8328 - DNA, 216 bp, Methylobacterium sp.
ttgaggagttcgtcccgcagcgacctccgtcacctcaatggaccggatcgcttcagcgaccttgcggccttgcgagaccaaaacatcgacctggcgcagcttggcgacgatctcctcagccgtatgctccttccggcgcatcaaaacgtcctccacatggctcaaagccataccttagggaggcccgcttctcagggggaagaccagaagacgtaa

SEQ ID NO: 8329 - DNA, 222 bp, Methylobacterium sp.
atgtgcggtttgcccttcgccgtatcgctcgccctgacgctgccgctccagcccgcgcccgcgccgctctgcccgcgtgcggacacggcggtgatggccgccctcgtcggcgacgtgcggcgggagccggccgcgaccgatcccgccttcgaggccgccatccgggcgatccgggctccccagccgcagaaggccgccccccggcggaagcaccgccgatga

SEQ ID NO: 8330 - DNA, 129 bp, Methylobacterium sp.
ttgttggataccgcggccccgatctacgagatggagatctattacaacgagttgctgaccttgatttggagcaattcaccgaaactcgttcacttcagtaagattatcaaagggtatatttatatttaa

SEQ ID NO: 8331 - DNA, 156 bp, Methylobacterium sp.
atggcgcgccaagccgctacgaagtctgccggtgggatatgggcgagggtatccgaggccggagacctcgcatcattcggcattcagtggctcctgatcggcgcacagataaaggctccgatcaggtttgagttcgatggcctagccgcggggtga

SEQ ID NO: 8332 - DNA, 702 bp, Methylobacterium sp.
gtggtcctggaccggcccgagcgccgcaacaccatcaccgacgccctccttgccgatcttcacggggcggtgaccgaggctgagaccgcatccgactgccagacgctggtgatctcagccatgggcgcggatttttgcgccggcatggacctcgaggcctcccacgccgctgtcggcgaggtggacctgcgatattgggcaatcctgcgccaactcgccaccaccgacttggtgactgtcgcgatggttgacggcgctgcgaccgccggaggcgtgggtctggcggcggcctgcgatatcgttctggccggcgcgcaggcccggttccggctgaccgaggtgttcttcggtctcatcccggcgatggcgctgccctttgtcgcgcggcggataggcgagcagcgggcattcaccgcgacgctgttggcgcagacgctggacgcccgtgctgcggccgatatcgggctcgccgaccgcgtcggccctaccgccgaagaggcgctgcgcccgctcctcgttgacctgcgccgggtgcgcccaggcaccgtcgcggcactcaaggcctaccgcgcgcaactgttcccctggcgcgctgatctgggcgacgtggcggggcgtgcctttctcgatcgcttctccgaacccggtgtgcggcaggcgatgtcggacctgaagaccgcactggtggggtcttcggcatga

SEQ ID NO: 8333 - DNA, 402 bp, Methylobacterium sp.
atgaaggtggtgatcgacgagggcgtgccccggcacctggcgagcgccctgatcgaacaagggatcgatgcttcccggttcccgcgtaagtggatatcgctgagcaacggcgtcctcatccgcgcgtgcgaggccgaggggtacgatgtgctcgtcaccaacgacaagaacatcgcggatcaacagagcttgcaggggaagcgcctcgccgtcgtggctctgccgcacaatcggcgccgcgccatcatcgaaaggatcgaggatattgcggacaccctgcgacgcgccaatcccggcgagcacatcgtgatcgaaatcgacggtacccggacgatccggaggatcgtcgatgggtctgttgtcgaggagcggcttcccgccgtggcgacctttcggttctga

SEQ ID NO: 8334 - DNA, 225 bp, Methylobacterium sp.
atgaactttaccgtcgagtttttccggatcaggccgggtgatgccgctcatgccatcttggatcgcgttccgcaggaggttccgacgttggaggatgccaaggtcagggcgcagtctctgtttgagaccttggacatgccccaggcgcccgatggcctgcggatcctcgacgggtccggagccgaggtcttctcctggaagccggtgacggctgtcgacaggtga

SEQ ID NO: 8335 - DNA, 282 bp, Methylobacterium sp.
atgctgatccccgccggccgccacctggaggcgtcgttcgtcggcaatgccgactacgaactgcccgacctggaactgctcgccgagccgccgctgaacgacggcgaggaggtcgacgcggacgagttggagcagaacgcgctcaacctccagcaaaccgtgcaggatttcggcgtgcgcggtgacatcctcgccgtgcgccccggccccgtcgtcaccctctacgaactggagccggcgcccggcaccaagtcgagccgcgtcatcggcctgtcggacgac

SEQ ID NO: 8336 - DNA, 555 bp, Methylobacterium sp.
atgacccgcgcactcatcgaggccgcgttcgaggaccgggatcgcatggccgccggctgggagcccaacggctacgtctgggccgacgccccgatcctgaaccggtgggcgtacggcgtgcacccgttgagcggcacgatggccctcgtgggattcctgaacggtcacccccggacctgctcacccgtcgtggcgatgctcaccggccccggcggaatcggctggtgccggacgctcaccggctggctcaggctcgccctcacgagcgacgagctccaccgcgagggccgccacctgctgccggcgcacgcccgggagctggagctcgccgcgcacgatgccggctaccgcgccccgcggcggtccctccgccccgacggcccgatcggctcggacccccgctggcatgaggcggccgatcacatcgataagacggccaaagatcccgagctcgccttcgcggtgttctatgcccggcagcgccgcgtgcccctggccgaggcccgccgggcgatggaggtgttctggctgagccgcacgatgaccttcgactga

SEQ ID NO: 8337 - DNA, 357 bp, Methylobacterium sp.
atgctgacgaccggttccggacgggcggaggaagtgcggttcttcgatttcccgcgcggccccctcgccacggttctgacccggatcgctctgcaaggccggcgctcgatcgtgttcccggccgacctggcgcgcggacgcatggtcggcccgatccgcagctacgagaccgtcgaggccgccctggcgcgtgccctcgcgggtaccgatctgcagatcgccaagggggcaggcggctccctgaccgtacgccgcatcgcggcgcgctcggccgcggcaggaaccgacgatctgacgtccgccgcggcgcccgacccatcgggggccgccaagcacccgacgggggcccggccgtga

SEQ ID NO: 8338 - DNA, 105 bp, Methylobacterium sp.
atgacccggcccattcaggcccccgcggacgaagcgtcccgctatgtcgggagcgacatccaatccggcgccctggcggccgacctgcaccgggtcgtggcctga

SEQ ID NO: 8339 - DNA, 198 bp, Methylobacterium sp.
atgagagcagtggtgttccatcggttagtaatctccgccgtgctcggcaccatggcgtgtgccacctcaacagccgcacagggaagcagcgggacgaaaacggtcatcatcctgtgccattacgtcaggtttgcgggccggatggggctgaacatcgccccgtccttcgtggcgcgagtggatgagctcgccgtttaa

SEQ ID NO: 8340 - DNA, 1692 bp, Methylobacterium sp.
atgtcattctcgaactcacgccgcattctgatcaccagcgcgcttccctacgtcaacggcgtcaagcatctgggcaatctcgccgggtcgctccttcctgccgacgtgcacgcccgcttccaccgccagatcggcagcgaggtgctgttcgtctgcgccaccgacgagcacggcaccccgaccgagatcgcggccgcccgggcagggctcaatccgcgcgccttctgcgatgcccagcacgcccggcaggccgaagtctatcgtaacttcgggctgagcttcgaccacttcggccgctcgtcctcgcccgccaatcacgccctgacccagcacttctatcgccgcctcgacgcggccgggctaatcgacgagcggctcgtgccgcaggtgtggtcgcctgcggacgggcgctaccttcccgaccgttacgtgctcggaacctgcccgcattgcggcgacgatggcgcgcggggcgaccagtgcgatgcctgcggcaacctgctcgatcccgtcgacctgatcgcgccgcgctcggcgctgtcgggcgatgcgcggctggagttgcgcgagagccgccatctcttcctgcggcaagcggcgctccgggatcgtttgagcgactggctcgatacgcgttcgggctggccgcccttcgtcgcctccctcgcccgaagttggctgaccgccgatctcaaggaccgctgcatcacccgcgacctcgcctggggcgtgccggtgccgcgaccggacttcgagggcaaggtattctacgtctggttcgacgcgcccatagcctacatcgccgccactcaggactgggcttccgccggaccggaccgcaactggcgggcatggtggtggggcgaggcggcgcgcgagacggcctacgtgcagtttctgggcaaggacaacgtccccttccacacggtcggcttcccggcgaccctgatcggctcgggcgagccctggcgcacggtggacgtgatcaagggctttcactggctgacccacgagggtggcaagttctcgacgagccgggggcggggcgtgttcctcgacgcggcgctcgaggcgctgcccgccgacctttggcgctggtggctgatcgcgaacgcgcccgagcgcgcggacgtggacttccaggcagcgcgcttcgcggcggaggtgaacaaggacctggccgacgtcttcggcaacctcgtgcagcgcgtgacccgcttcgcgcggacggccttcgaaggacgcgtccctgagggcggcgagccgggtaaagccgagcgtgtcttggcagcggaggtgaaggaccgggtcgccgccatccgtgcgcatcacgaggcgcgggagttccggcgggcggcggcggagacgcggggattgtgggcgcgggcgaactcctacgtccaggagaccgcgccttggtcgaccctgagggcggatcgggctcgggcggctctggcaacacgtgtcgccctggccctcgtcgaagtgggcgcgaccgtggcatggagcatcgttccgaaccttgcggcgaacgtcctccgcgcgacgggcgccccagccagctcaggcacgccggcttggcctcacgatctggagggtttgatccttggcgggcggcggtccggttcgcacctgtcgcatacctttgagccggtcgtgaagctcggtgctgggcacttcgatttcacgtaa

SEQ ID NO: 8341 - DNA, 192 bp, Methylobacterium sp.
gtgaccagtgtcggcatcttcgacgataagccgcatcgcggcgagatggcgaaaggtggcttccactcgaaggaagcgtccttgcttgcgattccgggcctgcaggcggaagggaagctgccgacctcggatcaggtccgggcggaggagggcgtgggctgcgcgcagagctggccggaaagcgttggctga

SEQ ID NO: 8342 - DNA, 246 bp, Methylobacterium sp.
atgccccgtcctgaacccgcgcccggtccgctcccctccgaagcggatcaagggcgcagagtcttcggcgcactccaaccgacttcaccgctttgccggtatctcggcaccacggcctgcgcgaacatctacaaggcctgcatcgacttcatcgagcgcttcggcgctgaggccgtgggcttaggctggatcatgccgctgaactacggcgtccatcctgagtataggtcgttgcgcgtggattga

SEQ ID NO: 8343 - DNA, 339 bp, Methylobacterium sp.
atgagcgaaaccgaacccgtcgagtcagcgcatcggaccgtcgccggcgtcgagctggtgacgatcccgctcaaccactacgccgagctgctggattgccagcggaggcttgttgaagtctctgcaagcgcgccagtcccgccaaggcgaccgctcacggtcgatactcggagccgtctgtttgatgatcccgaggtggctgcgtttctgatcgagattgcaggaaccatgcgtctcacagacgcgcgcagcgcctgcgttgaccggttcggggcggagcgcgccccgagccggtcaacgatcaatcgcttttggcagcagcaccggaaccgcagatga

SEQ ID NO: 8344 - DNA, 384 bp, Methylobacterium sp.
atgaccgtcgaacgtttgaccaccgccaccggtgatatgccgacgctaaccttcgagcccggccacgccttgcccatcttcgcactccgggagggcgtacctgtggtggtcatctcggccgctgagtaccgtgacctccgagcccttcgcgcgcagcaggcccggggcgatatcagcgcggctttgcgagccgtcagggcggcgccgccgggcctgtccacggtagaggaggacgccgaggtagccgacttcctccgcaaccgcttccggaggcggatgtcgctgcaagctctccgcgcggcatgcgtcgagcggttcggagtggagcgggctccttctgtcggccgcatccagaccttccgttcgcgctggcggtcctactga

SEQ ID NO: 8345 - DNA, 183 bp, Methylobacterium sp.
atgggggtgatgggtgcggttgagacgggcggcgtcgaggccgcggccctgatcgggtccatggctgcattccttcggtttcggcgcgaggccggacctcaggagattgcgcgcgtcgctaccggagtcttaagggccgccggttgtcccccgggaacggccgccagcctcaccgatccgtaa

SEQ ID NO: 8346 - DNA, 1014 bp, Methylobacterium sp.
gtgagctccctcaccgaggctcagaagcgaaagatccacctaccttatgtccgagccgcgacgaactgcatctctcaatccttgctgatgaatcctgatgcagttcgtcttgctaggcaggggcagtggggcgacgcgtttcgagcagcgccaaaggggcagtgcgctactgaaatcagcaccctcatcagcacgcacgatcagctctatggcgccggaaccgggcaaacatttttctccggcccctatatcagcgacctgccgcgtgcgctcggcagtcggctgaaaggcgagttcgagcggctcgccgccgccgaagcccgcgaaatcgcagcgagacagcaggaggttgcaaggcaagaagctgcgaagcgtgcccgtatcgaggaggcggaccgcgttgtgactctctaccgggacaagatgtacgaatgcacgacgaaccaaatcgtcaagctcgcggcatcatcggaaggtgccgaggtgcttgccacggctgctatgaccatctgcgacgatgagatcgcaaacgcggtccgggcagggacagcaaaacttcggctccagttccctgatgcggaaaccgcacctctgcgagcggatttcgaagcggtcatcaaaaagaacgtcgtaacgaccgcggttcaggcaaaggcagcgctgaacacttcgagacagcaggtcgcaagcgagccaacccctgcgccggtgacgccggtcgtcgcggccccaccgcaagtcgctaccgcatccgatcccgcaaactccggccctgcacttgtagcaagcccagtccgagaatgcctccgcacaatggctaaggcgcgggagggtaagttcgtgaaccgcgaggatctcgtgaaggccatgctcgatctctgccggccagagatcgaaggagctgcccggtccgccttcctcaaggacgacaaagcgtccttagagcagacgcgggacaagatgctgcaggaggctttgcgggaggcgcgcgaagtcgttgggtcgacgaactaa

SEQ ID NO: 8347 - DNA, 195 bp, Methylobacterium sp.
atgtctttcccacacctcgagcagcacaggaacgggaagtattacatccattggacggtcggacgccggagcatgcgtgaatcgaccaggacggacgaacagcggactgctctgatcgccttcgcgcactggatccttagccgctattcagacggtgacggcaccggcgacgcagtccgcaggcgagcgcggtga

SEQ ID NO: 8348 - DNA, 318 bp, Methylobacterium sp.
gtggagaagcttttcaccgaggccgaggtcgccgagcgcctgaactgctccgttgcccgaatccggaagctgcgcgcggcgggccggctggccttcctccccgggcgcccggtcctgatcaccgagcgcgactacaacgccttcgtggaaagcgagcggcagcacctcaagacgctgaccggcaagcgccgcaagcgtgccaagaagttcctgccaccggaagatccgccgccgaaaggcggcatgacgccggagcagcgcggccactggatcgcgatcaagatgcagatcctccgcgaggagaaggccaagcgctga

SEQ ID NO: 8349 - DNA, 591 bp, Methylobacterium sp.
gtggccgtgtcgtcgatccgcaagctcgtcgcttatcaagagaccaccttcatcgagggcggccggactgccccgcagccgctcaagttgttcggcgtcgccgccgtcctgaaaaacccgtgggcagggcggggctttgtcgaggatctgaggcccgagattcgcagcaccgcgccggagctcggggctctgctgacagccgaaatcctccgcgccgtcggctccggcgaggcggtcgagggctacggcaaggccgctgtcgtcggcaccgacggcgagatcgagcacgcctcggcgctgatccacacgctgcgtttcggcaatcattaccgccaggcggtcggggccaagagctacctgagcttcaccaacacgcgcggggggccggattgcccgatcgtgattccgctgatgcacaagcacgacgagggcatgcgctcgcattacctgaccgtgcagttctcgattctcgacgcgccggctcccaacgagatcgtggttgcgctcggcgcctcggtcggcggtcgtccgcaccaccgcatcggcgaccgttaccaggatctgcgcgagatcgaggccggcgatgcttga

SEQ ID NO: 8350 - DNA, 915 bp, Methylobacterium sp.
gtggcagacgcggtgatgggcgcgcgcgaacggagccgcgccatgaccgcggcacggttgcaggccctgccgttgcaggatgcccctcccccctggagccggcgcctgcgcggcttcggagcagtgctccccgctctcgtgttcctcgtccttctgttcgtggttccggtgctggcgctgctcctgcgcagcatcaccgagccggcgctgggactgggcaactacgccaccttcttcgccggcacgacctacctcaaggtgctgggcaacaccttcctcgtcgccagcctcgtcaccggcgcgaccctggtcatcggattcccgacggcgtggttcctcgccatcgcgccgcgccggctggccgggctcctcaccggcatcgtcgtcctgtcgatgtggaccaacctgctggcccggacctatgcgtggatggtgctgctgcaggggacgggcctgatcaaccgagccctgctggaactcgggctgatcgcggcgccactcacgctcaccaacaacctcgtcggcgtcaccctcggcatgacctacatcatgctgcctttcatggtgctgccgctggcctcggccatgcgggcgatcgatccgagcgtgctccaggccgcctcgctctgcggcgccagccgatggcagtgcctgacccgcatcctgctgccgatgctctccggggccatcgcctccggtgcgctgatgatcttcgtgatgtcgctcggctacttcgtgacgcccgcgcttctgggcggcaccgccaacatgatgctgcccgaactgatcgcgcagctcgtgcagtcgctgctcgactggggactggccagcacggccgcgacgatcctgctggttctgaccctgcttctctacgcgctccaagtccggttcttcggaacccgcagtacggcctga

SEQ ID NO: 8351 - DNA, 525 bp, Methylobacterium sp.
atggtcgttgcacctgtccaggccggccgctttacagcgcaggtcagagagcagctcacgccgctggtaaaggccgcctttcgcgaaatcatccgggactctgttcaatcccgcctttcgaatgcacttgccgatacggctgcccttgatattgccgaagcacagcccgctgtagaagatgccgaaatcgtcaccaccgatgaagagcgcgagggcttcatgatcgttcgcgccatcgtgcgggaggtcatcaaagccgatcgtgtgattatgcgcgatcaaagaagctattgcggcattctaattgacaacaacaatcgcaagccgctcgcccggcttcatttcaatcgtacgattaaatatatcggccttttcgatggagataaggaagagcgggtacgcatcgacagtctggaccacatctatgaactgacggatcgacttcgtgcgacggcacggttctatgctgagggcggggcacgtaaagctgaggcagtcagttccgaaacagtgcctgctgcttga

SEQ ID NO: 8352 - DNA, 318 bp, Methylobacterium sp.
gtgtttcccctgctggccgcgctcggcttggctctcggcgcctgcagcgacgagccgtccgaagcggcgatggtgcaggccatgaacgacttcatgttccgcatgtccaggcaggaggccgccctcatgaaggcatcgggtcggcaacccaagccgatgcccgtgatcgaggattttcgaaaggtcggctgcgcctcggctcaccccgaggccggataccgctgcgagttcgaggcgacggtcgacggaagccgcggcggcaaggccaacgcccgcttcttcaaggcggccgacggcaccctcacgatggtcgagtga

SEQ ID NO: 8353 - DNA, 102 bp, Methylobacterium sp.
gtgcgtttcggcattgagcgccttgaagcgagttcgcgcgcgctcgccctcgcgcaccgccatttcgaaggcggcgccaagggggcgcaggcgctgggatga

SEQ ID NO: 8354 - DNA, 993 bp, Methylobacterium sp.
atgtcgacccgcatcctgctcggcgattgccgcgacacactgcgttcgctccccgccgattccgtgcactgcgtcgtcacctcgcccccgtatttcgggctgcgcgactacggcgtcgacggccagatcggcctggagcccacccccgccgaattcgtcgccgccatggtcgaggtgttccgcgaggtccggcgcgtcctgcgcccggacgggaccctgtggctcaatctcggggacagctattgcaacgacgacaagtggggcggccgcggcggcggctacaacgggcgaggcggcctcgaccgcgagcgcatcgccctcgtcccccggcaccgacgcgcccgaagcggcctgaagcccaaggaccgcatgatgatcccggcgcgtaccgcgatcgcgctgcaggacgacggctggtggctccgcgacgagatcgtctggcacaagccgtgcccgatgccgtcgagcgtgaaggaccggaccaccccggcccatgagatgctctacctgctgacgaagagcgcccggtaccgctacgaccacgccgcgatccgcgaggaggcggcctggggctacaaaaccagcccgaaccaggtcccaatggaggggcggagcgtcgcctcaaccggcatctggcgaggagccggcaccggcgaggtcgacgtcgcccgcggccgagacgagaccggttcgagctacgacaggtcctcggggcggcagaagcggtcagtttggaccgtggcaccgaccccgttcaaggaggcccacttcgcgacgttcccgccggccctcgtcgagccctgcatcctcgccgggtgcccggagggcggcacggtcctggatcccttcggcggggccgggacgacggcgctcgtcgcggagcgcctgcagcgcaacgccatcctgtgcgagctgaaccccgaggacgcccgcatcgcgacccggcggctgcaggccgacgggggcctgttcgcccaggtcgcggccgagtag

SEQ ID NO: 8355 - DNA, 243 bp, Methylobacterium sp.
gtgacgatcgagcccaccgagttcgacctcatctcgctcgcccgccggggcctgcaggcgctcctcgacgaggcgatcgccgagcgccagttcgcccgcaagttcgccacggtcgatgtcagcacgaggcggtacacgcccgagtcgaaggaggcgacatcgagggccctcgacgccttcggggtcgcccatgaccgcctgacccgcttcaacctcctttaccctgagcgggccgaggcatga

SEQ ID NO: 8356 - DNA, 141 bp, Methylobacterium sp.
atgcagcgcatcggcgagacttatttcgccccgaacaaggacctctccgacttcgcggacatccaccatgccagcggcctcgacccgctttgcgcgttttcgacggtctgccgcagggaactcgcaatcgcccggcgttga

SEQ ID NO: 8357 - DNA, 777 bp, Methylobacterium sp.
atgctgcgcgaggtcaccccctcggcgtcggacgatgccgcacgccttgatgccaccaagaccgcttacgcctcggagccaggctggctgctgcccccactgacggagatcctccccccctccccagccgtctgcgccatcaaccttcatcggcacacctggcaagcactccaagctagcagtgcattcctcgatgccaccggacagaccgaacgcaagcggctgatgtggccggcggaggacgccgagggcgaagcagaggatgacctgatgatggtggcgtgccagggtctagaggacgctgccgccatgctcgcgcaccttcgctggtatctcggcgttcgcccagagcatccgacgcggccaagactctgccccgccaccgctgcgcttatggctgcccgggtggcggacctcgcgttcatgctcggagaagccggccggcaagctggcggcggggacctcacggccaccctcgcagaacatcgacgggcctgggctgcctacctcgagacgcctgaccccgaggagaccggatgggacgtgcatcacgctctgaccggagcggtggatggggcggtcttgtcggtgctggcaatgccctgcgccaacctcgcggacggggcggccctggcggcgcacgctcaatggtactcggcggagctggaggcggctggagaggatctggcggacggcttctcctacgaggtccagcacctaagggcccgtgcgggcgactggacgatgttcctcggagcgggcagtcggacggcttga

SEQ ID NO: 8358 - DNA, 447 bp, Methylobacterium sp.
gtgagcactcatgtccgggaagcagcggcgtccgacgcgataaccgtccttgggctagttcgggcgcatgccgggttcgagcacggggaggcctccctgtcgctcgacgaccttaaggcgatcctgtcggcggactatccgccgacacacttgctcgtggccgagggggatactgcgctcgtcggttacgcagcggtcacgttcgacttctcgctctggcgagggcgcacatacggccacctcgattgtttgttcgtcgccgcgagtgtgcgcgggcggggcataggcaagcaacttttcgacgcggcagtgcggcttgcacaggccgagggcgtcgatcgcctcgaatggcagacgccggtctggaacagcgatgccatccgtttctatatcaggactggggcgctcggaatgaggaaacaacggttcacaatatcgctctggtga

SEQ ID NO: 8359 - DNA, 483 bp, Methylobacterium sp.
ttggtggcgaagaaatgcttccttagctttcactataagcccgacaactggcgggtgcagcaagtccgcaacatcggctcaattgaggaacagccgctgctcgacgccaacaagtgggaggagatcaagaagaagggtgatcaagccataaaggattggatcgaatccaacctaaagggtaaagaatgccttgtggttttggttggcgaaaagactgcagataggccctgggtcaagtatgaaatcaaggaagcctggaagaaaggcctcggcgttacagccgtgtatatccacggcctcaaaaactccgatggtgtgcagggcacgaaggggagagatccctttgtaggacttagcgtgagcggcgaaacgattgtcggcactacacacgatacgccttactcctccagcacgtacgtttatgaccacattaaggaaaatatagagacttgggtctcggatgcaattaaggcgcgcaagtaa

SEQ ID NO: 8360 - DNA, 477 bp, Methylobacterium sp.
ttgagcggaccggacgctctgaagcagctgatccgggatggtgtgcacaacacgtctgtggtttgcgtgctggccggagcggagacctacgcgaggcggtgggttcgctatgagatcgcgcggagcgtgatcgatagtaaaggccttctgaccgttcacatcaactccattccgaatcatcagcctccgcgccaaccacatcccttgggtccaaatcccacagcgttcatgggtgtcgctcagcgtgacgacggcacttaccgcctctgcgagcggaactacgttgacggcgcgtggaagtgggtgtggtactccgattacgtgagcggtgtaccgataccgatgtacatcggcgcctcagttcgaaagggcgtcattccgctgtccgcctggacgagcgagtacgactggaagcagggcggttacaacagcatcggtagctggattgaccgcgccgcgcgtgaggcgggccgctag

SEQ ID NO: 8361 - DNA, 309 bp, Methylobacterium sp.
gtggatcgagaccagttgaaggacacctccgtcacggtggtcctgttcggcgcgcaaccccccgaacgcgaatgggtcggccacgagatcaggcgcagcgacaagcctgggaagggcctgcttgccatcgacttccacaaggtgaaagatcagcaactcggcgcggacgtccagggcaggaatttgctgtcataccggttggtcaagcgcggcggacggacgattgggtcgccagcgatgggtacaataatatgtccgcgtagatcgaggcggccgacaaagccgccgggcgctgaggccagcagatga

SEQ ID NO: 8362 - DNA, 261 bp, Methylobacterium sp.
atgcgccgttggctccgcgacctgtttcagccgagccgcttccggcgtgaggtggccgccaaggcaaccgacctcctggccgttcatggcgcgttggcctaccgcgttgcccgcgagcaagcgcgcatagagcgtgcggctcaccgctcgaccgagaaccacttttggagccgcgtcgcggttgaaattgcccgacgtgaggggcgagcggatcagattggggtgaaaggctcggatcggtggggcaaattcggggaatga

SEQ ID NO: 8363 - DNA, 123 bp, Methylobacterium sp.
atgacgctcctcgaccgcgacatcctgttactcgagctgcgctggtacaactgccacgagttccgccacttggcgccccagcttgcgggtgcgctcacaggtttgttacgtgtggggttctga

SEQ ID NO: 8364 - DNA, 243 bp, Methylobacterium sp.
ttgccgctgctcgccaatgcaggcttctgcttgacgattgcgcgatctcacatttcgggggagctatgcaaggagtttatgtttagcctacaaaaagaatacgagatgacctacgatctcacctttcgtgagatgaatggcgatgctttgctatcgatgtatcagaattttttcgatgttgcgcagggttacagccttcttgaggacttagccgattatcaattcgtagagtcgtctgaatga

SEQ ID NO: 8365 - DNA, 222 bp, Methylobacterium sp.
ttggaccgctggcaagcggggagagccggcaaggacgctcgcgcctatctctacatcgggccgagcacgcgcatcagcccggtcgctgccgatcccggtagccggccgcatgcccgctccgagatcaccatcggaccactgacgtcgctcgcgcaggagacgcgggaggaggtggtgcgggctccgtgcgtcgagcgcgggaacagatcggcagagcagtga

SEQ ID NO: 8366 - DNA, 147 bp, Methylobacterium sp.
gcctattacagcccggccgacgaccggaacctgcgctggaacgatccggcgatcggcatcgcgtggccggtggctgaagcggatgcgatcctctcgggcaaggacaaggccgcgccgcttctggccgatctcgggcgggtgttctga

SEQ ID NO: 8367 - DNA, 117 bp, Methylobacterium sp.
atgcccgaaggggctcgcttcatcggcaagccgttcactgccgaaatggtgcacgaccatctcaaggagatcctgccagacgggcttaagccggccccgttgcgcgacatggcttga

SEQ ID NO: 8368 - DNA, 126 bp, Methylobacterium sp.
gtggtcgacgggggcactttcgtttggaggtgcggcgccgggatgacgcggcggactatcgacccgccgctatccgtctacttcatgcccgcgatccagcgggcgttccacatcgaccgatactag

SEQ ID NO: 8369 - DNA, 234 bp, Methylobacterium sp.
ggcgaggccatccccctgtccggccgcatcgtcgcggtggccgacgtcttcgatgcgctgacgacccagcgtccctacaagccggcttggtcaccggagcatgcgcgggtctttctgcaggagaacgccggcacccacttcgacccggccatcgtcgcggcgttcctgagccgctgggccgacgtccaggccttcctcgatctcggccgcgacaccgcatccgcggccgcctga

SEQ ID NO: 8370 - DNA, 153 bp, Methylobacterium sp.
gtgactcttgaccccgattcgccagattggccgcgccgggcgaaagttgtcgatgcgatcgccttctaccgggcgcaggaattcgaacgctgttggccgatcaacatcgccgatcggctatcggtcaggtcggatcacctccatcgcggctga

SEQ ID NO: 8371 - DNA, 120 bp, Methylobacterium sp.
cagggcttcatcggccgcgagcagttgcaggcgcgcggtgagctgttcgccaaaactagctacggccagaatttgctgcgcctcgcccgcgagggccaccgggccgatcagagtttttga

SEQ ID NO: 8372 - DNA, 564 bp, Methylobacterium sp.
gtgctgactgaccatctcagattgcatctcgacggcgaagcacacctgactcatacgccctgcgccggcagagaagtcgcgacccgcgaaccggaccggcaggggaactacaccgtgatcgtgatgccgactgagcagtttcgtgcgcttgctgaagctctcgggaacctcgaaccggattggtttgcggcaaagcccgacgccaacaccatgaagatcgccatgggtgagttcggcgacatctggtccgactcgatcttcggcggcaacgaccaatcgcgcgagacctacctgctagcaaggggcctctaccaagcgctcaaatacgcacagtcgatcccgaagcacctccgcaacttctcggaggagtatgcgatggctgacttactgcggacgcggttcgcgtccctcgtccagcggcttcaagcggcagatgaggcgatgctagctcaccttgaagagccgcgcgtggctcatcgcatcccggaactgcgcatcgctctcgccgtgcacacaccgcccgacatggacgggatcaggacggaagaagccctcattgtatga

SEQ ID NO: 8373 - DNA, 339 bp, Methylobacterium sp.
gtgatcgtgatgccgactgagcagtttcgtgcgctcgccgaagctctcgcgaacctcgaaccggattggttcgcggcaaagcccgacgccaacaccatgaagatcgccctgggcgagttcggcgacatctggccggactcgatcctcgacgccaacgacacagcgagcgagacctaccttttggcaaagagcctctaccgggcgctcagatactcacagtcgctcccgaagcacctgcgcaacgtcgtggaagagtgcgcaatggccgacttgctccgggacaagttcacatccttcggcgagcaggttcacgatgaggacgaggtgatgctcgcttga

SEQ ID NO: 8374 - DNA, 312 bp, Methylobacterium sp.
atgtctcccttacagctcgagggacattttcgtgcgctcaccgtgcgtttcacccagcggtgcatcgaagcgcagcaggcattgcaggatcttgcggacatccagacggagatcgaagacttgcagggcgctaactcgtctgacgggctctctgctggcctgctcgggcatatcgagcgcatcagtgaactcaagcttcacgactttatcggcgcactcctcgaagcagagcaggaggaggccgagtttcttgaggacggaagctcgccgcctccgccggtaggattctcggacgatgaggacgacaagtag

SEQ ID NO: 8375 - DNA, 336 bp, Methylobacterium sp.
gtgaccacgaaccccaacaacccgtctctcgccgagcgggaagcactctaccgcgcactcactgcacggtgggtcgcggcgaacgtcagcgcgcagcagacgttgattgacctgtgcgacatccagggcgacctcgaatctctcgatggccttcgtggccgggatgggttgccgctgccgttgaaggaccatctcgaaaggatcacggatttcgacaccgatgctccgcaggccgccctgttagccgtcgaacaggaggaacccgaagcctacttccttgaagatggcgacgcacccaccccgcctccggcattcgtggacgaagacgacaagtag

SEQ ID NO: 8376 - DNA, 2085 bp, Methylobacterium sp.
atggcccaggcctacggcggcgacacgacccccagcgtcgagcatctgtttcgcaccccctggaccatcaacctgcccaacgccgcgaagcgccggcgtggccggactgcgaggctcgcgaaggctcaactcgtagagccgcgccgctggcacaccctggaagatcttgaggcgcggtttccaccggtggccgagcctgaggatgctgcgcccgtcggcagcctcgacgtctctacggccctcggcgtcctcgacgcgcccgagtacctcgacccagagcttgcagagcgcattagctcggcccgagcggcaaacccggtgtttgacaaggcgctgagaggcgacgggccggcggctgatcgatcggcacgcgattacagcttagccgcggccagcatcgatgccggattcgacgatccgctcgacgtcgcccacatcgtggccgcctattcatcggaaaagacggaggaacgcggcccccgctacttggcccgcaccgtcgagcgggcccgccagcgtgtgcggccggcgcggcctgaagatcatttcgagcgcatcgccgatgcagtcccggcggcagcgggagccaacgaagcatcgatcgtcgagcccgccgacattttcggcgacgatgacccggggcacctcggaacaccgccggccggctgcttgccagagatcatgcagaggttcgtcgccacggaggcgcagcgcaaaggcgtgccggaaagcttcgtcgtcggtgctaccctggcggtcgtaggcagcgcgatcgggaacgctctgaggatcaggccgaagcgccatgacaactgggaggcgcccggcgccctcgctgtggtcgtcgtcggatcgccgggccggaagaagtcccccaccatcaacgctgcgctggcgccgttacgcgcgatcgatcgcgaacagtatgcgcgctgcagccagcagcgtcggacgtgggaggcggcgaacaagccggtgcggggcaaagctccatcggcggccacgcctgccccgccgatgcgccaagccatcgtcgacgacgcgacactcgagaagcagatcaaaatccacgccgacaacccgcggggcatcgtgcgggcgcccgatgagttcgtggccttcctcggcagtatgggcgcctacaagcgcagtggcgacggtgaccgcggaacggtcctgcgcatgctcgacgggggcgagatcaacgtcgaccgtgtcggcgggtcggtgcgggcgccgagcgcgctgatgggcctaatcgcctcgacacaaccggacaagatcaaggagctagcgcgaaatcttgggagtgacggcttcctgcagcgcatgatcttcatcgtcgatgacggtttggaccgcgtcggcctggacgtgccgccggatgccgccgcgctcgccgattacgaggccgcgatccgaggcctctactcgctcgacgaatgcaccggaggcgctgttcggctttcggccgaggcttacgagatcctccagcagacgtggcggcgggttcgcgccctgggcagcttgccgggtgcatctgcggcctgggaggggcacgtctcgaagtgggagggcctgctgttccgcatcgccctaatcttccacagtctggacacgtggtcgttctggggctcggcggattggatcgcccggctggaggtatcggcggccacagcgcggaaggtgtcccgcttcgtcgacttcctgatgcgtcacgctctgcgattctacggcgaattctacgagccggcctcccacacccgcgaggcccgggagcttgccggatggctgctcactcggccggagatctcgaccttcacgccacgcgacatcgagaaggcgcgccgctcgctgacgggacaacgccccctgacgctcgctgtcatgggcagcttggaaagcgccggatgggtgactgtcgagaaacgcggcgccgaagggccgtcgagttggacggtaaatcccgaaattcatcgccgatttgcggaacgtgcggaacgggaaaaagcacgtcgagagcaggagcggacgagaatgctagcggcaatgtcggcgcagaaggccattcgcgatgctcagtag

SEQ ID NO: 8377 - DNA, 135 bp, Methylobacterium sp.
ttgtcgttggccgacgcgaggagcaagatcgagacgtggcggcggcactacaacgagagccgtcctcacaccgccctggggtggcgaacgccccaggaattcgccctggcggcggccctgcagcccgccgaatga

SEQ ID NO: 8378 - DNA, 735 bp, Methylobacterium sp.
gtggcgggggagggcggcgagaccctgacgctgccgctcgccgaactcggcgatctgctcggcctcggcatcgcccgtccggagagcgcgacgatcccgatcgtgcgtctgcgcggcacgcgggggcgctgcctgctcgcggtcgatcgcctggaggaggtgcgcacactcctcgtcctgcccgcgccgccgatcggcagcgatcccgccctcgtcaccggcacggtgatcctcggcaccgatacgcccgcgctcgtcctcgatcccgacggactcatcgaccgactcggccgcgccggcccgcgcgccgcccggtccccgtccaaaggacttggggacggcagcggaacgatcccggaaacgcgacgttcgacgattcttgtcgtggacgactcgatcaccacccgcactttggagaagagcatcttggaagcggcgggctaccgcgtgatcgtctgcgtcgacgggcaggaggcgctcgaccgtctgcgcgcgcgcatcgagccggtcgatctcgtggtcgccgacgtcgagatgccgcgcctcaccggtttcggcctcgtcgaggctttgcgggccgaggaagatttcgcgcgtctgcccatcgtgctgatgacgtcgcgcggcgacgaggaagacgtcgcccggggattggaactcggcgccgacgcctacctcaccaagcagaaattcgatcagcgcgaacttttggacaccatcggtcagttgctgtga

SEQ ID NO: 8379 - DNA, 1038 bp, Methylobacterium sp.
atgaaattctccgtcttcgtccacatggagcgcttcgatgacgcgcaggatcacgccgagctgttcgatgagctgaccgatctggtccagaccgccgaacggggcgggttcgagacggcctggatcggcgagcaccacgggatggagttcacgatcgctcccaaccccttcatcaacctcgcctatctcggcgcccggaccgagcgcatccggctcgggaccggcacggtgatcgcgccgttctggcatccgatccggctggccggcgaagcggcgatgaccgacctcgcgaccaaggggcggctcgatctcggcatcgcccggggcgcctacagcttcgaatacgagcggctgatgcccggcctcgatgcctggggcgccggccagcggatgcgcgagatgattccggcgctgcgtggcctgtgggccggcgactacacccacgaaggcgagttctggcagtttcccaagaccaccacgacgcccaagccgcttcagcagccgggcattccggtctgggtcgcggcgcgcgatccgagttcgcacgccttcgcggtggagaacggctgtaatgtccaagtcacgccgctcgcctcgggcgacggcgaggtcgaggcgctgatcggccgcttcgacaaggcctgtgccgacgcgccgaacgtgccgcgcccgcagatcatgctgctgcagcacaccttcgtctccgaatcccccgaggagacggcgcggctgaacgaggatctgagccggttcttctgcgccttcggcgccctgttccagaacaagctgccgatcgagcagggcttcatccgcggcctcgacgccgagctgcaggcctcgatgccgcaatttgcgccggagaagatcgcccagaacctcgtcatcggcgaggccgagacggtcatcgcccgcctcaaggcctacgaggcgatgggctacgatcaatacgcggtctggatcgacagtggcatcgggcatgcgcgcaagaagcgctcgctggagctgttcatccgcgacgtcatgccggccttcgcgtga

SEQ ID NO: 8380 - DNA, 1623 bp, Methylobacterium sp.
atgaacgttgtccttcacgacagcctcgccgcctatgagcgggagtacaatcttgtgcgtggcgccctcacctcgaaagggacgtcgctgaacgcttggttgtcggaacagggaataaatcggcagctcgcctatcgggcgctcaaggggcaatcactcggccgcaaggccgtcgctgtccgcgcgcagatcggcctgcgcggcgggatcaccggcacgttctcggatctggccgcgggcaagagcccgctcgctggcatcctcaactccgtcaaccgcacggccagttcgaacttcgaccggatggtttccggcccgctgaccgctgcgctgtttggccaggagggcaaggccggcggcggcctgttcggcgatgcgttcggcggggtgctcggcaaggcggccaggttgccgacggccgacatcacggccggcgtcgtcaacctttccgggccgatctccggcatccccggcctgacggccgccaacggcaacgtcccgagcgcggcgagcgttgcggccgggctcggcggcaagggctcggccgacgcggccaagggcatcctctcgggcctgtccggctcgcgcgccgaggtggccgactacgtgaagcaagccgcgatcgagcgcggcatcgacccgaacaccgcgctccgcgtaatcaatcaggaaagcggcttcaacgtcgctgcaaagaacctgacggcgcgggagcaatcctacggcgtcatgcagctcaacacgatgggcggcctcggcgtcgatgccatgaaggccggcatcgacgtgcgcgatccctcgacgtggcgccgtcaagtggatttcgggctcgacacggtcatgcgcgacggctggcgccagtggtacggcgctcgcgatatcggcatctcgcgctgggaaggcatcggccagggtggctcggcgacttcggcgaccaactcggcgctgccgaacctcgacgcttctcttcgctcgatcgagggaacggccacccgcgccaccgaaggcgtgaccggcctgaccgccaacctgtcgggcctgcccgcgccactcgcccagaccagtcagggcctgacccaggtcggccagtctctcggctccggcggtgggggcggtggcttgctcggcgcgatcgccagcctgttcacgggtggcgccagtgcggcgccggcctcggtggccgccgcgaccggcggcctcatccacggcccgggcaccggcacctcggacagcatccacgcgcgtgtgtccaacggcgagttcatcgtgaacgcccgggcgacggccgccaatctctcgacgctgcgcgccatcaacgagaaccgcctcccggcctttgcagagggtggctacgtcggggccgtcccacccgccgctcgctgggacgctccggcccgagccgctacggcgaacgggaatgaggcggccggctctagccgcggcattaacgttcagatcatcaacaacgccggagccaagatcgaggcgcgagaggtggcggatggaaatggcgggcgccggcttgaggtccaggtagacgagatggtggctcagtctgtggggcgtgccggttcagcatctcgtactgcgcttggtgtacccagccgagtagcatcgcggtga

SEQ ID NO: 8381 - DNA, 885 bp, Methylobacterium sp.
atgtcccgatccgtcgtcattcccctctcacggtacttcgctggcggcctgtgcctgcgcggcggctccctgacgagcctcgacctctgcctgtggctggcggccgtctcgggcacgctggcgctcgtggacgagcccgacgagagcggcctcacgatgcgcgatcactggatcacggcacgcggcgacgcggccccggtctggatcgccgggccggtgctgctgcaggcgacgggacagaggggctacgcgctgttggagcggtccttcgagcgcctggccgaggcccgggtctccatcggcctgcacggccccgccgacgcgcaccggctctggcacggctgggaagcgaccccggtctctaaggaggacccgatcgatcggggcgtcgtctctgggatgatgctgtcgcaggccatgatcgagggggatccccaccccgtcgcggtcaaactgagcgcgatggcggcctttcggtcgcggttctccgccctgatctacctgcgcgccctggggtggatggcgggcgcgggcacgccgaaggcttggagccgcacgaagccggggccgagggtcaccgtgacggtgccgatcggcgacctgcatcgggcgctcggcaccgattcgctcgcgatggtgggggactggaacgccaagtgtttcggtcctggggggcggggcgggccggtgcacgaggacctcgccacagccggaatccggctcaagaccgagtggctcacgggcgcggccggatacggcacccggcaggtgccgaccggcttacgaatcaccgtgtcgacgatcgccggggcggagcggcgtccgctgccccggcggccgcgtcagtcctcgtcctcctcgatctcggcgtcgtccaggccgtag

SEQ ID NO: 8382 - DNA, 552 bp, Methylobacterium sp.
atggctcgcagcggcggcggcttggcggagtgcctgccggccagtcgttttccggccgcggcggtatcgctcgaattcgtcgggggtcatgtttccggggcggatcgtgcggattttgagatgctcgcgttctgcgatcgtcagtgccagcagatccccgagttggtgggccgtccagaacaggcgcccgcgctcatttcggcctcgcgcctcggcaatgccctccgtcagttcggctgcgctgacttgcggaacggcgacccgggcccagtcggtgaggtgccgcccgaagcctacttcctccaggcctccgctgacctcggcgatgctcggcaatgcagcccgaacccaaatcgccccatcgtcagtgtcgcacgggccgccgtaccggtgctcgatcagcctgccgacctccgccaggatctgacggccgcgggtccaaccgctgcgcttgcggcggggttttgggcgagcatcaatcgccgcgtcgaaacgctcgaagcgctccgtcgtctgcctcgcggtatccggtattttctcaacatcttctga

SEQ ID NO: 8383 - DNA, 855 bp, Methylobacterium sp.
atgaagaagcggccgccacccgcccgcccggattcgcctgcgcgccgagcgtgggagctgtcgccggagttccgcgcgatcgccctcgagaccctccgccgtgtgaacgcccggatgcacctgatcccccgctgtggtgccaaggcgcgatcgaccgggcagccctgcaagcgcattccggcgccgggccggaagcgctgcctattccacggcggcgcgacgccacgcggcgacggtcccgcggggtggcacaccccgggcttccccgacggactgccgccgcgaaaggcccgaagcgccagcttcaagcagaagcgccgccgcgagctgcaggagcgccgggacgcactgacgcctgggcagcaagcccagctcgaggaatggcgccgcactcacgaagcggggagcacgagtaagcgcgcccgccggcgaactgatcgcgaggccgctcggtggctgcgcgacctgatggagcggccgcagcgccctcctgaacctgcagcggcggcctgtgagccgatgactgcgaaccaaacggagcacgacgacatgagcaagcctcacatcgacagcgagggccgcgcagagctgacgaagcggctccatgcagaaggggccagcatcggcctggacaccctaatgctgatcgcaagggacggaaattttgcagccggcgcgcgcgtcttggcggcgcgggagctcgtgaagctgtccgggattagcggcgctgatcaggatgacgagaagtcgccggatcagatgtcccgggcggagctggaggccgcggcacgctcgatcagggctaagctcgcggagcttgatcagggagaccggccgctgagcgtcttcgactga

SEQ ID NO: 8384 - DNA, 405 bp, Methylobacterium sp.
atgaagaagctcgcgcccgccctcctgtcgctcctcctttccagcgctgcgctcgcccagcccgcgcccatctttgcgatcccgatcagcggacagcttaccaacggcgcccctgccgctgggcaggccacgggatacaacacgggcgtcggagagttctgggtcgccttccccggatcgatccggtgttccggaacgtggtcggtccgcgacccaaacccgacgatcatcatccccgtgacctgcgggcctcgggtccatggggaggctatcgtcacgcggcaggctggcttcatgaccggcttggccatcgtcgctctcagcaacggcaagcgcgggcagttcgtgttcggcgatctcacatacgagacagcgttcggccaggggcgggtccggacccgctga

SEQ ID NO: 8385 - DNA, 180 bp, Methylobacterium sp.
gtgactgcccatgcgacgcggcttggggagaagctgcgctgcgaggaactggcgaccgaccacctgacggacttctcccacatctccgagcaagaccgcgccttcttcgaagatgcgttcgtgagccgggtgaaacggcgcatgtgcatccgcatcgtcaggttctgctgctccacgtag

SEQ ID NO: 8386 - DNA, 1269 bp, Methylobacterium sp.
atggaggcaaaccgcttcctgcccgtgctcataaagatgtttcccaaaacggacagcaccaaacgctcttactacagcggcgcactggcctatgcttgggagcagaagacacctaccagccagcttaacactttcatcaagtcaaacggcggagtgcaaaagacttatcgtgcttacacacaggtgcagaagcagcgtcaggcgtctagccaatcggtgtcattaggcgcgcccttgccgatgctggacagccttcatcacaccttgcagctgatgcttggccttacgtacagcgcgaagatcgccgtagcgaatgttaagggcaagaacgtcaaacagactaaatcgcggcacttcattatccgtaatgcgacgagcagcgatggccgcatctgcggcatcgttgaaacagctatcgccgaatacaccgcgccagcagcacgtatgacgttcgatgacgctctccccgagctgcacggcatcgcttacgtgctcactgacacacaggtggagaccttcgggcggctgtacgtgcatcacaagccctggaccatcactgcggacagcaacgagatcgtgttccgcgcagccaatggctccgagatcaagggcgcagctctgtccgcgcagcatcaaggcttacgggtgctggatcgtctgcgggatccctcggagcgcatgactgccaccgctgcgcagatggcgggttttgaggtctggtacaagaaggtgacgggcaacaccaaggcgcaataccggcgactgctcgaccgggcgctcacgtccgagaacgtacaggagcgcctccacgccacccgcttcactacgcatgccaatcccttcgcggcaccattcatcccgcgcgccctcgatttcaacgtgcatgcggatcacgtcacggttggcttcaaccggagcaggctacgcttcgacaccatttggctgcgcaatgaggtgcacgacatgttcagcaccacgaaggccgtggacgtgctgctcgagcgccggttgctgctgggccacgcccttaagctgtttggccggctcaaagtgaacgccgacatggctgagatggccatgttctacctagccagcaccgatgaggcgcagggtgcctttgtgtgcgaattgcctcttgatgcaggtgagttcatcgtggcttaccccacggtgctgaatgccgagatgcagcagcgttgcatcctcgatgacctcgacatcgcgaagctggccaacacgggcttgatgatcccggcccagcctcagtag

SEQ ID NO: 8387 - DNA, 342 bp, Methylobacterium sp.
atgagcacggacatccggctgatcgatgaggacatggcgctggagagcatcggtcgtctcgcgcagggcaagctgagccttgaggtgatcggggtgctagctggagagatcgcgcggtgggttgaggatcatcctgatctgccgatcgtcgcagtttcggtacgaagcggaggccgactgcagaaactctggttgctattcagcgcggtggaggcgcagcgggaggacgtccgcagaagcaacgatggtttgatgctatttaaggtgacgtgggatgtgtccgagcgtggtgttcggtggcatgtgccgtcggatgcgcgaacggtgctgtatacacactga

SEQ ID NO: 8388 - DNA, 141 bp, Methylobacterium sp.
aaactcccccagacactcagccaatcgaatgctcactggaccggtgacggtgtaagcgacagcaagattggtgagccgtttttctccttcgacatcttcatgcgtttgagcctggaatcatcgattctggtcctggcataa

SEQ ID NO: 8389 - DNA, 297 bp, Methylobacterium sp.
ttgatctgtgctgccggcatccagagccgtccggtggcttcgatccacatcgcgtcgacccggagccggcgcgggtcctcgatcaggctcgagacggtgccgtccggcgcgatccggaggatgcgttgcgtgtccgtatcgctgacgaagagggttccgtcggcggcgatcgcagtgcccccggtcgacggcgtgacggcactgcgctccaccgcgcccgacagggtctcgggcgcggttccgggcgcgtcgaggagccgggtcggcacgcgagagagcggacctgagcagggctga

SEQ ID NO: 8390 - DNA, 153 bp, Methylobacterium sp.
atgatcatccggttgctgtcggcggcgctcgtcgccggcttcctcgcgtccgtcgtcgcgacgggcctgcagctcacgctgacctccccgctgatccttcaggcggagacctatgaaggcgagggcgcgcatgccgccctcccgccctcgcct

SEQ ID NO: 8391 - DNA, 111 bp, Methylobacterium sp.
atgggacagcgtccggccatcgcgcggatgacgggtctgtcgggcgccggccaatcgaccatcgccgcgctgttccgcctgagcgcccatgcgccgggcaggccgacctag

SEQ ID NO: 8392 - DNA, 540 bp, Methylobacterium sp.
atgaagtccttcgccctcgccgccacggccctcgccaccctgatcctcgcacccgcaaccgccgaggcccgcgagttcggcggtcatggcgggtatgtcggcggcggtcgccatcagggcggctacggccatcacggctatggtgcgcgcttcggtcaggccggccgcttcggtgggtatcgcggcgggttcgccggtcatcgcggcggctttggacatcgcggctatggccatcacggcttcggatatcgtggatacgccgcgcgcggcgtctacggccgcggctacggctacggacggggtgccggcatcggcctcgcgggggccgggatcggtctggccggtgccgggctggggttgggccttgggctcgccggcggcgcgctgagcggcggctacggctggggtggttacggcggctacgccgcacccgcctacggctacgcggcaccggcctatggctacggctacgcgcccgtcacctacggcaatgccccgatctacaacaccggctacggcgcgggctgcgtctgcgaatga

SEQ ID NO: 8393 - DNA, 105 bp, Methylobacterium sp.
atgaaagacatcgagcgaaatcgccgagatccgccctcgatcaatgacgacatcgctctggcgacgtggctgccggagaaagattgcgtcacgggggttctgtga

SEQ ID NO: 8394 - DNA, 513 bp, Methylobacterium sp.
atggctgacccaatccttgccgaggaagggcgccagtgtgaagttgatgagtacgatgcgtacttgtatggcgccgcacggttgtatgccgagcaaatagtaaactacctctccgctgagctaggtggagagaagctggcgtaccgcaacggtgctcagagcttcttggcatcgatgatcgtccgatactgggacgggttcttacggccagctcaggaccgggaggggcgcccccatgtcgggctggtcggcggcggagaccggatgctcgatgtctcggcgcacttcctagtctgcgccgtcgccgccttaacggaaggacggtgcgacagccacaccgggcgatgccttcgagactttctcacgaaggcgctcgaactctggcaccagcgctaccccggagccgttccgcggccgatctacggccggttggcgttcgatggcatcgagagcgccgcgccagactggagccaacgggggcagacggtcggtctacgagccagctgggtttag

SEQ ID NO: 8395 - DNA, 816 bp, Methylobacterium sp.
gtgagctgcttcgacgacgatatggaacgtatccggtcccgcatccggcagtacatcgatgagcgcgcgcgggaggaggcggttccgcttctccaccggctcatcgcctcgtatccgggcacgctcgctcagcgcgtcgccctggcgcgcggtgtcagcatggcgatgcagggacgagccgaggccggcggtgccttggtggagctgggcggcttggacttcatccgcggcttggccgaggccggtgcaccctctccagcgctccggagcgccatcgagaccgctctcttgatatggtatcgccaactgcccgcattcatcgcagccaacggcggtcgggcctcgttcgccagctggtgccggcaggctggtttcagcatcccagagaccttgcccgaaacgctaaccatctaccgaggcaccatgggctgcagccctgccgccgcggcgaccgggctgcactggaccgatacgttcgagaaggcgtgcttctatgcgtgccgcttcgccgacgagcatctgaccggcgtgatcgtgctcaaggcagaggttcagcgcagtgagctggtggcgttcctcgaagcggtcggtgagcacgaagtgatcccggccgatgtcccggctcgcttcgaaatcgtcgcagaccatgagctgatcctctcggcagggcatcgggcgctgctccgataccgcgatcaaatcgcgcagggttacccgttcatcgccacgcgcggcatagccgagcaggccgcaatggcgacccggggtcggatgacagaggctggcattgcacccggcacggccatcgtggcctga

SEQ ID NO: 8396 - DNA, 993 bp, Methylobacterium sp.
atgaccgagccgaacgacccgccctgcttcaggtacgcgatcccatcgtttctgggattcctggagcggtcgaccgccgccatagaccctcgacagttcagcttcgatcagatcagcgcgatcgatgagctgatgcttctgtccaagccggggcgctcgttccagttcagcgaggggcagcgccagatcatccgccacttcgcacaccgcgccttcgaagccggtcggctcctcgaactcgcgggctgtggcatcgatgtgctggaacgaggcctccagggcgtggtcggtttgggcgacgccctgacgttgccggaagaggagcgagacggtcctagccagcgccagcgcgagcggacattcatgcgggcggtcaagcggcttcgacacgccctctacgcagcgcaaatcgccatcgacgaagagcacgccggcgccgatgtggatctcccaccgctcggagacttgcggcagctcgcaggcccgacggctaccgttctcccgttccggctggaaacccgggaagcggtcaagcgccgtgaggcccgccaagcagaggaggaggcagccctgtggaagcgggcagtggcctacttctgggctgctcacaatctcgacgacccggccacaccctacgccgcaggcatgcgcctgctctctgaaggcctcgccgcgggcttccggctgtcggcaccggatcggatcaccatcgctatagctatgctgagcgcgcagtgggcggtccaccgcgtcttcgtcccgacgtacctgtccgagtcgacgttctccgtcgtccgtgcccggacccaccacatcctcgacgctctcgaggccgacgacgcagagcggtccatttggcagcctgagtgggttgccggcctctgcgcggatgtgtgccgtcaagccaacgccatcgccgacgccgcgcacgatcgcacctaccagcgcgctgagctgtcggtgcaccgctacatcactcagcaggccggatag

SEQ ID NO: 8397 - DNA, 249 bp, Methylobacterium sp.
atgaaagcagtcgatcccgctgccgcgtacgccgaccgattctacggccggcaagcgcagttctccagcgtggccctcatgagcgaagggttcaatgcggcgtcggaagacgccacggtcttcgcgtacatagatgccaccaatgaggatttgaaaaccccctgcttcaccttcgaagctgccgatatcacggctcaacaagccatgcggttattaggctgctggcagcagatcatccgagaaaagtga

SEQ ID NO: 8398 - DNA, 1089 bp, Methylobacterium sp.
atggctgcggggcggcccacccagagcatcatcatggtcggtctccgcggtgtcgggaagaccgttctgctgaaccgattcgaggagatggcaaccgagagcgggtgcagggtctcgctcgtcgaggcgcacgagggaaagggcctgcccgagcttctcgcaccgcatttgcggtcgatcctttacagcctcagtcacgtccagaacgcgaaggacttagctcggagagggctccgtggtctcaaaggctttctgaacgggctgcgcgtcaacatcagcgatatcgatttcggattgagcattgatgccgaggaagggctggccgacagcggaaacatcgaggctgactttccggaactgatcgtcgccgtcgctcaagcagcgaaggccgcctcgaaaccggtcgctctgttgatcgatgaattacaatacctgtcggaaaaggagttcagtgcgctcatcatgggcgttcacaaggtcaatcagaaaaatcttcctctgatcgtcatcggtgcaggcttgccgcaaatccgcgcgctggccggaaattcgaaatcctacgccgagcggttgtttcgttttccggatattggcgcgttgaagaccttggatgctgttgaagccattcagcagcccgccatgagcgagggagcgcgtttcgatgaccgcgccatcgctcatattctcgcaatcacggaacgctacccctactttttacagcaatggggctatgttgcttggaatatttctcaaacaaatgtcataacggaagagacggcgaggcgagctgacgctttggcgattgccgaattggacaaaagcttcttccaaatgcggttcgagcgctgcacgccatctgaaaagcggtacatgcgagcgctcgccgagttcggagcaggaaagcagagatccggcgagatcgcggatttgctcggcgtcaaggtccagtccgtcgcgccgaccagaagcgcattgatcaaaaaaggcatgatctattcgcccgctcacggcgataccgaatttaccgttcccctgttcgatcaatacatgagaagggcgatcccgattttcggtgcgggtcgcgtctga

SEQ ID NO: 8399 - DNA, 2766 bp, Methylobacterium sp.
ttggcaggcggcacgcctgagctcgaagccgaacggcatgtctgggcggacgccttcgtagcggaggcggtccgtcgaggtctcggtgcggtggcggtcacggaccaccacgacatcgcgttcctaccctacattattgcagctgcaggacggatcggggcctacgccaaactcaccgtcttccccggcatcgaaatcacgtgcagcgacaacgttcagtgcttggcgatcttcgagcccggtaccgagccggcggattggcgtaggctgctgtcgcggctggatgcggtgaccgagacggcgctcgacgcccccaagaccgaccaaatcaggcattgcggtcttaccgtcgaggccctcttcagcatcgtcgccgcggacgagtcactctcaacgcgcatgatgctcgtgccacatttctccaaggaaggcgcacacaaatccctgaacgctgaaggtttcgcgccgcggtttgccgagctgccgtgcgacggcgtgtacatcgaatgccctcacggcgacctcgatgccgggacgctcgacaaggtgcaggggcggaccgaggagtgggggcggcggcgcagagccatcctggcaaccggcgataataggaacgcctcctgggagcgcttgggcgtacatgattgctgggcgcgcctcggcgagcctaccgtggaggcactgcgtcaggccttcttggcagacggggctcgcatcacgcacgtcccgccgcagttgccggccaaccgcgtcgtcaagatagagatccgctccagcatcaccggtccggatacgcttgtcattctcgtcaacgaaggcttcacggcgctgataggcggccggggatcggggaaaagtgcggcattggaattcctccgcttcggcctcggtaagtccgagctcgacattggacaggaggaagcgcccggccggaaggcccgtgcccgggaacggacgctcatcgaggagacgcttcttggcggttgggttgcggtcgaattggaccggggagggttgcgagagcgctggctccgaactggcgacgcgccggcaacgatcgctgtcggtacggtggccggtgatgagattatcacggtggccgatgcgcagcgtcgctttccggcccgcgcgtttcaccagaaggagctctcgacgacgatggtcgacccggtcgcggccgccgagcacataactggcatagcggccgccgaagtcattgaggaacgccgacggctcgacgcggagatcactgcggtcaagcgcgacgtgacttcttcgctgcaggacgtggccgctcactggcaggccgagttggagctccagagagcgcgcgggcattccgctgatatccgccgacggctcgatgccgtccggaaccggatggagcagggcggcgtccgcgaggccgacttcgatatcatccgtgaggcgccacggtacgctcgtgcccaaaactatttggacgacgttgagaaacgcatcgtcgatgatgacgagcgtatcaggctcagcctggaatccattctgatcgtcgatcgaaaccgccatgcagaggcactggccttcccaccaatcgcggcgctagacgcccgtgtcggcactgttcgcgccgatgtggtggcgcgtcttcatgggatcctacaggagctcaggaaccttacggccacccacgcaggagaaagggacgccttcaacgcgcttcgcgaggcttttgaagtcgattatgcggccgcgaaggaacggcaagcggcacatggtgctctgatcaaagaggctgaggcgcttgccaaacaagcggcggaagctgagtcgcaggtttccaagtgtgtagatcgattcaatctcacccgtgctgcgccagccggcctgctggacgcgcgggaacggttacaggctctggtcgaaggtcgccgcagcctgctcgctagggcatcggacggggtggcgattaaatccggcgggacgctccttgcccgggtttcccgggatcggaagcctgtcgagtgcgtgcagtcgctctgcacatggatggaagggtcgatgatccggcaatcggatcgcgcatgctcggattgggtcgcggatacgtgccgggaaggcggcgggggatggtcgaacctatgcgacgccgtcctaggggtgtaccgcgccaagatcatggccggcagcccgcaggagcccggacccgacgcgatcgcgacactgaatgacttggtgttcggaggcgtcggcatcacagataaccaggccggacgcctgtatacccggctgactgaccagactgtcgaggttatgctctccgcggtaccgagagattccattgccctgacctacgtcagtgggcgtcagaaaattgcattttcgagggcctcgccaggtcagcaggcatccgcgttgcttgaactcctgctgcgtcaggaggcgggaaccctcatcatcgatcaaccggaggacgacctcgacaatcgcgtcatcatgcggatcgttgaggggatccgaatgtcgaagtctgctcgacagatcatcttcgcgacccacaacgccaacctcgtcgtgaatggcgatgcggacaaggtcgtcacgatggtatcgacgatcgcggaggaccggcagccagagggaattgtccacgtccgcgtcgaggtcgacggagcgattgagacgcccgacgttcgccgagccgtcacgcgtatcatggaaggaggcttggaggcgttcgacctccgcgcacgtaagtacggtgtcgagggcgcgcagcgagcctag

SEQ ID NO: 8400 - DNA, 93 bp, Methylobacterium sp.
ttgcagcgcgatgcgctgaccaaggctggctgcgagcggatctttgagaagaagagcggtaagggtcaggagcaggcgcccacgaaggaatga

SEQ ID NO: 8401 - DNA, 165 bp, Methylobacterium sp.
atgaagctgcgcctgacactcgtggccgagaatgcgtcgctggagcacgtcgccgagcggacgatctcgcttggtgagagtgaggacagcgaaacaccttacgcttacagtaacgtgcaaacagatcgggccgaaagtgtctcgcgcttcatgcctagcgtgtaa

SEQ ID NO: 8402 - DNA, 309 bp, Methylobacterium sp.
gtgaggcccgccactcgccctgaggtcgccggccacctccatgcggcctacgacgtcagcgagcgttgggcctgtcaggctaccggcttcggccgttcgtcccatcgctaccgcagtcactgggatccgcaggtcgcgctgcggatgcggctgaaggagggggccgccgcacgggtgcgctgcggctgccgccggctgcacatcctgctgcagcgggagggctggaaggtgactcacaagcgcaccgaccggatctaccgcgaggaggggctgtcgatccggcccaagcggcgctcgacacattggtga

SEQ ID NO: 8403 - DNA, 165 bp, Methylobacterium sp.
gtgatcgcgccgggccagttcgtggtcgagtccgacatcaagaaggtgcagcatctcaccggcggccgcgcgctgcgggtgcgcgaaggggcacgggttcaggccggtgacgtgctgatccgtctcgacgaaacccagacccgggcgagctcgacatcatcctga

SEQ ID NO: 8404 - DNA, 198 bp, Methylobacterium sp.
atgggacgccccccgctcaagctcgaactcacatccgtccgcctgtccgagggcgcgaaggagcgcatcaccgcgttggtcggcacctacgggatggcgcagttcatccgtgaggcggtcgatacggcgctcgcggcagaagagaagcgccgcggagttcaacagcccgccccgctcaagcctgaatccgacgcctga

SEQ ID NO: 8405 - DNA, 468 bp, Methylobacterium sp.
atgtcgaacttcttcatcgccgtccccgccaaggcccccaccgccatcttcggcgtcggcaccaccgaggccgccgcgatcgccgacgcggtgagctggggcgacccgagcgacaaggacgccgcggaggtctggcaggccctgccggccaccgagaccctctacaacctcgtcctcaacgagggcacgccgaaatcctggggctcgatcaccgtgggcgcccaggagctgcgctgcacggtcgacgaggaggaggccgtcgagatcgcggccgacatcctgaaggcggtcggcgagagcgtcgacggcggctcggacctctcgggctggaacggcgaggaggcgatcgacgcctacgccgagggctccagctgggccgacgacgtcgagtcccgcccggcgcttcgcaaggccgtcgccgccgcgatcgacgccgagctcgcgacctggcgcgctcaggccgcctga

SEQ ID NO: 8406 - DNA, 543 bp, Methylobacterium sp.
atgctgttctgcaccccggcccccggcctgtcccacgccggcatcctcgcctgctgcaccctgaccgccctccgcgacgacgagctgcacgacctgctcggcggccacgtgcccgtcgagacgacccccgagccgacctacctggagctgaccgccgaggagcaggcccgcggctggctccagcgggccgagcagcgcgtgctggagatcaagcgacgcggcggcacgagcgccgagatcgtctcggcccggcaacaggtcgacctggcccacctccgcgtcaccttcgccagggcggtcgaggcggtcggaccgctggacgccgaccggacgctggaattcgattggaacgactacagccgctacgaggtccgggacgaggacgacggggtgctgttccacgtgccgcggacgttgcggcctcaggacatccactgggccctcgcgatccacgaccgcgccttcttccagggtctcgcgaagggccgggagcaggtgcggaggccaatcctcaccgccctggggctgatcgacggcgagtga

SEQ ID NO: 8407 - DNA, 210 bp, Methylobacterium sp.
atggcgaggcgtaagaactataacccgaagctcatcacgcacgatggcctcacgatgacggcactcgaatgggccgaacacatcgggatcagccgttcccgtctctacaatcggctgaaggcatggccaattgccgatgcactgtcacgtgacaagcagacgggccgcaacaagttggaaggcccgcgcattcccgtgtccgctcactag

SEQ ID NO: 8408 - DNA, 210 bp, Methylobacterium sp.
atgcgcgcctgccacaccgacgacacccgtaaacacgactccgtcaccgcccacgtccgcggcagcaacgagcgccgcgccgaggcctcccggctcacggagaaggaggtcaaggcgatcctgcgcagccgccgcaggatcaaggatctagcccgggccttcggtgtcagcaccgagacgatggccctcgtccgctccggcaacctctga

SEQ ID NO: 8409 - DNA, 336 bp, Methylobacterium sp.
atgaccaggcactgcgacgactacatcgacgacccggcgcagcccgaatgcctgcgccgcttcctcgactacagccggctccccgccgccctgaagtacccgacgcgcgacgaggccttcaaccagggcatggaggagcatctcgggcaccccatgtggcgggatcccgtcccggtcctgttcgcccggcacgaggggcgccctgtgcgcgtcacgatggcatcccggttcggggacatcgggatcaccgaggacctcgacgccgatcggggctacgaccggcgcgtcgcggtcgaggagctggccgacttcagcgccagcctccccgcaatttga

SEQ ID NO: 8410 - DNA, 402 bp, Methylobacterium sp.
atgagcgagcccatggacgaggcggccctgaaggccgcgctgcgcgagaacatcgctcgctacctcgcctctccagaggggagggaggcggtccttcggcacctcggggaggctgtttcggaggcagaccgccgccgcatcatttacggcgacgctgcctccttagagatcgagttcgtcgaggtcgacgcgaacgaggcagtccggagcgggatcgagttcgacgagaccgggaagccgatcgcctattggcttgagccatcccccgacgcgagccggttcgcccggggcatggcggcctacgcgcgctgccaggacgcctgccaagagcgggcggccggcgagccggagtgccgggattcctgcaggcgggccgaggcggccatgaggaggaagggatga

SEQ ID NO: 8411 - DNA, 291 bp, Methylobacterium sp.
atggccctcacggattcccagctggacgccctgcgctccttgaaggcagccggcggcgagggggcgatcgaccggcacgggggcgtcctcgcggccggggagcgcctgccgttcctggcggacacctggctgcggctggtgacgctgggcctcgtggccggggccggcccgctgcggatccggctcaccgccgccggggaggaggctgccctgccgaagggccgccgcttcgatccccggctcctgattaccgacaacgcgccgaagccggcgcacccgggagccgagtga

SEQ ID NO: 8412 - DNA, 288 bp, Methylobacterium sp.
atggccaagtacacccgtttttacctgaccaagtggaaggacgagggcgacagcgtggtctgccgtctcatggagcgggagggctccgacgacggcacggacgccatcgtggccgagttctcgatgcacccggcaccgctcggcgagcggctcgcagtggatgccctggcgacggcgaacgcctacgccgaggcggggtcgatcaagctcacccccgggatggtcgtggagcttccggccggcacggagatcaagcgggttgacgtctctgaggcgaagaccgcctga

SEQ ID NO: 8413 - DNA, 450 bp, Methylobacterium sp.
atgcgcctgagaccactcacccccgcggaaatccgcgccatcgaagagcaccggcggcaggtctgggagatcctatcgcgggagaaggccggcggccgattcgtgcacaccgacctgcgcatggccccgttcctcgaccgctgggagctgcgcgagtcccctacggtgccgggggcgatctgcctctccggcatcgcgtacggacacccgggccgagaggacggcccgatcgtcacgccgccgatccggcaccgcgccgacacgtggatggagacggacgacggcgttctctacctgcttgggcgcatggccgagcccgagcgcccgccaatcctggacggccgccgcggccggggccgctcgctcctctacggcctcccccccgtgaagcccgatttcggccccggcatccccggcgccgacgacgacctccccccactggaaccctga

SEQ ID NO: 8414 - DNA, 174 bp, Methylobacterium sp.
atgaccgccgccgaccgctcgaccctgctggccatcgccgcgctcctgaagacgccctcgacgatcaaggggccgacccgccgctacggtgaggacgagctcaaggccgccgtcttcggcgccggggcccgcctcgccagctcgactttcacgaatcccatcgggagggcctga

SEQ ID NO: 8415 - DNA, 378 bp, Methylobacterium sp.
gtgatccgcgccgccgccatcctcctcctcggggccctggcggcgacgccggccgccgcggcctgccgcaccgtgcccgagctcgtcgaagtcatccgggcgccccttccgccccaagccttcgtcggcgagctctcggccttggtcgtcccgacagtgctcgcctggctcgaatccgaaggcctgccccaccgggccgaccgcatcgtgcaggtcgccggggatcgcgggctcgccctcgtcctcatctccggcgagctcgcctgcgcaggcgccccgatcgccttgcagatcttcggcacgaaggcggtggagctcgcccgcctcgtgcgccgattccgcgagctcaagggctacggcccggagctgccagcatga

SEQ ID NO: 8416 - DNA, 360 bp, Methylobacterium sp.
gtgacctccggcgagatcctcaccgtcatcctctccgtgaccctgccgctgctcgcgatcggcaccgtcatctggcgccaagcctcgacccagagcgagctcagggcgtcgatcaggtccgtggacgagaaggccgggtccgcgtccgaaggcgtgaagcgggtcgagagcagcgtcgccacgatgcgggacgagctccatcgcgagtacgtccggcaggattcccagcgggagatggaagcccgcatctcgaagcggatggacgacgtcgagcacaccgtccgcaacacggccacgaccatcatcgcagccttgtccggaaccgaacccctgcctcgccgccggaggcccacgccgtga

SEQ ID NO: 8417 - DNA, 540 bp, Methylobacterium sp.
atgagcgccctcgacatcctcgcggccctcgggccgatcgccttcctggcggtgttcctgctcacgccgtggggcagcgccctcgcgggtttcctgctcggcacccgggtcggccgctggatctcgctcgcaggcctactcgtctacgccggcctcgtggcctacgcggctgcctaccgctccggccgccgcgccgggaccgcgggcgccctgaaggacgtggcgcaggccaacgccgcggccgtcgcccgtcaccagcggatcgaggcgaaggtctcgaccgcgaagaccgacacgctgcgcgacgagctcaagcggtgggcaccgatgctcctcgtcggcctgatgctcggcggctgcgccagcgtcccgaccggcggtcccggccgcggcggcgcctggtgcgacatcgagcggccgatccgcctgtcgcccgagcgcgtcgacgccatgaccgacgcagaggtcaaggcggccgtcgcgcacaaccgtcacggggccgccgagtgcgagtggaagcccggggagaagcagtcgtga

SEQ ID NO: 8418 - DNA, 279 bp, Methylobacterium sp.
atgcgccccggtctcgccctcagcctgctggccgctctcgtgaccgcggcctccctgtgcaaccgctccctccgcggtcaccgccggcaggctcctcctctccccccgtccccggtccgccggctcctcaccgccgaggaggccgtccggctctccggtggccgcgccgtcgccgaatccctcatcgccgccgactggcggctctcccccgaggaggccgcccgcatcgccatggcgtggccggcctacacccctctggtttccacgaggctccagtga

SEQ ID NO: 8419 - DNA, 342 bp, Methylobacterium sp.
atggaacccgctgccgcctttgcagttaactcgcccccgcttccgctggcccgccgggcgccgcggggtcggcaccggcgtgccgcaacctcgattgagctgcggctctgcctggtcaaggcgatcgcccgtgacatccgcgatcgggccctgacggccgaggacatccgccggatgctcggcgaggccgaggcttccgcgatccgccgcgaggtgggcaatctccgcgcgcaccgggccgaccggttcggacccgagcgccttcaggtctactgcgagatcctcgatctcgacgtcttcgcggtgatcgccggccacgccgcccggaggctcgcggcatga

SEQ ID NO: 8420 - DNA, 357 bp, Methylobacterium sp.
gtgccccagcccgccgagacctcgcccgccacccgcaaggcccgccgcaaggccggggcccggattcgcgcccagcgctggcgcgacagccgcgccgccgagcgcgccgccctgcaggccgccggcgccgaggccgaggccctgcgcacccgcctcgccgtcgacggcgccctcgtcgacgccctcgtcgatcgccaccgccagctgcgcgacgagaccggggagcgcgccccggcactgccgctcggcgacgtcatccgtctcgcccgccgtgccctctcccccgtcctgcccgaggccgaggccgcgatccgggaccggctcggcgccgccctgcaggccgcccccgccgcctag

SEQ ID NO: 8421 - DNA, 102 bp, Methylobacterium sp.
atgttgcgggcgtcgcgggacgagaccttgccggccgcgctgggggacccgagcccggtgtgcttcaggttcgaggagaccgggaccttcacggactgctga

SEQ ID NO: 8422 - DNA, 321 bp, Methylobacterium sp.
atgcggacgacacactcacggattcccgacgcgttcggcaagggctcaacggtcgttgagcacgtcttcctagacgacgtcatcgaggcctgggacgccgccatgacgcgcgctgggatcgacccgaccctgcccgcctcggtcgccgccctgcgcgacctgctggacaaggcgggcgtgctcacactgtccacgtggggcatggtctacaaggccgagcacgcccgggccgacctcgccagcgcgctggccgccttcggcgtcgatgccccggccgagtccgcgatcgaggcccctcccgaggaccgcgtcctgcactga

SEQ ID NO: 8423 - DNA, 126 bp, Methylobacterium sp.
gtgctgcgcaagcctttcgcgctcggtgatctgcggacggccgtcgagcggctcctggcgggccgacccggccgcatcctcccgttccggcggacggacgacgacggggacgggcgcgccggttga

SEQ ID NO: 8424 - DNA, 174 bp, Methylobacterium sp.
gtgatcgcgatcttcgaacgcctgcttgtgccgttcgaacgcggtacgctgtcggacgatttcggccaatccttcgatgagcgcctcacgttctccgtcaaggacgtcgcacagtgcatcaattgcgtcggagagcggctggaggtcacccacatctggggcgactggatgtag

SEQ ID NO: 8425 - DNA, 621 bp, Methylobacterium sp.
atggcgttcctacaggaggccgacatccgcgcgcgggcgcgacgcagggccggggcggctgggatcagcgtcccggaggcgctgggccggatcgctcggaatcgacgcccgcgatatgacatcttcctctcccagacgatccgcgacgccgagatcgttctcggagtctacgacatgctcaccaacgccgggtatgatgttttctgcgattggatcgaagcgcccgagaccgatcgcagccaagtcacgcccgccaacgccgaatttgtccgtacgactatgggtgtaagcgacaccctgctattcctcgacaccgtgaacgcggcccagtcgctgtggatgtgttgggaactgggttggttcgatgggcggaaaggtctcgttgccgtcctcccggtcttgcctgaaggcgagcgatactaccgcagccgcgagttcctcggcctttacccgtacgtcgagctggatgaggaggggcaacttgaggtcgtcaggcccgtcgtcacgagcccgagcggcatcacgctgttcgaagcgccgaactcacggacgttcgaatcctggcggaacgacccgcgcgacttcatgcggccgcgcgtagttggcggggcaggacggtag

SEQ ID NO: 8426 - DNA, 555 bp, Methylobacterium sp.
atgtgcggtgacgctgccggcagggactacccctgtgggcgtaaggcggccttcgcgctctcggacaagatcggctcgggaaacgtcgcgtgcgatgtcgtgggcaaggatcgatatggccgctcggtcgcgatctgccgtctcggcgccgaggatctgaacggctggctcgtcgcccagggctggggcatggcctaccgccaatactccaaggcctacgtctcgctggaagacgaggcaaaggccgcgaagcggggaatctgggctggcccgttcacgccaccgtgggattggcgcaagggcaagcgggaaggcgatgcacctggggccgccgccatcacgccggcgcctgcctctccaacgacgaaggcccctgcggcttcagcggctggctgccagatcaagggcaacatcaaccgaaagggcgatcagatctatcacgtgcccggatctcgagactacgacaagaccgtgatcgacgtcggctcaggcgaacgcatgttctgctccgaggacgaagcgaaggcggctgggtggcgggctccgagggggtga

SEQ ID NO: 8427 - DNA, 498 bp, Methylobacterium sp.
atgccgaacttcaatgaacaagtgttgcgccactgggatgattgggaggagacaaccggcgatgagtccggcgatcctgacgctttcgtcgcgtgggcaatggaaaacaggcacctgctgccgcgcccgcaggatgtacgaaaactgttgcggcggcaggtgacgacggccctgcggcaggcatcacgggtcgatgagaatggcgtgacctatcgcgctaagcagtgcgttacgctgtttgatggcgaccttgctttgaagcgatggtttgatacggaccacggcggtacatcaaatcttagacagaaggcagtccgtcagcgacgagacgctattgcgaatgatgtcttccgcgccatgtgtgatgtcgagcacatgaaaacgcagtttcccaaagacccgccgctgcagttcgtcttagacttcacggatgactacgaggaaaagaaagcggcagcccagcaatcccgcgatgctgacgacgaggacgtcgcttag

SEQ ID NO: 8428 - DNA, 264 bp, Methylobacterium sp.
atgaaatggtcaatcgatgttcaagcgccctaccacctccctgatttggagggctaccccatcacgcttccggctgtggaggctgacacgaagcaggacgccgctagtaaagccggcgaagcggttcgtgcttacaggcctgcgctcgatcaaaacgcccgtgtaacaatcacgggcgaggacggatcaacgagccacgacacacctcagacggtagatgagtttctggaggatgagcagaaccatccgagggagggcttatga

SEQ ID NO: 8429 - DNA, 297 bp, Methylobacterium sp.
gtgtcggccatcggcgggatcaccaaccgtatccagcagatcagcggcgtcgcaacttcgatcgcggcggcggtggaggagcagggcgcggcgacgcaggaaatcgtgcgcaacgtcagccaagccgccgtagggacgacggaggtcaccagcaatatcgccggcgtggcgcaggcctccgaggagacaggggctgccgcgacccaggtccttggcgctgccgccgagctgtcgcgccaatccgagcatctcggcgccgaggtcgcccgcttcctcagcactgtgcggacagcataa

SEQ ID NO: 8430 - DNA, 282 bp, Methylobacterium sp.
atgcccgtttttcagatacaccaaggtggaacgggcgcgatcctctggacaggcgcggccgctaacgaaatccaggccatggatgcgatggcccatgacgcaggctactacgaccactctggtcttccggagaacatgcgcagagggctgaaggtcgaagcgctgtcgttcgataccgatcgtgagcagggatcagcaggccgagcgcagggtggccggtacggtcagttcgtaatgggcaccgcgatcagcgaccgtaacctcggccgggccgcaggctag

SEQ ID NO: 8431 - DNA, 195 bp, Methylobacterium sp.
gtgcggctctcgatcctgaccttcatcgtcttcactctgaacggggcgatcgacagcggacgctacgatacgctcgcgatcggggaggtgcgtgaggccatccaggccgggacgatcttctcgttcctgaagaccaagatcggtcacgacatcgatctctccatcttcgccgcagatgcgggcgccgaggcctaa

SEQ ID NO: 8432 - DNA, 210 bp, Methylobacterium sp.
gtggatatcgacacgggcgaggcgttctactggggcgtggatctctgggcggggtcccttgcggactgcatcgagttccgcgggcaggcctcactcctcctggcccacaacggcactgggtacgactaccgggcaatcgagaagctttatcccggttggtgtcgccccgctaagtcgcgggacacccaggtcatcgcaaaggtggcctag

SEQ ID NO: 8433 - DNA, 288 bp, Methylobacterium sp.
atgtccgcaccccagagcctcacgatccccctcgcggccgagctcgccgcgcgtctggcgacggcggccgagcgcagcggcctgacagcggccgagctcgctgcgcgcgcgatcgccgatcacctcgatggggtcacggcctacggccggctgggcgaggagatggccctcgtcaaggaccggctcgccgaactggccggactggtcggcgaggccctggtcgagcccccaccgggcgcggtggccgagatctgccgctaccgagcggcgaaggccccggcggcgtga

SEQ ID NO: 8434 - DNA, 582 bp, Methylobacterium sp.
atgtcgtcgccttcttcccgcgggtcgtcctcgagcgtcgatgcgcgtctgcgcgcggcgcagaaggccgagcgggcggccacccggcgggtgcagcaggcgagccgtgcccggctcactgagatcctgcggctgccgctacgcgagcgcctcacccatctcgacgatctggcgcttgtaggtccggaccgggtcagcctacgccgctcgctccaggctggcctcgcccgcccccgccgccgctggcatccgagcaggcgcctgcaggccctgagtcggcggctcggcgtatcggcgctgcgccagctcctgcatccggccttgctcggactggccggtatcgccggcgtatggctgcacatggcttggtccaacacgccgcgggtggcgctctcgacacaggtgctggccagcaacgtggttggtccggacggtctggtgcagagctatgccttcccagcccggagctgggttccgatggaacggctcgacgcgcagacggcgcaggtgcgggtctggtacacgcgccagggctacgggcacggtgcggtctggcgcagcgggctcgacctcgctcgctga

SEQ ID NO: 8435 - DNA, 474 bp, Methylobacterium sp.
atgaccgtccgcgcagcttccctgaggcatgtgatgtgccggcgcttcgggttcgggaagtcccgcgggatcggcaccgcctgcattccgttgatcctaacgagccaggccgtcctggctgcaggggccgacttcacacggatgcgggcgttcgacgcccaatacgcctacctcgatgtccctgccggtgcaccggcacaggactggatcgcgatcgaagcgagacgccgcggtgatggatggcgcatcgaagccgtcggttcgaacccgaagcttgccgcgtccgtgcgcacctgtcgaaaggtgttccgtggccgtaccgtcggacccggtcggatacgagcaacggacccttccggggagttcggcacgttcgaattgcgccgcgaaggcgcatatgcacgattggttttgctctcgataggcgactgcgcccgccagggcctctacctcatcccaaccgtgcaggattga

SEQ ID NO: 8436 - DNA, 342 bp, Methylobacterium sp.
gtgcgcctaagcgccagcgcccccctcgtgaccgcctctgtagcctgcggcttcccctccccggccaaggatcacctcgaacgcccgctcgatctcaacgagctgtacaggatcggctcgccgtccgtgttccttgtccgcgtcgcgggcgagagcatgaccggctggggcctgtttcccggtgacgtggctgtggtggacaaggccaagccgccccggaacggctgcatcgtcgtcgcctgtcgcaatggcgatttcacgatgaaaacctaccagcggcgcggcgagcgcgtgacgctcaaggccaaaatcccgcctttccgaacatcgaggttcggctga

SEQ ID NO: 8437 - DNA, 201 bp, Methylobacterium sp.
atgtcgaccgtccctgtcagccagcgaagcctcaccgatctgcagcgtgacctggatcacgtgaagaagatgcaggatgttgtagaggccgaccaagcgaatatgcccaccggtgattttagcttcacgcgtgatctgttggcccaggggcgtcagcagcttgaggaggaaatggagcggaaggcatcagggcagccatga

SEQ ID NO: 8438 - DNA, 84 bp, Methylobacterium sp.
atgcagatgatgttaggcctgtctatgaaactgaggatgatcgagacgaccctaaggcacgatggggaatggaaggaacgctag

SEQ ID NO: 8439 - DNA, 174 bp, Methylobacterium sp.
atgtggttcatctttccgcggctcgccagtctcggcatgagcgcgatggcccagcactatgcgatcagcgggctggatgaagcgcgggcctatctgcgacactccgtcttgggtgagcgcctgcgcacctgcacggcggcggtcaacgcggtcaccgggcggaccgcccactag

SEQ ID NO: 8440 - DNA, 114 bp, Methylobacterium sp.
atgacgctgttcggacgtgcggatctggcggatccgacgttcaaggcagccctcgcccgctactacgacagcgcggaggacctgcggaccctcgggctgctcggcgacgtctga

SEQ ID NO: 8441 - DNA, 282 bp, Methylobacterium sp.
atggcctacggcgggcagctccggttcgggttcgagggagcggtcgcattctgcgacgtggcccccgccgtcgaggcccggttcgctgtctacctcgacgctatcgcggacggcgagatcgttttcgccgccgggtcgaagaacggatcgttctacatgttcccgaacgcgaagctgaactgggcgagcggcgcacctttccgcgtcgtgtcgccgagcacgcgggacgcgcagctgcggggattggagttctcgatcccctacacttacaacgtgagctaa

SEQ ID NO: 8442 - DNA, 333 bp, Methylobacterium sp.
atgggcctcgccaccgacctcagcctcgacgccggctcccgcctcggcatggtcggatcattcgcccacatgggcgtccagcgcgccatggcggatatccggcacgagcagcgccgggaagccaacgccgtcggtgaggtcgtcgctcggctccgggaagcgcgccttgggcaagtcgccgccacgcgccgggcggtcgccgccgaggcccgcgccgcgcgagccgaggcggaagtcgccggggcccagggcgagttggatctgctccgcgatgccctgcgggccgagaagcgcctgaccgccgcgctcaaggaaacccgcggcgtcgcgtag

SEQ ID NO: 8443 - DNA, 813 bp, Methylobacterium sp.
atgagcttcctcgcccgaatcctcgcctccatcgccgccgccatgcgcggcgcgtggtccttcctctccgacaccttcgacgagatcgtcgagcccgtcacgaagcgcctgccgtgggtgcggaaccgggcgcgcgccgccggacgcgccatcgaccggggcgtctccgccgccgccgatgcggccgccgtcaccgccgaggttgccctcaaggcccccggcgtcgtgggccgcgagatcggctccgtcatcgcctccgcgctcccgtcaccggcggtgaccggccgggccctggccgagggcgccgtcgtcagcgacgcggagatcgagcgcttggtcggggccgcgggcgacgaagacggcttcttcgagcggcagcgcccccccgtccatttcggcaacttcatccagcacgccatcgaggcgtaccgcgacaacggcgagcgcggtctcgcccgccacgtgaagacggtgtcggagccggtcgcggagtggatccgtagcctctcccgcgccgagctctccgccgccctgacggtctcgccggacgtcctgaagcgccacgccgaggccacccggcaggaagagctctccccgctgatcccggcgatcctgccggtcaagccggcgcgcctcgtctcggacgacgagttcgccgcgatcgctgcccagatgaagcggaaccggcttcacgatcgggacggtctcgacgagatgatgaagcgggggccgggggcccgcccggagccgcgcttcgacgccggccagccgcctgtctacggtcgcggctaccgcccgcggccgctgcactga

SEQ ID NO: 8444 - DNA, 534 bp, Methylobacterium sp.
gtgcgggtggtcctgccggcgggctcgacggtccggctcgtcgacgtgtggtccgggacgcggacgagccttcacgcccggctcgtgacggtgcggccgttcgcgagccagcagcacttcctcaacccggagcgcacgcgctggaaagccgggttcgacttgccgatcggcgaagtcgtcacgacgtgccgcgtccgcgagccaaccgcgggccagctcttcctcgtgaccgaggacggcttggagccgctcacgtacgcgcaggcgtgggatcgagtggacccgacgggtgcggaggaggggctggccgaaatggagcacgacgcccgggccgcgaaggccggcttaccgcgtgagctcacccgattcgtcggcgctcacacccttcggaacggggtccacccgatcgggaattcgcattatttttcagagcgttgcaccgcccggcaggcgttctggcggcgggcgacccgggccgagatcgaggccctcggctcggggtgcgtacgtgcgcctgtggtgccttgcatgtga

SEQ ID NO: 8445 - DNA, 327 bp, Methylobacterium sp.
gtgtgcagggaggaattcaaggtgccggcggcggtgctgcggcagcacgtcgccgcgggtgagggctacgcggcgatctcccggcgctacgacgtcggcgagaacgccgtccggtaccgctgccggcggctcggcctgagagaactggtgaacgggaaggcgccgggcgaggccgcactgcggatggcgctctcgcacagcgacatccccctcaagcaaatcgcccgagcgttcggcatcgaagccggcacgctcacgagagcgtgccgggcgtacgggatccccacggacgagctcggccgcgagcagctgcgggacgcccgctga

SEQ ID NO: 8446 - DNA, 222 bp, Methylobacterium sp.
atggcccgccgccctctccacgatgaggacgtcggccgctgcctcgcggccgctgtcgacctcgccggcgggcagtccgcttgggccgcccggcacggcatgacgcagtcctacgtcgccaagctcctgctcggccgccgcgaggtttcgccccgcgtcctgtcggctctcgggctccgggcactcccccgcgcgtacgagccgacggagccccgcccgtga

SEQ ID NO: 8447 - DNA, 492 bp, Methylobacterium sp.
gtgctctcgggattcgagcgcgcggccgttctcgccgtcttcccaacgatgcccgaccccccggcctcggagccgccccccgaggagccatccatgcctgcgccaggacagacgaatccgaagcgcctggtcccatcggacgacgggatccgggccgatcacgcggcgaacccgagccctcgggcccccgccacgaagtggggcacgagcgagtcggcggttttcacgcacctgcgccgcctgggtctgacccggccccgcgccagcgtgcggttgccggcgccggtggctcctcggtcctcgcctgaggaccgctcgatcggtgtccacccgctgccgggcgagccccgcctgctcggccgcctcggtgtcgaggacctcgccatcgcgatcgagctcgcccgccggacggggatcaccccgctcgatgctctcacctgggtccgcgccgacgcgggcctcgccgcctccgacgccgaaaggaccgcctga

SEQ ID NO: 8448 - DNA, 282 bp, Methylobacterium sp.
atgctccgcctcctcctcgccaccgccgtcgccaatgccaaggccgacccggcctggcgccagtgcatccgcctgatcgcgggcctcgtcgtcctcagggtgaacagcgcgatcttcatcgccgccgtcgtcttgcaggccatcggcgcgccggcgctgtggccgcacgacgcgcccctgatgtgggcggccgtttgggcccctgcctacgtcgcgctgagcttcctcgccgacgcgttcggcgtcgacggcatgggcgatcccgacctcgacccccgctga

SEQ ID NO: 8449 - DNA, 474 bp, Methylobacterium sp.
atgaccgatttcgaaccgcccgtcgtcgaccccgcccgccgccgcatcatggagtttcacgaagaggcgcagcgatgcggccaggactacgagccgacggccgaggagctacgcctcctgatgatcgaggcgctccctgaggccggcggcatccactactgggcgcagcgcctcggctgcacgccggaggatctgcaggccgtgctcgacggggagatcgagcccgccggggacatgctcgacatcctcagcatggagccgatcccctcgcggggcgtctacgccgatccgctgatggaccgagaggcccgcgcgatccaacggcagcgctggtccacggcgccgaccgcagcgacgtacgtcatgggcactccccgccgcatcgagcgcagcgccgcgatcccggacagcgtgcggaacatgttcgcgatcggcgtcgccgcgccgcggatgaagcccaacgaagaaaagtga

SEQ ID NO: 8450 - DNA, 471 bp, Methylobacterium sp.
atggcgggcgccacgctgcctgacttcatgtcgacggtggaactcaacctgaacggggcggtgcagctcacccgcctcctggcgccggccatgtgcgaggcgcggcagggatcgatcgtcaacatggcgtcgatcacctcgctgaaggggttgggcggtgccgtcgcctacaccgcctccaaggcgggcatgacgggggtcacgcgggcgctggccgtggagctggccccgttcaacgtccgcgtcaacgcggtctgtcccggcgtgatcgatacgccgatgacctgggagcacgccgaggcgcagcccgatccggccgcccactacgcgatgctccgggcccgccagccgatgaaccggctcgcctccgcccgcgactgcgccctggcggtgctgttcctggcgagcccggactcggccttcatcaccggagccgcgctcccggtggatggcgggcgccacgctgcctga

SEQ ID NO: 8451 - DNA, 513 bp, Methylobacterium sp.
atgagcgccgatcctttcgaacggtcgctgccgctggccgcgggcaggctggttcccctcgatttcgcgtacagccacgaaatcgtgcgctggcgcaacgacccaacgaacgcagtctggttcaccacctcgcacaccttcaccgtcgaggggcacgaggcgtggctcgacaaggcgcgtgcgagcgggaccgacttcaactgggtgatcgaggacggggcggaacgcccgatcggcacgattgggctctacaacctcgatcgtcccgccggtcgggtggagatcggccggatcctgatcggcgacaggggggctcggcgaggcggctacgccagggccgccatcgcggcgctgctcgatctctgccgcgacgtcggcatcggggaggtctacctgtacgttctgtcgaacaaccgaagcgccatccagctctacgagtcgcttgatttcgtcgtcacggaagacggcccgacgacggtaaggatggcctgcctcctcggcccctcgccgtga

SEQ ID NO: 8452 - DNA, 1143 bp, Methylobacterium sp.
atgacttcagatgtcatccagctcttcacgccgacctaccggatcgacgaatgcctggcggagatcaggacctgcctcgaagtcggctggacgggcctcggcttcaagacggtcgagttcgagaatgcctggaaggcttataccggtctcccgcatgcccatttcctgaactccgcgacggccggccttcatctggcggtgaagatcttgaaggagcgacacggctgggaggacggcgacgagatcatcagcacgccgatcaccttcgtgtccaccaaccacgcgatcctctacgagaatcttgccgttgccttcgccgacgttgacgcgacgggctgcctcgatcccgtcagcgtcgcggcgcgcatcacgtcgcgcaccagggcggtcatgttcgtcgggctcggcggcaacgtcgggcagtacgaggcgatcgaggcactttgccgcaaacatgggctcgtcctgatcctcgacgccgcccacatggccgggacgcgccacaggggcgtcgtcccgggacgcggcgccgacgccaccatctattcctttcaggccgtcaagaaccttccgacggcggattccggcatgctctgcttcgccgatgccgacctggacaagatcgcgcgtcagcagtcctggctcggcatcgacaaggatacgttctcgcgtacgcagtccagcggatcgtacaagtggtactacgacgtgccgtccctggggttcaaggatcacggcaactcgatcatggccgccatcggcctggtccagctgcgctacatcgataccgacaacgcctatcgccgccagttggcgaaatggtatgacgacgtcctgtcgtctatcgacgccatcgaccgcgttcccgtcgattcggcctgcgaatcgtcccggcatctctaccagatccgggtcaggcgccgcgacgaggttctgctcgcgctcaacaatgccggcatctttcccggcgtccactaccgggacaacacccagttcacgatgtatgccgacaaccctcatccctgcccgaaggcgcgggaattctcggacgaggtcatctccctgccgctccacctgcgcatgtcgcatgccgacgtcgtgcgcatcggcgagcaactgaacgccatcgtcagccatgcttga

SEQ ID NO: 8453 - DNA, 108 bp, Methylobacterium sp.
catctggctcaaaagccatacctcagggcggaccacttcagtgggggcggatcaggctcgccattcgactatcggctgccgatcgaggacgtacagagggtggcgtga

SEQ ID NO: 8454 - DNA, 300 bp, Methylobacterium sp.
gtggaggccgagccagttttccttgcgccggaccgcaatggccgtcggcaggttcgggtcgtcggggtcgaaggcatcttcctggccgccgtcgccatcgagaggcgccgggcgcgggtgcggctcgggagcgggcttcggtgccggcttcggggctgcgtcggcgtgagaggcgttgttaccgtccttagccctcaccgagcgatgggttacaccgccccgataggtcgttggccgctggtcgaggttccactcggtggcttccacatccacgcggccggtgccgtcgagaacaagtaa

SEQ ID NO: 8455 - DNA, 144 bp, Methylobacterium sp.
atgacggaagccattgaacacctgaagaactggtgcaccgatcagcacaagctgttgtccaaaaacctcgacctcaaggagaggggattgctccatacgagcgaaggccacgtcggcggtggcgtcgtcgatacaacaccctag

SEQ ID NO: 8456 - DNA, 249 bp, Methylobacterium sp.
atgcgcacctccaccgataccgccctcccccatgtgatcctggcgacggtcgctctcgccgccgcctatgtctcggccgggctcggctggcccttcatcgcggtcgcgttattcctgcccatcggactcgggcaggctaagcgcgccgtcaccctcgatctcatcgccgctggccggtgggtctatggccgcgtgcggatcaccgccggaagggccgcggccgccttgcggaggtggtgggctcgctga

SEQ ID NO: 8457 - DNA, 186 bp, Methylobacterium sp.
atgcatcagctgatcgaggtgtgcgaccgcctgatgagaagggtgcaccatgccacagcggcggatagtcgggtgttgggcctgccgacccgctgctaccgcgccggcatggatcatctcgctctcaccgtcatggccttggccgccgcattttccggcttcgtcgtcctgatcgggtggcggtga

SEQ ID NO: 8458 - DNA, 186 bp, Methylobacterium sp.
atgatccgccgcgagccggtccaggctccttcaccgccgccggcgccgctcgacgtggttctcgctgagcttgcccgggcaggcatccggccgacacgatcggcgatcctggccgtggcgctcgatgcggggtgtgggccggagttcgccgcgacgatcgcccgccgggccgaggtggcgcgatga

SEQ ID NO: 8459 - DNA, 198 bp, Methylobacterium sp.
atgtctgacgggcgcaggcacatcccctgccgcatatcaatcaacactctgcgcgactgcttcggtgaggaaaattccgatccgttggatttgtttgaaagctgccaaggcgagatcgaggacgcggccagcagaaagttccttggcaacaacatcagcaacgggcttatcgaacttgaagaaggagactttgattga

SEQ ID NO: 8460 - DNA, 162 bp, Methylobacterium sp.
atgcacatcgaggccttccggcacgttggcctcgacctgatcgaggaaggcgcagaacccgatggagcggtgacgccgggcgcaacagccaatgaagcgacccgcctgcacgtctggcacggcgaacaggtcgtgggtgcctgccctgcggtagccggatga

SEQ ID NO: 8461 - DNA, 237 bp, Methylobacterium sp.
gtgactgaggtcgatgagcgttgcagcactgttctggccgattttgctaccgaggccgagcgagaggcgacaaactcgggcatggacatccatgaatttcaaactgcgctcaagggcgaaaccatcacgacgctgataccacccggctctcacgagactctgacggcctatgggcttagggcgacgagcgagatcttggtccagtacctcatggacgacctttcagtgacgccatga

SEQ ID NO: 8462 - DNA, 393 bp, Methylobacterium sp.
gtgtgcaacctctacagcctgacgaagagccaggacgagatccggcgcgcctttcggatcgacatcgaccgcaccggcaacctgccgccgctgcctggcaacttcccgaacacctccgccccgatcgtccatgtcgccgacgggcggtgcgtgctgtcgatgtaccgctggggcatgccttcgcccgccttcgcgctggagggtaagcgagtcgatcccggcgtcaccaacgtgcgcaatacgggctcgccgcactggcgccgctggctcaggccggagcaccgctgcctcgtgtcgctgtcttccttcagcgagttcaacagccgaggccaaggcggccgcctattgggcgacccaggaccggccgcgcatctaccgctggcactcgtttga

SEQ ID NO: 8463 - DNA, 282 bp, Methylobacterium sp.
atggccaccggcaacaacacgagcatgcccgacctcggcaaaggcgccatcctgatctggctgaaggagggcctggaaccgggcaagggacagttcggggcgaagccggacggggttaatcctaagccagtgtcctggagccgcttcgacctggcgctctcgttcgcgatgcacgatcccaggacagacgagcggttgccctggatcaagaccggtggccgggtcatccggcctaccgaattgcgcgcgatgttcggtgctgccgaaggccttctgggttga

SEQ ID NO: 8464 - DNA, 1164 bp, Methylobacterium sp.
atggttgcgcatatcgggtccgagccccgtgtggcgttctcgagtgaaacagcggacgagattcctgccgacggcgcgcgcgagatcgccgggcgcgggatgggaatcactctagacaatcacggcggccgggtcgggaccctcagggagttgcccgcagtgctttgggcgctggggttcgagcccgatgccatcatcggccgggacggtctggatccgcgcctgctcgacaacggggacaacgcactgccggcttcgtccgtcggtggcctgctggaagcgtgcgtggagagtaccggttgccgttatgtcggcctcttggtcggagcccgggcgcggacctcctgcttcgggatcgtcggtctgctgatgcagcaccttcccaccgtctccgacgcgctgcggtgcctgatcagccacgggcatctctatcacccgggcgccgtctcgatcctggatgccaccgacgggaccgccatgttgcgctaccggttctcgcccgccgatgccccgggaggcggacagatcgtggatggcgcgctcgcctccggcttccgcatgatgcaagccctgtgcgggcccgactggaccccggtggaggtactcctgtcacatcctggtggcggcgacgaggaagcctaccgtcgggtgtttgacgtgccggtccggttcggtcaggaggcgacggcactggtcttcgatgcggaatggctctcccatccggtgccaggcgcggatccgggcttccgcgcgatcctggaactccaggtcgatgcgcttgagcaccttcacgacgaggcgttgagcagccagcttcgccgttccctgcggaccctcctattgcggaagggttgctcggcggggcggacggcgcagcttttcgccatgcaccggcgaaccatgagccgccgcctcaaggcggagggccacagcttccagcacctcgtcgacgaggtccgctacgacatcgcccggcatctgctcgggaacgcgagcatgccgcttgccgaggtcgccgcggcgctcggctattccgaggccagcgctttcacgcgcgccttcaggcgctggtcggggctcaacccgaaggcttggcgcctcggcgccgtggtaaggcgtggcctgcccgagccggccgtcgctcctgcgctcccggtggtctga

SEQ ID NO: 8465 - DNA, 105 bp, Methylobacterium sp.
atgcgtaaatcctcagtcttcagcgacatcgtcgcgcttgtcatcttgggcatcgccctgggcggcgtcggcctctatcttctggaaaaggcatccctatcgtaa

SEQ ID NO: 8466 - DNA, 87 bp, Methylobacterium sp.
atggatgatgcgccgcatccacgcttcggcgctatcaatgtgacggcgagcaacttcatcacgctcttgacgagtcagacgatctag

SEQ ID NO: 8467 - DNA, 243 bp, Methylobacterium sp.
aagggcgaggccatccccctgtccggccgcatcgtcgcggtggccgacgtcttcgacgcgctgacgacccagcgtccctacaagccggcttggtcaccggagcatgcacgggcctttctgcaggagaacgccggctcccatttcgacccggcggtggtcacagcattcttgagccggtgggcccaggttgaggcgaacctgcgtctgcgaacagcgctgcattcggtgccggtcgccgcctaa

SEQ ID NO: 8468 - DNA, 102 bp, Methylobacterium sp.
atgacagtcgaatccgacaggtcacgcctagccgcgctgatcgatgggaaggaccgtgcgctgctcgccgcgttcctgcgcgacgaggggaccgactttgcc

SEQ ID NO: 8469 - DNA, 327 bp, Methylobacterium sp.
aacggcgatctctccaagaagatcaccgtcgatgtgcgcggcgagatcctggaactcaagaacaccatcaacacgatggtggaccagctgaactccttcgcctcggaggtgacccgcgtcgcccgtgaggtcggctcggaaggcaagctcggcgggcaggcgcaggtgcgcggtgtcgccggcacctgggccgacctcaccgacaacgtgaacctgatggcggccaacctcacggggcaggtacgcaacatcgccgacgtgacgacggcggtcgccaacggcgatctctccaagaagatcaccgtcgatgtgcgcggcgagatcctg

SEQ ID NO: 8470 - DNA, 96 bp, Methylobacterium sp.
atgagccgcaacttcgggatgaaaatgctcacaatgacaaatctgtccacggagtgcttaatccaacttaccaagctgggttacgacgcgacgccg

SEQ ID NO: 8471 - DNA, 171 bp, Methylobacterium sp.
ggacccgtctacggcaccggctacgaggaggcgcgggcgctcctccatgccggcaacgacccgcgctgggatttcgccccgctcaagttcctggcgaccgtcctgtcctcgatcagcggcatccccggcggtctgttcgcaccgtcgctagccgttggcgccgggctgggc

SEQ ID NO: 8472 - DNA, 150 bp, Methylobacterium sp.
ccgtcgggcacgatcaccctcgacaccaccgcaccgacgctggccctgaccgcggcaccgcccgccacggtcgaggccagttccgccgcgggtgcggccgtgagctttgccgccagcgccggggacggcgtcgatccggccccgcgcgtg

SEQ ID NO: 8473 - DNA, 894 bp, Methylobacterium sp.
atggatgatgtgatcatcgtcggcggcagctttgccggtctcgccgccgccctgcaactcggccgtgcccgtcgcaaggtcaccgttctcgataccggcctgccccgcaaccgcttcgccggccactcgcatggtctgctcggccacgaccataagccgccgctggacatcctggccgaagcgcggcggcagttggtgcgctatcccacgatcaggccggtcaacgcccgggccgacggcgtctccggcgccatcgacgacttttccgttctcactggtgatggtgggagccttgcggcgcgtcgcctgattctgagctatggcgtcgttgaccagatgcccgatgtccccggctttgccgaaagctggggaacgtccgttgtgccctgtccctactgcgacggcttcgaggtcgccggccagcattggggcctcgtctggtccggcccacggtcgcacagccaagcgaagctgttcggcgattggaccgaaaagctgacggtcttcgccgacggacacgacctgtcgcccgccatccgggccgacctggcgcgtcgcaacgtacccgtcgtcgatggccggattgccgggatcgtcggtcgtgggggtcacaatgccaccgtcaagctctacaccgtccccgataccgacgtcgacatcctgttcgcgcagccgagcatcaagccgtctgcgagcctgcacgagatcctgggccttgccacggtcgacacgcccttcggcatcgccctcaaggtcgacgagcgccgcgaaaccagcatgcccggcatctacgcggccggcgacctggccaaccccgggatgccttcggtcaccactgcatcatggcaaggcgcaatggcaggggtcttcgcgcagcagtcgatggtggtttga

SEQ ID NO: 8474 - DNA, 909 bp, Methylobacterium sp.
atgcggtttgatgcgatcgttgtcggcggcagcttcgccggcctctccgcggcgctctacatcgcccgcgcccgccgcagggtctgcgtcatcgatgccggcgcgccccgcaaccggttcgcggccgcctcgcacggcttcttcgcgcaggacggcgagaacccgctggcgatgatcgccgcggcccgtgcccaactcgcggcctacccgaacaccaccctcgtcaccggggaggcggtgtcggcacgggcgcagggcgacggcttcgccgtctcgctcgcggaggggcggcggctcgaggctgccaaactcgtcctcgccttcggcatcagcgacatcctgcccgaccttccggggttggcggagcgctggggggcaagcgtgctgcactgcccctactgccacggcttcgagttcgccgggcgcgtcctcggcgtgctgtatgctgggccgaaatcggtccatcaggcggagctcgtcgcggaatgggggccgaccacgctcttcctgagcgggaatccggcgccggacgcggagtccaccgcgcggctcgccgcgcgcaaggtcaggatcgaacccggcccggtccgggcgctcgcgggcgacggcggcgccctgtcggccgtcgtcatggcggatggccggacggttgcgctcgacgccctcttcgtcggcccccggtaccgcctcaacagcccgatcgccgagggactcggctgcgccgtggacgaggggatgctcggcccgacgatccgcaccgacgcgatgaaggagacgacggtgcccggcgtctacgcggccggggacgcggcccggtttccccatagcgtggcctgggcgtcggccgacggcgtgacggcgggggtgtcgctgcatcaggcgctggtgtttccgcgcttggcagcgtga

SEQ ID NO: 8475 - DNA, 558 bp, Methylobacterium sp.
atgaccgcgaccgccacgaaagacatcatccaaaccttcgagaaggtgttcgagccgatcgaccgcgagcggctgcacgccctctccgagaagggccgggccgatccaagcgtggtgaagaccgtgcgcgcccgcacgatcgcggaggggcgccgcttccgccacctcaactacatccgcaacctcgacgcccacatcgtcgacgagccgccggccttgctcggcgacgacaccgccccgaacccgaccgaggccctgctcgcggcgttgggcacctgcgtcgccgtcggcctccaggccaacgcgatcgcccgcggctggaccgtgaagggcatcgaggtcgaatcggaaggcgacatcaacatcacctcggtttggggcaccggcgacctctcggagaagccggtcgggctcactgccgtacggctcaaggtgcatctcgacatcgagggcgcgacggccaccgaactcgacgaactcgtggcccatgccgggcaatggtcgccggtgctcaacacggtgaagaaccccgtcgccgtcaccctggcgcgggcctga

SEQ ID NO: 8476 - DNA, 10764 bp, Methylobacterium sp.
atggccgttaagctcaatctccaggatctgaccttcatcctcaagcagatcaagatcgccgaggcgcatgcgagcggcatcaagctcacggaactgcgcctcgacgccgctggcacgccgctcgtggagcgtggcctctacgacgccaccggcaattggctcggcgatgcggcggctccgaaggcgatcccggacccccacgtgccctacggcctgcgcaccgtcgacggcaccttcaacaacatcgtgcccggccgtgagacctggggttcgtccggccagccgatgccgcagaatttcgatccgacctacctcaacgatgcggacggcgacacgatggcgctcggaccgggcgctccggtcattacgaacaacaattacggtctgtccggctccgtggccgacgccgatccgcgcatcatctcgaatctcgtggtcgatgcgagcctcgacaacccggccgccattgctgcggcgctgcggatcgccggctcggagaacgtcatcgccgatcagcgcgccatcaccgccgcgcgcgaggccctgaaggccgccaaggcggcagacccggcgggcgaccacacgaccctgcaggcgaacctcgatgcgttgctggagcagaccggcgtcaccgtgaccaacggctccatcgacgtcctcaacgtctcgcccgacgagggcctgtcgaagcccttcaacgcctggatgaccttcttcggccagttcttcgaccacggcctcgatctgatctccaagggcgggaacggaaccgtttatgtcccgttcgccgccgacgacccgctggtgctcggaaaggatggcgtcgccggtaccgccgacgacctcgcgccgcatctgcgattcatgacgctgacgcgcgccacacccgtcgagggctcgcagcgcaacgtcacgacgcccttcgtcgaccagaaccagacctacacctcgaacgcctcgcaccaagtattcctgcgcgaatacgcgctcgtggacggacggcccatcgcgaccgggcgcctgctcggcggcgcggacggaggcctcgccacctgggccgacgtcaaggagcaggcgcggacgaagctcggcatcgagctgaccgacgccgacgtttccgccgtcccgcaattgctggtggacgcctacggcgagtttgtccgcggtgccaacggcctgccgcaggtgatggtcggcatcgggcccggagggcaggccgtctatgccagcggaagcctggccgagccgctcaagctcgcagcgatccagcttcccgtcggcacggtgctgttgggacccagcaatacccagaacgtcatcgatgccggtgagacggtcgcggcggcccgcaccctcaacgccttcctcgacgacatcgcccacaacgcggtgccggtcgtcgtcaatggcgtgctccggcccgatgccgacgcgcttaccgggaatgcggttccggtaggtcagaccggccggaatctcgaatacgacaatgaattgctcgaccggcacttcgtcaccggcgacgggcgcggcaacgagaatatcggcctcacggccgtccaccacatcttccattccgagcacaaccgccaggtcgacgcccagaagctcacgattctgcagtcgggcgatctcgccttcatcaacgattggctggcaaccgacatcgcggcccttccggccaatttcgcgcagatgacgccgctggcccagctcgcctatgccaacacgctgtcctgggatggagagcggctgttccaggcggcgcgcttcgccaccgagatgcagtaccagcacctcgtcttcgaggaattcgcccgcaagatccaaccgctggtcgatcccttcgtgttcaactcggtgaccgagatcgacccgtcgatcttcgccgagtttgccaacacggtctaccgcttcggtcactcgatgctgaccgagaacatgccgcggatcggagccgacgggcaggcgctcgatgccggtctcgggctgatcgaagccttcctcaacccggtggcattcgacaacgacggcaggatgtcccacgacgagagcgcggccgcgatcatgcgcggcatgacgatcgagcgcggcagcgagatcgacgagttcgtcgtcggcgccctgcgcaacaacctgctcggcctgccgctcgatcttgccgcgatcaacatcgcccgaggccgagacaccggcagcccgacgctcaacgaggcgcgcgcccagctctacgccgcgaccggatcgaccttcctcaccccctatacgagctgggtggagatcgcggccaatctgaagaacccgctctcggtggtgaacttcatcgccgcctacggcacccacgccaccattgccgccgcgaccacgctcgacgccaagcgcgacgcggccatggcgctggtcttcggcggcgagggcgcgccggcggaccgcctcgactacctcaattcacgcgggagctgggccggacgggagacaggcttcaacgccgtcgatctctggatcggcggcctggccgagaagcagatgccgtttggcggcatgctgggctcgaccttcaacgccatcttcgaagcccagatggagaacctccaggacgccgaccgcttctactatctcacccgcgtccaggggcagaatttcctcaacgagctggagcagaactccttctcgaagatcatgctcgccaattcgagcctgtcgctgccggggcctgacggcatccgcggcacggcggacgacatcgtgccgcgccatatcggcgtcgatgccttcgccgattacgacttcgagctggaggtgaacgccgccaaccagctcgaccagaacggctccgcgccgggccgcgacccgaccggaaacgaccccgtgctggaggcgatgggcctcggcaaggtcgtgcgcgacgaccccggcaccaccgccgacgagggcgcgagcggcttccacgcctcgatcaacgccctggtccggcgctacggcgccgacggcaccccggccggtgcgctcgtggacggcagcgaggacggcatcggcgctgccggcagcccggtaacctgggccgacctcaaggcgaacgcggccaagctcggcatcgccctgactcagaccgacatgctggacgcgccgatgctgcggatcggcacagacgggcgcctcgccttcgcgcccggttcgtccgtgccccaggcggtgacggtggcgaacggcagcttcgagggcttggcgctggtggccggccaggaaggcgtgatcctcgacggcaacggcaactacaccaccacgagcccggccggctggaccatcgccgggggcgtcggcggcctctacgcgccgtccgacacggtcatcgacccggccggccgcgacggcgccaacgtcgtgtggctgcgtggcggcgccacactctcgcaggagggcggggccagcctccaggctggcgtcacctacacctacagcttcaaggtcggagaccgcaccgacttcacgtggccgggcgccgaggcgcgcctcgtggcggccggcgggacgaaccccgtcaccctcggaacgctgaccctgacggagccggccgacgggcagtggggcacgttcaccctcgcaacgggcgtcgtcccggccgcgctcgcgggccttcagctccgcctggagatccgcaacaccggcagcggcgacgcccagatcctcgtggatgatgtcgagctcgtgcggacggcgccagcctaccggtccgatctgaccccagggcagacgcccggctacgatccggccgccgacccgttcctgcgcgacgccgccggcaacgtcctgcgcaccgggcagagcatcgccagcccggccgccgacatcgacgcgactgtgatcgatccggccgcgctcaaccagccgttctcgaccgggcactaccttcgcttcaccggcggcgagcacgtgttggtgggcggcaccgacggaaacgacaccatcatcaccgatttcggcgatgacggaatctggggcgatgcgggcgacgaccgcatcgaggcgggcgcgggcgtcgatctcgtgaacggcggcgcgggcgacgacatcatcaccgattccggcgacaccggcgacttcctcaagggcgaggacggcaacgacgtcatcgccaactccaacggcatcgacatcctgatgggcgggcgcggcaaggacgcgatcttcgtcggcgtcgatgcgaccgaagtcttcgctggcgagggcgacgacttcgtgatcggcggcgacgacgccgacctcctgatgggcaacgagggtgacgactggatcgagggcggcggcgggttcgacaccacggccggtgacaactcggagctgttcttcaactcgaccatcaagggccacgacgtgatgttcgccggtggcgacgagcatgatttcgacggcgagtccggcgacgacatcatggtccagggcgagagcgtcatgcgcaacgagggcatgttcggcttcgactgggcgatctataagggcaaccagatcgcggccaatgccgatatgcgcatcccgatcttcaccaccgaagaagccgacattctgcgcaaccgcttcgataagacggaggggctctcaggctggcgactgaacgacacgctcatcggcgacgaccggacggcggcggccgacgcggatgccgaggagcccgccggcgcacccgtcaacgcaaccaacgagggcgtgttcttcaacgacggtctcgacgcggccggcatcgcccggatctccggtctcaaccagatcgtgtctctcgcgccgggtcagcaattcttcgaagccggcaacatcctgctcggcggcgcgggcagcgacacgctccaaggcaacggcggtaacgatatcctcgacggtgatcgctggctgaacgtgcgcatcagcatccgcaatcccgcggatgccagccaagaaatggcgacggtcgacagcctgaagcacatcttcgacaacagcgccgccaaccaagcgcgcggctgggccggaaagtcgctgttcgagctgatgatcgaccgggcgatcagcccgacgcagctcaccatcgtccgcgaggtgatcaccaccggcgcgacggcggcggacgtggacaccgccgtattcaacgatatccgggccaactacacggtcacccgtgccgccaacggcacgctgacggtcgcccacaccacgctcagcgatccggccgtcgatgacggcacggacacgctgcgcaacatcgagaaactgcgcttcgccgacggcacggtcgatgtcgcgttggtgctcaaccagcccttcgaccggctgaccatcacgccactcgacgccgacggcgacgattcctcgacgctcgtcgcgacgctggtgaaccaggtgaacgcgaacacccgccccgtgaccctgcagtggcaggtcctcggcgacaacgggcagtggcggaacgtgacgggtgcggacggccagctcacaaaccagggcacgcgcttcacgccgaccggcgcgacgggcctcgagatccgggtggtcgcgaactggaccagcacgatcgccggcagtaccagcgcgcagcagacggcctccgtccaaaccgctttcgtcggcaccgccgccgccgaggatatcttgggctccgcgagcccgaacgtcattctcggacgcgatggtgacgacgacatcgagggcgatgtcggcaacgatgccatctacgccggcagcggcgacgaccgggtcgatggcggcgaaggcgacgacatccttctcggcaacgacggcgccgacaccctgatcggccggaccggaaacaacacgctcgacggcggcaacgacgacgatcagctctccggggggcacggcaacgatcgcctgatcggcggcgctggcaccgacaccgcaatcttctcgggcccgatcgcggcctacagcttcgagcggaacgcgcaggccgaggtcgtcgtcagcgacaacctcggcgcggagggcgacggcatcgacactctcgcctcgatcgagcagatccagatgggcgaggacatcacgccctacgcgctcggcgccaacggcacggcggccatcgatatcgtcgtcgggaccaccggcaacaacacgctcagcggcggcgcgggcaacgatctcgtcttcgcgggagcagggaacgacaacgtcctgtggcggacgggcgacggccgcgacttcgtcgatggcggcaccggcacggacagcttccggatcatgaacgggaccgatccggtccagcagctcacgctggctcaggcgagggcgcagttcgcgaacctttcgttccgcgacgacacgcaaaccgtggtcgtgcgcaacgggatcgtcatcgccgagctcaagaacgtcgagggggtcgtcgtgaacagcgtcgcgaccggcgcacccgtcgtgacggacccgacgccgaccaacggcctcgtctcgccgactgagggccagccgctcagcgcgctggtcgccgcgatccaggacgccgacggtctcggaaccttcgcgctccgctggcagcaatcgggcgataacggccagacttggacggatatcgcgggcactgcggccggcacgctcaactacacgcccggccaagctcaagtcggcgatgtcctgaggctgcgagtgagcttcaccgacggcgccggcaatccggaagagctgttctcgagcccgaccggcgtcgtcggcgacaccttcaacggtacggcgttcacccggaccttcaatggaacggctggcgacgacatcgccaacggtgccgacaccgccctcttcggaatcccgccgaacgacacgatgaacggcggcggcggcaacgacatcctgaacggtcgtggcggcaacgatacgttcaatcaggtcagcaccgacgggcgcgaccgcgtcgatggcggcaccggcactgatacgtatcagttgaacggcgtcgcggggtccgaactcttccgcatttacagccgctcggcctggctgcaggtcgccggcaacacggatgcgcagctcgcggcttcgaccgagatcgtcatcacccgtaacggcacgggtgccggcgccatcgtcgccgaactcgacaatctcgaggagatccgcgtcaacgcgctccaagtgacgtcgcccggcggccagaacggcggggccaatggcggcgacacgatccaggtgatcggcagcttcaccggcaccagcctgaacttcaacaccatcaccatcgacggctcctccggcgacgacaccgtggacatggcggccctcgcctcggcccaccgcatcgtcttccgctcgaacggcgggcacgacaccatcgtcggcacgctgcggccgcaggacgtgatcgaactgccggccggctcgaaccgggcggactacgtcacgactgcgggcgcgaacggcatgacgaccctcaccaacgggtcgcacaccatcaccttctcggccgctggcggcatgccgcggatcgcagtcgaggcaggctctgacgaaggggacggcgagggcgtcaccggcgccttcgcctatacgcagggcgacatcgacgggctggaggcgctggtgcgcggccagcgcccggccaatgcgggcgacgacgacgtaccgacgggctaccgcgagctcagcgggcacggcaacaacctcgaccatgcgacctggggcagcgccgaccaggccttcatccgcctgacccaggcccgctacggcgagcccgacgccaacggaaaccgggcgatcaacccgatcttcaatggcctcgacgcgcgcaccatcagcaacatcctcggcacgcaggaagccggcctgccgaaggccggaaatgacgctaacatcttcttcatggcgatgggccagtacatcgaccacgggctcgacttcctgcccaagggcggcaacggctcgatcgtgatcggcgcgcctggcggcggggcgccgggctccaacaacccggccgacctcacccgcggcacggtcatggcgaccgacgccaacggcatcccgcagcacaagaaccagacctcaccctacatcgaccagaaccaggcctacggctccaacgcgatggtcggccagttcctgcgggagagcgatggggcgcagggcgtcggcatgcgacttctggccggggcaccggacccgtccaaccccgccttcaacctgctgccgacgctgcgcgagctggtcaaccaccactggcaggccgacacgatcttcgaaggtccgaacgggccgatcagcttccggacctattacaccaacttcgccctgtccgagggggtgacgggcaccctgttcaacacggagaccggcgccttcgaccctcaggtcctcacgaagctcgtgggcgacttcatgggttcgggccaccctctactgctcgacaccaatcccttcatcagcgtcctcgaccacttcgtggccggcgacgggcgggcgaacgagaatttcgccctcacctcgatccacacgatctgggcgcgcaaccacaactaccacgtcgagaaactgcttgaatccggcttcgagggcacgcccgagcaggtgttccaggccgccaagatggtcaacgaggcggagtatcagcgcgtcgtcttcgacgagtaccttgagacactgatcggcgggctgcgctcggacgggacgcacggcttcgaggcctacgatccgagcgtggatgtcgcgatcagccacgaattcgcggcggcggtgttccgcttcggccattcgctgatcgggcagacgctgaacgtgaagggcgcggacggtcagaccattccggtcagcctgttcgacgccttcctcaatccgagcaacgatccctcggtgttcaccgcaccgctgcctcccggctacgtgccgcaacccggctacgcccagtacggcgtcggcggcatcatcggcggcaccatcgagcaggcggccgaggacgtcgacttcaacatcgtcgacgcggtccgcaacgacctcgtgcgcatccgcgccgacctgttcgccttcaacgtggcccgcggctgggacgtgggcctcggcaccctcaaccaggtccgggccgatctcgccgcctccaccaacccctacatccgggacgcggtcggttttgccggcggcgacctctcaccctacacctcctgggaggatttccaggcgcgcaacggcctcagcgacgcggtgatcgcgcagttccggcaggcctacccagacctcgtccttgccgcggcggacatcgcggccttccgggcggtcaacggcgatatcgcggtcgcgatgcaggccgacgggaccggcgtcgtgaaagggatcgaccggctcgatctctgggtcggcggtctcgccgagaagcacatcaacgggggcgtcgtcggccagaccttctgggtcgtgctgcacgagcagttcgaccggctgcaggacggcgaccgcttctactaccttgagcgcttcgacaacttcgacttctacgagaacttcatcgacggccagggcttctcggacatcgttgcccgcaacaccggcttgacggtcctgccggaacacatcttcgaggtgtccgacgaggacgggccggggacggagcccggtgacgacgatgacgacgacggcgccaccgatccggtgggcggcggcgaagacgacgaagacgatgacggcacgaccgatccggtcggcggtggcgacgaagatgatgatgacgacgatgatgacggcgtgacggacccggtcggcggcggggatgattccggcgacgacgatgatgacgacgacggacaaggcgacggggacgggacgaccgacccggtcggcggtggcgacgatggcgaggacgacggcgaggacgggcctggcaccaatccgcccgtgaatcacgtccccggcgtgatcgcgggtggggcgaacggggacgtcctcaacggcacggccggagcggacaccatcctcggcttggacggcgacgacaacatcctcgccgacggcggcgccgacgtcgtccgagccggggcgggcaacgacttcgtcgatgccggcgggggccgggacgtggtgttcgccggggctggcgacgacgatgtcctggccgggggcggcgcggacatggtctacggcgacggcggcaacgaccgcatcctcgccggggccggcaacgacctcgtgaccggcggcgccggccgggacacggtcatcggcggcgagggcgacgatctgttcgtggtcgagatcggcgacggcgacgacacctactggggcgacgagatgggcggcggcgtggggagcgacacgctcgacatgtcggccatcaccgccaacatcgcggtcaatctcgggacgggcctggcgggtcgcggcagcgcgacgagcacccaatcgggtcgcgacgtgctctggggcgtcgagaacgtggtcaccggttccggcaacgacgacatcacggcgagcgacgccgtgaacgtgatggatggcggcgagggaagcgacacctaccgcttcggctccgcggcagccgcggacggcgacaccatcgagggcttccggccgggcgacaagatcgacctcagcgcggtcgacgccaatgccggggcggccgggaaccaagccttcacgctggccaccggcgccgccttcaccggcgtcggtcagctcctggtgacgcaggagacgcgggacgacggggattacgtcgtcgtccaggggaacaccggcggcgatgcctccccggagttcaagctgtcgatcaagggcaacacggcccccacggccgccgacttcgcgctctga

SEQ ID NO: 8477 - DNA, 267 bp, Methylobacterium sp.
atgaaggccctgaccttcgctctcgcaagcaccctcctgctcacgcctgccgccttcgccgccgaagggtcgggcactagccgctccggtaccgccgacaggacggggccgaacgatgccggttccggagcctcgcccggagcggccggaagcggccccacctccggcgacaagagccgatccggcacggccaacagcacggggccgaacgatgccggctccggcgcctcacccggcgcccagggcaaaggccacgaggcccgataa

SEQ ID NO: 8478 - DNA, 282 bp, Methylobacterium sp.
atgtcggaatccatgtcagacgtttcatcgaacggcaggatcacctggacccaggacgggatctccgaggtgcccctgcagcgcttcaccggccgggtcggcgcgatcgaggtcgccaccgtcgagttcgacggatcgaaccgcctctggacatggtggagcccgttgtctgaagacatctggggccacgccaaggacgcggatggggccaagcaggccgccgacgtctggcttcgcgaatggttggagaacttccggaccttcttcgaagccggccgctga

SEQ ID NO: 8479 - DNA, 1077 bp, Methylobacterium sp.
atggccgccagcgcccgcatcgtggagtccgcgccgcccgacgttgccgggatcgtgcgcgagcgcttgcgcccgcgcctcgccgcgatcgacgccggggaataccctgctgacatcctgcgggcgctcggggcgacgggcgcctatgggcaccacgctgacggcacggcggcggggctgctcgccgccatcgacgcgatgacggaggcggggcaggcctgcctctcaaccgccttctgcatgtggtgccaggacgccctggtctggtacctcgcccgcggcgacgaggccggtccgcgccgccatctcgcggccctggcctcgggtgcggcgctcggcggcaccgggctgtcgaacccgatgaaggcattctccggcatcgagccgctggcgcttcagggcgagcgcgcgggcagcggctaccgagtgcgcgggcgcctgccctgggtctcgaatctcggccccggccaccgcttggccggcatccttgccctccccgacggccggcgcgtcatgggcctgttcgaggctggcacggacgccgtctcgatcgccgccaacgcccgcttcgtcgcgctcgaaggtaccggcacctacacggtgatggtccgcgacgcgcatctgtctgaggccgacgtgatcacgcatgatgccgccgccttcgtgccgcgcatccgcaacggcttcgtgctgctccagaccggcatgggcctggggctcgcccgcggcgccgcggcgctgatgcgcgcggatgcccgcggccggacgaacgcggcgttcctgccgctcggtccggaggcgatcgaagcgcgggcggacgccctgcgcgcgcgcgtcgcggccgctgccgaggcgcatgccgcgaccgaccgcgcgaccttcctggagacgctgcggctgcgcctcgacgtgtcctggctggcgctggaggcggcgcaatcggccatgctccaggccggcgcgcggggctatctggaaggcgcggaggcgttccggcggctgcgcgaggcgcagttcgtggcgatcgtcacgccctcggtgaagcacatcaccacggaactcgcgcgaggcgcctga

SEQ ID NO: 8480 - DNA, 765 bp, Methylobacterium sp.
atgttttcggattcgatgtcgcgttccgttccccgcctcgccctcgcggccgtcgcctatcgctacggcccgactccggtgattgatcgcgtcgatctcgagatcgacgcgggcgagcgcatcggcatcctcggccgctcgggcgtcggaaaatcgaccctcctgcagatcatggccgggctcgtcgccccctccgccgggggcgtgcggctcgacggggcgcccgcgcgcgggccggtgccgggttgcacggtgatgttccagcgcccggccctgctgccctgggcgagcgtgctcgacaacgtgctcctgcccgcccgcctctccggacgccgcgaccgggcggcgtgcgaggcgccggcgcgccgcctcctcgacgatctcggccttgccgagcgcgcggacgccaagccgcaccagctctcgggcgggcagcagcagcgggtggcgctggcccgggcgctggcgagcgaaccctcgatcctgctcctcgacgagccgttctcggcgctcgatcccgagatgcgggcgagcctgcgcgccgacgtgctgcggctcgcccgcgcccgcgacctgacgctgatcgtcgtcacccacgaccttgccgacgtcgccgcgctcgcggcgcgggcggtcgtgctcgacggacgaccggcccggatcgccgcggatttcgccctcggtgacgacgcggaggcggacctgcgccgccgtctcggtgccctcccccggcccgtgtccggcgtcaccggccgcgccgcctga

SEQ ID NO: 8481 - DNA, 1065 bp, Methylobacterium sp.
gtgtccctgttcgaacgctacctcaccctctgggtggccctgtgcatcgtggccggcatcgcgctgggccacgtcatgcccggcttcttccacgccgtcggctcggccgagatcgcccgggtgaacctgcccgtcgccgtcctgatctggctgatggtcatccccatgctgctcaagatcgacttcgccgcgctgcgcggcgtcgggcggcactggcgtggcatcggcgtgacgctgttcatcaactgggcgatcaagcccttctcgatggcggcgctggcctggctgttcgtgggcaccctgttccggtcctccctgccagcggaccagatcgacagctacattgcgggcctcatcatcctggcggccgcgccctgcaccgccatggtgttcgtgtggtcgaacctgacgcggggcgagccgcacttcaccctgagccaggtggcgctcaacgacgccatcatggtggtggccttcgcccccatcgtcggcctgcttctgggcctctcggccatcacggtgccttggggcacgctggtcctgtcggtggggctctacatcgtgattccggtcctcatcgcgcaggtcctgcgccgcagcctgctcgcctccggcccggccgcgctcggccggctgctcggccgactcggaccggtttcgctggcggcgctcctcgccaccctggtcctcctgttcggcttccagggcgagcagatcctggcccagccggcggtcatcgccctgctggcggtcccgatcctcatccaagtctacctgaattcgggcctcgcctacctgctgaaccgcgtcgcgggcgagccgcactgcgtcgccggcccgtcggccctgatcggtgcctcgaacttcttcgaactcgcggtggccgccgccatcagcctgttcggcttccactcgggcgcggcgctcgccaccgtggtcggtgttctcgtcgaggtgccggtgatgctctcggtcgtgtggatcgtgaaccgcagccggggctggtacgagcggggtggggcgcgcaaggacctgagcctggaccctgcgtcccgccaggtctga

SEQ ID NO: 8482 - DNA, 1827 bp, Methylobacterium sp.
atgcgggtggcctcgaagagcgcgaaaggccttcatgcgatgaacgacgcgaccgacgacgattggctcgaactcattcccgacgaggtggcggagactccggcccgcgccggcgcctggacgatcgcggtgatcgacgacgatccggccgtccacgagggcacccgctacgcgctcgccggatacagcctcgacgggcggggcctcgacatcctttccgcccattcggcccaggaggcgcgggcgctgctggcggagcggcgcgacgtcgccatcgtgctcctcgacgtggtgatggagaccgacgatgccggcttgcggctcgtcaactacatccgccgggagttgagggaggaaaccgtccgcatcatcctgcgcacgggtcagccggggcaggcgccggagcggcgcgtcatcgtcgattacgacatcaacgactacaaggcgaagaccgaactcaccgccgacaagctcttcaccagcctcaccgcggcgctccgggcctatcagcagctccggcggctcgacgagacccggcgcggcctcgagatcatcatcgacgccgcgccgatgctgctcgaccacaagtcgatgcagcggttggccgaaggcgtgctgacccaggtcgcctccctcctcaacgtcgattgcgccggcatcctcgtgctgcgcgaggacgagcgggatcacaagcgcgagggcggcttcagcgtgctcgccggctcggggctctacggcggctatgtcggctgcgatcccggctggccgctcgatcccggcatccagcccctggtcgagcaggccttcgccgcgcgccgccacagcttcggcgacggtctctccacgctctacgtgcagaccgcgagcggcagcgagatcgtcgcgctgatcgacaccgatcgcccgctctccgacaccgaccgggcgctgatcaccctgctggcaggacgcctctcggtcgccttcgacaacgtgatcctctacgagcggctgcagcgcgccaacgtcaccctggaacagcgggtggtcgagcgcaccgccgagctgatccgcgccaaccgccgcctcgacatgcagcgctcggacctgcggcgggccaacagcctcaagaccgagatcctgggcaccatcgcccacgacctgaagaacccgctctcggtgatcctcggccgctccgaaatgctgaccgacctgatcggtctcgattcaggcgagccgtccggcttggagcaggcacgcatcgcgatgcggacccaggtcgatcacatccgcacctcggccacgcgcctgatcgacatgatcgacagcctcatggccgatgccatgaacgatgccctcgacatcacccttcggcgcgagccggtcgatctggccagcctcgcccgcgaggtctgcgaggccaaccgcccgctcgccgattccaagggccagagcctgaccctggatctcgccgcgccgctccatctctgcggcgatgccgagcggctgcgcgaggcgttcgacaacctcgtctcgaacgcgatcaagtattcctatcccggcggcgcgatcacggtgagcgtgcgggaggagggcggcgactatgtctgcgcggtggccgatcagggccccggcctgtccccggaggatgccggccgcctgttcggccgctaccagcgcctctcggccaagcctaccggcggcgaaggctcgacggggctcggtctctccatcgtcaagcgtatcgccgaactccacggcggctgcgccgaggcgttctccgacgggccgggacggggggccgtcttctcgatgcggtttccgaaggagacggtgggattggtgtag

SEQ ID NO: 8483 - DNA, 756 bp, Methylobacterium sp.
atgacgccgaccggcccccacatcgccgtcgtcgacgacgaggcggatgcccgcgccatggtcggcgaatacctgcgcctgcacgggttcgacgtggccctgtgcgagggcggccgggcgctgcgggcgcatctgcagatacgcacgccggacctgatcgtgctcgacctcaacatgcccgaagaggacggcctctccatcgtgcgggacctcaaggcgcgaagcccgatcccgatcatcatgctgacggcgaccgcaagcccgatcgaccgggtggtggggctcgaactcggtgcggacgactacctgcccaagccctgcgagctgcgcgaactcgttgcccgcgtgcgctcggtgctgcggcgggcgcaaggcacgccgccggcccctgccccgaccaccactccggcctctgcgccggccgccgcaccggagaccccatcgcgaacgatccggttcggaacgaagtggctcgaactcgacgccctgcgcctgcgcgacgatgccggcatggagcagccgctgacccgctcggagttcgatctgctcaaggccttcgccgaccatccgaagcgggcactgtcccgcgagcggctgctcgacctcgccgatgcccgcgatccggacgcgttcgaccgggcgatcgacgtgcgaatcaaccgcatccgcaagaaggtggagccggacccggccaatccgcgctacatccgaaccgtgcgcggtctgggctacatcttccggcccgaaggtgactga

SEQ ID NO: 8484 - DNA, 2292 bp, Methylobacterium sp.
atgcgggtcggccggaagattgccctggtcggcggtgtcccgatcctcgtcgccgcggccatcgcggcggcgggctggttcctgctcgcccagggcgagcgcgcccgcgccggcgcccttctcgccgcccgcgtctaccatgacctcatccaggcgcgatccgtgcgtgacgacttcgttgccgcccgcgccgacgagcgcgacgcgatcgcgacgcggttctttgacctgaccggccgggccgggagcggtctggagactctccaggggcaggctcgcacccggcgacaggccgagcgggccgccgcggcgcgccaatccctcgaccgctacgtagcgcggatgcgcgagttctccgcggtcgcccacgagaacgacggcctcatcgccgagatgggccggcgcgcgagccggctgaccgacctcgccgagcaggcccgccagcgccagcaggcctcgaacgtcgacctcgcctggacgctgacggggaaggtgaaccggctgcgcgccacgcgggacgcggtgacggggctcaacgccgtgctggccgccgcgtggcagctcgccctcggccgggaacgcggcgcgtcgccggagactgagcgcgccgcgcgcacccgcctcgtccatgccggccgcgacgtcgccgcggcgctgcgcgccacctcccgcgagatcgaggctgcggaggccgagcgccggaccgctctcgacgccgcgctcgactcggccgcgggcgaccggctgaccgaatggggcgagcgcctgctcaagatcgtgacctcagagcagcgcacgctcgacgacgaggtggcgcagctcctcgcctatgcgggggaggccaacgcgacgggccaagcgacgcagaacatcggcatcacgacgctcaagctcggccagcgcaccgccgaggcgctggtgcgtcgggacgcggaggccgtttccgccatgctcggcgagggcgagcggctctcggcgagcgccgccgccctgccgatctcgccgctgatccagtccgagatgatcgaggccatcgacggctggcgcgcgaggctcgccaccaccgtcgacgggctcaagcggcagaacgcgatgatcgccgagatggacggcctcgccgccggcctgagcgaggccgcccgcgcgctgaacgacgacgcgctcgaggatgccgaccggttcggcaccttcctgggccagctcctcctcgccggggcggccgtcggcctgctgctcggcgcgctcgtcgcgctggcggtggcccgctcgatcctcgtacccctgcgccagcttcagggcgacatgatcgcactggccgccgatccgaaggcggaggggctgtccggcacgcagcgcacggacgaactcggcgacatcgcccgcgcgacgaatttcttcgtgactgagatcggtcggcgcgagcgggcgctgcggcaggccaaggaccaggccgaccacgccctgcacgatctgcatcaggcccaggacgacctgatccgcgcggagaagctcgcctcgctggggcagctcgtggccggcgtcgctcacgagatcaacacgcccctcggaatcgcgctcaccaccgcgacgctggtgcgcgatgagacgcggaccttccagggcctggttaccgcaggcacgctctcgcgttcgcgcctgacccatttcgtcgatcgggtcggagaagggacacaactgctctgtgccaacctgacccgcgccgccgacctcgtccacggcttcaagcaggtggcagtggaccgggccagcgacgagcgccgccgcttcgatctcgatgtctggctcggcgagttgctggcgagcctgcagccgatgctgcgcaagggcggccacaggatcgagcgtgacgttccgtcgggcatcgtcgtggacacctatcccggcgtgctggcgcagatcgtcaccaatctcgtcgccaacgccgtggtgcacggtttcgctgcggcccggcggcccggcaccatcacggtgcgtgtctcgaacaccggatctctcgtgcggctggaggtgagcgacgacggaagcggcatcgcaccggaacatctcgggcggatcttcgacccgttcttcaccaccgcccgctcccgcggcagcaccgggctcggcatgcacatcgtacacaacctcgtgacggccaagctccagggccgcatcaccgtcgagagcgagctgggccggggcacgcgcgcgcggctcgaattcccgcgggcgcccggcgatgccgagcggccgggcgcggcccgccggcccgccggggtgcaggccccgtga

SEQ ID NO: 8485 - DNA, 858 bp, Methylobacterium sp.
gtgagcgggggtgcgatcgaggcggcgctcgccgtcgagcgggaggtcgcggctcccgcgccgcgccggactggaatcaggctcggatcctccggccaggccctcgaccggctggccccgctcgtcggactcgcgggtctgctcgccctgtggttcgcgggcgggctggttctggaaagcgtgccggcctacgccgccttcgccggcttcgcgccgggacccgccctggcttccttctgggacctgatcgcctccggcgaggcgtggcgggccgccgccccgagtctcgcgcggatcggccagggcctcgccgtcgcgtttctcctcggtgcgccgctcggactgctggtcggctcggcgccgctcgccgagcgcatcctgcagccgccgttccaactcctgcggatgatctcgccgctcgcctggatgccggtggcggtgctcgcctttccgagctgggacggggccatcgtcttcctgatcgcggccgccgcgatctggccgatcctgttcgccaccgccgccggcgtgaagcgggtcgatccggtctggctcgccatggcgcgcaatctcggcgccggccggctcgcggccctgcgcgccgtcatcgtcccggcggtgctgcaggacatcctcaccggcctgcggctggcgctcggcgtcgcctggatcgtgctggttccggccgagtatctcggggtcacgagcgggctcggctacgccatcaacgacgcccgcgacaccctttcctacgaccggctcgccgctctcgtcctgctcatcggactgctcggctacgccctcgacagcctgctcgggcgtctcgctgcccgcgctcgctggattcccgccacgtaa

SEQ ID NO: 8486 - DNA, 1227 bp, Methylobacterium sp.
atgagcgcccccgacgacctctccgccctgtggacgcacgaatggacgcgcgccgactggacgcgccgcaacaccctcgacgcgctcgcccgcggtggcctcgccgccctgctcggcggcggcgggctcgccctgtcgggccgcgccgtgcacgcggccgaggacgacaccgtgcgcatcggctacctgccgatcaccgacgcgaccgcgctgctggtggcccatgccaagggcttcttcgaggaggcgggcctgaaggtcgccgagccgaccccggtgcgctcgtggtcggcgctggtcgagggatttgccgcgggcaagttcaacctcgcccacctgctcaagcccatcccggtctggatgcgctacaacaacaagttcccggtcaaggtgctcgcctgggctcacaccaacggctcgggcatcgtcgtcggcggcaagagcgggatcgaggacttcaaggggttggcgggcaagcgcgtcgcggtgccgtactggtactcgatgcacaacgtcgtgctgcaatacgccctgcgcgaatccggggtcgtgccggtgatccggggggacgccgggccgaacgagtgcgcgcttcagatcctggcgccgcccgagatgccggcagcactcgcggcgggcaagatcgacggctacatcgtcgccgagccgttcaacgcgctgggcgagttgagggccggcgcgcggatgatgcgcttcaccggcgacatctggaagaaccatccctgctgcgtcgtggtcgcccacgagagccagatcgcggccaggcccgaatgggccggcaaggcggtcgatgccatcgtgcgggcgcaggcctattgcgtgaagaaccgcgaggaggtcgcccggctgatctcgaaggagggccgcggctacctgccgatgcccgccgacgtcgtgatcaaggccaccaccgattacggcccggcctacgaggcgagcggcgcgatccgccaccccgattgggcggcgcaacgcatcgacttccagccctggccctatccgtccgcgaccaagctcatcgtcgaggcgatgggcaacaccgtggtcgagggggatgccggcttcctgaaaggtctcgatccggatttcgtcgcgcgcgatctcgtcgacgaccgcttcgtgcgggcctcgctccggcgctatccggaatggccgggcgcggcggatgacgccgcgctcacccgtcaggagaccctgagcctgtga

SEQ ID NO: 8487 - DNA, 342 bp, Methylobacterium sp.
atgctgaacgacgcgcagtggggggctctagagccgctggtgcatgcctgccggccgaaggcgaagaccccgtcgcaggacctgcaacgcacgctctcggccatcctgtggcggcaccagaacggggccaagtggcgcgccattccggacgagttcgggccgtggtggcgggcggcgcagatcttcatccgctgggcgcgtgccggggtgtgggagcgcctgctcgccctggtgcaggagcgcggcgtgcagctcggcatggtgttcctcgacggcaccaacatgcgggcgcaccagaaggcggcaggtgcagccaaaagggggggatctgcgaccgagtga

SEQ ID NO: 8488 - DNA, 378 bp, Methylobacterium sp.
atgctgttagatgcgcagtggggtgagttggagccgttgattgaggcctgccgcccgatggccaagacgccttcccaggagcttcggcgcacgatttcggccatcctctggcggcatcagaacggggccaagtggcgggccatccccgaagacctggggccctggtgccaggccgcgcagatcttcatccgctgggcgcgcgccggggtgtgggaacggttgctcgaccgaatgcaggagcgcggcgtcgcactgggcatggtcttcctcgacggcagcaacgtgcggggtcaccaaaaggcggcgggcgccgcaaaacgtatggcccgctccgtccgcaagtgtctctggatgccttggactgagcagtctgcttaa

SEQ ID NO: 8489 - DNA, 5793 bp, Methylobacterium sp.
ttggagccgaagctccttctgaagagccttcgtgcgtttcggaagggtgacttctcaactcggctgccgctggatctgacgggcattgagggggagatcgcgcaagcattcaacgatatcgtcgagctcaaccaggggctcgctcgtgaactcgacagggttgcccgcgcggtaggcaaggacgggcgcatcggcgagcgcggaaagcttccgacagcgaccggcgggtggaacgaatgcgtcgagtcggtcaacacgatgatcggcgacctggttcagcccaccaccgaggtggcgcgcgtcatcggggccgtcgccaagggcgacctcggccagaccatgcaaatcgagatcgagggccgtcccctgcgcggcgagttccttcggatcggcaaggtcgtcaacacgatggtggatcagctgaactccttcgcctcggaggtgacccgcgtcgcccgcgaggtcggttccgagggcaagctcggagggcaggcgcaggtcaagggcgtcggcggaacttggaaggacctgaccgacaacgtgaacctgatggcggcgaacctcactggccaggtgcgcaacatcgccgaagtcaccaccgcggtggccaacggcgacttatccaagaagatcaccgtcgacgtgaagggtgagatcctcgacctgaaatcgaccatcaacacgatggtggaccagctcaattccttcgcctcggaagtgacccgcgtcgccaaggaggtggggtcggagggcaagctcggcggacaggcgcaggtgaagggcgtcggcggcgtctggaaggacctgaccgacaacgtgaacatgatggcggaaaacctcaccggccaagtccgcaacatcgccgaggtgacgaccgcggtcgcgcggggcgatctgtccaagaagattaccgtcgatgtgaagggcgagattctggccttgaagctgaccatcaacacgatggtggatcagctgaactccttcgcctcggaggtgacccgcgtcgcccgcgaggtcggcacggagggcaagctcggcggacaggcccaggtcgagggcgtgggcgggacttggaaggacctgaccgacaacgtgaacatgatggcggccaacctcaccggtcaggtgcgcaacatcgccgaagttaccaccgcggtggccaacggcgatctgtccaagaagatcaccgtcgacgtgcgcggcgagatcctggaactcaagaacaccatcaacacgatggtggaccaactgaactctttcgcctcggaggtgacccgcgtcgcccgtgaggtcggctccgagggcaagctcggcgggcaggcgcaggtgcgcggagtcgccggaacttgggccgacctcaccgacaacgtgaacctgatggcggccaacctgacggggcaggtgcgcaacatcgccgacgtgacaacggcggtcgccaacggcgatctctccaagaagatcaccgtcgacgtgcgcggcgagatcctggaacttaagaacaccatcaacacgatggtggaccaactgaactctttcgcctccgaggtgacccgcgtcgcgaaggaagtgggttcggaaggcaagctaggcggtcaggcccgcgtcgagggcgtggctggcacctgggccgacctcaccgacaacgtgaacctgatggctgcgaacttgacggggcaggtgcgcaacatcgccgatgtgacgacggcagtcgccaacggtgatctgtccaagaagatcaccgttgacgtgaagggcgagatcctggagctcaagtcgaccatcaacacgatggtggaccagctaaactccttcgcctcggaggtgacccgcgtcgcccgcgaggtcggcacggagggcaagctcggcggacaggctcaggtcaaaggcgtcggcggcgtctggaagggtttgaccgacaacgtgaacatgatggcggccaacctgacggggcaggtgcgcaacatcgccgaggtgacgaccgcggtcgccaacggcgacctatccaagaagatcacggtggctgttgagggcgagatcctggagctcaagtcgaccattaacacgatggtggaccagctgaactctttcgcctcggaggtggtccgcgtcgcccgcgaggtcggcatcgagggcaagctcggcggccaggcgcaggtgcgcggcgtcggcgggacttggaaggacctgaccgacaatgtgaacatgatggcggccaacctcactggtcaggtgcgcaacatcgcagacgtgacgactgcggtcgccaacggcgatctctccaagaagatcactgtcgacgtgaagggcgagatcctggagctcaagtcgaccatcaacacgatggtggatcagctgaactccttcgcctccgaggtgacccgcgtcgcccgcgaggtcggctccgagggcaaactcggcggccaggcgcaggtgcgcggcgtcggcgggacctggaaggatctgaccgacaacgtgaacatgatggcggccaacctcaccggtcaggtgcgcggtatcgcagatgtcgtcacggcggtggcgcagggcgacctcaagcggaaactctcggtcgacgccaagggcgagatcgcggcgctggccgacaccgtcaacgagatgatcgagacgctcgccacctttgccgaccaggtgaccaacgtggcgcgcgaggtgggcgtcgaaggcaagctgggcggccaggcgcgggtgccgggcgcggcgggtctctggcgtgatctgacggacaacgtgaaccagctcgcggcgaacctcacgacccaggtgcgcgccatcgccgaggtggcgaccgccgtgacgaagggggacctcgcgcgctcgatctcggtcgaggcctccggcgaggtcgcctcgctgaaggacaacatcaacgaaatgatccgcaatctgcgggacacgacgctcaagaacgccgaacaggattggctgaagaccaacctcgccaagttcacccgcatgctgcagggcgagcgcgacctcgccacggtctcgaacctgatcctgtccgagattgcatcgctcgtgagcgcccagcgcggcgtgttctacatggtggaggacgagggcggagagccggttctcgacctgatggcgagctacgccttcacggagcgcaagaacctctcgaaccgctatcgcctgcgtcaaggcctcgtcggtcaatgcgccttcgagaagaagcgcatcctcctcacccacgtgcccggcgactacatcaccatcggctcggctctcggcgaggcgccgcccctcaacatcatcgtgctgcccgtcctcttcgagcaggaagtccgagcggtcatcgagttggcgtcgttcaaccgcttcagcgagacccaccagtcattccttgatcagctgaccgagtcgatcgggatcgtgctcaacacgatcgctgccaacatgaggacggaaggcctcctgaagcagtcgcagctgctcaccggcgagttgcagagccggcaggaggaattgaagaagacgaacgatcgcctggagctgcaggccgcctcgctgcagcaatccgaggacctcctcaagaaccagcgggagcggctgcagcaaaccaacgaggagctggaggaaaaggcgcgcctgctcgaaatccagaagcgtgaggtcgagggcaagaaccgcgaggtctcgatcgccaagacggcgctggaggagaaggccgagcagctgagcctgacctcgcgctacaagtcgcaattcctcgccaatatgagccacgagctgcgcacgccgctcaacagcctgctgatcctctcgaagcttctctccgagaatcgcgacgggaacctcaccgacaaacagcgggaattcgccaagacgatcaacgcggccgggaccgacctgctgtcactcatcaacgacatcctcgatctctccaagatcgagtcgggcacggtgtcgcttgagatcggcgacgtcacgctgcaggacatcagcgagaacctgaacaggaccttccggcagctcgccgaggagcgccacctcgcctttgtgatcgaggtcgatccgggcctgccgcgctccctgcggacggactcgaagcgcctgcagcaggtcctgcgcaaccttctctccaacgccttcaagttcaccgagaaggggagcgtctcgctcaagatcggttctgcggagggctcgcccctgcgcgccgggacccagtggatcgccatgtccgtcaccgataccgggatcggcatcgctgaggacaagcagcggatcatcttcgaggcattccagcaggccgacgggaccacgagccgcaagtacggcggcacgggcctcggcctcgcgatcagccgcgagatcgcgcgcctgctgggcggcgagatcgtggtcgagagccgcgtcggtacgggcagcaccttcaccctgttcttgcccttcgaaccgcccgcgcaggcactcaccggacgcgcggtggaggcatcggacgggtacgcgccttcggcgccgatgggccgccagccgaacaccgcgatggcgctctcgtcctccgcggacgaccgtcatgcaattcacccgaacgaccacatcgtgctcatcgtggaggacgacgccatgttcgcctctgtgctgctggagctcgcgcgcgagcgtggcttcaagggtttgatcgctcaggacggggccggcgcgctgagcctcgcgcaccgcttcaagccgcacgccatcaccctcgacatcggcctgcccgacatggacggctgggccctgctcgacctcctgaagaacgacccccgcacccggcacattccgatccacgtgatctcggtcaacgacgagaagaagcgcggccttcgcgcgggcgctttcgggtttctggagaagccggtcgagcgcgagggcctgatgcgcgccctggagcgctcgaaggagttcatcacgcggccggtgcgcaacctcctgctcgtcgaggacgacgagaaccagcgcgccagcatcacagcgctcctgagcgaagaggacgtcaagatcttcggggtcggcacggcctccgccgcgctggaagccctgacaggcggccggttcgactgcgcgatcatcgatctcggcctgcccgatatcggcggttccgagctgatcgagcagatccgtgcctcccaggatggggaggagttgccgatcatcgtttatacgggccgggagttgacggccgccgaggagcagcagctcaggcaaaccgcctcgacgatcatcctcaaggacacgcgctcgtccgagcgacttctcgacgagaccgcgctgttcctgcaccgcgctatcaatcgtcttccagtcgaggagcagatcctcgtcgagcggaaggacgcggtgtcacttcagggctgtcgggtcatcctggtcgatgacgacctgcgcaatatcttctcgctcacgagcgctctcgagcaacatgggctggaagtcctgttcgccgagaacgggcaggacggcatcgcccttctcaagtccaacccgaacgtcgatgcgatgctgatcgacatcatgatgccggggatggacggctacgagacgatgcgcgcgatccgggcggaggctggcttccatagcctgccgctcatcgcggtaaccgcgaaggccatgaagggtgatcgcgagaagtgcctcgaggcgggcgcgtccgattacgtctcgaagccgatcgacatggatcagctcctcgcggtgctgcgggtgcagttggcccggcgtagcgaggtcgcacacggccccgcgcccatgatcagcgacgcgacaaccctcaatcggcaaccacaatga

SEQ ID NO: 8490 - DNA, 1662 bp, Methylobacterium sp.
gtgggcggggccggcgccttcggggcgcggctcgtcgccgggctcgccaccaccaccgatctcgccgtgatcgtcgccggccgcgaccgggccagggcggaagccgtggcccgcaccgtgccggaggggcgcggccgggcggcgcgtctcgacgcgacacgggtcgaggcggccgacctgcgcgcgctcggcgccgccatcgtggtggatgcggccggaccattccagggcggcgcgccgacgctcgcccgcgcggcgatcgaggccggcctgccctatctcgaccttgccgatggccgtgacttcgtggcggccttccccgccctcaacccgctggcacgggccaacggcgtcgtcgcgctcaccggcgcgagttcgacccctgccctgtcgaacgcggcgctcgatgcgctgaccgacggctggcgctcgatcgagacggtgcgggtcgcgatcgtcccgggcaaccgggcgccccgcggcctctcggtgatgcgggcgatcctctcctatgccggccggcccgtgcggatcctccaggccggcaggtggcagaaccggcccggctggggcctgctccgccggatcaccgtgccgggcctcggccggcgcttcgccagcctgtgcgagacgcccgacctcgacatcctgcccgcccggtttccccgcctgcgcacggctctgttccgcgccgggctcgaactgccggttctccatttgggcctgagcctcgcgagcttgccggtgcggtggcgcctgctgccctcgctcgtgccgttcgcccgccccttcctcgtgatcgccggctggctcgaccgcttcggcagcgaccgcggcggcatgagcgtcgaagttctggggcgtgatgcgacgggcaggccgacccgcgcggtctggagcctcgtcgctgaaggcggcgacggaccctctgttccgaccctgcccgccctcgccgcaatccgccggctcaccgatcccttcgccgcgccgatcccggcgggcgcctatccgtgcgtcggcgtgctgccgctcgctgcgatcgaggcggagatgggccgccttgccatccgcacccgccgcgacgtcgatcaccccgtgctgttgatcgagcgggcgctcggagccggcttcgtgcaaatgcccgaggcggtccgcgccctgcacggctcggtcggcgacggcgcgttccgcggccgggccgaagtccggcgcggaagcggcctcgtcgtcgccctcgtcgccctgctgttccggctgccgccggccatggcggacggaccgatccgcgtgacgatggagcccgacttcgaggccggcgcggagcgttggacgcgctggtttccgggtcgccgcttctccagtcggatgcagtccgtcgggctcgacgggagcgggcgggtgcgcgagcatttcggcccgttcgcgatggatctcgctgtgagcagccaagcggacgggctcgatatggcggtgacgggctggcggctcggcccgctgcccctgccgcgtgccctgcggccgacgacgcgggcgagcgagcgggtcgatgcagagggccgtttccgcttcgacgtggccctgttcctgccgctcgtcgggctgctcgtgcattaccgcggctggctggtccgctgcgacggtagagaggaagagaccccatga

SEQ ID NO: 8491 - DNA, 1260 bp, Methylobacterium sp.
atgctcgacttaaccacgcttcaggtcgccagcatcagctctcgcctcgccttcgtcatggtgtttctcgtcactctgctgcggcatccgcgcgagatctacttcggtgtctgggccagcgcgctgtgcagctcgctggtggcctcgttcctgatgctgggagatccgccgagcgttccgctgaatgccgccaagggaagcgtcgtctacatcctgtacggcgcgagcctcgccctgtcctgggtgggcttgcgcctcttctacgagcggacgccccgcattccgctgaccttcgtgctcatcctcgcctccggcctgccctacggcgtcctgcagcaggccggggcatcaatgccgtggagcctgaccacggtgttcggctgcatcgcactgagcacggcgctgtgcatcctggagatcttgaggactcccgcctcgatgcgcctgtggacccaatacgtcgtcctcttgggcttcagcgggtatctctgcaccttcctgctgtcgatcggcgcggtccatttcgcgagcgagcgcctcgcttcgcccgagagcggcatctacccgcttgtgttcgatctatggtgcggggtcttcatccaggtcggctacctcgccatggtgggcgagcgcgcgaacctgaagatcagccgcctggccgagaccgatcccctcaccgggctcgcgaaccggcgcgggctgttcgcggcgatcaatcggcgggccagccccgcctctcccccgccgcgctgcgcgattctgctggccgacatcgaccacttcaagtcgctcaacgacacctacggacacgatggcggcgacgcggttctgatcggcttcgcggagcggctgcgcaacgtggtgcggaagaacgacatcatcgcccgctggggcggcgaggagttcctgatcgtgctcgatcaggccacggacgacgtcgatcccgccgttgcggccgccgagcggctgcgacgtgcggtggcagggcagcccttcaccgtcaacggagcggccgtgaccgtgaccgccagcatcggggtctcgatcgtggcggccggcgaggtggggatcgagcctgccttggcccgtgcggacgcggccctctacgccgccaagagggatggccgcaatcgggtctgcctggaacggcccctgtctcagccggacatcaaagccgcccgaacggagccgctctccgggcttcgcggagccatggacgccatccagatcgccggacagccgcggtccgagccagcctga

SEQ ID NO: 8492 - DNA, 1788 bp, Methylobacterium sp.
atgtccctgtcttccccccggcgcgcggatgccgtccgccgcgtcctcgccttcgtcgtccgcggttggcgcgaacgcctcggcctcgtcggcgccctcgttgccgcgatcacgctcgccacgctggccgacgtgatgctgccgctctatgccggccgcctcgtcgatgcgcttgccggggccgagcggcacgccgcgctccaagccgcgctgccggccttcgcggtgatgaccgttctgagcctcgggacggtgctgttgcgccacatcgcctggagtctcgtggtgccgctgacgctcggcaccatgtccgacatcgcgagtcggagttttgcccgtgtccagcgcttctcgaccgaatggcacgccaataccttttcgggctccacggtgcgcaaaatctcgcgcggcatgtgggcgctcgacgggctcaacgacgttctgctgctgtcgatcctgccctccgtcgtggtgctggcggggacgacggtcgtgctcggcctgcactggccggccatgggcgcggtgatcgggatcggtgcgctcgcctatgtcggcaccgccgtcatcctggcgactcgggtgatcgcgcccgcggcgacgctgtcgaacgccctcgatacgcggctcggcggcgccctcagcgacacgatcggcaacaacgccgtggtgaaggccttcggtgccgaggcgcgggaggacgatcggctcgcccgcgtcctctcgcagtggcggcggcgcacccggcgcacgtggatgatcgtgacatggagcggaacggcccaactcgggctgttgcttgccttccgcaccgccatcgtcgccacggctctgtggctgtggtggcaggggcaggccagccccggcgaggtcgcctacgtgctcaccacctacttcgtggtgcacggctatctccgcgacatcggcggccacatcaaccatctgcaacgctcggtcaacgagatggaggagctggtggccctcgaatccgagcccgtcggtgtcgccgaccggccgggggccgtgccgctcgcggtcgagggtggcgcgatccgcttcgaggcggtgcgcttccactacggcacccacggcacgccgctctacgatgggctgtcggtgacgatccccgccggtcagcgggtcggtctcgtcgggcgctcggggtcgggcaagacgaccttcgtcaagctgatccagcggctctacgatgtgagcggcggacacgtgcgcatcgacggacaggacgtggcgggtgcgacgcaggcgagcctaagggcgcaggtcgccatcgtgccgcaggagccggtactgttccaccgctcgctcgccgagaacatcgcctacggccggcccggcgcctcggcggaggcgatcgagcgggcagcgcggctcgccaatgcgcacgacttcatcgcgcggcttccgaaagggtacgccacgccggtgggcgagcggggcgtcaagctgtccggtggtgagcggcagcgggtggcgctcgcccgcgccttcctggccgacgcaccgatcctgatcctcgacgaggcgacgtccagtctggactcggaatcggaagcgctggtgcaggaggcgatggagcggctgatgcacgggcgcaccgccatcgtcatcgcccaccgcctctcgaccgtgcgtgcgctcgaccgcatcctggtgttcgagcgcggccgcatcgtcgaggacgggccgcatgccgcgctgatgcggcgtccggacggggcctatcgcgccctgttcgagcggcaatcggtgctggcggagagcgcgtga

SEQ ID NO: 8493 - DNA, 1401 bp, Methylobacterium sp.
gtgcggacacgcagcgccgagatcgacgcccgctcgctgcgcgaggcggcaccgagaccggaaaaacccgataccggagagccggaccggcgcctgccgttcacctcctctcccgatctgcgtcgggcgaccgtggagcggcatcttcgcaccttgcgcgcgaccagcccgatcgcggcggccgaggccggccgggaactggcgaagtacgattacgacacgatcttccgcagcttcctcgacggcaccggcctcgacccggcggatgccggcgacgtgctcaccgccttcgtcgtcctgcaatggatggtcgccaacgatgcgaccgtggagccgagcccggcggcgcttcaggcgatccgccgccgcttcgtgatgccgatggcggccaagccgccgctgtcgcagccggtgagccgggccgccttcgccgagcaggtcaagctacgctcggtgctgcaccatgcgggctggaaggcggcgcggcagctcggcgtcatgccccgcttcctcgccaccctctcgaacgagttcatcccagccacgaagctgcaggcgctggcgctgaccgaggacgggctggtgcccaagacgcggccggcgggcgcccggcttttgcgcgagccgtcggacccacctccgccgacggcgtcgacggacgtcgccccacccgctaatccccggacggtaacgccgccttctgccggagcaatggccgacgccgcagccccgccccgccacaccgccaactgggacgcggtcgagggcgtgtacttccgctccaccacgggcgtcggcgtcggcggcatggtgacgatcgatttcgagccgctgatcttcctgcaggacggcacctttttcgagatcggcgacaccgcactcgaagacatcgatctcgccgccgagcggaccgccaagccgcggcgcttcggccgctggacccgcaaggatcagggattcttgctgacggattggcggggcaatgcgaacagctacaagctcggcgacggcagcttcttccgcgccttcccggctgtggccgatgagcgtgtgacgcgctcctaccggcgcctgtcgggcggcggcaacagcgcgatgggcggcgacgtcacggttgcggtcgagagccgctacgacttcaaggccgacggccgctacgggcgaggcggttcggtcggagcgatcaactccggggcaagcaccggcgtcggatcgtcgatcagccggcgccgcgcgcccgagggcggacggtaccgcctcgaccgccacacgctgattctgacgggcgccgatggacgcagccggcgcctgttcttcgcctacagcgcgcagaaggacccgcccgagatcgaccgcgacatgatcttcgtcggcgacagcgtgttctcctcggacgactga

SEQ ID NO: 8494 - DNA, 669 bp, Methylobacterium sp.
atggcggcgcggcgggtcttctcgcttgcagccgcgctctgcctgctcggggcctccgctccctgtcaggcagccgagccggccgcggatacggcgcccgcgggggggctgaccgccgggagcctcctcgttcggggccgggtcatcggctcgatcccggtcggccagtactcgcgcatcgagccgatcggcgggcgcgtcatcacccccgcgcgcgctctgccggatctcgacgtgacctatttcctgtccgatcatttcgcggtggcggcccaggccggcgtcgtgtcgacccggacctcgatccgcgggtcgttcatcggcgacctgccgatcggctcgacgtggagcttctccatgaccggcgcggtccagttccatttcctgcccggcaacgccttcaatccgtatctcggcgcaggcgccggctacacccatccgatcgcctacgagccggcgaagccgttcgtcaccaagatgaaagccgatccgcaactgggaccgatgctccaggccggattcgactatcaccttgtcggcaactggtacgccaacatggagatcaagaagatcttcctgccggcacaggtctcgcggatcggcgccggcagcacgaccgtgaggctcgacatgctgatcatcggcgcgggcgtcggttaccgcttctga

SEQ ID NO: 8495 - DNA, 1374 bp, Methylobacterium sp.
atgagcacgcattctgccccgatcccgatcacgtcgcccgacgcttcctcgccatcactgggtgggagcggagaggacggcgccgtctctccgatcgcgtggcagcgctacgcaatcgccggttacgctctcatcgcggccaccttcggtgtcgccggtgcctgggcagccacggtgcgcctggatcgcgccgtcatcagcaccggcgtcatcgtcgcggagagcagccgcaaggtcgtccagcatttcgagggcggcatggtccaggccgtgctggtgcgggatggacagacggtccgcgctggtgatgtcctcctgcggatcgatcccgtccagtcccaggcgagcgcggacctgttccgaaatcagctcgacgccgctctcgttctcgaggcgcggctgcgggcggagcaggcgcagtccgacgacctgcacttacccgccgacatttccgcgcggcgcgacgagcccgccctcgcgcgcatgatcggcgatcaagccgggcagttggtggaacggaggacgacgctcaagggccaactcgccctcatcgaggccaaagtcactcagctgaggacggagatctccggccttgccgtcgagaaatcctcggtcgagcagcaagtcggcttcatccggcaggagctggagggcctgcgcagcctgcacgagaggaatctgatccccctgtcgcgcctcctcgtgatggagcgggagcgcacgcggctggagggggtgatcgggcgctcggtggccgagagggccaaggccgagaacgccatcagcgaggccggactgcagatcacccaattgaagcagaagcttcaggagacggtcaccggccagcttctcgaaacgcggcagagaatcggcgagcttcgcgaaaagctcgtcgtcgcgcaggacgtattccggcgccacgagatccgcgcctcccacgacggcgtcattcaggcgctcaaggtggtcgcgaccgggcaggtcgtccgctcgggcgagccactgatggagatcgtcccgacggcggaccggctcgtggtcaacgtacaattctcgcccaacgacctcgaagccgtccatgccggcatgcgggcggagatcaagtttccaaccttccaggcgcgccggacgcccgcggtcttcggcactctcacggtggtgtcgcgggaccgtcttgtggacgagggtacgaagcaggcctacttcgccggtaccgtggagatcgacgaacaccagcttccggccgatgtcagacaccgccttctcgccggattgccggccgaggtggtggtctcggccggcgagcgcacggccctggaatatctgtttgcgcccttcttcgacgcgatgggacgcgccttccatgaacgctag

SEQ ID NO: 8496 - DNA, 297 bp, Methylobacterium sp.
ttgtatgtccaccagcaacgtctcggctccgaggaggtgcaggaactgcgccgcgaaggtggccgttttctgaaggagcttcgggagaagcgcggcctctcgcagaggcagctcgccgcgcaggtcggcgctgaatattacaccttcatctcgcaactggagaccgggcgcggccgtgtccccccagaccggtacaagatctgggccgaggcccttggggtcgatgcgaaagatttcgtgaaaagcctgatgcgcttctacgatccgctgaccttcgagatcctgttcggcgactga

SEQ ID NO: 8497 - DNA, 873 bp, Methylobacterium sp.
atgataagcaacctgaacgtcgatcagatccgctcgttcctggccgtggttgagagcgggggcttcacggccgctgcgcagatgctcggggtgcggcaatccacggtcagcgggcatattgcgcggctggagcaggcgctggaccgttccctcctcatgcgcgacacccatcgggtcgccccgaccccggatggccaagccatgatcggcttcgcgcgcgaggtcgtggaagcgcacgatcggcttcgcgccttcttctcgccgggcggcctgcgcggccgcatccgcctcggcgtctccgaagactacacgctctcggccctggctcaggttctggcgcgatttgccgagcgccacccgtcggtggacctgcagctgacggtcgggctcagccgggccctctaccagggctacgatgcgggcgaactggatgtgatcttctgcaagcgccgacgcggcgatccgcgcggcgaactggcttgggcggacgagctgatctgggcaggccgaccgggcctgattcccgatccggcgctggccttgcccctggtcctctatccgccgccttcgatcacgcgcaccctggccctcgatgctctcgaagccgcgggccgttcctggcggatcgcctgcaccagcggcagcctgatggggctgcgcgcggccgtcgaagcgggtctgggcatcgcgccgcactcggccagggtgatgccggcgggattggcgccgatcccggagatggccggtctgccgccgatcggcgaggtggagttcgtggtgctcggctcaggccgccagcatgccgtcgcgacggcgctgcaggagacgctcctcgcaagcacggcggagcttcaggccgccccggaggggtga

SEQ ID NO: 8498 - DNA, 1764 bp, Methylobacterium sp.
atgagcgaccctctcgctgggtccgtcctgaaggatgggctgcgttcgatccgtcccgtcctggtgacggtgttcgtcttcgcctttttcacgaacctgctcctgttcgccggcccgctctacatgctgcaggtgtacgaccgcgtcctcctgagccggaacgaggcgacgctcttcgggatcacggcgatcgcggccttcgcgctcgcggtctatgccgctctcgagatgctgcgttcgcgcctgctggtgcggggcgggatgatcttcgatcggaaggttgccggaccggtcttcgagatcgtgcacagggccgcgttgctcaagccgcgagctgggcacgaagcagccctgcgcgacgtcgacgtcctgcgcgagtttcttacgggtggcgcgattttggccttctgcgatctgccctgggcctcgctcttcctgatcgcctgcttcatcctccatccgtggttcggctggatggccttgctcgggggcggcacgctcctggggctgacgctcctcacggatctcacgacccgccggcctctcgacgtggcgagtcaggctgctcgcgaggcgggcgagcaggcccgcgcgacggtccgtgggggcgaggttctgcgagccatgggcatgctgggcgccctgcggtcccggtggcgttggcgtcacgatgaggcgatcctgctgcaggctcgggcgagcgaccgcgccggcctcatcgccgcggcaacgaagttcacgcgcatgttcctacagacgatggtcctcggtgtcggcgcctatctcgccatccatggcgagatctcagccggctcgatgatcgcggcctcgatcatcatgggccggacgctggcgcccatcgaggcggtggtcggacattggaagagcttcacggcggcaaggagtagccacgcccggctgacggaaatcgtcgcgcgcatcgggctagagccgcagcgcgtgatgctgccgcgcccgcgcggcctgatcgagaccgagaacttggtcgtcggggctccggggacgtcgagaaccatcctccacgacgtcagcgtgcggctggagcccggcagcgtcgtcgggatcatcggtccgagcgcggccggaaaatcgacgctggtccgcgcaatcacgggcgtgtggccgatcgaatccggcgccgtgcgcatcgacggagccgacctccggcactgggatcctcaggcgctcgggcggcatctcggatacctgccgcaggatgtcgagttgttcgatggcacagtggcgcagaacatcgcgcgcttcgacgttcaggacgatgccgcggtcgtctcggtcgcgcagcgcgcgggctgccacgacctgatccaggctctgcccgagggctacaacactcggattggctcaggcgggcacggtctctccggcggccagcgtcagcgcatcgccctgtcgcgcgcgatgtacggggatccgagcttggtcgtcctcgacgagccgaatgccagcctcgaccaagccggagaggctgcgctgatgcgggcggtggcggaccttaaagagcgcgggacgaccgttgtcatcgtcacgcacaaggtgagcctgctggcgagcgccgacctgatcctgatgctggatggcggaacgctgcgggcctctggcccggcggaccagatcctcgcccaagtctctggtccccgcccggttccggcgctggtcgcgaccggtggccgggccatgcccgagaacgagagagtgcccgaagtccagcgcagcgcgggctga

SEQ ID NO: 8499 - DNA, 429 bp, Methylobacterium sp.
atgacgcctgattccacgctgccaaactccccggcgctcgggctcgatcactcctccgtcgcggatctcaacctcgccctgcgccactaccggcgcctgatgatccgcctgcccctgatcctcgtcctcggcttcgcggcggcgatcggcctgtcgtatctcgggaccgctttgtcgccgccctacggcgtctatatcctcggctgggatctcacgacctgggggctgctcggagtcctcgccgttctcttcgccgagctttggtgggaggggcggcagatcgggcgcgccctcaacagcgtcgagatgcagtccgcgccgattgcctctctgctgggcggccaggcgctgatcagtgcacgcgcccgcgaacacggcatgaagccgggtcccttcaacggtccgctgcggccgatccgtgagcggtag

SEQ ID NO: 8500 - DNA, 438 bp, Methylobacterium sp.
gtgacgaccggcctgccgccgaccctcgtcttcgacaccgattgcgtgctctgcgcgggatcggtgcgcttcgtgctcgcgcacgaacgcgatgatcgcctgcacttcatgggcgcttggtccgttgaagggctcgccctggccgcccgttacggtttcaccgccgaggacctgaacggcaccttcctgctggtctacgacggccgagcgctgacgcgctcggacgccgcgctcgccgttgcacggcatctcagggcgccttggcgctggttcaggttgttcaggatggtgccgaagccgctgcgcgaccgtctctacagcctcgtcgcgcgctatcgctaccgattgttcggacgccgcgaggattgcgcccgcgtgccgccggggcagcggcaccggttccacggggtgcggccggcggacccgccgcacccgtag

SEQ ID NO: 8501 - DNA, 372 bp, Methylobacterium sp.
gtgatcgccaacggcgcgggccgcgccgtcgccttccgcctcgcgccgggacaggcgcacgaactgccccacgccgtgccgttgctcgaccagttgcccggcgcgccgctgtgggtcgtggccgaccgcggctactccagtcacggcttccatcagcacatccgcgacgtgggcgccaagccggccggccccaccaagcgcaacgaagcacccacccgctgcccggactggatctacaccaaccgcaaccgcgtcgagcgcctctgggcgcggctgaaggaatggcgagcggtggccacccgctacgagaagactgccgccagcttcacaggcgtcctctgcctcgccgcagcctgcgattggatcaagtga

SEQ ID NO: 8502 - DNA, 372 bp, Methylobacterium sp.
gtggtcgccgacggacgagggcgcgccgtcgccttccgcatcgctccggggcaggcccacgaactgcctcacgccattccgctcctcgaccaattgcccggcgtgcccaagtgggtcgtgggcgaccgaggctattccagccacggcttccgcgagcacatctggaccaccggtgcgcgtcccgcgatcccgaccaaacgcaacgaagagcaactcgcctgcccggactgggcctacaacaaccgcaacatcgtcgagcggttatgggcgcgcctcaaagagtggcgcgccgtcgccacccgctacgagaagaccgccgtcagcttcgccggtgtcctctgcctcgccgcaacgctcgactggctcaggtga

SEQ ID NO: 8503 - DNA, 363 bp, Methylobacterium sp.
atggcccagctcctcgcctcgctcttcgtctccggtcgcatcgtcgatggcatcctcgtgctggtcgcgctcgaagcgctggtgctgctcggggtgcgagcccgctgggggcgcggcccggcgccgatggcgctcctgagcaatctcgcctctggggccgcgctgatgctcgccctcagggccgccctcaccggagccgcgtggcccgccatcgcggcttggcttttcgtcgcccttgcagcgcacctcgccgaactggttatccgctttcgggaaggtccccgcgccgcgcaggactgtgacaaagcggcctggaacaaccggaggtggcgaacgttcggtgcgcgtccaccgatgacttag

SEQ ID NO: 8504 - DNA, 1845 bp, Methylobacterium sp.
atgcggtccctcgacaccctctccccgatgcggccgaaggccgaggccggccgcgcgcctacgggcgaagatccgcgcgcaggcggcacccccgatttcgaggcgatgctcggggcgttcgagagcgggaccgcgccgtctggagaggctcccgcggaagccaccgaggaccggacggacggcccgcccgcgttgcccgccgacccgcccgttgcgaccgcgcccggctcggccctgcaagccttgatggcgctcaccggtcccgtcgccgggccggttccccccgccaccccggaggctggccttgaagcgatggtgcagcgtgccgcggcgcgggccggctccgggccgagcccactccccacggcgccggccctgtcgatctcccaggtcggattagagacgcatttcgcgcccgttcggcccggtctggtcgcgccggccacgggatccgggccggttgcgaacggaaccaccgcgtcgccggttctcccggagaccggcggtgtcgaagccgacgtttcgccctcgatcgtgcgggacgacgcgccccggctttcgtccccttcgatcgctccggctccggcggcgacggtgtccgggccgcccgtcgccgggccggatcgatcgtcgctcgcggcgctgcgcggcgctgtccatgatctcgccgccggaatcgatgacgcggtccctgctcagggcagtcccgcaccgtccaggcaagcggccgtcgagcagccgtccgcctcgaccgtcaccccggccgcgacgcggccggcgcccgccatcacagcaccgcccggagtaccggcgacggccgccgctccagcgacacagcagccgacgtcactcgatgggggccaggaccgggccgcgggcgcggctgcggtgtcggcggcgtctgcgcaccgatccgccggcacggcgcgggggcccgccgccgcacccgatgccctcgggaaccctgcgggccgcgaacgcaccgcgtcccgcggcgaccggccagaaccagccggtgccgcggcgtcggcgccgcccgccgagggcctcagccgtggcgatctccccgagccggccgctgtggcccaggccggtgcgacgcaaccggtccaccgcgatcctgagccggtgcggcagcagccggacggcctcgctcgtcctgaaacgcccgcggaacgtgccgccgcgtcggtgacgcgcgcaaagacggaggcagaggccggcacggacgccgcgggtggcgggccttcgaccgaggcgccgcatccggagacgccggccgagccggtcctgcaagcgggcgcgccggctccggtgccggcctcgccgctgcgccagatcgtcgatgcggtcaccgcccaattgcccgcggcggcctccgctgctcaaacccgcccgtcgacggccccgaccgagaccggcccgctgaagatcctgacgctccaactccatccggccgatctgggcacggtgctggtgcggatgcgcctgcaggacgggcggctggagatgagcctgcgcacgagccgcgaggaaaccgccgagcgcctacgcaaggagggtgacctgctctccggtctgctgcgggaggccggctacgaagccgataccgtgacgatccaggcaggcggcgccgggcccggtgaatccggatcgcgcggccagggcttcgccaccttcgccggatcgcagggcgggcagcctgacagacagccgggcgcggcgacgcccgatcaatcgggccggcgcccatccccgcgcgcggacgagtccgccatgcccaccgaggagcagaaccatgagacggattctcgcgggcgcgatcacggcagcctgtatctctag

SEQ ID NO: 8505 - DNA, 219 bp, Methylobacterium sp.
atgccggttttcgtgctcaggggcgcccaccgcgcggccgacggccagatcgggccgccgctgttcgaggaggcgatcacggccgacaatccggtcgacgccgtccgcctcgccaacacgcaggacctctcgaccaaggatgagcgggcgaacgccctgtggctcgtcgatgcgcagggcgtcctgcactggtccctgcggcgcgcagaccgggattga

SEQ ID NO: 8506 - DNA, 945 bp, Methylobacterium sp.
atgtcgtccacgcccggcgcgacggatagcgactcggccgaggcgatgcgccgggaactggctcgactgcgggagatgctggagcagaactcggattggatctgggaggtggatgcgcagggccgctacacctacgcctcgcgccagtgcgtcgccttgctcggccgcgagccggaggaggtggtggggcacacacccttcgacttcatgccccctgacgaggccgagcgggtcgggcgaatcttcgccgccattgccgccgaacgacggcccttcgcccagcttctcaaccgcaacctgcgcaaagacggtcgcctcgtggtgctggagacgagcggcgtgccgctgctcggccctgacggtgcgttgctcggctaccgcggcatcgaccgggatgtgaccgagcgcgaggtggcgaacgagcggctccgccatatcgctcgccacgacgacctcaccggcctgccgaaccggatgtatctgcgcgagcatttggcggaggggttggccgccgggcagcgaccgagcgtgatcagcctcgatctcgacggcttcaaaccggtcaacgatcgccttggccacgctgccggcgaccgcgttctgacagagatcggccgccggctcgccgaaatgtcggccgcgcacggcctgttcgcggcacggcccggaggcgatgagttcgtcctgatcgtcccggacggtgtgcccgctccatccgagtcgcttcgcaagacccttcgtgagatccttggcgaagccattgccgcacccatcgtcctcgacgccgaaacggtgcgggtgagcgccagcttcggcttcgcccgcgcgaacggtccgaacgacacggtcgaggccctgctggccagggccgaccgtgccctctacgaggccaaggaagcggcgaaggaagccgcgcggcgcgccggcatcagcggcggcggctga

SEQ ID NO: 8507 - DNA, 123 bp, Methylobacterium sp.
ttgatcgccgtcatgctgtccgtctcccgcgccgtcgtgtccaagcatcgtgagatttccgcgctgctcgcgacctatgccatgttcctcagcggcgtgctgattctcgcctgggcggcatag

SEQ ID NO: 8508 - DNA, 873 bp, Methylobacterium sp.
atggtctgtgccccgtccctctccttcacttgcccgcccggctttgtgccggatcgcatcggggccggccgatcctcggaggtgttcgccgaggggccggaccgggtggtgaagctctaccggcagcccttcgagccgcaggccgtggtcaacgagttggcggcgagccgcctcgcccacggcttcggcctgccggtgccgcgggccttcggcctcgtcggccgggccgggcgcaccggcatcctgttcgcgcgtctcgacgggccaccgatgatggtgcgctacgcctgcaacccgttcgggctgcttctggcgctgcgccgcgtggcgcggatccagcacgcgatccacgcctgtcccgctccgggcctgccctcgcagcatggccgcctccgccaccagatcgcgggggcgcgggtgcccgagcccctgcgcgcggcggcgctggccgccctcgaccgcctgccggcgggcgaccgcctctgtcacggcgacgtgcatcccggcaacgtcatcgcgacttcggccgggctgcacctgatcgactggcagaaggccgccgccggtaatcccgccgcggacgtggcccgctccgaactgatgctgcgctacggccagtttgggccggcctggttcagccggcttccccccgtgcggacggcgcgccggctgatcgccgcgtggcgcctgccggtggcggtcgcgcgcctgttcggccagcccgccggcaccgacgccgaattgctggccgcgatcgaggcgctggcccgccaaagttcggatttcgagaaggcgagccttttcccgggtccagggcagaaccctggtcgagggcccgtccctcacaatccttcggccaaggtcccgcgctga

SEQ ID NO: 8509 - DNA, 2769 bp, Methylobacterium sp.
atgagcgacgcggccgtcatcgcccggctggagcacgtttcgcatcgctacggcgggacgcgcgcgctcgacgacgtgtcgctcgaccttccggcgggccgcatggtcggcgtgatcgggccggacggtgtcggcaagtcgacgctgctcgcgctcgtggccggcgtgcggcggatccagaccggccgcgtcacggtgctcgacggcgacatggcggagcgccgtcaccgcacgcgggaggcggcgcgcatcgcctacatgccccaggggctcggccgcaatctctaccctacactgagcgttttcgagaacatcgacttccacggtcgcctgttcggccagggtgcgtcggagcggcggcggcgcatcaccgacctgctcaccgccaccggcctcgacccgttcgaagaccgcccggcgggcaagctgtcgggcggcatgaagcagaagctcagtctctgctgcgcgctgatccacgaccccgacctcctgatcctcgacgagccgacaacgggcgtcgatccgctctcgcgcggacagttctgggagctgatcggctcgatccgggccggacggcccggcatgagcgtgatcgtcgccaccgcctacatggacgaggcctcgcgcttcgagcggctgatcgcgatggatgatggccacgtcatcgccagcggcagccccgccgacctgctggcccggaccggcaagcccgacatggaggctgccttcatcgccctcctcccgccggagaagcaggcgcagcaccggcccgtggtgctgaagccccggccgccccggctcgacgcggtgccggcgatcgaggccgagcacctgacgcggcgcttcggcagcttcaccgccgtcgacgacgtcagcttccgcatcgcccgcggcgagatcttcggcttcctcggctccaacggctgcggcaagtccaccacgatgaagatgctcacaggcctcctgccggtctcggagggaagcgccaagctgttcggccaccccgtgggcgacaacgacatggagacccggcgcaacgtcggctacatgtcgcaggccttctcgctctacagcgagctgacggtgctgcagaacctcgaactgcacgcccagctctaccacctgccgccgcacgaccgcccggtgcggatcaacgagcttctcgagcgcttcgaactcgaaccggtcaagaacgcgcggcccgacagcctgccgctcgggatcaagcaacggctccagctcgcggtcgccgtgttgcacaggccggcgatgctgatcctcgacgagccgacttcgggcgtcgatcccatcgcccgcgacgccttctggcgcacgctgatcgacctctcgcgcgacgagggcgtcacgatcttcctctccacccacttcatgaacgaggccgagcggtgcgaccgcatctcgctgatgcatgccggccgggttctggcggtgggcacgccggccgagttggtgcgaaagcgcggcagcacttcgctggaacaatgcttcatcgattacctggccgaggccgccgggctcgacccgaaagcggcggagaaggcgggcctcgagacggcggaagaggcggccgaaccggacaccccgccggccccggcgcctccccgcgccgcctcgcaccgtcaccgcttcgatccgcggcgcctctgggcctatgcccggcgcgagacgatggagttgctgcgcgatccgatccgcatcgccttcgccttcatcggccccgtgctgctgatgatcgccttcggctacggcatttcgttcgacgtcgagaacctgcgcttctcggctttcgaccaggacaacaccccggaaagccgccagctcgtcgatgccttcaccagctcgcgctacttcagcgagcagccgccgatcagctccgcgaccgaactcgaccggcgcttccgcaacggcagcgtccagatcgccgtcgagatcccgccccgcttcggccgcgaccttcaatcgggccgcgcgccggaggtcgccgtctggctcgacggggcgatgccgttccgggccgagaccagccgcggctacgtcacggggctcgccaaccagtacgcccaccagctcgccgtcgagcgcctcggcatcgatgcctcgaagacggtgagcgtccagacgcgcttccgctacaatcaggcctttcgcagcgtcaacgccatggtgccgagcgtgatgatgctgctgctcatcctgatcccggcgatcatgtcggccatcgcggtggtgcgcgagaaggagacggggtcgatcgctaacttccgctcgactccggtgaccaagttcgagttcctgctcggcaagcagcttccctatatcggcatcgccatgatcagcttcggcctgctggtcctcgtggcgcttttcgtcttcgatgtgcgggtcaagggttcgttcgtcgcgctctgcctcggaacgctgttctacgtctcggccaccaccggcttcgggcaattcatctcgaccttcatgaagacccaggtcgcggcggtcttcgccaccgcgctcctgtcgatcatcccggccgtcaacttctcgggcctcctcgtcccgatctcgtcgctgtcgggcagtgcccggctgatcgggctctcgctgccgccggcctggtaccaacccgtcaccgccggcaccttcaccaagggcctgccctttgccgaactcgatcgcaacatcctcgtgctggcgggctttgccctcctgttcctgatcctgtcgcagctcctcctgcgcaagcaggaggcgtga

SEQ ID NO: 8510 - DNA, 336 bp, Methylobacterium sp.
gtgaggatcctgttcgtctgcggccgggcccgcgcccgcagcccgaccgcggagcagatcttctcgcgatggcccggcgttgaaacggcctcggcgggcgtctccgacgatgcagacgaacccatcgagactgatcatctggcctgggcggagatcgtcgtggtgatggagcgcgcgcaccggcggaagctgatgcgccggttcggaccggccctgcgtcacgtccggatcgtctgcctcgacgtgcgcgacgactacgccttcatggagccggcgctggtgagcctgctggaggcgcgggcggggcgcttcctgaccatccggaagccggactga

SEQ ID NO: 8511 - DNA, 2229 bp, Methylobacterium sp.
atgcggcggctggctcggggaatcgtccgcggcatcgccggggccgttctcctcatcgttccggcccgtgcggccgaaccggtcgagcaccggatcgaggcgctcctttcgcggatgacgctggaggagaaggccggccagctcaccctgatctcgcacgaaccgatcctcgacctcgacagcttccgccgcggtgaggtcggagccgtcatcaacttcaacaatgccggtctcgtagcccaggccgaccggctcgcccgctcgtcgcggctcggcatcccgctgctcgtcggcctcgacatcgtccacggctaccgcaccatcttcccgctgccgcttgccatggccgcgagtttcgatgccggcctcgtccgccgagccgcggctgcgcagggacgcgaatccgcggccgtcggcctcaactggacgttttcgccgatggcggacgtcacccgcgacctgcgctggggccgtgtggtcgagggtctgggcgaggatccgtggctgacggggcggctcaccgcggcgcaggtcgagggctttcgcgatggtgggctcgcaagcacgctgaagcacttcgcgggctacagtgcggtgctcggcgggcgcgactacgacgccaccttcgtggcgcccaccgaactgcacgaccttcacctgccgccgttccgcgacggaatccgggccggagccgacgcggtgatgacggcgctgaccgcgctcaacggtgtgcccaccaccgccgatccggcgctgatgaccgggatgctgcggcggcagatgggattttccggcctcgtcgtggccgattggcaggcggttgcgagcctgacgaagcacggcgtcgcccgagacgaggcggaggcggcgcgcaaggcgctgctggccggcgtcgacatggacatgacgagcgggctcttcctgcgccacctccccgaagaggtccgcgccgggcgcattcctgagagcgcggtcgatgaagcggtgcgccgggtgctgcggctgaagttcgggctcggcctgttcgaccgccccgtgatcgatacggccggcgccgaagaaaaactcctacgtcccgagacacggaacctcgcccgcgaggcggcacgggcgagcctcgtcctgctccaaaaccgcgaggacctgctgccggtcaatccggccaaggtgcgccgcatcgccgtcgtcggccccttcgccgattcagcctgggatcaggtcgggccgcacgagggtgcggggcaggaatgggacgcggtgacgatcctggcgggtttgcgcgagcgcgccgccgcatccggcatcgccatcgatttcgcgccgggttgcgggcgggtctgcgacggccgtgccgagttctccgaagcggtcgcggcggcggcgcgtgccgatctcgtcgtggccgtgatgggcgagccgcgggaccgttcgggcgagggctcatcgagcgcgacgctgtcttggccgggtctacagcatgagttgctcgcggcggtggcgggaacgggcaagccggtcgcgctcgtcgtggtcggcgggcgcccgaccgagctcggaaacgcgctggagcaggcgcaggcggtgctgatggcgtggcttccgggcacggagggcggaccggcggtagccgagaccttgttcggcgacgccaacccttcgggccggttgccggtctcctggccgcgcagggtcgggcaattgccgctgacctacgacgtcttgcccggtggacggccgcatattccgggctcgcgctggaccatgggctatgtcgatgaatcgccgctgccgctgttcccgttcggctatggcctctcctacacccgcttcgcctacggtgagccggaggtcgtgaccccgcatctcggcgtcggtgaccgctatgacgcggtgctggaggtgcgggcagacgtcaccaattacggcacgcgggccggccgggcggtggcacagctctatctcagtcagccggtggcgggccgcagccggcccaaacgcctgctgaagggcgtcgcgcttctcgatctcgcctcgggcgagaccggcaccgcgagcttccgcgttcccacgcgcgacctcggctaccatgagccggacggcacgctcgtggtggaggccggcgcctaccgcgcccatgtcggcggcgatgcggtcgcgacccgcagcgccggcttcaccgtcgagaccggctggcgcggcccgccggggagcgacgaggcgcggcgctga

SEQ ID NO: 8512 - DNA, 279 bp, Methylobacterium sp.
atgtttcccaaactggtcgggtctctcgctctcctcgtggccggatctgttctcctccacagctgggagatgccgcgctgggtgatcgcgaccctgtgcgccatcggcacggccgcgaccgttctgctcatcgcgcccgctctggagcggacggtcgctccggtcgcggcgacgccggaccgcgaaccgccgaaggggccagcgccggtcttcgagggaatctgggatccgctcgaccatcggcaggttctgagcggatcgcccggaacggatctctag

SEQ ID NO: 8513 - DNA, 996 bp, Methylobacterium sp.
atgaagcgaggatcgatcgcgggaagggtgccgggcgccctcatcctggcgctggcagtgctggcctcgcccgtccgggccaacgacagcgcggcgaccctcgatgcgggcggcctggtgctggtgcgtgatgacgcgatcgagctggcgagcgaggatcttcgcatcgccatcgaccgcatcgacgtcgattacgtcttccgcaaccgctcgaaggcgccgcgcaccctgcgtctcgccttcccgctgccgccgatcgacggggccgaactctcgttcagcgcgctctcgctgccggtgcgaggcagcgccaacttcgtcggcttcacggtcaaggccgacggcaaggcggtcgaaccggccctggaggagcgtgccttccacggcacgcaggagatcacggagcgcctgaaacggcacgggcttccgctcaatcccctgcggcgcgaggagttggaggcggcgctcaagcgcgtctcgcccgccgacctcaaggccctgcacaaggccgatctgctgtccgatgcgacgactgacgccggcgcccagtggcgcagcgaagccaagttccactgggagcagaccttcccggcggacgcggagctgcgcatcgcccacagctacgcgccgatcgcgggcaactggttcctctcgcccgaggaggctacggcgcgcgacttccgtgcccgctactgcctcgacgatgcgggcctggccgggatccggcgcctcgccgcggcgaagcccgagggctacacccgcgccttcgaggtgccctacatcgtcaccacggcccggaactgggccggccggatcggccgcttcaccctgacggtggacaaggcgcgcgccgacgccctggtcagcttctgccggcagggcgtgcgcaagaccgatccgaccaccttcgtctgggaggcccgcgactacgtgccggattccgatctgcgcgtgctcatcgtctcgaacgatccggctctcctgggagatcgctga

SEQ ID NO: 8514 - DNA, 2262 bp, Methylobacterium sp.
atggctggcgaccgagccaatctgatcctcgcgaccgcgcagggtgcggcggacggctgggccaagtatcttcaaggagagggtacgatcgatatcacgatcggtatcggcaacgtcggcggcggcaactacctcgccaatggcggtcccaactgggcctggagcggaacgcggtgggaatacgccgccatcctcgaagcgcgcgaaggttatgacgggaacggcgggaccccggaaggcaccgtcacgctcggcgagcatcggctcggagacctgttctacgatccggccggaacggccgcggttccgggcaacaagatcgatgcgttcgccctgttccagcacgagatcgggcacgcgatcggcttcgtcgatttcgcggccacgacctcggccaacggcgcgccggtcttcaacggcgataacacgcggacggttctcggcggcgcggtccagctcgacgcaacccgcgcgcatgtctcggggatcgaggatctgatggatccttattccccctggggagggcgtccggccatttcggacctcgatctggccatgcttcaggacaaggggatgccgatcgcgaccgagcgggcagacaagctctcgctcggcactcgcagcgacaccttctacgcctatgggggcgacgactggatcgacggtggtgcgggcaatgaccggctcttcggcggcgccggcaacgacacgctcatcggtggcactggaagcgatgcgctggatggcggcgacggcactgacaacgccgtgttcgcaggccgcagccgggattacctggccctttataacacgaacggcggcggctcggtctccatcaagcatctcgcctcgggcagcatcgacacgctgacctcgatcgacgcgttgaacttcgatgacaccgtgctcggcatgtcggggctcctcgcccacctgcaggcgcgctacggcacgggggccgccggccaaggcgagacctacgaaatggctctgaacgccgccgccgacgaggcctatcgcgccgagattcccgagatcgacggggcgttcagcgtcaccgcgcgggtccggttcgacgatctcgcggacggctactaccagcgtgtgttcgacaccggcaacggtccggacagcgacaacatctggctcggccaagtcggcaacggacgcgacatggccttcgagatcctcgacggcgcgatcacgcatcgtatcaccgccctcgacgcgatcaccgagggcgtggaggcgcgttggtccgcagccgtcgatgagcggggttggatgtccttgtccaaggacggcgtacgcgtcgccgagggtcagggggtcgtgccgcgcgacgtgacccgcgtgaaggacctcgtgggcgcgtccaactggggggccgacacggcgctgaaaggcggcgtctacgatctgaccttcaaggacgatctgcccgacatccacggcgccttcacggcgagcgccacggtccggttcgaggatctcgatgccggcgcctggcagcgcgtctacgatttcggaaacggtgccggcgccgacaacgtctttctcgggcagatcggcaggtcgagcgacatgcagttcaccatcgtgaacggcagcaagtccgcccatgtcgtggccaagggggcgatcgtcgagggtcaggaggcgacgtggacgacgagcgtcaacgagaccggctggatgcgcctgttcaaggatggcgtcctcctggccgagggtcagggcatcgtcccgaaggatatcgcgcgggtcaacgaattcgtcggcaaatccaattgggcggcggacaagcccctcgtcggcgaggtgagcgacctgaccatcacgccgtacaaggccatccccgagattgacggcgccttcaagatgttcgccgaagtccgcttcgacgatctcgacgacggccactttcagcgtgtgttcgataccggcaacggcccggacagcgacaacatctggctcggccaagtcggcaacggcgacgacatggcgttcgagatcctcaccggctcgaccaagcaccgcatcaccgccttggacacgatcgtcgagggggagatggcgaagtggcaggcgagcgtggacgaggccggctacatgcgcctgatcaagaacgacaaggtcgtggccgagggtcagggcgcggttccgctggatgtcctgcgtacgagcgacctcgtcggccagtccaactggtcgtgggataccgcgctggccgggcaggtgaaggacctgatcttcgcctga

SEQ ID NO: 8515 - DNA, 1206 bp, Methylobacterium sp.
atgccaggccccgcccgcaacatcggcccttccgagcgcgccggccctgaccaatccgcggcccccgcgccgctgggcttcggcacgcataccgccaacgtgttccgcctcatcgtcaaggagctgcgcagcatccgcgccgatccggtgatgctgttcctcgtcgtctacgccttcactttcgccgtccactcggttgcctccggcgcctcgaccgaggtgcgcaacctgaccgtcggcgtcgtggatgaggatcagtccgacctctcgcggcagatcgtcagcgcgctcaacccgccgctggtgaagagcgtcgtcgcgctgacgccggccgagatcgacccggcaatggataccggtcgtctcgtcttcacgatcgagctgccgccgcgcctgcagaaggacgtgctcgccggccgtccggccgaggttcagctcggcgtcgatgccacggcgatgacccaggccggcaacggctcggtctacctccagaccatcatcgcccaggaagtcgcccgcttcgccgcgcgcagcgacctcagcgacaccgccccggtgcaggtggtgacgcgggcgaaattcaacccgaatctccagacgagctggttcacctcggtgatgcaggtgatcaacaacatcacgctgctcaccgtcatcctcaccggcgccgcgctgatccgcgagcgcgagcagggcacggtcgagcacctgctggtgatgccgctggtgcccgtcgagatcatgctcgccaaggtgatcgccaacgggctcgtcatcctcgtcggcgccggcctgtcgctggtattcgtcgtggaaggctggctcggcgtgccgatcgccggctcgatccccctcttcctgttcggaggcggtctctacgcgctggcggtggccgcgctcggcatcctgctcggcaccatcgccagctccatgggccagttcggcctgctggtgatcccgatcctgctgctgatgcagctgctctcgggcagcagcacgccgatggagagcatgccgtactggctccagatcctggtgcagatcgtgagcccgacgccgcacttcgtcgcgctggcccaggccgtcctctaccgcggcgccggcctgtccgtggtctggccgcaactgctcgcgctggccgcactcggcagcgtctacttcgtcttcgccctcgcccgcttccgccgcgtgatcttcggggtctga

SEQ ID NO: 8516 - DNA, 915 bp, Methylobacterium sp.
atggccggatcgtcctccgccgccgcgcggccgacgaaattcggtgagccccgcacgctcgcccttctggcgctcgccgccctggccaccctcgtcgtgatcgcggcggtttggacccttctcgccggtggcgcgggcgggggcacggtccaggcggtgagcgaggggctggcgagccgcggcttctggaccgccgtcgcggtcgggctcgcggcgcagactgtcgatggcgcgctcggcatggcctacggcatcacttcgaccaccttcctgctctccaccggggtgccgccggcggcggcctcggcctcggtgcatgtcgccgagatcttcaccaccgccttctccggcctgtcgcactggcggctcggcaacgtgaacggggcgctgtttcgacgcctgctgatccccggcgcgatcggcgcggtggcgggcgcgtatctcctcacatcggtcgatggcgagaccatcaagccgttcgtctcggtctacctgctggtgatgggtctctatgtcctgtcgaaggcgttccgcaccctgaagacccgccgcgagccgccgcgcgcggtggtgccgctggcgctcggcggcggcttcgtcgacgcggtcggcggcggcgggtggggaccggtggtgacgacgacgctggtcggcggcgggcaggatccgcgcacctccatcggcacggtcaacgcggcggagttcttcatcgcgctggcgagcggcctctccttcagcctgctcggcgggctgacacactggaccaccatcgccggcctcgtcgtcggcgggctgttcgcggcaccgatcgccgcccttctggtgcgggtgatcccggcgcgggcgctgatggtcgtggtcgggctgctgatcgcgggcttgagcctcgtgaacctcgccgggctgttcggctaa

SEQ ID NO: 8517 - DNA, 699 bp, Methylobacterium sp.
gaagtgccgggcgcccgcccgcccgccgccgaggcggaggcgcccgcggcccgcgacgaggcaacggagcgggccgaggccggggccgtgaacccctcggcgaacgcaatcatccgctcgctcgcccccttcgccgacggcaatccgggccgtcccgccgcgccggtcgcggtgtcccccggcgacggcggtccgagcctgcgggtcgaccccgcccgctcggtcgatctcaccgtgttcttcgcctacgacagcgcccgcctgacgcccgaggcgcgcatccagctcgaaccgctgggccaggcgctgcaggcccgcgaactcgccggccacggcttcctcatcgccgggcacaccgatgccgcgggcggactcggctacaaccggcgcctgtcgctcgcgcgcgcccgcagcgtgagggcccatctcgtcgagacctacggcatcgatccgcgccgtctgcgcatccacggctggggaccgggccgccccaaggatccgtcccagcccttcgcgcggatcaaccggcgggtcgaggtgagcctgatcgcgcctgcgccgagcggcgccctgcgcttcatcctgccggcctccgagcggagttgcgcggccgagcctctcggcgatccccgccggcaggtcccactcgacctcgacgatttcggcgcggcgccgacgcccctgccctgcaccgactga

SEQ ID NO: 8518 - DNA, 195 bp, Methylobacterium sp.
atgattttcatcggcggattcgtcgcgatcccggccttcggcagatgggcgcatcaggtcacggaagcgctcgctttcctgctggcgaccgtcctgctggtgacggtgatcatggtcctttgcgatcgatggccggattactttgccaatcctcgggcgccggtcaccgtgatcgtcgattcgcctcgggattag

SEQ ID NO: 8519 - DNA, 180 bp, Methylobacterium sp.
atgaaatccttccttcgcgccggtacggccatcgccggcatcgccttcgccggttcggcgctcgccgccgacctgccgcgccgcgccgctccgcccccggtgttccagccggtgccggtcttcacctggacgggcttctacgccggtttcaacgccggttacggcttcggcacccaggac

SEQ ID NO: 8520 - DNA, 1710 bp, Methylobacterium sp.
atggatcgtagcgaaggcccgccccatcccgcgccggacgtttcgcggcgcgcgcttctcctgacctccgcttctgccctgggggcgacgatgatgccgagccgactcttcgccgaggcgggtgcgccccgtggcgccctcgcccggtcccgtcagggcatggtgacgagcccgcatgaactcgccagcgaggcgggacgggaggtactgcgggtgggcggcaacgccatcgaggcggcgatcgccatcaacgccaccctctgcgtgacctacccgcatttctgcggcctgggcggcgacgcgttcatgatcgtcagcgatcgcaacggcgccagcttcaccctgtccggcatcggtcaggcggcggcaaaggtgccgcaggacggccggccgattccgacgcgcggccccggctcggcgatcacggcggcggcggccgtcgatacctgggaacaggcctttacctacagccagcgggccctgggcggacggcaatcctggcgcggtctgtttcagcgcgccatcgcctgcgcgacggacggcttccccctgacgccgtcacaacgcttctgggcgaatttccgggccaaggagatcggcaactggcccgatatcgtgcgcgtgttcaccgccgagggccgcatcccggaggccggggagaccttccgccagcccgacctcgcccgcacgctcacggcgctggcggagaacggcgggcgcgacttctacgagggcgaactggcccaccggatcgcgcgcgggctggaaaaggcgggctcgcccttgaccgtggacgatctcgcccgctgccgggcgcgcaacgagagcgcgctgcgcgtgccttaccgcggcggggaactcgtcagcctacgcccgccgacgcaggggctgaccacgctcgagatcatgggcgtcctcgaccgcttcgacctggcctcgacgcctgagggcagcgccgactactaccacctcctcgtcgaggcggtgaagctggccttcatcgaccgcaaccgcttcatcgccgatccggatttcacggacgttcctgtcgagcggctgctgtcgccctcccacctcgatgggctggcccgcagcatcgaccggcgcaaggctgcgccctggccgcatgtctacaagaccggcgacaccgtcttcatcggcgcggccgaccgggacgggaactgcgttagcctgctgcagacggtctatttcgactggggaagcggcgtcgtggcgggcgataccggcattctctggcacaatcgcggtgcggccttcagcacggaggcgggccacatcaacgcgcttcgacccggaaagcggccgttccacaccctcaatcccggcatgtacttccaaaacggccgtccgcggctgctctacggaacgcaaggcgcggacgggcagccgcagacgctcgcggcggtgctgacgcgtctgatcgattatggaatggacccgctcaccgccctcgcccggccgcggttcctcctcggaaagacgttctctgacagccgcgacagcctgaagctcgaactcgatgcgggtcaggccgtgttcgatgaactcaaggcgcgcggccacgagatcagccccatcccggcgcagagcccgctcgccggccatcccggtgcgatccgcatcgaggacgacgacagcctcgtcggcgcccacgatccgcgcagcgacggtctcgctctcggactctga

SEQ ID NO: 8521 - DNA, 459 bp, Methylobacterium sp.
atgcacctgacgctgaccgaaccgggcacctggatcgcgaccccgaccgtcgcgcagcgcttcggcatctcggtgcatcacctccagaagatcgcccaagccctggtccggtccggcgtcgtcgaggcgcggcagggccgctccggcggcgtgcgcctcgcccgcgacccgcgggagatccggctcggacggctcgtggcggacctggaaggcgtcggcacggtggtcgattgccggcgtgacccttgcccgctcatcggccgctgccggctcaaatgggccttcgacgcggcggaacaggccttcttcctcgaactcgaccggctcaccctggccgacgttgcggccgggccgacggcgtcggcgctccgcgccctctttcgtgccgaaccggaggcgcgggtggtgacgactgcccccgatccgactgatcccgccgagcccggttctggcaattga

SEQ ID NO: 8522 - DNA, 1194 bp, Methylobacterium sp.
gtgctggcggtgctcaccgcgctgagcggtgcccttctcctcgccttcctgctcggccgcggtgccctgcgcgatgccggcgtcaattcacacggggcactggctgatgcgctcctgcacggacggctctgggtcgagcactgccccgagatcgactgcgccctgttcgagggccgcacctacatcatcttcccgccgctcccggccgtgctgctcacgcccttcgtcgccctgttcggctttcccggcttcaagggtttcgtgctcttgggcctcagcctgtcggtcctgagcctgctcgcttggagccggatcttccgtgcgctcgccgtcgagcgctggcctgcgctgtggcttctggcggcactcgccttcgcgagccccctctatcaggtcaccctgcgctcggacggcgtctggttcttctcccagacccttgccttcctgatgatgagcctgagcctctgggcggtgatctgccgggcgtcgctgccgctcgccgggctgttcgtcggcctcgccttcctgtgtcggcagatggcgatcttttatcccctgttcctgctagttctggccctgccccgcgaccgtccgctgctcgcgaacccgacatccgtcgcgcgggcggcgcttctcgcgggccttccggtcgtggcggccatcgccgtctattgcgcctacaacgcagcccggttcggcagcccgttcgagaccggttacgcctatatccacaatcccggccaggacagcttcatctggcaccggatcaccggcaccggcctgttctcgcgcgactacctgctgttcaacatgctctacctgttcctgcagggaacgcatttcgagttcagcggcccgcggctgatggatctggtcggcttcgacaaggccggcacgtcgatcctcgtggcgagtccctggctgttgctcgccttttatgcgcggcttgatcgggtgttctgggccggggcggcgaccatcgcggtcattgccgggatcaccctgttttatcattccaacggcgccgagcagatcgccacgcagcgctacgttctcgattggctgccgatcctgatggtgctgatggtgcgcggtgaacgcccgccggccttcgccgccctgccgcttctcgtcacctggggcgtggtggcaaacctcgccgtggtcacgctgctctcggtctacaggctctga

SEQ ID NO: 8523 - DNA, 1398 bp, Methylobacterium sp.
atgagcgcgaccggacttccctccgacttcctcgcccggctcgatgcacggctggggccgggcggcctgctgacggacgaggccgattgcgcccccttcgccatcgactggcgccgcctgttcccgggccgggccgccgcggttgcgcggccggcgagcacggagcaggtcgccgccatcgtcggcttgtgccgcgaggccggcgtcgcgctggtgccccagggcggccataccgggctcgcgggcggggccacccccgacgcctcggggcgccagatcgtgctctcgctcgcacggatgaatgcgatccgcgcggtcgatccggtcggcctcaccctggaagtcgaggcgggctgcgtcgtccaggcggcgcaggccgcagcggaggccgccgggcggctgttcccggtgagctacgccgcggaaggctcggcgatgatcggcggcatgatcgccaccaattccggcggcatcaacgtgttgcgctacggcatgacccgcaacctcgtcctcggtctcgaagtcgtgctcgccgacggcagcgtcgtcgatggcctgcgcgccctgcgcaaggacaatgccggctacgactggaagcagctcttcatcggcagcgagggaacgctcgggatcgtcaccgctgcggtgctgcgcctcgtgccccgtccgcgccacaccgagaccgccctgctggcggtgccggatccggaggcggcgctccgggtgctggccgccgcgcaggacggcctgggcgacacgatccaggccttcgaattgatctcgcgctgctccttcgagctgctggagcgccatgccgacatggcgagcccgctctccccctcgccctggtgcatcctgctggaggcgggatcgagcctctcgggtctccgggacgcggtcgagggcacgctcggcgaggttctggagcggggcgatgccctggacggcgtgctggccgaatcgaaggcgcaggccgctggcctctggtccttgcgcgagcgcatcaccgaatgcgaggcgcaccagggcaagtcggtcaagcacgacgtctcggtgccgatcccggcgatccccgcctttctggaggccgccgaccgggcgctggccgagggcgcgcccggcaccgtcccgaacgtgttcggccacatgggcgacggcaacctgcactacaacgtgctgatcggggccgagcatgatggcgccgcgatcaaccgtctcgtgcacgacgtggtcgaccggttcgcgggcagcatctccgccgagcacggcatcggccagtaccgtgtcgacgaactggcgcaccgccgccggcccgaggagatggcgctggcgcatcgcctgaagcgggccctcgacgcggacggcctgctcaatccgggcaaagttctgcggacctga

SEQ ID NO: 8524 - DNA, 1758 bp, Methylobacterium sp.
gtggccgaggcggccgccttccgcagcttcgccaacggatacctgcgcgagatcgaccccggcatccgcgtctgccacgcgctgccggacggcccgcccgcacgctgcgtcgagtggaacctgcgcagccgtcgcctcgcgatccgcgccgagatcctctccccgtcgctgtgcggcgcgcacgccttcggccgtctctggacgcgtcacctgcacgagccgcgctggcgggcggtggcgccgatgcgggcgcttcaggagcttctcggcgaggcctattcccgcgccgacgagggccggggcgagaccgcccgcgagcgcgagctggaactgctcgggcgcgtgctcgacagctaccgcgagaccgcccgcctgcttgattttgcggagcgggaggcggacgccaccggcttcatcgccgccgagcgcgccctcgtcttcggccactggctgcacccgacgcccaagagtcggcagggcctcaccacctggcaggcccgcacctacgcgccggaggagggcggttcgttccggctcgccgtgttcgcggtgcaggcgagcctcgtgcgccatgattcggctgagacccgcgccgcgcccgacctcgccctcgacctcatcggctcggatgccgcccgcctggatctgcgcgcgggcgagatcgccctgccgatgcacccgctccaggccgaggcgctgatgctggagccgcacgtcgcggcgctcgtcgaggcgggccgcctgcggccgctcggcgccttcggcccgcgcttcaccgcgacctcctcgctgcgcaccgtctacgccgccgagagcccgtggatggcgaagttctcactgcccgtcaccctcaccaactcgctgcgggtgaaccggctcgccgaactcaaggccggcgtcgccatggcgcggctgctggcgaaaagcgggttcggcgcgcgccatccgaatttccggatcctggccgaccccgcctatctcaccctgcactgtcccggccgcgaggagagcggcttcgagacggtcctgcgcgaaaaccccttccggaacggcgcggagcggggcgtcgccacgctggcggcactcaccgccgagccgctgcccggccgcccctcgcggctggaggcgctcctgcggcaggtctgcccggaaggcgcggccgcccgcgcccaggccgcccgcacgtggtttagccgctatctcgactgcatgctggagcccgtcgtcgccctctacgacgggcacggcatcgcgctggaggcccaccagcagaacgccctgctcgacgtcgcctccggctggccggagcgcggcttctaccgcgacaaccagggcttctacctgtcggaggccgcccgcccgcggctcctgcgcgacgcgcccgagaccggttcgatcgcctcgctctacttcgccgacggcgagatccgccgacgcctcgcctactatctcgtggtcaaccagatcttttccgtgatcgcccggatgggccatgacgggctggcgcgcgaggaaacgctcctcgacgatctcgcccggcgccttgaagcgatggcgcaccgcctgacgggtgcgggccacgccttcgcccgctcggtgctcgacgggccgacgctctgcaccaaggccaacctgcgggtgcgcctgtccgaccgcgacgaactcgcctcgggcgacggccgcggcaactacatcgacatgctgaacccgcttcacgcggcggctcggggcgaggccggccatgccctcgcttcgtaa

SEQ ID NO: 8525 - DNA, 240 bp, Methylobacterium sp.
ttgccccacgtcgccccggccaccgaaccgccgcgcgccgaaaccgaggcgagccgaggcttgccgagctacatcgtcggccaggacggtcagggccgctgggtcgccctggagagccacggcctcggcggcggctacttccgcagccgcgaggcggcgttccaatatgcggtcggcaagaccggacgccgcgccggcgcggtccgcctcagcgccgagccgttgcgcatcgccctgtga

SEQ ID NO: 8526 - DNA, 1944 bp, Methylobacterium sp.
gtggtcggcgcacttggctgcgctctgggggccgcaccggcccaggcgggcatcaccggcatcgagatcgccagcgtcgagccttttgccgacggcgccgagttcggcgcggccggcagctacgagcgcgtcgtcggcacggcccgcggcgagctcgacccggccgatcccgccaatgccggcatcgtcgacatcgccctggcgccccgcaacgcccgcggcatggtcgagtacaagaccgacctgttcatcctgcggcccaaggatccggcccgcggcagcggaacgctcttgttcgaggtgctgaaccggggccgcaagttcctcttcaactgggtcctcgatgcgccggcccaaggcgtgcaggccgtcaacgatccgaagaccgccacggatgccgggaccgggctcgtcctgcgccggggctacacccttgtctggtccggctgggaggcggatgccctccgccaacagggcggcatggccatcgatgtgccggtggccacgcgcggcggcaagccgatcgtcgagctcgtgcgcgatgaactcgtcagcgcgacccgcgggcccccggaggcgcccttcgccctgaccttcaagacagccagctcggacaagacgagcgcgcggctcaccgtgcggcgccgggaggccgatccgccgcggccggtgccgccggaggcttggcactatgccacgccgcgtcagatcgagctcctgccgaagggcaccaagccgttgcccggctcgctctacgagttcacctatcaagccaccgagccgaaggtgctcgggatcggtttcgccgccacgcgggatgtggtggcctatctccgcagcgaggccggggccgcggccaacccggcgggcggcgccatcaggcacaccctcgcgctcggcatctcgcagagtgggcgctatctgcgcgatttcatccagcagggcttcaatcgggacgaggccggcaagcgggtcttcgacggtgtgctgtcccatatcgcgggcgtgggcggggtgtttctcaatgcccgcttcggtcagccctcgcgcaccaacacgcagcacgaagaccacctctatccggagaacaccttcccattctcggccgcccgcctgcacgatccgatcaccgggcggacgggcagcatcctgcgggacgatggcttcgatccgctgctgatcgaagcgaacaccggcacggaatattggcagaagggtgcctccctcctgacgaccgacccggtcggccgcagcgatgtgccgctgcccgacaccgcgcgcgcctatctgatctcgagcggcttccattacgggcgtgcgggcctgacctcgaccaagggaccctgcacgaacccgcgcagcaccctgaatccggccccggcggttcgcgcgatgctcgtcgcgctggaggagtgggtgaaggacggcaaggacccccccgacagccgtgttccccgcctgtccgacgggactctggtcgaggcggcggagatcggctttccgttcatggtcggcgtccccgttccgacggcgcccaatgcgatcgcgcgcttcagcacctacctggacccgcgcccggaaagcgggccgcaatatcgcccgctggtcccgcgcgtcgatgccgacggcaacgacgtggccggcatccgtctgccggccgtcgcggcaccgcgggcaaccttcacgggctggaacctctatgccgatcccttccccgccgacgccttgtgcgaccgggaaggcagccagatcccgttcccggccacgcaggccgatcggaccgcgaaaggtgatcccagacaatccatcgaagagcgttatccggatgccgccgcctacatcgcggccgtgacgaagtccgtcgatgctctcgtgacggaccgcctcctgctgcgcgaggacggggatcgcctgattgccgcggctcgacaggaagcgccgtag

SEQ ID NO: 8527 - DNA, 204 bp, Methylobacterium sp.
atgccgcatttctcgaaggaaggcctggaggcctcgccggaagcgctggccaagctgcgggagatcctgcacgggcgccaacagggtggccgcgacggccggaccgtgccgtcgacgccgaccaaggagggccgcttcggcacctccggcggccgaggggcgccggtgcgccgccggcgccggacggatctggcgggggtgtga

SEQ ID NO: 8528 - DNA, 2424 bp, Methylobacterium sp.
atggagcggacgggtaccgtcccggtacgcaggccgttcggtgccgaggagttgaaggccctcgccctggagtgcggtgcggacgacgtgggcttcgtcggcatcgaccgggccgaactcgaaccgcaacacgacgagatccttcggcactatccctggacacgctcgctgctgagcatcgtcgtcaagatggcccaggcaccggttcgcgggacgccgcggtcggtcgccaacctcgaattccatcgtgccggccacgataccaacgcggtctgtgccaagatcgtcgcacgtctccaggatcggggcatccgagcggtgaacccttccatgggcttcccgatggagatggaccagaacccagggaacgccatctggatcgtggcccacaagcccgtggcagtcgccgcgggcatgggccgaatgggcatccaccgcaacgtgatccatccgaagttcgggaacttcatcctgctgggcacggtgctgctcgagcaggaggtcgacgtcgcggacgaacccatcgacttcaatacctgcctcgactgcaagctgtgcgttgcggcctgcccggtcggcgcgatcaaggtcgatgctccgttcgacttccaggcctgcttcacccataactatcgcgagttcctgggcggtttcaccgattgggtggagcagatcgcggattcaaaggacgcgctcgactaccgccggcgggtgaacgagccggagacggcctccatgtggcagagcctgacctacggcgcgaactacaagtctgcctactgcatcgccgtatgcccggctggcgaggacgtgatcggcagctacctgaaggacaaggcggcgcatcgccgggacgtcctcaaaccgctgcaggatcggccggagccggtctacgtcgtggccggaaccgatgccgaggcggtggcccgccgtaagtggaagcacaagacggtgaagccggtgggcaacggcatgacgccgcgcaccatctccgggcttttgaccttcatgcccatcgtgttccagccggcgcaggcccgcgggctcgacaccatgtaccacttcactttcacgggttccgagaaccgcgatgtgactgtcaccgtccgggacggcaagatcgccgtccgcgacggcctcgtcgacaagcccgacatcagggtgacggcggacgcgaagacttggctcgggttcctcgccaaggaaaggagcctggtctgggcgttcgcgcggcggaagatccgcgtctccggcgacccgcggctcctgctggccttcggcaagtgcttcccgtccccggagattcggcgcagggatgttgagatcctcccggtgaactccctcttgcggccggcgatcacggcctacgagaagaacgacgagatgaccggtaaggtccggtggtcgggcgagctggagctgaaggaggtcgagcgtgtcaccggctcggtgaagacgttccgtttcgtagacccggcaggaggcgagatcccgttccggcatgtcgccgggcagtacctgacgcttgagtgcgtccgacagggcataccaacccgacgctcgtacaccatcgcctcgtcgccgacctggcgggaccgcgtggagatcaccgtcaagcgcgaggagcacggcacggtctcacgatggttgcatgacgagctgcagccgggcgaccgtatcaaggtcgaggctccgagcgaaaccttcgtattctcgggcaccgaatggccgacggtcgtcctgatcggtggcggcgtcggcatcacgccgatgatgagcagcgtacgctacctcaccgagacggaatggcccgggacgatctacctgctcctgagcttccggagccgggaggacttcatcttcgagagcgagatcgagagcttgaagctccggaacccgaggctgcgcgtcgccgtcgcgatgaccgagcccaggcaggcgggttgggatggccataccgggcgcatcgatgcgcggttcgtcacggccgccgtgcccgacatcgccctacaccgcgcacatgtctgcgggccgacgccgatgatggacgcggcgaagggaatcctgctcgacctcggcgttccggccggtcaggtcaggatcgaggctttcggaacggaccggcgcgatccgaccaagaaggtcgggaagtccggccaggtcgtcggcaaggtgaagttcctggactccggcaagtcggcctcggcccgagagggcgcgacgctgctcgacgtggccggcgaggcgaaagtccgcatcgacagcgcctgtcgctctgggacctgcggaacctgcatggtgagactgagagctgggaacgttcgcatgtcggtccaggacgcgctgagcgacggtgaccgagaggacggctacatcctcgcttgccaagccgaacccgagggcgacgtggagctggaagcctag

SEQ ID NO: 8529 - DNA, 1311 bp, Methylobacterium sp.
gtgagcaacgagacgttgatcgccgcgatcggcacggtgctgcgcgaggaaatgcgccatccccatctcgatgggttcgggccggaggcgcggctgaacgaggatctctacctcgattccgtgcagttgcttcagctcatcctggcactggagctgacgcacggcgtgtcggtgccggaagaggcgatcaaccggcaggacgtctcgactgtggctgacctcgcccgcctgctggcgccgggcgcggaaccggccacaccggccgccgaaccggaggccccctccgagggcgtccacggggcgatgccctacgatctgaagatccactgcttcgtcagttgcgtctgcgacgggctgaaacgccgcggcatcgatcaccgtccgttctacgccctgatctgggacgccgaattcgcgatcaccgacgggtcgaagctcgcctaccactcggacgcgatggaccacgagtcgttccgctactggttcgagcggctctacggcgtgccgctcgtgccctggtacgaccattcccgctcgaaggacgagaacgtcgccaccctgctcgacctcatggagcggcgggaaccgaacgaatgcatcatggtgatgctcgacatgttccacctccccgagcgggagaacaagttcaaccagaaccccttcccgcactacctgctggtgtcgctctccgacgatcccgacctctggcaggtgcgcgaccccgacttccgctgggagggcgtgatcgagtgcgagcggatgctcaacgccatccgccagccgagcgtggccggcggctaccgcttcgatccctcgctggcccacccgccgagggacacggatctggcggccttcttcgatgcctgcttccggctcgacgccaacccgctgatcgatgcggcgcgcgccatcgtgctggcccatgccgagggacgcggcggcttgaagctgaccgatctcggcgaggcgttgcgcgaactaccggtcatcaccatccgcaaatgggcctacgagcacggcttcgccttcttctggcgcgccctgcgctggccggacccggagttccagcggatctgcgacgagatcgaggccctggtgaacggcctcaccgccctgcactacgccgtgctgaagcttgcccggaccggggacgtggccgaactcgcccccgtcctcgcgcggctcgatgccctcgacgcacaggaattcgcgatcaaagggcagctcgccgcggcctacgccgcgtggcggcagagaagcccggatctcggcaacgccgcgccgccctcccgcgaaaggctctccgcatga

SEQ ID NO: 8530 - DNA, 279 bp, Methylobacterium sp.
atgaccgagagccacgccgtggtcagcaccccgcatgccggccgctatctccagcagctctgcaagcactgggcccaccggttcgagaccgagttcagcgcgacgaacgcccggatcgccctgccgctcggcgagacgcggctgtccgccgacgcggagaccctgacgatcgatctgaccgcgcaggatgccgccagcctgcccggtctgcgcgacgtcgtggtgcgccacatcgagcgcttcgccttccgcgagacgctgcgcttcgactggacgtga

SEQ ID NO: 8531 - DNA, 501 bp, Methylobacterium sp.
atggacctgacgatacgggccctgcgcgaggacgatgcgcaggatctcttcgaaatctacaatcagcccgccttccgcttcggcaccctggcactcccatacgaatccttcgaggccgtgaagaagtgggccgagccgcgctcgccgcgcgatctccacctcgcggcggagcgggagggacgcctcgtcggggcggcggccctgcggcccttctacggccggcgcgcccacgcggcggagttctggatcgcagtgcacgaggatttcgccggcaacggcatcggctcgcggctcctcgcggcggtgatcgacaccgcggacaactggatcaatgtctcgcgcatcgagataacggtcttcaccgacaacgcccgcgccatcgcactctacgagaaattcggcttcgtcattgagggcacgcaccgggccgcctcgttccgcaacggccgcctcgacgacgtgcattgcatggcccgcctacgcccgacgagcgagctctga

SEQ ID NO: 8532 - DNA, 8385 bp, Methylobacterium sp.
atggccacgagcctcgccgccggcgacatcgctcttgtcggatacgatgccgacaatcccgacgacttcgccttcgtcatcctgcgcgacatcgaggccggcaccagcatcaccttcaccgataacggctggaacagcagcaccaacgcgttcctgtccaacgagggcagctacacctacaccgcgccaaccgcgctcgccgccggcacggtgatccacccgacggccgacagcgcggccgggggagcgaacacccccgtctacacggcgaccgacgcaccgcgattctcattcagcacgagtggcgaccagatcctcgcctatcagggcagtgcggcgaacccgaccttcctgttcgcgatcaatttcgccgacgacagcgggagcttcgcggccgacggcactgatgccaacacctcggcgctcccgcctggactgatcctcaggcagaccgccgtggcgctcggcgccgataacggccgctacaatggcaccgtctccggcactcgcgatcagctccttgcggcgatcggcacggccggatcctggagccaggacaatgccgcccgcattggcgccggcagctacggcgccttcacggtgaccgccgccgcagtcgctcccgccctgtcgatcgacgacgttcaggtcagcgagggtgattcgggcatgaagcagctcgtcttcaccgtctcgctgaatgcgcccgcgcccgcgggcggcgtgagcttcgatatcgccacggccgacggcagcgccgcggccggcagcgactacgtcgcccgggcgctcaccggccaagccatcgcggcgggccagaccagcacgaccttcgccgtggatatcctcggtgacaccgcgatcgagccgaccgagaccttcacggtcgcggtctcgaacgtccgcggggcgacggtggcggacggacagggcaccggcacgattctcaccgacgacgtcggcacgcgcatcaacggcatcacggtcttcgacgcggcgccctcgcttcagggcctctccggcgccacggcggcgccggtcgcgacgaacgcgctccagctcgtacgtctcggcgcctacgccgccaccaacgacccggcgacccaggccgctcccaacgccgaggtggtggcctacgattcgacgaccagccgcctctacatccagaacacgggcgagaaccgcatcgagatcgtcacgctcgacgcgaccggggccctgaccaagcccggcgagatcggcctgtccgggctggagcagtacggcgcggtgaactcggtggcggtcttcaacgggctcgtggccgtcgcctacgccaatgcgaccggcgatgcgccggggcgggtcgctttgttcaacgccgacggcaccctgctgcgctcgctcacggtcggcgtcgggccggatcagatcgtcttcacccgtgacggtagccgccttctcgtggccaacgagggcgagcaggcgagcgccggcagcaacccggtcggcggaatctcgatcatagacgtctcgggcggcgcggccaacgccgccgtcacggccaccgtcggcttcgaagggctcgacggcagcgaggcggccctgcgcgcccgcggcctcgccatcacgccgggcaagagcgcggcggccgatatcgagccggaatacatcgcgatttcgcccgacaaccgcttcgcctacgtcaccctgcaggaggtgaacggcgttgccatcatcgatctcaccaatcccggcacgacaccgatcgcgattcagcccttgggcgcggtcaaccattcgctcgccggcaacgaattcgacgcctccgaccgcgacgggcccgccaacgcgcagggcgtcggcagcgcctcgatcagcattgcggcaaccccggctaacacaccgatctacggcctgctccagcctgacgccgtggcctcgttcgccaccggcggtgcgacctacttcgtcaccgccaacgagggcgaccagcgggtgatcggcggcgccgacgacaccggtgacgtgacccgcctgagcaacatccccaacagccggctgacgcccgaactccagctcctgaaggccgatccggcctatgcccgcctcaacgttctgcagcgcacgggcgataccgacggcgacggcgtgatcgaccagctccacacgctcggcgggcgcggcatctcgatcttccgccagaatgccgacggcacgctcaccaaggtgcgcgagaccggcggcgagttcgagaagatctttgcccagatcgcgccggagcgattcaacaacgaacaggggctcgccaatacgccggacgaccgctcggataacaaggggccggagcccgaaggcatcaccatcggcaccgtcaacggccggatttacgctttcgtcggcctggagcggcagagcggcgtcatcgtctacgacgtgaccgatccggccaacgcggcctacgtctcctacgtcccgccgctgccgggtgcgacgaccgatctcggcccggaggtgctgaccttcatcgccgccgaccgcaacccgaccggcactcccctgctggtcagcgccaacgaggtcgccaacggcggcgccgtgctctacgccgccctgccccaaggctacacgcaggaagtcggcttcgccacgaacgccctcaccgtcagcaaggccgagggcaatgcgggcgagagcgtgttcaccttcacggtggagcgcaataacggcacgctgggtgctgtctccttcaccgccgaactcacgggcagcggcgccaacgcggccgataccgccgatttcgccggcgcgccgggcctgcccctgacggtcgtgggcacgatccccgccggcgccgccacggcgcaggtcagtgtgacggtccgggccgacgtcctgcccgaggccgacgagaccttcgccctcaccctgcgctcggtcgcctcggaccaggccggcatcacggccgccgtgcgcggcagcgccgccaccgcgaccggcacgatcgtcaacgacgacgccagtctgatctcggcggtgcagggtgcgggcacggcgagcccgctcgtcggccgcaccgtcacaatcgaggccatcgtcgtcggcgacttccagaacggcgacgccgacgccaagcgcaatctcggcggcttctacctgcaggaagaggcgaccgatcaggacggcaacccgctgacctcggaaggcgtcttcgtcttcgagggtaccggaaaccgcctcgtcgatgtcgccgaaggtgaccgcgttcgcgtcaccggcaccgtcgccgagttcaacggcgagacgcagatcaccgttcgaaacgccgcggcgatccaggtcgtgacgcccggcgcactgacgcccgagcaggtcaaggcctcggcggttgccgtcgaactgccggcggccgggacgatcggcaccggcacgacggcgcagcccgacctcgaacgctacgagggcatgctggtccgcttcccccagacgctgtcgatcacagagcagttcaacctcgaccgcttcaacgagatccgcctcgccgccggcggacggaccgagactttcaccaacgagttcgagccgaacacggcggcctacgccgcctacctcgcccagacggcggcgcgcacgatcacctacgacgacgggcagaatgcccagaatatcccggtggagaacctcgacggcttcggcccggcctacggcaccgcgagcgcgccgcgcatgggtgacaccgtcacggggctgaccggcacgctcggcttcggccccaccggcgcctaccgggtgcgcgccatcgacgacggcgacaaccgcttcgcggtcgccaaccctcggcccgccgagcccgatccggttggcggcacgctcaaggtcggcagcctcaacgtcctcaactacttcaccaccctcgacactggctcctccgcgcgcacagcgatcggccagcagccgcggggcgccaacagcgccggagaactcgcgcgccagaccgagaagctcgtcaccactctgatcggcaccggcgccgacgtgctcggcctcaccgaactggagaaccagttccgtccgggcgatcccggcaacgcgctcgaatacctggtcgggcagctcaacctgcgcgcgggcgccggcacctacgcttacgtcagtcccggcgcgcaactcgaccagggccagttcctcggcggcgacgcgatcgcggtcggcttcatctacaagccgagcaaggtcagcgtggcgatgaacaccacgatcgagcggctcgacgacaccgatgtggcggccttcaaccccgccctgctgcagcagagtaccctcggccacatcttcaacggtgccaatacgagccgcgcctcgctcgcggtgaccttcaatgagatcgccactggcgagaccttcaccgcggtcgtcaaccacttcaagtcgaaaggcgggaccgggaccggtgcggatgccgaccaaggtgacggccagggcgcctggcagcagcagcgcgagctggcggcgacggcgctggcccagtggctcaccctgcggccgacggggagcggggacagcgacacgctcctgctcggcgacttcaacgcctacatcaaggaggatgcgctcgacatcctcaaggcgaatggcttcactaatctcgccgaggatcggctcgccaacccctattcctacgtgttcgacggggcctacggcgccctcgaccacgcactcgccagtgcgagcctgaaccggcaggtcaccggcgtcaccgagtggcacgtcaacgccgacgaggcggacgccatcgactacaacctcgatttcggccggtcgcccaatcacttcgacggccggtcgcccgcgcgcgaatccgatcacgatcccgtcctcgtcggcctgcgcctcgaccagaccgcgccgaccctcgtcgccgcgacgccggccgacgacgccaccagagtcgcgcccggcgccgacatcgtccttcgcttcagtgaggcggtgcgggcgggcgccggcagcatcaccctcaccgacggcgcgggcgacacccgcaccatcgcggtctccgacaccgcccaagtccggatcgacggcagcacggtgacgatcaacccgagcgccgacctgcggcctggcaccgcctacgacctgatcgtgccggcgggcgccttcaccgacgccaccggcaacgccttcgccggcatcgcccgagacaacctcgatttcactacggagcaggccacccccatgacctacacgcttcagatcctgcacgcctcggactgggaaggcggattgctcgcgaccgagcgggccgccaacttcgccgccatcgtcgatcggctcgaggatacgacgccgaactcgatcacgctctcgaccggcgacggctggatcccgagcccgttctacatcgcgggcgccgacccgcagatggccgcgacctataatggggtctacaatcagttctacggactctcgggcgccgccgcttacggccgcctcgccgcctcgcccggccgggccgacatcaccatccagaacatcatcggcgtccaggcggcggtgttcggcaaccacgagttcgatgcgggacccaacgaggtcgccaatatcatcggcgccaatctcggcagcgcggcgggtgccgccgacgacacctgggtcggcgcgctcttcccctacctctcgaccaacctgaacttctcccgcgaggccgccctatcgggcctcgtccatcacgacggcgaccttgccaccttcgcgcagaccggcccgacctcgacccagaccggcaccggtgcggacaagatcgccaagtcgacgatcctcgtcgagaacggcgagcggatcgccttcatcggcgcgaccacgcagctcgagccgctgctgacgacgctcggcaatgtcacggtggacggtttcaccggccgcgacgagatcgcgctcctggccagccagatcaacgccgaagtcgatcgcgtgctcgcggccaatccgggcctcaacaaggtcatcgtcggcacgcacctgcagcagcttgccaacgagcaggcgctcgccccgctcctgcgcgacgtcgacgtgctgatcggcggcggctcgcacaccctgctggccgacggcaacgatcgcctcctgcccggcgacaagtccggcggcgcctacccgcaattcttcaccaacgcctccggccagaccctggctctggtgaacaccgcctccgaatactcctatgtcggccggctcaacgtcaccttcgacgatcagggcaacgtcatccgcaactcgatcacgccggagaactccggcgcggtggcggtcgatgacgcctcggtcgctcaattgtggggctcgaaggcagcggccttcacccccggctcgaagggctacctcgtgcgcgaggtgatcgagggcctggacgccaacaacgacggcatccaggagacggcgggcgtcgccgacgtcatccgccagcaggacggcaacatcctcggccgcaccagcgtgtacctcgaaggccgccgcggcgaggttcgcaccgaagagaccaacctcggcaatctcagcgccgacgccaacctttggtacgccaagcagttcgacggcacggtgaccgtctcgatcaagaacggtggcggcatccgcgactcgatcggctcgttctcgacggccggcggcggcaccgcggagcttcctccggccgccaatccggcggcgggcaaggcggccggcgacatctcccagctcgatgtcaccaactcgctgcgcttcaacaacgcgctcgccatggtcaccgtcacggcggccgaactggagcgggtgctcgaacatgccgtttcctcggtcgctccgggcgcgacgccgggcgccttcccgcagatcggcggcatcagcttctcgttcgacgcgacgaagcaggcgcagacgttcgacgccaacggcaacgtcacccgcgaggggcagcggatcctctcggcggcgatcgtcgatgccgacggcttcctcgtggacaccctggtgcagaacggtcaactcgtcggcgacgccaaccggggcatccgcgccgtcaccctcgatttcctcaccacgggatcgagcgcggcgccgggcttgggcggcgacaactatcccttcccggcctacggcgagagccgcgtggcgttgagcagcgccacgccgacgtcgctgcccaataccgagaccttcgcggcacagggcaccgagcaggacgccatcgccgagtatctcaaggcgttccacagcgtaacgcccttcggccaggccgataccggccccgctgccgacacgcggatccagaaccttgccgtgcgcggcgacagcgtcctggcccgtggcgtgagccagcccggaaccagcggcaacgacgtgctgcagggaacggccttcgccgatcgcctctccggcggcctcggcgacgacgtcatcaccaatagcgcgggcaacgacatcctctcgggagggcgcggcacggacacgctcgtgttcaactcgtcgtttgccaacatcaccgtcacggaggccgggcgcttcaccgccatcaccggcccgggtggcctcgacctcgtagagggcttcgagcgcttcttgttctcggacgccaccatcgtggtgaacgacggcaagccgctcgtcgatgacctctactatctcgcccgcaacaaggacgtgttccaggcgggccaagacgccgacacgcacttcgcccagtatggtgcccgcgaaggccgcgacccgaacgccttcttctcgacgaagggctatctcgcggccaatcccgacgtgcgggcctccggggtcaacccgctcgaacagtacgagcaggcctgctggaaggaaggccgcgatccgggtgcccgcttcgacaacgagttctacctgtcggccaacccggacgtgaaggccgccggactgaacccgctcgcgcactacctccagtacggtcagagcgagggccgggcgatccacgaggcggtcggccgagcgagcgacatccgcggcggcttcgacgccgagttctacctgctggccaatgccgacgtggcccaagccgcaggcaccggcaacaccttcgccttcgccagccagcatttcgagcagttcggctggaaggaaggccgcaacccgaacgcggtgttcgacaccaagggctacctcgccgcctacagcgacgtgaaggcggagggcatcaacccgctcacccattacgaccagtacggctggaaggagggccgcgacccgtccgcctcgttcgatacggcgacctacctctcgacctacaaggacgtggccgccgcccagctcgatccgatgcagcacttcctgcaatacggcctctacgagggtcggtcggacttcgccgacggcggcttccggttcggcaccctcgtctag

SEQ ID NO: 8533 - DNA, 255 bp, Methylobacterium sp.
atggaccgttccaagaccgactgtgccgatcagggccacaccgcctcaggcgaagccgccggtcccgaagcctcctcgcgcgccctcgtggccccgtcatccgccggggcaggtccccgtcttcggggcggtcgcccgatggcgaactttctgacccagttgatcgtcagcgccgaccctgccctgcgtccggcccgcctggaacgcacgaaggccgcggccgcgctctacgcacgggccgcggcctccagataa

SEQ ID NO: 8534 - DNA, 204 bp, Methylobacterium sp.
atggctgagcggacccaccatccctactccatcgatgtgcgaccgtgctggcggcgtccgggccgcttcgtctgctccatcctcgagaagggcgcgccgcggcgctacggcccgcagaactacgccaccttcgacgaggcccgccgcgccgcccaggcgcggctgcgccagctcgtcttcgagtggcagctcgtcggctcctga

SEQ ID NO: 8535 - DNA, 1278 bp, Methylobacterium sp.
ttgcatgaggtcctgatcgcgatggacgtggtcaccatgctgttcatgagcctcgtggcggccgccgccgccgcgggctttctcgcgttcgagtggcggaccctgcgcaaccgggtgctgctgttctggagcgccggcttcgccgtcatcgtcctcggcagttcgctgtcgctgctgcgcgcctattccttcctcgtcggggtctggttcgccaacggcctgctcgtggtggcccatctcctgttcctgttcggcgtcgcccgtttcaccgggcgccgggtcgcgccgctctggtggggcctgctgctgccctgggccgggctcctgatcctgccggagggaatcgaccccacccccgtcttcgcgatcacgggttccaccctcgttgccctcgtcgcgctgaaggccgcccacggcctgctgtcccgctcgggcgcgccgttcgaggagcgaaccgcggcctcggacggcctcggcttcgtcttcgccgtccacggtgccttctacgccgccaaggccctgctggtgcccctgcccggcgccttcgtcagcatcgtcggcttcaagggcgtgctgatccaggtctcgctggtggagggcatcgtcgtcgaggtgctgctcgcgctgctgatggccgccgccgtgcgccgccgccgcgaggaggcgatgacggcgctggccgagcgcgatgctctcaccggcctctacaaccggcgcgccttcgagagccgggcgcaggcggcgcttgacgccatggccgcgcggcaccggccgggggcgctgctgctgctcgacatcgaccgcttcaagacggtcaacgacagcttcggccacgccgccggcgaccgcctgctggtggcgctcgcggcggtgctgacagaggtgctcgaagccggctcgacacgggaggcgatcccggcgcggctcggcggggacgaattcgtgatcctggtgccgggattggacgaggcggcggtccaggcgctgggcgcggcgatcggcgcccgcatggcccgcgcgcgccgccgggatctgccggccggcgccacggtgagcatcggcgctgccctgttcaccgcgggtttggccaagccggacctgtcgctcgaaaccctgacggcttcggccgacgcggcgctctacgaggcgaagcgtcagggccgggaccgcctgcatgtccgccgcttggtgcagcccgccgcagaacgcggctgcgggcaccgccgggcggacacggcgccgtccccgctcgcctccggggagggctgctgcgcctga

SEQ ID NO: 8536 - DNA, 312 bp, Methylobacterium sp.
gtgcgatgctaccggctcatcctcggctcatcatccgagccggcaatttcgaggacaccatgctctccgcgaagcccgtctcatccgaagggagttgcgcaggcctacagcgacatccgcaccgcgctggcccatcaaggcttcgactggattcagggcagtctttacgtcagccggaacgaggatctcgccaggctcttcgccgcgatcacggcgctgaaggccctgccgtggtttcccgcctccgtgcgcgatctgcgcgccttccgtgtcgagcaatggtccgacttcacggcgaccgtcaaaggctga

SEQ ID NO: 8537 - DNA, 2130 bp, Methylobacterium sp.
atgccgagacaggccacggtcatcgccgcgcgcggagccatccgcagatccgtccgcagatccgtccacctggccgcgctcctcctggccgccggcctcggcatcgccgcgacggtccggatcgcgccggctcaagccgcgcccgaggcggcgcccttcgccgacaacgccgattcggtcgcggtggtgatcggcaaccgcagctacaagcagacggtcccggtcgatttcgcccacaacgacgccgaggcgatccgcgcctacctgatcgagcgcctcggctaccgcgacaccaacgtcttcatcctgaaggacgcgaccctcaacgagttcaaccaagtcttcggcaccgagcgcaacccgcaatcgggccggctctggcgcagcgtgcgcgagggccgctccaacgtgttcgtctactattccggccacggtgtgccggatctcgcgacgaagcagcccttcctgctgccggaggacggcaacccgaaccagggcgagagcggctattccctcgagaccctctaccgcaacctcgacctcgtgaagcgcaagatcggctccgagcgccagctcgtggtcatggtcgatgcctgcttcaccggagagaccggtcgcaagggcgagagtctgctcgcggtctcggcacccggctttgctccggcccggccgaaggcggaaagcggaatcacgcgcctcattgccacctcgggcgcgacgcccgcgaactgggacgagccgaaccggctcggcctgctgacgagccgctttctgatgggcgtctcgggcctcgccgatgccatggacgggcaaggcaacggcgacgggctgatccagtggccggagctgaagggctacctgcgccgcgaggtcgaggaggcggcgcgccgcgcctcgggccgggagcaggtgccggagatcgacgatgcgtcgatcgtggtgaaggcctcgcttcccgtcgcggcggtggccggcggcgtcgcagcgatccgcgacgacgcggcgtggcggcgcgccgagacactcggcacccgcgaggcgttcgaagcctatgtcggcacctgcggcgaggcctgcgcctaccgcgcccaggcgatggaccggctgctcgccggccgcaagcgtgacgcggcggcgatcgaccaggagaactgggcgaagttcggggcgcagcggcaataccaggcctatctcgattcctgcggcgagacctgcgcctatcgcagcctcgcggagggctatctcggcggcacgaacccgagcagcgatccgcgggtgaagcgctgcgacgagttggccgccggcaccgatgatcccgaccggccgaaaggcgtgccgggggtgaagctcggacggatcgaggcgtcggccgccatcgaggcctgccgcggggcgtccgctgcctacccgcaattgcgccgcctcgcctaccaactcggccgcgcctacgaccgagccgaccgctccaaggaggcgttctcggcctacgaccgggccgccaaggccggcagcgtctcggcgatgaacaatctcgccacgctctacgagaacggccagggcgtgaagcgcgctcaggccgaggcctaccgcctctatcggcaggcaggcgaggccgggaacgtcgtggcgctcgccaacgccgcgcggatgctcgaatacggcaacggcatccctaagaacgaggcggaggcggttgcgctctacaagcgcgcggtggcgggcggcgacgtgccctcgatctcgaagctggtgccgcactacgccaccggcacctacggattcccgaaggacctgcgccagggcttcgacctgttccgacaggcagcggacaagggcgatcccgtcgccatggcgacgatggcgacgctgatcgacaacggcttcggacgctacttccccggaacgcgctccgccgacatggtgctgcgggcgctcaagcggggcgaactcggcgcggcctcggtctcggcgaccgacacggcggcgcagaagctgaagccggagacgatccgcaccgtgcagcgggcggtcaaggacgcggactattattcgggcgccctcgacggtcgcttcaacccggtcttcgtccgcgcccttgatcaatacgcccgagcgaacgaggcggaatga

SEQ ID NO: 8538 - DNA, 264 bp, Methylobacterium sp.
atgatgctcgccgcgaccatcctcgtctggaccccggccctgctgttcgcactcggcttcgcgctggcccacctcaccggctgccgggtggacgagggaagcgcccatccctgcctcgtcgccggcatcgacatcggcgggctgctctacactctcatgatgatgggctggctcgtcatcctgatgctgcccttcatgctgctgacactggtgatctggctcggcatcggcctgcgggcgcttttcggcgtgtggttctcatga

SEQ ID NO: 8539 - DNA, 1041 bp, Methylobacterium sp.
atgacgcccgcccccgatccggccgccgacgtgtacgagggccgggacggctggctgttcctgattcgcggcaacaaccgggtgctgcagcaatatggccggccgggcgtctcgcgggggacgctgtggcgctggcggcggatcatcgagacccgcgtgcggcgctgcgccggactcggcgcgacctacctccacgcgctcgccccggaaaagctcaccgtctatcccgaatgggccgaggggcttgtcttcgaccccgcccgcgccccggcgctccggctcgcccgctggctcaccgcctcgccgggcgctcgcgcctgggtcgatctcaccggagccttccgggcgacgcgggacggcccgccgctttatctgcgcaccgacacccactggacgtttgacggctgcgcactggcctaccggacgatcctgtcgcggatgggcgttccgccgcgcgaggacatcgaggcgcggcgcgagcgcaccgccctcctcttctcgggcgatctcggccgcaagtacgcgccccatcacacggagcttgcggagggtagcgcgttcgcaagcgcggcccggcgcatccacgccaacgatctcctgcgggagatggaggcgctcgggcgcggcggtgacgcccatctcggcacgcacgccgtgttccgcaacgacgacccggcggccgatccgcgccgcctcgtgatcttcggcgattcctacgcgcagcacaccgcccacagtccgatcgcgacgctgacggcgctcttcgccgacacgttccgagaggtgcatttcctgtggtcgacggggatcgactgggcttacctcgaaacggtccgacccgatttcgtcctcggcgagatggccgagcgcttcgtgatcgacgtcccgcccgccaacatccgcatcgagcggctcgcggaactcgcccgcgagcgcaagctgatgggcgagatcacggcaatgggttcgccgtcacccgtgccgcctccgcctggcgcgcccgcatccgcgcctgaagccgctggcgccgcgccgcgatga

SEQ ID NO: 8540 - DNA, 1194 bp, Methylobacterium sp.
atggcgatcgaggccggccacatcgcctccgcggaagagcattaccgcctcttcggccgccgcgagggccgcccctaccgcgtaccgtccgcaagcggtgaactcggcggcgggatcgccgggctctggacctatcgctatccctaccgcgcctggccggatttgccggagatcgccttcgctccgccccgccccggccccgaggatgaggcgatcgcgcgccggctcatcgccgcttggcgctccggtgccgaacggtcacccgtccaggccgacagcgccggtatgtgggcagcccgaacacagggcttctccgccctccatcacgcgctccgtagcggcgatgctgccgcgctcgccgaccagttgaacaacctgttccagtcccatctctcccacggcatcgcgatgggacgcacgatggcgaccctggcccgtcacgcttcggcgccctttgccgcaagctggtgcgaccggatgctgcggctctccgaagccctcggcctcgtccccgtccgctcgccggagcagggcgatttcgccgcttccctcaacggttctcccgccgtctacccggagccggcacgcctcgaagccgaactcggcttccccctgaccttccccgaggtcggcgcgccgttcggcgtgcatttcggcgccggcatcctgcccgagcacgccttcagccacgcctacgccgcgtggcgaatcgggcagatcggcgtgatcgaccgcatcgtcgagatcggcggcggtttcggcggcctcgcatggttcctgcgccgccccgaccggcgctacacgatcctcgatctgcccttcaccaacgttctacagggctggtttctgctgaaggcaggcctcgacgtgtctctggccggggagcccgacgccgcaatccgggtcctgccgtggtgggagatcgaacgggacgagcgttacgacctggtgatcaaccaggattcccttcccgagatgcctccggagacggcggccatgtacatttcccgtattcgaacgatcgcgcccctattttattcgatcaatcaggaagcagcagcaccgaacacggatgagtttcggcaggttatcgtccccgaactcgtggcgcgcaacggcggctatcggcgtttgagtcgcaacctgttctggatgcgcgacggctacgtcgaggaagtctacgctcggcgctga

SEQ ID NO: 8541 - DNA, 309 bp, Methylobacterium sp.
atggacgagagccgcggcaagcccgattccaatcgagattccctgcgcaacttcagcgcatatgccgaccgcaacgggcaggattttgggcaggacagccccctcgacgtcgcccgccccgccgaacttcaacaggccctgcaggacgatccgggcggggaggcgcaggcggcgcgcatcgcctccggcttcgaccggcgcgacgcgattgccggtggaagcatcgagtcggttgaggccatcgaggccgcgacccctccggaaaacctgcgccgcattagcgatccgagctctaccccgaagcgctga

SEQ ID NO: 8542 - DNA, 450 bp, Methylobacterium sp.
atgaccgaggcgttcaacctcaagatcccgcacggcggatacgtcctggtcggcgacggccgccgggccctggtgctgcgcaacgagggccacgcgctgcatctcagtttgaaggtacagcacctgttcgaggccccgcccaacccgccgacgcgggagcagggaacggaccggccgccccgcgtccggcagggggagcaccgcagcgccatcgcgcagaccgactggcacgagatcgccgagcagcgcttcgccggagaagttgcggcggcgctggaccgcgtcgccagcgcgatctccgccctcgtcgtcgtcgccccgccgcggacgttggccgcgttgcggcaggcgctgtccgaccgcctgaagcgcgccgtcatcgcggagatcgacaaggatctgaccaagctgacgatcgaggagatcggccagcgcctcaccggagcgtga

SEQ ID NO: 8543 - DNA, 723 bp, Methylobacterium sp.
ttggcggagccactgcacgcggtgatcttcgacgtcgacggcgtgttggtcgattcgccccacgagcaggcttggcgcgaagcgctggccgatttcgccgacccgagtggcttcaccacggccttctatcaggcccatgtcgcgggcaagcggcggctcgagggcgcacgggccacgcttgagcgtctcggcggtgccgaggcggcggcgcaggccgctgcctacgcggagaaaaagcaggcggtgatcgaccggctgatcgcggaagaccggttcgaagcgttccccgatgcgatccgtttcgccgaggcgctgcgggagacgcctctgcgcacggtgctcgcctcggcctcgaagaacgccgacgcgctgctggcccgcgtgatcctgtccgagggccgcacccttctgtcgctgttcgatgccgatgtgagcggtcgcgaggtgccgcgcggcaagcccgatccagccctgttcctgctcgccgccggcgccgtggacacgcctccccgacaatgcctcgtcgtcgaggacgcgacggccgggatccgggcagcgaaggccggtggcatggccgggctcggcatcgcccggctcggcgacgaggccctattgcgggcggccagtgccgacctcgtcctcacctcgctcgatgaactcgatgtgcgcgccttgccgagcggcgtcctgcgcacccggcctgttcctctctctcacacctga

SEQ ID NO: 8544 - DNA, 516 bp, Methylobacterium sp.
atgagacgacgcgccgccctcgtatcgctcggcctcacggcgggcctggccgttgcgttggcgggcgcccccgcccgatccgccggcctcgattgcggtccgccctcggcgccgcaaccggaggctgataccgtcctgacccaggcgatcctctcgccgcggctcgacgagaaggcgagcacggcactcgcgtcggcggtccggcgtctcacgagcgcgggcgtgccccgtgcggtcatcgtcgaccgcgccgtcgccgcctattgtccgctggtcgcccgcgacgggagcctgaccctcgatcgccagcgcgaggcggtccgccgcttcgcttccacgctgacgagcctcgtctacgatcctcccgaaccgaaccaaggcgagaccgcattcatcctgagcctgccggtcaggccggcgctgtcgctgcagatcgacgccgccgccgccaaggcggggaagacccgcgacgcctggattctggaggcgatccaggcgcggctggcgggcgactga

SEQ ID NO: 8545 - DNA, 561 bp, Methylobacterium sp.
atgatcccggatcttcgcccgatcgcccgcgccgccctgtgcgccacggcagcgctcctggcggtcctgccggcggcggcgcggggtccgggcttcgacttccccgcggaggtcgctggctttgcccgcgggccacgcacggattacgaggcccgcgcgccggggctcggctattccgtcgtctacaccaacggtcgctggaaggcggacatctacgtctacgacgccggtgtggcgaacattcccgacggagcatcctcgcccgcggtcgccgggcagctcgcgcaggcggccggcgacgtcagcacggcggtggcacagggcatctaccgcggcagcgaggatcgcggcccggtgcgcgtgccgggggaggcgggcgcccggctcacctgccgcgccttctccatcgatcacccggccctcggccccaccgagagcctgctctgcctcaccggcctgcgcggccaattcgtcaagttccgcctgtccggcccagccgcgaagcaggcgccgaaggcggaagccgaacggttcatcaccggctggctcgaccggcaatag

SEQ ID NO: 8546 - DNA, 216 bp, Methylobacterium sp.
ttgctcggcgaacgggagaccgacatgaggaagccggagaagcctggcacggaggccggcaagacgcacgagggcggcgcgctcggcaatatcgacgagcagaccgggcatcccggcaagggcacgccgggggcgacggtcaagtccgaggacaatcccgatccttcgagggatcccaagccggaaaggccggaggatcggaagccgaaacgctga

SEQ ID NO: 8547 - DNA, 1719 bp, Methylobacterium sp.
atggacatggtcagttccggcatcgtcaacctgctggtcatcgccggcatcatcgtcgtggctttgctcggcatcggcttcgtcttcagccggctctaccggcgcacgacgcgggataccgccttcgtccgcacgggtctgggcgggcgcaaggtcgtggtcgatggcggcgcagtgctgctgcccgtcttccactcgatcgccatggtcaacctcaacacgctccggctcgaagtgaagcgctcgggcaacgagtcgctcatcaccaaggaccggctgcgggccgacatcaccgtcgagttctatgtccgggtcgagcccaaggaggaatcgatcgcgctcgccgcccagacgctgggcgaccgcaccaatgacgccatgctcttgcgcgagctgatcgaggcgaagttcgtcgatgccctgcgcgcggtcgccgccggcatgaccctgcccgacttgcaggagaagcgcgccgccttcgtcaagggcgtgcaggaggcggtctcgggcgatctgcgccacaacggcctcgaactcgaatccgcctcgctgacccgcctcgaccagacctcgatcgagcacttcaaccccgacaactcgttcgacgcggaaggcctcgctcggctcaaggagatcaccgagcagcgccgcaaggagcgcaacgccaccgagcgcgacgccgaagtggcggtggccgagaaggaccgcgagaccgcgctcaagcaactcgagatcaagcgcaccacccgtgaggcggaactcgcccaggagcgcgacatcgccaacaagaccgccgagacccgcgccgagaccgcccaggccgagcagcgcgcccagcagagcgaggagacggcgcggatcgagcgcgagcaggccgtgcgcctgcgcgaggccgaggcgcgcaagaactcggagggcgcgcggatcgaggcggatctcgccatcgcccagcgcaatgcggaggccgagcgcgagcgccagctcatcctgcaggacaacgcgatcaagatcgccgagcgttcgcagaaggaatcggaggcccgtgccgcggccaagacggcggaagcgctggccgtcgcggcggaggaacgcgtcgccacggcgaaagccaaggagatcgccgagcgcgagcgcgaaatcgcggtcatcgccgccaagcgcgaggcggagcgggaggcgaccggcgtcaccgtcacggcggaggcggagcggcgcgcggccgaggaccgggccaacgccatcacgacgctggccgaggccgaggcgacggccgccgcctccaaggcagaggccatcgccaagctcggccaggccgaggccgagcgcgagcgggtgatgaacgaggcccgcaacgccctctcacccgaggcccgtgccttcgagaccgggctgaagcgcctcggcatcatcccggatgccctgcgcgagagcatgcgggcggtggagaagatcgactcgatccgcatcttcgacgcgggcgggatgatgggcggcggcaacggtgcgggcggcgtctcggcgagcctcggcgacagcctgtcgggccacctgctccgctaccagtacaacagcccaatcctcggggcgattctgaacgaggcggggttttccgagggcaagggcagcctcgacgcgctggtcggcggacttcggaacggcgcggccaagcccctcgccgacggacacgccaaagccgcggagaccctctccggcgcttga

SEQ ID NO: 8548 - DNA, 1050 bp, Methylobacterium sp.
gtgacaggcgggcgcgcagacgaggcctcccgaaccgacgatgcgcggctggcgcgggaggtggcccgacactgcgccgcgttccgcgaaccgattccccggctggcccttcggcaggtggccgacacgctgctgccatacctgatcctctgcgccgtgatgctcggcgcggcggcaaatggttacgcacttctcgccctgccgctggccgtgccggcgggcgggctcctggtgcggctcttcatcatccagcacgattgcgggcacggctcgttcctgccgtcacgccgcggcaacgatgggctcggccgcgccctgagcctgctgacggtgacgccctacgacagctggaagcgcgcgcatgccctgcatcacgccaccaccggcgatctcagccgccgcggcacgggcgatgtccataccttgaccgtgcgcgaatacctcgcgctgccgcgctggggccggttgcgctaccgcctctaccgaaatccgctcatcctgatcgtgctcggttctcctatcaacttcctcatcctgcaacgccttccctccggcgtggggctgccgtggcggacggcatggcgcgacgtgctggcgctcgacgccgtgctcctcgtggtcctggcggggctcgcgctcgcggccggcggcatcgggccggtgctctggacattcctcccggtgatcgtcgtcgccgcctgggtcggtggctggctgttctatgtccagcaccagtacgaggagaccgtctgggaggaggccgacgcctgggacttccaccgcgtggcgctgggcggcagttcatattatgcgctgccgcgggttcttcagtggttcaccggcaatgtcggcctgcatcacgtccaccacctcaacagccgcatcccgaattaccgcttgcaggaatgcctcgacggccacgaggtactcgggcgggtgggccgtctgaccctgcgcgacagcctgcgctgcctgaagctggcactttgggacgaagaggcccgcaagatggtcggcttcgcgcgtgtgcgaggactccaggccgcctaa

SEQ ID NO: 8549 - DNA, 141 bp, Methylobacterium sp.
ttggcggcggcccgtcacggcttcgagtgctcgctgatcgccctgcgccgggccgcgctcgacgccgtcgacagcggggatctcgcgattctcgccctgcgcgtctgcggcgagcgccgccttcgcgcgggcgccgagtga

SEQ ID NO: 8550 - DNA, 1416 bp, Methylobacterium sp.
atgcacaagctgctgattcagctcggccttcgcttcgacaacccggacgaggaacggtcgttcgtccgcagcttcacgctgcatgacctcggccgcacgcaggccgcgatggtgctcggcgccttcgtctactgctcgttctcggccatggactggatcctcagcccggacgcctgggcggtcgccaccgcattccggctcgccgtggccgtcctggtcctgctgcccgcgaccctgctgctgacccggccgggtgcccgacccttcgcggaacagatctacctcgtctactgcgtcgtgccgggctgcgtgctcagcgtgatctatgtcttcctgcggccgagcttcgaccacggcgcggcgggcctgatcgtggtgattctgttcgtctcgacgctgctgccgctgcgagtaccctcgttcgccgtcttcgccgtcctgacctgggcctgcttcgccctgttcgagacgatcgcggcgcacgaaaatcccggtctggcgctggtgaacaatgccgaactcggcgccgcctacgcgctctcgttctacggggtcgcggcccgcgagtttcgcgcccgacgccagttccggacgacgcaggagttgcaggtcgagacggagcgctctgaggcgcggctctccgaattgcgggccgcccaggcccatctggtccaggccgagaagctcgccgcgctgagtcaactcgtggcgggcgtggcgcacgagatcaacacgcccatcggcctcgcgctgacgacctcgaccgctttcgaccacgatctcgcccgactgcgccggaccatcgcctccgggcagattcggcgctcggacctgacgcagagcgtcgagcggctcgcagagggcgcggccctggtcttcgccaacctgacgcgggccgccgatctggtgcacaatttcaagcaggtcgccgtcgatcaggcgacagaggaccggcgccgcttcgaggtccggtcctggctcttcgagctgatgagcacgctcgatccggtcctgcggcgcaagggccacgccgtccggctcgcctgccccgacggcatcgtgctcgattcctatcccggcgcgctggcgcagatcgtcagcaatctcgcgctcaacgccagcgtccacgccttcgagggagaccgccccggcacgctcttcatcgacgtcacccgcctcggcgagtctcagatccggatggtggtgcgggacgacgggcgcggaatcccgcgggagaacctgcagcgcatcttcgatccgttcttcacgaccggccgcgacaagggcagcaccgggctcggcctgcacattgtctacaatctcgtggcctcgaccctgcgtgggcagatcaccatcgagagcgaggagggcgtcggcacccaggtggcgatcgagcttcccgtggccgtgccgtaa

SEQ ID NO: 8551 - DNA, 261 bp, Methylobacterium sp.
atgaacaaggtgatgatcctcgcgctcgtcggcgccggcctcttcggcgcagcgccctcggccttcgctcaagacagcgccgcccagccctccaaccaagaattcatcggcgtcgatctcgacaatggcggcgtctactacaacgggcgcaattccggccggtactgcctctaccgcacggtcgaggtgttcaaccgttacaccggctatgtcgaggcgcgccgcgtgcgccgctgcggccgcggcctctacctgccgtag

SEQ ID NO: 8552 - DNA, 522 bp, Methylobacterium sp.
gtgagcgacgaggcccgcttgctcgccgaactccacgccgcccgcgccctgatgcgggtgccggtacccgtgtcccaacccggtcagatcgaccggccgcgccacgccgccctctgggcgcatgccaaccgggagccgggaagcccggtcgatctcacggtcgtccgggcgatccgctccgatcccgagaccgcccggcgctaccgcacgctgctcggcgcgcaatcgctcgcccacgcgccactggctgcggcggcttcggatggggcgttgtcgcggcggcgcatcggcccattcgagctggagatcctcaagggcacgcctccgctcctgatcctgcgcggactggacgcggcgatgccgcggtggatcgaagcctggctcggcgacgaggcggtgcggctcgatctcggcgcgccggtcgacggcgcgatcctgctcgccctcgatccggccgtggccgaggccgaccggctcggacagatgctgcgcgaccccgcctgcgcggtgttcctgttgtga

SEQ ID NO: 8553 - DNA, 1182 bp, Methylobacterium sp.
atgactgggccttcgatcctcgtcgtgattccgaccacaggcgggccgctccgtctgcggtcgctgaacccgcgccccggcctgccggcgccggccgccttcgccgacggtgactaccgccccctgccctggtccggcgattatgcccgcctctgcgcgcccggcgggcccgtcgtccgactgggcggcgaggccggtgcgccgcacgaattgcggttgtccggctcgttcgatgccggccgctcttgggaggtgccggtctgccttgcccacggcctctccgcacgcggcgcccgcttcgtcggcgagccggcgcaggccgacctgatcctctgggcgaccggcgcggtcgatcgcgatctcagcctggtccccggtgactacgcgctcctcgacaagatcgagcgctctcgcgctctgctcaccgaggcgccggacgtctcgctcgcaatcctactgccggagggcccggagcggacggaggccgaggccgccttccgcaccctcggccgatccggaaccttgcggatcctgccggccggagacgtgccggccgccgtggaagcgttgacccggcccaacggcgcaaacctgccggagccgcagagacgcgggcggcgtctcgtcctgacggcgggcgccgccgcagcggcttgcctcgccggtttcatcggattcgtagccctgggtgcccggcaggcccccgtcatcggcgccgcgagcgatcccgccaccggcgccgcctcggccgatcccgcgcgcagagcggagaccgaccccccttccccacctgtggcggaagagccaactgcgaaggaagcgtccgcgatccgcatcgaggagttgcgggcgccgcccggctcgtcctgccgccgcgtggccttcggcgccgatgcgcccgagcgccgtcccgtcgcgtcggagaacggaggccgcctcgccccgacccggctcttacccgacctgtgcgggctcgccatcgcggcagcgccgggactgcggctagagatcgggccggagctgcgcgccgccgccctgcccccggtgcagctcgccgacggggcgcagggcttcttcctgcgcgagggcggccggcagaacctcgtctacgcggtccaagccctgccggagaccggcaccacgcggccgggcgagcgactcgtccacgccctcacccgctga

SEQ ID NO: 8554 - DNA, 993 bp, Methylobacterium sp.
atggtcccgattcgccgcagatgccggcccgcaacggctgctgcctgcctgctgctcgctcccttcgcggccgattccgtgcttgcgcagaccgtcggcttcgaccccgccgattacggccgggcgcagttgcctctgcgccagacgaccggagacgcggcggcctatgtcgatcagaacaagggcgccttcgagccgatcagcgaactcgacccgaaggacggcctcgccgccctggcccggccgatcggccgcgtcgacatcgtgctgcgcaacgcccgcaccggccagcaggtcggcgcctcctgcaccggcgcgctgctgcccggcgactacgtgctgaccaaccaccactgtctgccgcaatcgggcgacctgaccccggtcaaggcgtcgatcctgatggattacttgacgctcgacggcaaaggcgcgcgccgcttcgagatcgacccgaagccggtcgagttcgacgcccgcctcgactacgcactcgcccgcgtcgccgggaacccgagtgccgcctacggcgccgtccggctctcgggcgaggccgtgcccggcaaccgctcgatgctggtgatccaccaccccctcgggcggccgaaggtgatgagccgcttccgctgcttcgcgatgaaggatcaggccgaggggccggatctgcgccaccgctgcgacacgctaggcggctcctccggctcgctgatgttcgacgcgtccgtggccggcatcgccctgcacaaggagggcgggctcgacccgaaggacccgtcgagcttcaacaaggccacgcggctctcggcgatcctcgggcgcagccgcatcctgtccgagatcgccgccgcccagggccgtccggtcgccgcttcgtctgccggtgacgcgccgcccaaagcgggtgcggcacccaccgccaaatccgctgccagcccgcccgcggaaggaccgctcgatcctgcgagcatgaacgcgatcctgcgcgggcgctaa

SEQ ID NO: 8555 - DNA, 984 bp, Methylobacterium sp.
atgtttccgatgctgcgcgcccgcacccgaacatgggtcccgacattcgccgccctcaccctgatcggtggcgcgctcctcggcctcgccgcgccggcgcaggcccagacccggcccaacatcgtcgtgatgggcgaggatgccgacgaggattccgtgccccgcggcaaccgcatcttccagcgcgtcatcgccgaactctcggagacgatgaacctgcgcggctacaacgtctacgacgagacggcggtggcgatggggatcacccaagccaaccgggtccgccgccgcgacgcggagctgatcgaggtcgcccgcgcggttcagaacccgccgctcgacgtggtggcggtgttccaagtctacgcctcggcctcgaaatccgcctattccgacatcgtgcggccggaggtgcgcatccccggccggctcctaaacgtgcgtaccgggcagtcgctcggcgccttcgaggtggcggggctgcagcttccgcccctgccccagggctgcgaccgggaatgcctgctcgagagggtcggcgccgaggccaagagcatcgccgccgacgtggcgggcgcgctcacgtccaagctcgacggcgtgatcgccccccgccgcgccgccgatgccggcgcgcccccggccacgctgccgaatgccctgcccggcgccgagcctccgcccgccgccgcggccggtggggaatcgtgcggcggcctgccgacggcctatgtcgtgcgcctcaccggcttctcgccgcaggaggtgcaggcggccgaggagtacatggccgccttccgctgctacgagcaccaccgcccggtgcgctcgggcggggccactgccgagtactggtacgagacccgctccgactcggcccggctcggccgcaacctgcggctgatgctggagcacatgagcgcgccgggacaggtccagttctccggcaacaccttcgtcgtcagccgcgtcgccacccgctga

SEQ ID NO: 8556 - DNA, 258 bp, Methylobacterium sp.
atgcttcgtaaacccaccctgacccttctctcggttctggcctttgccgccggcatcgtcggaaccaccacggccgccatggccgacccgccctgggcgcgcggcggacgcgggctccaccacggcggccccccgccctgggcgccggcccacggatggcggcgcaaacacgagtacggcggccattacggccgatcgtatcgcggctcccggtacggcgaacggcgctacggcgggtatggcgggtatcgctactga

SEQ ID NO: 8557 - DNA, 795 bp, Methylobacterium sp.
atgatcgattggcttcgccgcctgctcggctgggatcgcccgcccgcgccggctccgcccacagtggtctggaggccgccgcaggggcgcggcgaggcggcgatcgacgctccaatcccgcctgtggcgctctgggaaccgacgcctcagccgccgcaacaccgcagcgcggcggagatcgacgccgtcgaggcggctctcgagagcctgatcgcagccgggctccgactcggtccgcactatgaggggatggaccggcgcgcggtcgcgcgggcgatggcggaacatcccgagttcgcgctgggcgacgacaacgagacattgtcgctgacggagcgcagcccggaggcgctctcgatcgacatcctgtggagttatcgcgccctgacggacggggtcgaggacgagttcgccaacgcggtaatcttcgtcgatcactgctacgacggcgccgacgcggacacctatcgcgccctgttcgcccggctgatcgcggtcgccggggtctggaccgaccgcggcgtgaccgtctctcgcgtggcgggtctcggcccttacggtcacggcttccgcgtcgcgttcgagaccgagccgccgatcccgcccctcacctttccggccgacaagaacttcgactggagcctgctcgaacagctcgacgcacaccggccggcgggcgagacgcgccgcttccggatcgccgccgacggcggagcgggactggtgctgttcctcgacgacgccgaggcccgcgcgatcgccctgcgcctcggctgggggccggacgatctgtga

SEQ ID NO: 8558 - DNA, 222 bp, Methylobacterium sp.
atgccggttcggatgacccaggaaacgcaggaggtgatcgacggccggagacaggtcgtggtgcgggtccatttcggccggccggatgcggggcgcgaggtcgtcgaggtcgcggcgacggtgcgggtgcccgccatcgaatcggaggcgcagactgaggccgccgcacggcagatggcgcggcgggcactcgaacaggcgctgtcggccttcccgctctga

SEQ ID NO: 8559 - DNA, 168 bp, Methylobacterium sp.
atgacgaacgtgtcgctgatgatttggggagcgaccggcatcggcctgatggcaatgctgtttctcctctacgaactcaagaacgcaccctacgaagacgagctcgagccggaaccggcattgcgacagattgaaaagcagagattacagtttctgaccttcgattga

SEQ ID NO: 8560 - DNA, 132 bp, Methylobacterium sp.
ttgacccgtgccggcgggaccgtccgcctcccgcgccgctcgctgttccgcagcggggccggcctgcgactggcggcggccctcattctgtcgatcctgctctgggcggtgatcctgtgggcgcaatcgtga

SEQ ID NO: 8561 - DNA, 837 bp, Methylobacterium sp.
atgagaatcgccctctgcaccatcagctttcgccaccatctcgtctcgatcggcgaactcgcccgcttcgcccgcggccacggcttcgacgggatcgagttgtggggggtgcacgcccgcaatctcggccccggcgcccacgccgaatggctcgccgcctacggcctacgcgtgccgatgctgagcgactacctgcccctcgacgcagcccccaaaaccctgaccgagcggacggccgaactcgcccggctcgcgggaagctggggcgcgccgcgcctgcgcaccttcgccggcaccaagagcagcgcggacgcctcggcggaggagcgggcgcacgtcgcggcacgcctgcggatggcggcgggccagctcgccgaccagggcctgcggctggtggtcgagacgcatcccggcacgctcgccgacaccaccgactcgctcctcgacctgctggcttcggtcgatcacccgaacctccgggtgaacttcgacacgctccacgtctgggagggcggcgacgacccgctcgcggcccatgcccggctgagcccccatatcgactattaccacctcaagaacgtgcgcagccgggcggacctgccggtgttcgagccggccaacgtctacgccgccgccggacggcgcgacggcatgaccgccctgttcgagggcgcgctggattacggcaccttcctgaagacgctgccgccacaggcggaagcctcgctcgaatggttcggcgacgcctcgttctcggtcctgccgaccgaccttttccgcgtgcgcagtgccaccgccggccgtcacgccgccggcccccgccacgccgcgcgctga

SEQ ID NO: 8562 - DNA, 345 bp, Methylobacterium sp.
atgcgccgtccgattctcctggtcgctttcctcgcgctccccgccgttccggcgctggcgcagggtttccccggcgccacggtcggcattccgctgggaaagcccgacccgttcggtaccgcgacgcgcccgccggcgcagccgatggccgaacctttcgccgatccctcggccgaccgtggagtggcacaaagggatcgccgcctgcgctctcagccccggcgcctcctcaagggcgatcatcgtgccgaaccgaagcggcgtccgcccccgggcccggcgctgacgggtccgcgcagcggcctcattgaccggcccggcgcgcaccgccatcaagcggcatga

SEQ ID NO: 8563 - DNA, 1068 bp, Methylobacterium sp.
gtggtgatgccgggacaggtgcagaagcgggcggatgacagccgcgacccggcgtgggcctccgctcgaagcgcctgggaggccctcgcccggcacgggctgacgccctcccctcggaactacgaactgctgcacgccttcttcagcggcgccaacccgccgctcgcggaacgtctcgccccctgtctcgcacccggcggcgcgctgacggaggagcaggcgaacacgctctacgacgcctgcattgccggaacctcgacggaggcgcgcatgctcgacggggtcggccaactggccgaggtggcgggtgcgctggcggagcgggtcgcgggcagctcgaaggcgatggccggctatggcgacgtgctggcccattggtccggccgtctcacggcccgcccgacggccgacgaactcatgacggcgctcgtcgccctgatcggcgagaccgaggtggcccagagccgcaaccggctgctcgaagagcagctctcaacctccgccgggcacatcgccaagctgcatcgggacctcgtcgagacgcggcgcgaggccgccaccgatgccctgacgggactggccaatcgcaaggccttcgaccgcttcctgcgcgattcgatcgcccggacccggtcggatgccggcagtacgttctccctgctcctgctcgatatcgaccacttcaagggtctcaacgaccggcatggccaccgcttcggcgatcaggtgttgcggctggtcggtcgtctcctcagcgagaagacgaccgaccgcgacctcgccgcgcgctacggcggcgaggagttcgcgatcgtgctgggcgaggccggcatcggggccgcggtcgcgctcgcgcaggacatctgcggccgactgcgtgcccagcggctggtcaagcgcggctccggcgacgtcgtggcccaggtaacgatctcggccggcgttgcgcaggtccggccaggcgaggccgcccgcgacgtgatcgagcgggcggaccgcgcgctctacgaggccaagcggaccggccgcgaccgcgtctgcccgaccccgcaggccgcggtcgcctga

SEQ ID NO: 8564 - DNA, 1140 bp, Methylobacterium sp.
gtgacgcgctcaggaatccttccctctcgtctgacgtaccggctcctgcccgagccggccgatctcgatgcggtccggtccctgctcgcggcctatcggcggatgctcgtcatcctcgaagtgatccgccgggagcacggcctgcgggccaatgtcgtcgccctgatcgagcacggctaccagcgcgcgcgcgatgagaccgggctgccggcccgcctcgtgaccctcggcatccgtgatttcgcccagcgccccgccgggttcgaccctgagggcgtcacgtcgatgccgctcgacgacaagctgttcagcgtgaagggcgctgccgagatcgcgctcaccacactctgcgggcgtcgcacgatgccctaccgcgtcgagggctatgacggcccctggcgcgacctctccagcgcccgcctcacggtcgcgggcgacacgctcaccatccaggtgggcgtctccgtcaccgccccgaaagaggagacccgcatgcccgagaacatcctgacccgcgtcggccggatcatcggcggcctgtcgaacgccgccatcgacgcggtcgaggaccgcaatcccctcgcggtcgccgagcaggccctgcgcgagatcgacgccgtgatccacgaggcccggctcgatctcggcaagatcaaggccgaggagcaccgtctcaccgcccgacgcagccaactcgacggggagctctcggccttgcccgagaagctgtcgctggcgctcgccggcggacgcgaggatctggcgcgggcgggcatcagccggcagctcgatctggagagccagatcgaggcgatcgattcgagcctcgccgaagtcgccgagcggcacggagccgccaccaaggcgatgcaggcggcccaggccgcccgtcgcgacgccgagcaccggatcgcattgctgcgacagcccccgacgaaggcggccgacccgctcgacggctacggccgcgaggaggtgacgcgcacccgccagctcgaacaatcgctgcgggcgatcgaccgggtgaccggcaccgcctcggcggttgccgatccctcggtcgaggaactcgaccggctccaccgcgacgacgccatcgagcggcggctcgccgcgctaaagcagggccggccttcatga

SEQ ID NO: 8565 - DNA, 237 bp, Methylobacterium sp.
atggctctgcacatccgcgatgcggaaacggaccgccttgtccgcctactggccgagcagaagggcattccgctcactgaggcgatcaaggtcgccgtgcgcaacgagctggagcgggaagcgcagcggcccgccctctgggagcggctgaagccgctgcacgagcgcgtggctgcccgaccctccacgggccttgaggccgacaaagcctttttcgatggactgaacgacgagtga

SEQ ID NO: 8566 - DNA, 198 bp, Methylobacterium sp.
atgatcgtgatgtatttcggatttatgacgatgttcgcgttcgcgaagcctttgatggggacaattttggcgtccggactttcgctctgcatcctgctgggtacgagcgtgatcgtcgggtcgttcgtcctctgtctcgtctacgtcgtctgggcaaaccggttctacgacccggccgtgcgccgcatcatgagctga

SEQ ID NO: 8567 - DNA, 1566 bp, Methylobacterium sp.
atgcaggcagcgaataacccactggccgtcaccttcttcgtcttcatggcgctgacgctcggcgtcacctactgggccgcacggcgaacgcgcaccacggaacagttcttcgccgcaggaggccagatcacggcctggcagaacggctgggcgctcgcgggtgatttcctcagcgccgccgcactcctgggcatcgccggcatcatcacgtcgaatggcttcgatgggctgatctactccatcggcttcctggttggctggccgatcatctcgttcctgatcgtcgaaccgctgcgcaacctgggcaagttcaccttcgcggacgttgtcgcctaccgcctgcggcaacggcccgtgcgcatggccgccgccatcggcacgctgaccgtgatcctgctgtacctcatcgcccagatggtcgccacgggctcgctgatcaaactccttttcggcatgccctacacggtctcggtcatcgtggtcgggacggccatgctcacctacgtgatcttcgggggcatgctggcgaccacctgggtccaggtcatcaaggccgtgcttctctccttcggtggactagtccttgcgctcctcgtgctcgcccatttcgacatgaacccgctgcgcctcttcgcggcggccgccgacaagtacggtgagcgcgtgctccagcccggttccaaggtcgccggcagcgggtgggacgcgatttcgctgggagtggggctgatgttcgggacggcggcgctgccgcacatcctgatgcgcgccttcacggtcccagacgtcaaggaggcccggatgtcgatcctgtacgcgaccggcatcatcggctcgtttcacctgctcgtcttcgtgatcggcttcggagccatggtcctcgtcgggcccgaggccgtgatcaaggccggcggcgggggcaacatggctgcctcgctcctcgccctcaccgtcggcggcaacgggttcttcgggttcatctgcgcagtcgccttcgcgacgatgctcgcggtcgtcgccgggctgaccctctccggggttgccacggtctgccacgatctctgggtcaacgtagtccgcaacggccacgcgccggagcgcgagcaactcaccgttgctcggatcgcgacgatcgccattgccgtcctggccgtcgtcctcgggatcgtattcgagggtcagaacgttgccttcatggccgggctggccttcgccgtcgccgcggcggccaacttccccgccctgctcctgtccatcacctggaagcgcttcacgacaccggcggcggtcgccagcatcctggtcgggacggtctcctccctcctgctgatcggcctctcccccacggtgcaggtggacgtgctggggcggagcctcgcggaggtctcgcaagcctggtggttcgtcccgatgaagaacccggcgctcatcagcatgcccctatccttcctcgtcgccatcgccgtctcgctggtgacccaggaggatggcgcggaaggcagcttccgggagatgcggcggcggatcatgttcggtgccgcgagggcggcttacaccgggcgctga

SEQ ID NO: 8568 - DNA, 1335 bp, Methylobacterium sp.
atgaggctcctcctcctcgccgccctcctcgtcctgccttcggcggcccgcgccgatccgaccaccgccacgctcagccccttcctcgacgcggtggcggcctgcgccgcacggtccgatctgacgctcgccgtgatcggcgtcgagccgggccaaacggcgctcgcgcgcgagcaggccgaggaggtgcgcctcgcggtcgagagccggctccaggccaccggccgcgtgcggctcgcccccgctgccgacgtggtgcggatcaagggcctgcgcgaaggcacgaccggattgtcgggggcggaggccgaggcgcagatccgtgcggccttctcgggcgatgccagcgtgttcctggtggaaccgcgccgggccggcgagaccgcggcgctgcggctccaggcgatcacccgcaacgcggcctgcaaggcgacgagcgaacccctgatcctgccgatccgcgtcggggccggtgtcgccgacatcgacgcggtgatggagagtgcggtgaaggccctcgcgggggcggcgccgaacgccggcacggtcgaggtctgccccttcgtcgcggaaggaggccactcgacctgcgccggggccctcaccgatcgcctcgtcatcgcgctggacgccgaggcgcgcgcgcctaaccgcatcctgaagggcgcccgcctcgacgtgcgccgcactccgcccggcaccgcctgcgccggggcgctcaccgcgcgcggccgcttccttaccgatcagaaccggcaatcctttatggagctggagttccagcgcgatggtgcggtgctggccccgaccgggcggcggcggatcgggatcgagggtctcggctgtgacccgaccccgcggcccttcctcgaccatctggcagcgaccgcccgcaccgatgccgggcgcctgacggtcgcggccactgccacgccgttctcggccgggcagcgcctggagatgcgcatcgaggcgcacgcccggcagaacctctattgctgggttgtcgctcccgacgagaccgctttcgtcgcactgccggtgcgcgacaacgccgcctctgcagcagcgctcaaacctggcgaggcgaagcgctacccgcgcggctacggcctcgacgagatcgtggcgggcgagccgttcgagaacctgttcgcctgctttggcatcgagggcggcctgccgccggaactcgccgcgcgctggcttgcggcggcgccgggcgcggacggcgaggcgaagctgcttcagccccccgatgtgctcgatctcctggacaagatccgcgcgacgcccggcgtgaccgaggccaccgcgcggatcgtggtgcggtga

SEQ ID NO: 8569 - DNA, 1392 bp, Methylobacterium sp.
atgaccggcggatatgacgagcgctgcgcggccgatctggccgccgtctgcgacggacgcgacctctcccgcgaggatcgcgcctggctcgcccgcgtcgtcaccggggccgtgcgcccgaaccgcgacaagccgctctgggacctcgcctacgcgctcgccgccctggcccgtgcgacgagcgcggtcagcgggcgcgacctcgtcaccctggcgctcgatcccggcctcgccaccgcctcggccgtgaccgcgcgcttctccggaagcatcgccgccgacacccgcggccccgtgctcggcgaggcgtggggcacgagttgggccgggctcgcgcgactgctggcgctcgccgagttcgtgctgacggccgaggatctcgcgcagttttccgctgtcacgggctggctcgacgagctggcggccgagcccgatgcggagggtgcgatcttcctggccaagcgcctcgctcgacatctgaccgcctaccgcaacgcccacctgccgctggcgccgctggagcgccgcttccgcgcgatcctcggcttcctggccgggcgcaaaaccttcagcgacgacgatatcctcggcttctggcgcagcgagatggaggcgggtgagcggccgggcttccgcacggtcgccgaacatttcgtgaccttcgaggcgggggcccatctcgtgggcggcttggaggggctctccgctcccgtctccctcgacgcccatgcgggctgggaggagcggctcgacgccgcgctcgtcgatctcgccgcctctgagccggccgaaacgctcgcggccctgctcgccgactggccggagggcccgaaaatcctcacaggcgccgagcgcgaggatctgaccgacctcctgcgcctcgaacccttccaccgcacccgcccgctgacgacgctcagggccgcgagcttcgggcgggtgcaatcgggcatcgccaaccgcctgcgccggggcggcggcggcgccgaggtcgccgagcgggcgacctgcacggatgccgagagctacgcggcgctgcaggagcgggccggcacgctcgcggcccatctcggccggatgctgcgcatcgcggcgaccctgcgcatcgccgagcgcgacggtctcggccctgagacacgcgccgctttggaggcggcagaggcggatctgcgccgggtgcgtcgggccggcttcgaggaccgcgccgtgcttgccgcgggtttcgccgccgccgagaccgcgctcctgcgcctttccgaggaggccggccggctggaaagggcgcttgcgggcctcgcccggcagcgcccgctcgacgcggccttcgccgcggatcaatcggtcttcgcggccgctttcgcggcggcctataccggggaggccgccgcgtga

SEQ ID NO: 8570 - DNA, 240 bp, Methylobacterium sp.
atgattgccgtgagcgcggtgctgtccgccggactcgtcgccggcctggccgcgacggacgccgccgcccgcccaaagccggcggcgaccgcggcggcgatcgaggcgccggccctcaaggcccccgagagccgcccgtcgacaacggtctcgccctgtaccgccgcctggccctaccagtcagccgcctgcgccgcggacgggcgcaaggtgcgcgtcatcgcgctgaccgggcgctga

SEQ ID NO: 8571 - DNA, 864 bp, Methylobacterium sp.
atgaacaactcgatgagccctgcggtgagcgaggcgcgccccgacatcgccgtgttggcgctggcgcgcaactgtgccgccaccctgccggccttcctgcgcttcctggcttcgctgcgggcggcgggactcgcgtgccgcgccttcgtcggcgagaatgattcccgcgacggaaccggagccttgctcgcggcggcggaggcgcggggcgaactgcgtcacgttcccaccggcttcatggccgagacgcgcggccggctcgcgcggatggcgctcgggcgcgagcacctgaagcaggtcctcgacgctcagggcccgccgccggccttcgtctgcgtcgccgacatcgacaacgtcatggcccgcccgcccgaggcgggggcggtgctggcggcgctggaaaagctggagcggccgggcctgtttgcggtctcggcggcctcgcgcccgcactattacgacctgctcgcctacgaggacgaaacggtgagctacgagcacctcctcgacgacatcgcccgccaccgccgcggcgcgctcggctactaccgcttcttctccggcacgatctatccggcccagagcgcgctgacgcgcgagcgcgagaccacctgcctttcggccttcaacggactgacgctctatcgcggcgccgattaccgcctcggctcctaccgagacgaggcttacgcgcgctgcgagcacctcaccttcaaccgccgtgtcgccgccgccacgggccggcgcatgctggtcgatccgggcctcgtcctgcgcacccccggcgaccacgcccagcgcggattcgtctcgttctacgccagccgtgtgcgcaagctggcggtggcgcggctgcggggatga

SEQ ID NO: 8572 - DNA, 1281 bp, Methylobacterium sp.
gtgacgggcgcgcccgcgcgccgacgggcggcgcgcgcctgcgccgccctggccctcctgctggcgaccgcaccgccggcccggcctgccgagatcgcgctcggcggcgcccgcttcgatctgcccgccgccttcgaggactggacgcgtcgggaggcgaatgacgggctcctgttccagcgcgtctacgagccgacgggtccgcgcgggcgaaagggcatggcgatcctgctggtcgccaagccgaagcccgcctccggccctttcgatgcggcgttcacggggttcgtgcgtggcatcaagcaggttccgagcgagggcaagccgctcacggcggaggcgggcgagaccctcgacggccacccgatccgcatcgagcagcgctgctgccggtcgagcgacgggctgcgcatgggcgcgtggttcgtcggcatcgccgctggcgggagcgagcattacctcatgctcctcacgcttcagctcgaacgggaggccgagaagccggtccgcgaggcgtttcaggctctggtgcgcagctaccgcccgctgagggatgaccgcggcttcgtcctcgcgccgaaatccggcgatggcggcatggaaggcctctacgcgcgcaccgagacgcggctgatgcccaatgccttcggcggcatggatttcatcgccgaccaagccacgctgctgttcgacaagagcgggctctacaccaccgaactgccccgcgacggcgacatcgcccgccattgccgtaccgcggtcgcgagctgcggcacctacgcgctgaagggcggatggctctcggccaaaagcatcgatcgcgtcgaggtcgagaatgcgttcggcctcacgaagcgctccaacgagaccttcgcccgcaccggcgacggcatcaagatcggcgacacgacctacgcgacgatgccacccttcgccgagggccaccgcttctccggcacgtggagccacaccttcggatcgagcgggccgacgggcgcggtcggcggagcgcgcacgctgagcctgaccccggacgggcgcttcacccgcgagggcagcacgggcttctcctcgaccggcggggcgatcgacggcggcaccactgtggcggggcacagccgccggccggtgcagagcgggcgctacgccgtctccggcttccggatcacgctgaccgacgaggcgggcggaacagagtcgctcagcctgttcgcgccggatcgggactcagacaagcttctggtgatcgacggggcgaactacctcaagcagggacggtga

SEQ ID NO: 8573 - DNA, 300 bp, Methylobacterium sp.
ttgtccaagatcacactcgccaaaatcgcgctggccaagatcgcactggccaagattgcactggccggatcgatcggcctgatctcgaacacggcggcgaatgccaagagtcacccggctcaaaccggcacgggcggcggcccggagacgacgatcaccgccccgcatgtggcaccaacgggaagggtcatgcctcgcccccgccccttggactcacagacgcgcggtgaggccgagcagacgctctccccgcagttcaaggacagctttctcatgaaggacatctgcgtcggctgttga

SEQ ID NO: 8574 - DNA, 150 bp, Methylobacterium sp.
atggcctcgaaggtgttgttggctctggtggtgctcgtcttcgtcctggacggccacctgcccgggatgcgcgagttgcgcaacccggatgccgagggcggcaagggcacaggccgtgcctcgctcctgtcgaagcggtccgaggcctga

SEQ ID NO: 8575 - DNA, 228 bp, Methylobacterium sp.
gtgcttcaatccatcgacatcgaaacggtgcgcatcgtgcgggttccagccggatcggggccccgcgacgaggcggtttccagcaccggcgcccggcttgccaatccgtccgcggcgcgcgtcgtcacgaacatcgcacgctaccacacgatccccagcctgcaggcgctcgccctggccgctctggcctcggcggtgacgccggcgctgatctggctggtgctctga

SEQ ID NO: 8576 - DNA, 621 bp, Methylobacterium sp.
atggtcgaggcgcagttgatcgcccgcggcatccgcgatgccgccgtcctcgacgcgatgggaaatgtgccgcgcgaggctttcgtgccgcccgatggcgcggcgcaggcttacagcgacgggccgctgccgatcggtgcggggcagacgatctcccagccctacatcgccgccctgatgatcgaggcgctggcgctgcgccccggcgagcgggtgctcgaggtcggggccggttgcggctacacggccgccgtgctggcgcggatcggggcgcaggtctacgccatcgagcgccaggcggccctggccgaggcgacgcgcgcccgcctcgccgccctcggcttcgccggcgtgcacctgcgcgtcggcgatggcggggcgggctggctcgaggccgcgcccttcgacgcgatcctcgtctccgcggcgggccccgcgatcccggaggcgctcaaatcccagctcaagcaggcgggccgcctcgtcatcccggtcggcccgcccggcggccagacgctgctgcggctgacccggcgtgggccggaccggttcgagagcaccgatttcggcccggtctccttcgtgccgctgctgcggggtgtggcggcagagagccggtga

SEQ ID NO: 8577 - DNA, 678 bp, Methylobacterium sp.
atgctgaggatcctccgtcggctccttgccggccgtcgggccaaggcgcaggtccggacgtcctccgatacgcccgtcgaaaagatcgaccgtgccgacacggccgagcagatcgagatcctggctcacggcggcttcgaaaccgaggcctcgacgcgcgagacgatcctcgacacgtacctgaaccccgacgcggtcgcgcccgacgatcgccgctgggtcgaggcggaggtggcccgcgccttcgcgcgcaagcgggccgacgaggcgacctggccgctggagacggatttcgaccgcctcgccatcgccttcgacaggctcgatgccgccggcatcatcgctctgcatcgcgccggctacacccgctccgacgggatctcggacgcggccgaggtctatcaccggcgtaaggagcgcgggcgcgcctcgcgtgggttcgtgttctaccacggtcaggatgtcgaggcggtcgtcttcgaccaggggctctacctcgccttcggctcgttcgacgatcgcgacgagaccatggccgccatcgccgccgagatcgtggcggcggtggaggcacaagggttgcggaccaagtgggagggcgacgtgggcacgcgcatccttgtccatccgatccagtggttgaagcgcagcccgtccgacgacccgcgggaggcatga

SEQ ID NO: 8578 - DNA, 213 bp, Methylobacterium sp.
atgatctctctggctctcctcgctgccgtcgctgctggcgccgtcaacattgccctggtcaccctggtggccaaccgcctcggcccgaaggccggcactgcttccgccggtgaattcgctgccatcggcggtgcggcgcccaccgcccagcgcggtgcggtcaaggtcggcaacgagaacctctcccccctcgccgtccggcgcgccgcctga

SEQ ID NO: 8579 - DNA, 201 bp, Methylobacterium sp.
atgtccatcgccagaattcgcgagaccgacgagcagtgggtcgagcttccggagccggaccttgagcggtaccttctgcacacgcgtggccaggccgccaacgataatcgccgcttatcggccgaaacctttcgcaccgttcagctcggtgcgtgcgtggcgctgatcggggccgccacgctcatcggtgccctgatctga

SEQ ID NO: 8580 - DNA, 657 bp, Methylobacterium sp.
atgagcgcgctggtcggccccgccctgttccccttcaccctggccgcagtggtgatgaccggcctcgttgtggtggaggttttgtcgctcctcgtcggccattccctctccgggctggtggacaatgccctcggccacgaggcggggggcggaggcgacctcgccaccgcggcggatgcggacggcgcgttctccccggccgcgctgatgtcgtggatcaatctgggccgcgtgcccttcctgatcctgctgatcctggcgctggccgtcttcgcgctggcgggcttcctcgtgcaggggctcgccgccgccctcgtcgcgcccctgcccaccctcctggcggttccggtagccagcgcggcgacgctcccggcccttcgcgtctcgacccgtgtcatcgccggtttgatcccgcgggacgagacctacgtcgtcaccgccgacgatctggtcggtgccacggcagaggtcaccctcggccccctcgacgagggcctgccgggccaggtccgcgcggtggaccgccacggcaatacccacttcctgcgcgcccgcgccgcccccggcgcgccagccatggccacgggcgcccgcgtgctcctcgtggaccggaccgaggcggtcttcgtcgcggtgcccgccacacctgatctctga

SEQ ID NO: 8581 - DNA, 1122 bp, Methylobacterium sp.
gtgcgccggttcggactcgttgaggacgccaacccggccgcgttcgaccgggtgccggatctcgcgatcggccttcccctgccggttgagccaacgcagcgcgagcgcatgggccgctacctcgacctgtgctcgcggaccgaaaatcccattcccggcgcgctgttcgtccgcgacggagccgagggctttggccgtcatccgtgccggggcgcgcgcatcgtcctgcgcgcgtatgatgaagagccgctcgtcctcctgcatctcacgccgaccggcctggagggccggcttagcctcctcaccgatcgcctgaacgatgcccggcgcgtgatgcaggagcggaggcggcgtgaaatcgagatgcaggcgctcctggccgagcgcagccgattgctggcccatcttgaggaggatgcgcaggcacgccagcgcgccgaagccgagcgggacgccgtcctgtccaaactctatcgggccggacaggacgagcggcggcgcctcgcgcgcgacctccacgatcatgccggccagcagctcgtgacgctgactttcggcctgagaaagatcgcctcacgcctgtcctgcccgacggcgatccgcgaggtggagcaactcctgcgacacacccaggacatcggacaatcgctccggcgggtgaccctcgaactccggccggcggcccttgaggagttcggcctcgtcaccgccttgcggtctctggtggaagaatggaaccgggtcaccgagatcgtgaccgagttccagatcgtcggccaggaagaggaccttcctctcgagaccgctgtcaccctttatcgcttggcgcaggaggcgctgacgaatgtagccaagcatgcggggccgggcgtggccgtctcggtcgtgctgcgcttcagcgccctacaggtcacgctgacgatcgacgataacggcggggggttcgaagccgacgaggctttgacgagccatctcgtctcccagggcaaactcggcctgctcggcatgcgtgaacgactgtcgctggtcgacggcaccttgaagatcgagtccgcccccggtcagggcacgagcatcgttgcgcgggtctaccggtcccctgaggcgcgcggcgatgcctag

SEQ ID NO: 8582 - DNA, 669 bp, Methylobacterium sp.
atgcctagcccgctgatccaggtcgtgctggcggacgatcacccggtcttccggcacggggtgaaaagcctgatcgctgattccggcgaaatcgtcgtcgtggcatccgtcgagacaggggccgcggcctatcgggcgattgtccagcatgagccggacgttgccgtcctcgacatcaacatgccggagatgaacggcgtgacggtcgtgcgcaatctcctcaagtccggcagccgcacccgagcgatcatgctgagcgtctacgagagccgggtctacgtggatcaatccttcgaggcgggcgcgcgcggctatgttctcaaacgctcggccttccagaacatcgccagcgcggtgcgggcggtgcacgagggtggcatctatcttgatccggcgctgccggaacgcaccgttccgcatcgcctgctgcatgccagcgtcgatgagtcggcgagttcgaccctgagcgagcgtgagaaggacatcctccgcttcgtcgccttcggcttcacgagcaaggaagtcgccgaccgactcggagcgacccccaaggcgatcgagactcaaaaggcccgggcctgtctgaagctcggcctgacgagccgggcgcagatcgtccagttcgccattctccagggctggctgcacggagaaatccccgtccgctga

SEQ ID NO: 8583 - DNA, 246 bp, Methylobacterium sp.
atgctggtacggtttgggctgggtgtcgttttgactatggtggccagcagtgctgcgttggccgcgcctatgtccgatgaggacaaggcggtccttcaacagcaatgcgctggtgatttcacgactttctgtgccggcttgccgccggaggacggtcccgaaacccaggcctgcttccagaagaacatgtcccagctctcccccggctgccgaactgcgattcaggcgtacaagaagaagggttga

SEQ ID NO: 8584 - DNA, 2112 bp, Methylobacterium sp.
atgtcgccgctcctgacgcgcctgctcgcatcggtcggcgccctcggctgcaccacactccccggtcacgcgctcgatccggccgcggtggagctggaggaattgcaagtcacggcgcaatccgcaccgacgagtccggtgacgatgatctccggcccgaccccgaacctgaagaccgccctgtccccctcggtctcggccctgccgggcaacaccacggtgatcgatgccgcggagatcgcccgcctgccggtgcagagctacggcgacctcttccgtcccgtggccggtttcgatgtctcgaattacggccagggcggcgtcggctacggcatcgctttgcgcggcttcagcgatgccgagcacggccgcgacgtggccgtcttcatcgatggcgtgccgatcaacgaggtctcctcgatccacactccgaactacgtcgatctcaacccgctgattcccgagaccatcgcctccatcagcatcgtgcgcgggccgttctcagtcgaggcgggcgatgccaatctcggcggcgcgatcttcatcgacaccaagcgggccgagccgttctcgacgctgggcgtgtcgggcggctccttcggcacggcgcgcggtctcgccacattcagccagctcggccccggcatccagcctttcctcgcctacgagggcttcggcacgggcggctatcgcgagaacggtgatctcgggcgctacaacgccttcaacaaggtcacgattcccctcgatctcggctccagcctgtcgttgcgggtacagatgtacggcacgggcttcgggcagccgggctatctggagcgcgaccgcgtgcgggccggcctcgtcccaccgcgcgcggcggccaaccccaccgatggcggcggcaagaccctgcagaccttcgtggccaactacgtcaatggcgggcccgacgacgcgctgtcggcgctcctctacgccagccacgacgtgttcagccgcttctcggatttcggagccggccagcgcggacaggtcgaggagcgcgagaccgtcggcgggcgcctgcgcaaggtctggacgaccagcctgttcgatgccctgccggcccaaatcctcgtcggcggcgactggcgcacggacgcgctcgacgtgaacaccggcccctcggtcgcgcgcggcttcaccgcgcgcagcctcgatctcgacatcctccagcacaacctcgcggcctatgcgcaggtgcaggtcaagccgacgccctggttgaagctgaccggcggcgcccgcttcgaccagttcttctacgacgtgcgcaaccgtctcgaccccgccctctcgccaagggtcagccccaacgtcgtctcgcccaagggcggggcggcgctcacgcccttcggctggctggagctgttcgccaattacggccagggcttccgcagcccgtccgcgtcgagcgagttgacgggcaatccgcgcctcaccccgctcaccatcgagagcacggagggcggaggccggctcgttttcgaccgcgtcagcctgctcggcaccgtgttcttcaccgacatcgccaatgaggtgttccagcccgctcccggcctgcccgtgcagaacctcggcaagtcccgtcgcgacggcttcgagatcgaggcgaaaatcctcgcctaccgcaagggcctcgaccgggtcgccgtcttcgccaactactcgggcgtctccgcccggctgctcaacggggcgccgtcgatcttcgtccccaacgtgccggccttcctcgccacgatcggcgccgagttcgacgtcggcgcgccggcctcgctcggccccagccgtctgaccggcgcggcgtacctgtcctacacgggtgccaagccgctgaccgagaacgggggcttgcgctcctcgccctatccgcgggtgagcggccggctcgcctaccttcacgcgagcggctggaccacctacggtcaagcgacctggtatcctggcgaccgcaccagcgaaagcatcttcaatttcggctcgtcggtctccgcgacggcggccgacatcttcaccagcccgcagccgcgcctgacgctgctggccggcatcacctacggctttccaacgggagtaccagcacgatga

SEQ ID NO: 8585 - DNA, 423 bp, Methylobacterium sp.
atggatacgacgagaagggccgccggcggctcaagcctcccgaaaatcaaggtgacggcggaagaccgcgagcgtttggccgggctggcgtccgccgcgatggaccgcatgccggacctggccggctacctgtcggacgagctcgaccgggcccaagtcgttcgggccgggaggtccgccctcgggttcgtgcggatgggcagcgaggtcgagttccgcgacgacacgaccggcaaggtgcaggtcgtgagcctcgtctatccgggcggggcggacatcggacaggggaggatctcggtgctgacgccggtcggcgcggccctgctcggcctgagcaaggggcagtccatcgcctgggcgacgcggaccggggccgccaagcgcctgaccgtgctcgacgtacgcgagccagtcttcgcctga

SEQ ID NO: 8586 - DNA, 1203 bp, Methylobacterium sp.
atgaacgacagcattttggtcgtgaatgccggcagctcgtcgatcaagttcaagctgtaccggatcgacggcgcggacctggctctcctcctgggcggcgggatgagcggcatcggcggcacgcccctgctgacggtgaaggacggacgcggtgccgttctggaagagcgccgcttcacgcccggcgacgtgccggacgcctcggccgcgcagcaccacctcgaagattggttcgcccaccaccgcggcgccgagtcgatcgtcgcggtcgggcaccgggtggttcatggcgggccggacttcgcggagccggtgttggtcgatgacgcggtgctgcgcaggctcgaaagcttcatcccgctggcgccgctgcaccaactcggcaacctcgatccgatccgggtgctgcggcagcgtcggcccgacctgccgcaggtcgcctgcttcgacaccgccttccatcgcggccatccggagctgtccgaccgcttcgccctgccccgcttcctgcatgacgagggcgtgcggcgctacggctttcacggcctgtcctacgaatacgtcgccgggcgcctgcgggatctggcgcccgagacggcgcaggggcgcgtggtggtcgcccatctcggctccggcgcctcgctctgtgccctgaagggcggccggagccaggagaccaccatgagcttcaccgctctcgacggcgtgcccatgggcacgcgctgcggcgcgctcgatcccggcgtcgtgctgcacctcatcgagcacaagggcatgagtccggctgaggtcgggcacatgctctaccacgcgagcggcttgctcggcctgtccgggctcagcaacgacgtgctgactctgctggcgagcgaccggccggaggccgccatggccgtcgccttcttctgccggcgggtggcgcaggcggcggcatcgctcgccgtgacgctcggcggcctcgacgccttcgtcttcaccgccgggatcggcgagaacgcgcccgagatccggcagcgcatcgtcgccgaattgggctgggccggtttgatcctgagcaatgacgccaaccgctccggcgtcgcaagactcgatgcggcgggaagccgggcgcagatctggatcatcccgaccgacgaggagcgcatgatcgcaagacacacgctgcgtctgctgggccgcgccgcgccgggagcgacggcatga

SEQ ID NO: 8587 - DNA, 1260 bp, Methylobacterium sp.
gtggaggtgacggtgtccggccggttcacgctccgggtcgggtgggccgccgcgacgctctgcaccgcctgcctgcccgcggtttcgacggcgttcgcgcaggggcagggccagccggctggcccgcccgtcgtcggcgtcgtcacggcccgcaaggagccgatcacgcagacggagcagttcatcggccgcatcgaagcgaagcaacgcgtcgatatcgtcgcgcgggtgacggcgttcatcgagaagcggctcttcgtcgagggcgccgacgtccaggaaggcacgctcctctaccttcttgaaaagggaccgttccaggcggccgtggacgctcaacgggcgcagatcgcgcaagtcgaagcgcagttgggcaacgcccgtctcacgacgcagcgggcgaggactctgctcggcggaccggctgggcagcaatcgacctatgacgcggccctcgcgaacgagcgcgccctggaggcacagctccaggccgcccaggcccagctcgagacggcgcagatcaatctcggctacacggagatccgggcgccgatcacgggccagatcgggcgcaccgctctcacgatcggcaacgtggtcgggccgggctccggcgtgctgacgacgatcgtcagccaggatccgatgttcgtgacgtttccggtgccggtgcacgaggccatcactctgcgggcgcgctacacgccgctcggtgggttcggcgccgtcgtgatccgggcgcaactgcccgacggccgcctctacggtcacaccggcaagctcgatttcgtcaacaacaccatcgcgacgaacacggatacgatcctgcttcgcggcgtgctgcccaatcctccgatcttcgatcggacgcacgactccatcaccgttcgcgaacttctggacggcgagttcgtgaccgtgttcctcgaaggcgccgagccggtcgaggtggttgcgatcccccgagccgccgtcctggccgatcagcagggcagctacgtctacgtgatcggacccgagaacagggccgagcagcgtcggattcagctcggccagtcgagcacgacgctcgcggcggtaacgagcggtctcaaggtcggggagcaggtgatcgccgagggtctacagcgggtccgcgcgggtgaggcggtctcgcccgagcccgccgacactactcttcagaggttcatgcggaactcggccgcgagggatggccgggccgccccggcatcccccgatggttcgagtcgccgacgctag

SEQ ID NO: 8588 - DNA, 987 bp, Methylobacterium sp.
atgagaagcgagccggacctgccgccggacggctcgtattctggagagggccggccgcctcccgatccgatcgcgcactcggccgtgtccggtctggcggcgcggagcctcgatacgatgtcatcgaccggggacggcgtcgcgggcgcccggtccatccagcctcgcatcgaggatctacagagtgcggatttccggacggccctgtccgaggaagagttctcgctcgtctaccagcccatcctgtcggcggcgacgggggcgatcacggcctgcgaagcgctgctgcgctgggatcatccgtccctggggtcgatctcacccgcactcttcgtgccggtggccgagaggacgcaggacatcatcccggtcggcgcgtgggttctcgaaaccgcctgccgggaggcggcggcgtggccggacatctgccgggtctcggtgaacgtctcaccggttcagttgcaggagccgggcttcgaggcccgagtcgccgccgccctggacgcgagcggactggcgcccggccgccttgaactggagctgaccgagggcgtcctgatgagggacgccgccgtcgcactcggcagcatcgtcggccttcgcgcgctcggtgtcagcatcgccctcgacgatttcggaaccggattctcgtcgctcggctacctgcagagcttcgccttcgacaggatcaagatcgaccgctcgttcatccgagccatgagcgagagacgggagagccgcttcctgatccggacgatgcatgacatcgcgcatcatttcgggatggcggtgacggccgaggggatcgagaccgaggacgaagcgcggatacttcgcgaaatcggttccgcggagctgcagggcttcctgttcagccgtcccctggcgagcgcggccgcgacgtctcttctccgggaggaggcgcacaggcagcgacggagcgaggccgcacgacaacggcgatccacgagacacgcggctccgtga

SEQ ID NO: 8589 - DNA, 426 bp, Methylobacterium sp.
atgctcgacgcgatcgatcgccggctcatagccctgctacggaccgacgcgcggatgcccctggcgaaactcgccgcggcgctcggcatcacgcgggcgacggcgcgggcacggcttgatcgtctgctgaccaccggcgtcatcaccggtttcaccgtcacggtgcggaacccggagcccggtggcgtgcgcgcggtgacgctgatcgaggtggatgggcgccatgccgagagcgtgatccgccgcctgtccggcctaccggagatccacgctcttcacacaaccaacggccgctgggacatcgtcgccgagatcgaggtgccgaccctcggcgacttcgacacgctgctgcggacgatccggcagttcgaggggatcgccaattccgagaccagcattctgctcgctgcgcgtaagggcatgtga

SEQ ID NO: 8590 - DNA, 255 bp, Methylobacterium sp.
atgacccgttttccgatcttcagcgcgctcgtcctcggcggcctctctcttgccggcaccgcgacggcgcaggctttcccgaacgacgaggcgtcggtgcgctaccggcagttcatccagcagcttccgccctccgagcgtccgcgcccgcacgatccgcgctggaccacgaacgcgatcagccccagcaccggccgcttcggcctgcccctgtcgggcccggccgcccgcggcgggatgacggccgttcgctga

SEQ ID NO: 8591 - DNA, 651 bp, Methylobacterium sp.
atgtggcggatcattatcgcagatgaccagaaaagcttccgcatcggtttgcggaaggctctggaggttggctctgccgggataattatcgtcgacgtgtccggggcgtcggaactcatcaatcatctacgctcgccgctgaaaaccgatctggtcatcgtcggatcgcgcctgcttcccgccggggatccgacctatctgggggccctgaagcgggcggccggcgctgcgcgcctcctgctcgtcgttccgcacgcctcggccgacctattccaggatgccctgagcctcggcttccacggattgatcatccgccggcagcgccacgaggagatgatcgaggccatccgcacgacgctcgacggccggctgtacgcacccaatgccatcctggccgtgaagccgccggaagtcgcgtccgcgatgcggcagccggagcgcggtgcgcggacgatcggtctgacactgcgtcagcgcgaagttctggcgttgatcggcaagggcctatccaatcgagagatcgccttcgcgctgagcatcgccgaggcgacggtgaaaatccatgtttccgccgtgatccgaatgctcggagttagaaatcgcaccgaagctgcgcttctcgcgccgaccatcctcaagggtaaaatctag

SEQ ID NO: 8592 - DNA, 156 bp, Methylobacterium sp.
atggttgcgagcgcagtctgcctcgtcacgggtgttggtctggcggcccaggcgcaccgcttcggcccgcgctcggcgctcgccgaatccctggccggcgtcctgctgatcctcggcctcgcgctgatcggctcggggttgccggtgtttcgatag

SEQ ID NO: 8593 - DNA, 1005 bp, Methylobacterium sp.
gtgcgcgccgcccttctcgcgatcgggctcgccgccggtctcgccgtcgccgctcccccgccggtccaggcgcagtcgcgcctgaaacagctcatcgaccggctgcgcggccagcgcatgcccgagggcatcgccaaatcgaacgggcgtattgaggcgacgcaggtcgatgtcgcggccaaatatgccggccgcatcgccaagctgctcgtcaaggaaggcgacgaggtcaccgcgggtcaggtcgtcgcgacgatttcctcacccgagaccgaggcgcagttgcgcggcgcccaggcccaggtgttgcgggccaagaagagcctcgcggaagcggtcgccctgatcgcccagcgcaccagcgacctcaccttcgccgacgccgactacaaccgcggcaaggagttggtcggcaagggatatctcaccaagcagatcttcgaccagcgcaaggccaaggcggatgcggcgaaggccggactcgaggccgccaaggcggaggaggagcaggccaagttcgcggtgaagagcgccgaggccgatgtcgagcggctgcaggcggttctcgtcgatctcgtgctgcgtgcgccccgcgacgggcgggtgcagtaccggctggcgcgggagggtgaggtggtcggcgccggcacccgcatcctgactttgctcgacctcgccgacgtctacatgacgatctacctgccggccgcgcaggccgggccgctggcgctcaacgacgatgcccggatcatcctcgatccgatcccccaatacgtaatcccggcgacgatcagcttcgtcgccgccgaggcgcagttcacgcccaaaagcgtcgagaccgaggaggagcgcgagaagctgaccttccgggtcaagctccagatcgatcccaaggtcctgaagaaatatcatcgacgggtgaagacgggcgtgcgtggcatgggcttcgtccgcaccaaggccgatgcgcaatggccgcccgacctcgccgtgaagctgccgtga

SEQ ID NO: 8594 - DNA, 582 bp, Methylobacterium sp.
atgagtgtcgacagttcctgcccgacgaccggcgagccgcgtctaccggttcaagcctctgaacggacgctgttcgacatcgaagtcgggctgtccgatgcgctggggttggtgaagcaggctgcggacacgatccatgacctgcagcgctggcgggatacgatcgagccgcagacgctgagtctgatacggagcgtccagcaggagcgggtccggtggcagcgggagcgaacggccctggccggtgaaatccgggaatgccggctgacgatcgacgcgacgaagttggccctgcaaacggctttaaccgagaacgaggggctgcagcggcgctatcacgacgcgaaagcgtgcgcagcgtccgccgaaaagcgcgccgccgcggcagaggacttgctcgccttcatctatcagactttccatgtcgagctgggcggcgcggccggaaacgacagaatccgcctgccgtctcgtccggccggtgagcggatcgcgcccgagtcgctgcccgcctccgcggcgcctcacggcacttcgtcgagcgccgcatcgccagagcccggcatcgacctaggcctgtga

SEQ ID NO: 8595 - DNA, 468 bp, Methylobacterium sp.
atggatctcgtggtgacgacgatggggtccctgttcgaggagacggtcggatccaacgaggcgggaggcttcgtcagcttggttgggcttgccgtgggggagaaaattcaggcggcgtaccttgcgtcgagtggggcgagccaactcgatcggaaggggatggtcgacgccctgctcgacatgaaacggcggatcggcagtgacttctacgtcgtggaggaatcggagcagcgcatcgttcttggcaacaagcgctgcccgttcggagaactggcgaagaaatgtccgtcgctgtgcatgctgacggccaacgtgtgtgggcatctggccgcggagagtcagggatatgcacgagtcgatctccccgagaccatcgccgcgggggcgtccgagtgccggatcgtcatcaacctcgaacctaattcatccggcggcgggcggcgatatcaccggagagcctgggcctga

SEQ ID NO: 8596 - DNA, 1314 bp, Methylobacterium sp.
ttgcggcggcacgatccgcaatcccgcgcggacctcgcgttctcggtcggtcctcgcattgtcgcgggcttcatcttcggcgtggccctcgtcggcggcgtcggcggatgggccgccaccaccgatctcagcggcgcaattctcgcctccgggaccgtcgcggtcgatcagcgggccaagtccgtgcagcaccgcgacggcggcgtggtcggcgagatcctcgtgcgcgacggacagccggtcacggccaaccaagtgcttctcaggatcgacgacgcgcagacccgcgccgaacttgcgatcgtcaagggccaactggtggaactcgccgccaagaaggcccggctcctggcggagcgcgacgggcagcgcgaggtgagtttcccgcaggctctgcttcgtccggatgtcgaggtgcagtcgatcctggagggcgagctccggctgttccggggcaatcttgccagccgcgacagccagcgccagcaactcgaactccagatcgggcagattgccgaggagatcgccggcctgacgaagcagcgcgacgccaagagagacgaactgaccgtccttacccacgagcacggcaagctttcgacccttgtcgagaagcaactctacgagagttcccgcttcctcccgatcacccgcgacaagcaccgcctcgccggcgagcaaggatcgctggaggcctcgatcgcgcgggccaagacgcggacgagcgagatccgcgttcagatcatcgcgatcggcgacaccgcacggaccgaggcacagcgcgaactcagccaggtcgatgccaaggcggcggagctgagcaaccgccgcgtggcgctggaggaccgcctgactcgtacggagatccgtgcccccgtcaccggtgtcctgcacgagttgaagaccttcacggtcggcggagtcgtcacccccgccgacatcctagcgaccgtggtgcccgaggatgcgcggctcaggatcgagatccgaatcccgccgaccagcatcgaccagaccggcgtcggccgcgcggcccgggtccgcttcacggccttcagtcagcgcacgacaccggaactcaagggggtgctgacctacgtctcgccctcaacgacgaagggcccacgggacgaggcgttctatgtcggacatatcgaactccaagatggggagctcgagcgattaggaggctccagccgcctcgtgcccggaatgcccgtcgaggttcaggttgcaaccgatgagcgtacggcgatgtcttaccttatcaaaccgttgcaagatcagtttagccgcgctttccgggagagatag

SEQ ID NO: 8597 - DNA, 231 bp, Methylobacterium sp.
atgaagcatccgattctcaccgccgccgtcctcgccctgggcgtcgcggccctcgccggcccggccgaggccaagggctgcctcaagggagccgtcgtcggcggtgcggcgggcagcatggccggccacggcaaggccggtgccgccgcgggttgcgtcatcggccaccacgaggccaacaagaaggacaaggcaggcgggcagaacgcgcagcccgttccggccaagtaa

SEQ ID NO: 8598 - DNA, 630 bp, Methylobacterium sp.
atggccgagcttgtggtgattggattcgaggatccgcaacaagcggacagcgccctgaacgagctggcacgcctgcagaccgagtatctgatcgatctggaggatgcggtcgtcgccgtgcggagcccggacggcaagctgcggctcaagcagagcgtcgatctgatcggggcgggagcggcctccggcggcatctggggcgcgatgtggggctcgctggtcggcctcctcttcctgaacccgctgctcggcctcgccacgggggcggcgctcggggcgggagcaggggccctatcgggcaagctcgccgattacggcatcaacgacgatttcatccgctccgtcgccgaggccgttcagccgaacacctcggccctgttcatcctcgtgcgcaaggcgcagccggagaaggtcctcgcggagatgaagcagttccgggggcgcgtgatccgctcctcgctctcgccagagcaggaaagccggctccaggcggctttgtcgggaccggaggtgtcgatgcccggaagcgcagagccagccgcgtcttccgctgcggacggcacggcggccccggatatcggcagcagcccgcagccgcccggcggggccaccggtccgacgggggcctga

SEQ ID NO: 8599 - DNA, 327 bp, Methylobacterium sp.
atgacccgatcgtggaccgccgccgtgctcttcgcggggctgaccctcacgaacctgccagcctcggtgcgagccgaaccggcgatctcgcccgaggcccggaagagcctgcccgccgccgtcgtggcctatctggaccggcggagggagtgcagccactggtccggagaggacgcctacgatgcggcccgcggccggcagatcgccgccgccgtcaagagactgcgctgcgacgacatcgaggcggacgagacgcggctgcggcagcgatacggccgcgatccggcggtgcggagggcgctcgacggggccgcgcatgccgactga

SEQ ID NO: 8600 - DNA, 1767 bp, Methylobacterium sp.
atgcgttccagagatcagaaaaagctcgctcagcaacggtgcgccgagcagctcacccggagcatccggggacccttcgtcttcctgttcggaatgtccgggatcatcaacatcctggcgctgaccggctccttctacatgctgcaggtctacgaccgcgcccttccgagcggcagcctgccgacgctcgtcgggctgtcgatcctcgccatcggcctctacctggcgcagggcctgttcgacgttctccgctcgcagatcctggttcgcctcggggcgcagttcgaccgccggctcgccccgctggcgcagcgggtcgggatcgacatgccgcgcttcggcttctcgaccgcggaggcgatggagcgtggccgtgacgtcgataccgtccgcggcttcctcggcagccccggcctcgtcgccctgttcgacctgccgtgggtgccggtcttcctcatcttcgtctacatgctgcacccctatctcggcgctctcaccgtcgcgggggcggtcgtcctcgccctgctgacgatcgtcgccgaactcctgacccgacgctggaccggcgccacgcagcaggccgtggtggcccgcaacgccatcgcggattcgaacgcgcgcagcgccgaggtgctcaaggcgatgggcttcgccgaccgggcggtggaccgctaccgccgcgccaatgacgagcacctcgatctccagacccgcaccaccgacatcagcggcaccttcggcgcgatcgcgcgcgtgctgcgcatgatcctgcaatcggcggtgctcgggctcggcgcctacctcgtcatcggcggcgaactctccgccggcgccatcatcgccgcttcgatcacctcggcccgcgccatggcgcccattgatcaggcaatcggcaactggaaggtgatcctggccgcgcgaaccgccttccggcgcctgaaggagaccgtgatcgcgctggccgcggccgagccgccgatgccgctgccgcccgcgcgccggtcgctcagggtcggccacatcacggttgccgcccccggaacgggccgcgtgctcctctcggatgtcgggttcgagctcaaggccagtcaggcgctcggcgtcatcgggccgagcggcggtggcaagaccaccctcggccgtgcgctgaccgggatctggccgctgctgcgcggcagtgtgcggctcgatgaggccgacctgccgcaatgggacgaggcgagcctcggcgcgatgatcggctacctgccccaggaagtctgcctcatggacgcgacggtcgaggagaacatcgcccgtctggctgaggacgccgacccggcgctggtcgtggcggccgcgcaggcagcgggcgtgcacgagatgatcctgcgcatgcccgacgggtacaagacggaactcgggccgctcgggacggcactctcgggcgggcagcggcagcggatcgcgctggcccgcgcgctctacggcaacccgttcctcgtcgtcctcgacgagccgaacgccaatctcgatgccgagggcgaggcggcgctcgccgcggcgatccagggcgtgcggttgcgcggcggcatcgcgatcgtgatcgcccaccgccccagcgtgctcgcagccgtggatctcgtcgcggtgattcaggacggcaagctcaccgccttcgggccgaaggaagcgattctcggcaaggctgcccgcgatagtgcggctaggctcgacgccgcccaggacaacagggagcgctccatgccggagcgggtgcccgcatga

SEQ ID NO: 8601 - DNA, 948 bp, Methylobacterium sp.
atggtgttgacgaggttcggcgggccggacagcttcgagctccgggagctgcccgacccacggccgggaccccggcaggtccgcgtggctgtgcatgcgacgtcggtcaacccgctcgacggccagatccgccgcggtgactacgccgaccaaatcgaactgccggccaccatcgggcacgacgtctctggggtcgtcgaccagatcggatccgacgtgaccgagttccgcgtcggggacgaagtctattacacgccgcgaatcttcggcgggccgggatcgtacgcggaataccacgtggcggacgccgacatcttggcgcggaaaccggtcaacctgacccattccgaggctgcgagcgtcagcctcgtcggcgtgaccgtctgggaagggctagtcgagcgggcccgattgcaggtgaccgagaccgtcctgatccacggtggtgccgggggcgtcggggccatcgccgtgcaggtcgccaaggccatcggcgcgcgggtcctggcgacggctcgaggcagcgacgcggcgctcgtcgaacggctcggcgcctcggctgtcatcgacttcgagcgcgaggactacgtggacgccgtcgatcgcctgaccgaaggcaagggcgtcgacgtcgttctggatacgatcgggcgcgacacgctttcgcgtgccccgcgcatcctccgcgaggacgggcgcgtcgtcaccctggtcgacaccgcgacgccccagaacctcatcgacgcctggggccggaacgcgacctaccacttcgtcttctctcgccagagtgccggcaagctcgacgccctcacgcgcctcctcgagcgaggcttggtggtcccgcaagtcggcctggagttttcccttgacgacgtcgcgcgcgctcacgcgcgctacgaggaaggccggctcaaaggcaagatcgtgcttcgggtcaaatcgtga

SEQ ID NO: 8602 - DNA, 258 bp, Methylobacterium sp.
atgtccatacgtaaggttctcgtcgcggcggccgccctcggcacactgatgatcctcgaagttccgagccatgctcaggggttccggatcggtcccggcggcgtggaaattgatgatggccgtggctatcgcgaagagcgcgacgagcgccgctaccgccgcatgtgccgggaccttcgcgatcgttgcgagaacaaggacatctacggcgaggaaggtcagggcaattgccggcgctaccgccgcatgtgcggttga

SEQ ID NO: 8603 - DNA, 1122 bp, Methylobacterium sp.
atgaatggtcacgccgaaacccgcatcaccgaacgcaaccgagtccgcgcggcgcgcatgaaggcggcgatcttcgtcgagcctggccgcatcgtcctggatgagaagccggttcccgacatcgggccgcttgatgccctcattcgcatcaccacgacgacgatctgcggcaccgacatccacatcctcaagggcgaatacccggtggcgcgcggcctgacgatcggccacgagccggtcgggatcatcgaacggctcggcagcgcggtccaaggcttccaagagggccagcgggtggtggccggcgcgatcacgccgtctgggcacagcgctgcttgcctctgcggctgcctctctcaggatggtccagacacgaagtacggcttcaagcccatgggcggctggcgcttcggcaacaccatcgacggctcacaggccgaatacctcctcgcgcccgatgccatgacgaacctcgcccccgtgccggacgacctgagcgacgagcaggtgctcatgtgtcccgacatcatgtccaccggcttctccggtgccgagagcgggggcgtgcggatcggcgacaccgtcgcggtctttgcacagggtccgatcggcctctgcgccacagccggcgcacggctgatgggtgccacgcggatcatcgccgtggaatgcgtgcccgagcgccagcaggtcgcccgccgcatgggggcggacgaaatcgtggatttctcgaaggaagatccggtcgatgcgatcctgcggatcactgacggccgaggcgtcgacgtggccattgaggcgctggggcgccaatcgacctttgaggcggccctgcgcgtgctgcgcccaggcggaacgctcgcctcactcggcgtctattcggaggatctgcggatcccgctcggccccttcgtggcggggctcggcaaccacaccatcgtcaccacgctctgccccggcgggaaggagcgcatgcgccgcctgatgtcggtcgtcgcctccggtcgcatcgatgccagcgtgctcgtcacgcaccgcttcggactggaggcaatcgaagaggcctacgacctttttgcgcaccagcgcgacggcgtattgaaggtcgcgatcacgccctga

SEQ ID NO: 8604 - DNA, 936 bp, Methylobacterium sp.
atggcgctccacgaagccctcggccgtctcgacggggcgcgcgaactgcgcggattccagaccgagccggcgcagatgcgggcaggggcgcccggcaaggtcggtcgattgcgcctcggcttcgcgctgcgcgacgggcgctcagacctgcacgacctctaccgggtcgccccgctgctggtgcagcaggcgctccactgggacgaggcgatgccggaactgccggtttgcccgatcatctcggtcgggggcggcatcctccagggcgaccgctacacgatcgagattgcggtgggggagggcgcctgcgcccacgtctccacgcagggcgccaaccgcatccactgcatggacgcgaattacgccgcgcagcaccagagcgtgacggtttcggccggcggctatctcgaatacctgccggatgtcaccattccctatcgcggctcgcgcttcctctcccgcacggagatcgtcgtcgcggaaagcgccactcttctctacggcgagatggtgctggcgggccgcaagcatcaccatgccgaggaacgcttcggcttcgatctgctgtcgatggacgtggcgctccaccggcccgacgggcgcaagctgtttgcggaaaagatcctgatcgagcgtggcgacccgacgatcggcttcgcggcggtgatgcgcggcttcgacgccttcgccaacatcctctgtgtgacgccacccgagaccgccgcgcgcatcaaggcgcggttcgagacaaacttctccggcgaggcgccgcgggcggtctccggcgtgagccgcctgcccaacgccgccgggctgatgctgcgcgcggtcggggtcgagagctacgacgtccgccacgaggtccgccggttctggcgcatcgtgcgcgaggaggcccgcggccgcacccttcccgccgaaccctactggcgctga

SEQ ID NO: 8605 - DNA, 1011 bp, Methylobacterium sp.
atgccgcgcgcgaaccccaaccttctcgtccagtcgctgcgcggagcgagccaggtcttcttcatggagaacgcggcgaccggcctgctgttcttcgtcgcgatggcctatgcctccgcgctcaccggcaactgggcgaccacgatcggggcggcgctcggggttctcgtcgcgacgctgaccgcgcggctgctggattgcgacgccccctccgtctcctccggcctctacggcttcaacggcatcctcgtcggcgccgcgctgcccaccttcatcgcgtcttcgccccagctctgggccgcgatcgtgatcggcgcagcggcgagcacggtggtgaccgccgccttcagcgcgacgctcaccgacaaatggggcattccgggctcgaccggccccttcgtgctgaccggctggctgatggtggccgcagcctattccttcggccgcctgcacgtcacgggcgatgcgccccggctcgcggccgacctcgtgcggggcgctgccggcattccggggccggcggatctcgtcgcgatcttctttcgcaacatcgcgcaggtctatttgctcggcagcgcggtgagcggcgccatcatcctcgccggtatcctgatcgcttccgtgccggccgggatcgccgccggtgccgggtcgctggtcagcctcgtcgtcgcgctcgcgatgggcgccgatccgtccgcggtgagtcaggggctctacggcttcagtccggtcctgacggcgatggccgtcggcgtgatcttcctgacgccctcaccgcgggtcgccgtctatgcgggactggccacggtgaccaccgtcttcgtccagggcgctctcgacgccctcgtcgcgccggccgggatcccgtccttcaccgccccctacgtcctgacgatgtacctgttcatcgcgcccaagcgcctgatggcgccccacccgcacgcgccggtcgccgatcacatggtcggcgaggggaccccggcccgtccggcgagccccgcgcggtga

SEQ ID NO: 8606 - DNA, 1239 bp, Methylobacterium sp.
atgcacggcatcaacgcgggcgacacggccttcatcctcatctgcaccgccctggtgctgatgatgacgccggccctggcgctgttctatggcggcctcgtcaagcagcgcgacgtgctgtcggtgatgatccagaacttcgtctgcatcggcgtcgtcggggtgatctgggtgttcggcggcttcagcctcgccttcggccccgatatcggcggcacaatcgggaatttcgcctcctatttcggaatgtacagggtcggcatcgagcccaatccggtctacgcgccgaacatccccttcatcatggtcttcgcctaccagatgatgttcgccatcatcacgccggcgctgatgacgggcgccttcgtcgggcgcttccggttcggcgcctacctgttcttcgtcgcggcttggaccatcctcgtctacttgccggccgcgcactggatctggggtggcggcttcctggccaagctcggcgtcgccgactttgccggcggcatcgtcatccatacctccgcaggtttctcggcgctggcgaccgccaagtatctcggcaagcgcaagctcgcggagggccagtccgaatcggcgccggcgagcctgcctctggtcgccctcggcgcgggtctgctgtggttcggctggttcggcttcaatgccggcggtgcctacgcggcggacgcgctggcggcctacgccttcaccaacaccatgctcgccggctccatcgccatgctgacctggatgttctgggaatggcgcgagacccggcacccctccttctcgggcgtcctcgtcggcgccgtggcgggtctcgcgacgatcactccggcctcaggctatgtcgagcccatcgccgccctggccatcggcgccatcggcgccacggcctgctactttgccaaatacgtgcagcgctggctgaggatcgacgacacgctggaagtctggcgcgcccacggcgtcggcggcctcaccggcgccctgctcgtcggcgtcctggccagcccccacatcaatcaggtctcggcgagcctggcgcagttcggcgtccagctcctcgccgtcactgtggtcggcgcctatgccgcgctcgtcaccttcggcattctgaagggcctcgaccggttcgggacgctgcgggtgcccgacgcgatccaggaagagggcctcgacacgatgctcggcgagcgcgccttcaacctgtggaacatggaccgcaccctgccgaagtag

SEQ ID NO: 8607 - DNA, 477 bp, Methylobacterium sp.
gtggctcttctgggcagccaagccgctttggccaagcgcgtcacggtcgtgccgggcgatcggccgattgccatcgacctgccgaacgcctggaaggtgtccgagatcaagcgcggcatccaggccaagaccgccgacgacgaggtctatctctggttcgagagctaccggccagcccagttccagacgctgctcgacgagcacaacgcctatttcaagggccagggcgtcaaggttgtcggtaccgaaaccgccaagcaggtcgacttcccgacctacgtgctcaaggtcaccgaatatccggcgacctacgagggcaagccaacggtgctgcgctacctctcggtcgtgccgaaggccgagggcgaccgctatctgctggtgagctactgggcctcgcccgcgggcgacaagcaatacgacagcgaggtccagaaaatcctcaacaacctggccgccgcctacgacggcaagtag

SEQ ID NO: 8608 - DNA, 492 bp, Methylobacterium sp.
atgacgctcaaggataggccgggggccacttgcgcggtccggcgcctcgaacccggcgacgtgccggcgatgcgcgccctcaacgcgctgttcgggcgcgccttcgccgagcccgacacctatggcgcggccccgcccgacgacgcctatctcgcggacctgctggccaaggcgcatgtcgcagtgctggtggcggaagagggcggcgccgtcatcggcgggctcgtcgcctacgagctcgacaagttcgagcgggcgcggcgcgaactctacatctacgacctcgccgtcgaggccgcgcatcgccgccgcggcatcgccacggccttgatcgagcatctgcaggcgcatgccgcgcgccgcggtgcctgggtcatcttcgtccagggcgatcccggcgacggaccggcgctcgccctctacgagcggctcggcacccgcgaagacgtcctgcatttcgacctgcccgtcgggacgccgcccttgccatag

SEQ ID NO: 8609 - DNA, 966 bp, Methylobacterium sp.
gtgctgcgcgccgccgttgaggcgtccggcgaggccatcatgatcacctcggccaaactcgacgagccgggcccgcgcatcgagtacgtcaacccggccttcacccgtatgaccggctacgaggcgcacgaggtgctcggccggacaccgcgcctgttacaaggtccagggaccgagcgcgccgtcctcgaccgcatgcggtcggcgctcgcggccggcgaggcgttccaggccgaggcggtgaactaccgcaaggacggcacctcctacgtggtcgagtggctgatcaccccggtgcgcgagacggacgggcgcatcacgcgatgggtgtcggcgcagcgcgacgtcaccgagcggcacgcctacgaggagcgtcaggcgctgatggtgcgcgagctccaccaccgggtgaagaacacgctcgccaccgtgcaggccgtgctgaacgcgaccgtgcgctcgtccctttcgattcctgagttcacgcgggccttgtcgggccgcatcgcctcgctggccaggacgcacgcgctgatcaccgaggacctcgcccaagcggcgtcgttcgacgggctgctctgggccgagctcgaaccctacgacgagcgcaggcgcctgacgctggaaggacccaaggtcgtgctgccatccgagcttgccgtgccggtcggcatggccctgcacgagctgaccaccaacgccctccggcacggctcgctggccgacccgaacggccggcttcacgtgacctggtgggtcgaggacgacaccgcaggccgcgccttgcgctgggactgggccgagcacgacgggccaccggccgagcatcccacccgcgagggcttcggccaccgcctgctgaacaaggtcttggcggcccagacaggggccgacgtcgacgtcgccttcgagtcggacggtctgcgcgtctccatccggatgccgctgcccggctccgccgcctga

SEQ ID NO: 8610 - DNA, 1476 bp, Methylobacterium sp.
atgacgacctatccggccgtgcgcggagccatcccgctctcctctctcgattggcctgccgcctccgccgggcaatcgccctcgatcacgccgacgcaactcctggcgatgctcaggcgccgccgacggctcatcgtcctctcgatgatcctcggtgtattgggcggcgcggttttcatcgccggcaccgagccgaagtacgtcgccaccgcacaagtcatcatcgatccacgggccctgcgcgtggtcgaacgcgaggtgacgccgagcgtcgacaacgccgatggacaggtcgcctcggtcgagaacgagatgcgcgtgctgcggtcgagcacggtcctcggagccctgatcgcccgagaccggctcgacgaggatcccgaattcgccggcgacccgcccggcctgctgcgtcggacgaaggcgacgctgctcgatctcgtcggcctgtcgccggcccgcgtgcccgatccgcgtcgtgcggccctccaggctctggaacgcaagatcgccgtccgccgggccgagcgcagcttcgtcgtcgaggtgcacgtggccacccgcgatcccgacaagtccgcccggatcgcgaacgatctcgtgacgctctacaccgaacaggcgagccggacccgcgccgaactcacgcgccgctccggcgcctccctcgacgaccgcctcgccgaactgcgcgcggccgtccgcgccgcggagagtcgggtcgagaccttcaggagcgagcacgatctcgtcagcgctgacggcgcgctcacgcgggaccggcgcctgcgcgacctcaacacccagcttgccgcggcccgggcccggtccgccgaggcgctcgtccggatggagcaggcgagcgccctgcgcggtcggctcgacggtctgtcggaggccgtccagtcccaggcgatgatccagttgcgctatcagatcgccgaggctcgccgccgccgggccaacctcgccaacgtgctggggccgcgccatccggaactgaactcggtcggccgcgagatcgatgcgctgcaggaccagctcggccaggagctgcagcggatcggcgacgcggcccgaaacgactaccgccgcgccaagcagaccgaggaggagctgcgcaggacggtcgagacgatgtcgacgacctcactcgccgacgaccgcgctctcgccgagctgcgcacgcgggaggcggaggcggaggcccagcgcaagctgttctcccagtacctcgtgcgctcccgcgaactgatcgagcagacgcaggtcaacgtgaacaacatccgcgtgatcggcgcggcgatcccgccggagaagccgacgaacctgagcaaggtcatcgtcctcgccctcggtacgctggtcggtctcgcgctcggcatcctcgcggcggtcgccctcggcgtcctgcgcggcgaggcggcgaccgccgcacggtctccgaccggattgggcgaggcggcgcgtgcctga

SEQ ID NO: 8611 - DNA, 2166 bp, Methylobacterium sp.
atgaccatcgagatcaaaggcacgaagcccggccgggacccggccgacggggccgagcgctacgtctcgggcagcgccgatcggcgctccggcgccccctattacgccgccatcgcggtcgcggccgtagcggcctacctcaaatccctgtttctgccccgcgcgaccctggcggaagaagtggagccggaggccgtggccgcccgcgccgacgccctgcgcctcgtccattccgaggagatcgccgcgcctgtctcgggaagggccgccgaggcgccgaggccgctggccgagccgccctccccggttctgccatccggcatgtccctgttcgacgacgggcacgaactgttctcgcgcgggctccgtttcgcaaagcccgacccgcgtccggacctcagcgacttcaaggcgtcgccgatcatcccccagccgatcaatgacaatggcggttccctcgccgccggatcgggcgggcgcggcggcgggcagacgagcggcagcggccggccgcaggacgcgggccgcccggagccgcaggagccaggagacgggacgaagtcgccccccgggccgcacggagaggacaagggcgacaagccggatcaagggactgacgggcaaggtggatcaaacccgcaagggcctacctcaccggaaggcggggtccgggtgccccccggttcgacaccgggcggcgatcccccctcccccgatccgacgacgcctccgcgtggccgggatgacggggcgaccgctcaacgcaaccgcgcgcccgtcgtgaacggcccggtccagctcggtgatgtcgcgggctgcgcgctcctcaccatcgccctgagcgatctcctgcgcggcgccaacgacccggacggggacgtactcactgtccgcgacatccgggtctcctccggtaccgtgacggcggatgggtcgggctgggtattcgacgccgacgcgcccgggccggtcacgatcacctacgcggtgacggacggcgagttctcggtcgcccgcacggcccatctgaccgtcctcgaacgggccctgatcggcggcaccgacggcgacgacctcatcctcggctcgccctgcgcggacgacatcgcggccggcgaaggcgacgacaacgtcgatgcacggggcggcgacgacctcgtcgaggccggcagcggcagcgaccacgtgatcgcggggggcggggccgacacggtcttagccggcgcgggcgaagacgtcgtgttcgcaggcaccggcgcggatatcgtctggggtggcgcgggtcacgaccgcctgttcggtgaggcgggcgacgacctcctgttcggtgaggcggggaacgacctgctcgacggcggcgagggacgcgacatcctggatgggggcgacggcgacgatctcgtcctcggcggcgcgggcgacgaccgcctctacggtgctgcgggcgacgacgatatgtccggcggcgccggtgcggacgtgctcgtcggtgatgcgggcaatgaccgactgcagggcggcgacggcgcggacgtgatctcggacggtaccgggcgggacgtcgtcctgggcggagagggcgacgacctcatcgtcctcgtcctcgacggtcaggaggacgctctcgaaggcggttcggggcgggatacgctcgatctctcggacgccacggtcgatctcgtggtcgacctgatcagcgagaccgtgtccgccggggaactcggcctcgaccggatcgcctcggtcgaggcgatcatcgccggatcgggagacgaccgcttcgtggtcggcgaccgggatctcgtgctcaccggcggttccgggcgcgacgtgttcgcgttcgccgggcctatcgagcctcgagacgacacccaggtcgtgcagatcacggatttctcggtcggggattacatcgacctcatccgctacgccctgttcacggacaccacggtcggtcgcccgctcgccgatgcgctgcagggcgggagcgatgcgccgaccggaatcctgtgccggttcgatcgtttcgaaggccgggaccgcacgctcgtctcggccgacctcgaccatgacgacacctttgagaccaccgtcgttctggatggcgagcacgcgctgcggttcaccccggcgccgttcacagaaccgccgacgacccacccctga

SEQ ID NO: 8612 - DNA, 3768 bp, Methylobacterium sp.
atgacgatgagcacggtcattcccttcttccgtccggcatcggcgcgacagggcaactggtcgcagcaggagctggccgagttctaccgcgtcgaggcggccctcctccgcgccggcttcagcatcgcgagcgaccacggcctcagcgacgaaggggagccttggttcgtcttctgccggccggatggcgatgcgatcatccatttcgccaagattgacggcagctatctcatcgcctcggaggctctggaccgacccgtgcgggggacggatttccgtacgctgatcgaccagatcgcccgcttgcatccgcacctgctcccgattccggcgactggaacggcgacgacgctcgtggttcatccggccgcactgctcgcggctctggtggctgcggccgccttgagcctgtcgtccgaggatgcccatgcggcgccgctcgtgccgggcgaaggcgtgtcggcggcgcccgcctccgagggaggcaggcacccgctgagccagccacagccgaaggccagcggcgggtccggcgatcgggacactgatcgcaagcagctcgaagccatcatcctctcggcgatgatcttcgcggccgaggcgatggcggtcgatcaccgcgccgtgagcgcggaactggatctcgacttcgcgggcggggcgggcaacgcctggagcccgacggcgcagggtgatgcgacgctgacgccgggcaccgcgctgggctctggccgcgggagcgtctcggttcagccggccgttctgacggcgcagggaagcggcgcgaatcccgacgctcgtcctcagtccgcttccgacacgatcgccgcgccgagccgagtcgatccggctcctgtggcgcggaccgaattcgcgatcgagacgccgaaatccccagcctcgcagaaccaaccgcaggcgccgggatttggcagcgatgttgcgctgaccggcacatcggccgaggtgtccgccgccaaatccagcggtcaccaagcgtcgacttcggcgcgtagcgaaggcgcggcgcccacatcggacgagccggggccggcctcgagggatcagcgcgccggatccgcatcggcctcgatcgccgagcccgcctcccacgcccgtcctggacatgccgcatcgtctgatctggtcagcaccggaagcggacccgcccggccggcttgggtcaatgacctgacccagaccgtgacgagccggatgccgtcgcccgaagcgtcgcgtgatgccgacgatcggagccacggccgaccggccgaagctgcgttcggaagcggccgaaaggtcgatccgacgggtcccggcaacggtcgcgtcgacggcgcgggccgggatcgcgaaccctctgccaaggctgccgacgagacccatcagaccaaggatcaagctgctcccggtcatagccaagccggcagcggtcaaggacgaggggttccagccgagacagcgaccgggaacactccgccggccgagcaggcccgccccggtcaaggtcccgtcgatcgcgccgatcaggaccgcggcgggatggcggccgtcggacgtagcccgaacgccgagcaggcggcccccggtccgagccaggccagcgccagaggtcaggatccggccgcgtcgagtgcagcctcccaagaaatgcgggtcgagcaaaccggccccatcaacggccaagtgaaccccgccggtccggaccgagcctcatcgcccgagggggcgagcgggaacgacccgcagaccgtaccggccggtggtggcaatggacacaccggcggtcttgcccggggagaagccgtgccggcacaagccaaagctgcgaatggtccaccggtcgagccgagtagccgtggcagcggtaacgccggtgccattgctcaggagcggggcccgcaggttgagacgacgaccggaagcaagccacagatcgatcagaccggcggcggcaacgaccacgccagtgttgtcgcccggcaagaagccgcgcccgctcagactgaagctgggaatctctcacccgttggacagaccggccaagggagtagccatgccggtggtgtcgctcgggaccggcccccacaggccgaggcggcggcaggaactaatccgcgccctgcgcaggccggcccgagtgaaagccgtgccgatgtgtccggtccgggaagcgcgcgggccgaggccgcgaccggcgagcttcccgaggctcaacaggtcggtcgcgccaacggccaagagaatgccaacgatcaaggttcgctgcggcagtccggggcggctccaggcaacgatccgcggatcgagccgacagacggcaacgacggccagggccatggcagtcacgcgaagccagagtctgtcgcgcagcgtgagccgggttcaggcgggcccgccatcggccgcgatcggtctccgagcgacgccagcgagcggggggcaacggctcaggccgaggccgctcatctcaagacggagcaggaggccgatcgcggcaatgggcacagctcggcccctgccgagcggagcgaccaacggatgcccgaagcgcagggtcccggcgcgaccgacaccgtctcaaatcacgggaggcccgacactcccggcgaagcaccgtccgatgcggcatcgaccatcaaggctcatccaccgctcgattccgattctgccgcccgcggatcgaacaagcccagcgcgaccgagcttcccggtggcgggcgcgaaccgattgaccgggcagccccggagcatgccgcagcggccgaacagacgcccgtggcggcggatgtgcccgctcagaagctgacatcgccgccctctgaacatggacggggcaattcgatcgggccgagcgccgatcacgcctcgaacgcggcagcctcggagcagaccaacggggacgtggccggcacgaaggagcacggatccgggccgaacaacaccgctgtggcctcgtcatcgaacgtccatgtcggcggcgccgggccacaggcgtcgcatgctcaagacgagccggtttcgcatgggcacgatcccgctgcggaggctcccgttcctgcgtcagttgcccgtgacccgatcttacaggatcggggaagcgatcgggcagtggcggaacactctgttggacacggcgcttcactgggatcggatgctctggatgcctccgcgaaggctaagcacacccaagccgagactgatggatcgcatgacagcgccggacccgtcgtcgttcgcgcgatcccggcagcgagcccacaggcgacggttcatggcgtggacgagaacggcctgtccgttccgtcggccggtccaaatctgacctcgccctccgcaccggtttcgcaggacgagatcgcagcggcccaagccgatcgagcccaattcgatgacagcccttcggtcagcggccgcgccgttcgggaggcgcccggacatgcggccccaccggtcagcgccgactcgccgaccgtgccctctgtgcctgtcgaagccgatcgagcggacgggccttcaccgaccagccaatccagctccacggcgtcccatgggacgtccggtcaagcgaagccgggtcggccaagccctccgcccgcggcgatcgacgccgacggcaatctcgtgttccacacggacgcccagaaggatccggttccatcggcccttccgcaagggccggatgaggcaacgccccatcatgcgatcggcctgatcggggtctcggatcaggcgcattcgatgcacaacctttatcaccagacctag

SEQ ID NO: 8613 - DNA, 120 bp, Methylobacterium sp.
atgcggcacactctctcaccgcccccggccacgccacgggatcgcgccgtccccatcacgctctgcgtgatgatcctgctggaatgcctgatcctgctggtcagtctgatctggctttga

SEQ ID NO: 8614 - DNA, 303 bp, Methylobacterium sp.
atgcacttcactcagcgcgaaaccgacaagctcttgatctacatgctcgcgcaggtggcgcagcgccgtaaggaccagggtctcaagctcaaccatcccgagaccgtctccctgatctccgtcgcggccctggaaggtgcgcgggccggcaagacggtggaggaggtgatggaactcgcggccaaggccatcacccgcgacagcgtgatggagggcgtcgcggagatgattccctacgtccaggtcgaggcggtgttcaccgacggctcccgtctcgtcaccgtccattctcccatcaagtag

SEQ ID NO: 8615 - DNA, 411 bp, Methylobacterium sp.
atgagtcctgcccagaagaaggcgcccgtcggaggcatcgtgttcggctccggcgagatcgagatcaatgccggctacccgacgacgacgctcaaggtccgcaatacgggtgaccgtccgatccaggtcgggtcgcactaccatttcttcgaggtgaacgcctcgctcgagttcgatcgcgcgcaggccttcggcaagcggctcaacatcccggccaccaccgcgctgcggttcgagccgggcgacgagaaggaggtctcgctggtgccctatcagggcaagcagcgggtgctcggcttcaacggcctcgtcgacggctgggtcggcgacgagagctacgacgattaccgcccgcgcttggccgacgcgctcgatcgcgtgaaccgctacgggttcaagaacaagccttaa

SEQ ID NO: 8616 - DNA, 384 bp, Methylobacterium sp.
atgggcgcgcaggccgtcttcgtcttcatcggtggcggcttcggcgcgatcacccgcgaattcctgatgctgctgatccctcagcagagcggcgcctttccgctcgatatcttcaccgccaacgtcgtcgcctcgtactgcctcggcgccgccttcggacttcaccgcctcggccgcgtctcggacgagttcatgctgctcgtcggcacgggcttctgcggcgggatgtcgaccttctcgagcttcgtcttcggcgtcctgtccgaggccacggcgccgggtcaggccggcctcgcggtcctctacggcctctccagcctcgccgtcggctacgtcgcggtccggctcgggatcctatccgggaaacgtctgcgccgcgcctga

SEQ ID NO: 8617 - DNA, 687 bp, Methylobacterium sp.
atgatcctcgtcgaacacaagctcggtcatctcgacgatccgctttggcaggagcgcgcgcggcacgcccggatcgatccgctggtgctggagcagtgggaggcgcccaagagccgcctgcgcaaggcgagcgagagcgggatcgagctggcggtctcgctgccgcgcgccgagcacctgcacgacggcgacgtgctccactacgacgcggcgcgcggcctcatcgtcgtcgcccggatcgccctcaaggacgtgctggtgatcgagctggaggggctggagcgcctcgcgccgcacgagatcctgcgcgcctgcttcgaactcgggcacggcctcggcaaccagcactggccggcggtgatcaagggatcgacggtctacgtgccgctctcggtcgatcagaaagtgatggcctcggtgatgcgcacccacgccttcgcgcatgtgaagacccgtttcgctccgggcgaggaggtggcggccaagctcgatgcgaaggaggtccggctgctgtttgccggcgccgacgccaccccgcaccaccatcacggcgatcacggcggggcgcatgcccacgatcagcacgaggcccatctccacccgcatgaccacccgcacggacacgatcacgggcatgcgaacggtcacgcgcacacgcatcaccaccggcccggtccggtggcgtga

SEQ ID NO: 8618 - DNA, 681 bp, Methylobacterium sp.
atggcgcatctcgcgcgcctgctgcaatggtcggattcgacgctgccggtcggcgccttcgccttctccaacgggctcgaatccgcgcttcagacaggaatcgtccgcgacgcggacagcctgctgtccttcgtcgaactcgtcctgcaccagacggcacgggtggacggcgtcgcgctgctgcacgctcatcgcgccgccctgacgggcgattatcccggcctcgtcaccgccgaccaggagttgctctgccgccgcgtcggcgaggagcagcaattgatgctgacgcggatgggcaagaagttcgccgaattggcgctcaggatcgccccgtcaccgatgctggcgcgctggctcgccgaaatccgctcggaggccacgccgggctgcctaccggtcggccaagcgatcgcgctcgccggtctcggcgcagacgagagcgaggccttcgtcgtccatcagtacggcatcgcctcgatgatcctgagcgcggcgctgcggctgatgcggatcgaccatttcgagacccagcgcatcctgttcaccgcgcaagggcgcgtcgaggacgactatcgcgccgtgcacgatctcgccctcgatgagatggcggccttcgctcctgtcttcgatgttctcgttgcccatcacaccacggtccatgtgcgcctgttcatgaactga

SEQ ID NO: 8619 - DNA, 693 bp, Methylobacterium sp.
atgaagaagatcacccgtatcggtatcggcggcccggtcggatcgggcaagaccgcggtcatcgagacgatcacgccgcgcctgatcgcgcggggcatcaagccgctgatcatcaccaacgacgtcgtcacgacggaggatgccaagcaggtgcgccgcaccctcaacggcgtgctgatcgaggagaagatcgtcggcgtcgagaccggggcctgcccgcatacggcggtgcgcgaggatccgtcgatgaacatcgccgcggtcgaggagctcgaagagaagtatcccgacagcgacgtgatcctgatcgagtccggcggcgacaacctcacgctcaccttcagcccggcgctcgccgacttctacatctacgtcatcgacgtcgcggccggcgacaagatcccgcgcaagaacggcgccggggtctgccagtcggacatcctcgtcatcaacaagcgcgacctcgccccctatgtcggcgcgagcctcgacgtcatggcgcgcgattccaagatcatgcgcggcgcgaagccgttcctcttcaccaattgcaagaccggcgagggggtcgacgacctcctccaactcatcctcgatctggccttgttcgacttggcgcccgtcgatcaggcgcccgtcgatcaggcgccagccggcggggcggcggaccgcccgctcgcggcgagcgcctga

SEQ ID NO: 8620 - DNA, 420 bp, Methylobacterium sp.
atgcacggcccggcaaccgcggcgccatacaacgccatcatgggtcttcctgattccgagcttcgtctgctgggcgtggccgcggccgtcggcggcctcctggtgatgatgctcgccggtcagccctcggccgcatcgctcggttggggctgcctggggttgcttctcttcggagtgtcgcgcctgatgccgcgtccgcgccggaaagccaggcccgccatcgtgccgagcacggtggcgacgccgctcgaaggggacgcgccggcaggcagcgcatccgaggacgcgccggccgcgcttccaggcgatcttcacgccgtgcttcagcgcaaggtgcgtgttcagcgtccgatcaatccgatcatcgcctcgtcgctcctaccgccatcccgtgcttcgcggtctccctcgacgaattga

SEQ ID NO: 8621 - DNA, 252 bp, Methylobacterium sp.
atgcagcgcgatcctgctggcgcgagcgcagaaggcttgagcatgcgcaccatcatcgagatcgacaatggcagcgccatgggtattcgcaatggcgggcaggaagtggccgaccttctcgcctgcgcactcatgaccggaagcgatgcggcctgggacaagctgagacccgacgggatcctatgcctcgtcgagcgtcacccgaccgagccggcgaaggtcgtcgggcagcgtgagatcgcggtccggtag

SEQ ID NO: 8622 - DNA, 171 bp, Methylobacterium sp.
ttgaacagcgctgtcctcagcctgtggtcggcctactgggccgcgatctttgcccaggttgcctatttgcgggtgctcgatgatggcgtgggcgtcggcgcgtttgcctggatctctcaaggtttcctcgctgtagggttcgtattctttctgttggcgaagctcccgtga

SEQ ID NO: 8623 - DNA, 396 bp, Methylobacterium sp.
atggcgatgggggttcaggctgaggcgacgatcgagagtgcgacacgggtcaagcgtcgtcgtggcggaacatattataagctcgacctcagttggaccgacgccagcggcctgaagcgaagggtcgaggaggtttcgatctctcacgcgctggccgacaagctcatcgtcgacaatcgcttggcggccgacacgctcccgatcaagtacatgccgggtgaagccggatcgccgaaggagagtgagaacgtcgtcgtcttggacgatacggcgtatcaggagaagaccgaccgggaaatcgtctatgtcggcacgggtgcgggcgctctgggcctgatcggagcagccttgttcttcctgccccgccgccgtcggcatgaggcggtcgcggcctga

SEQ ID NO: 8624 - DNA, 396 bp, Methylobacterium sp.
gtgcatgcgctgatgaaaccgatcgacatcatgtgggtgtgcctcggcggcggtgccggctcgctgctgcgctggtggctcggcggggtcatcgatcgtgcgatcccggcgcgcttcaagttcggcaccttgctcatcaacgtcacgggcgccttcgccatcgcctacctgtccgccgccttcgctctcggctggcagcagcgccacggggacatgatggcgtccctggtgctgacgggctttctcggcggctacaccacgttcagctcgatgcagctcgatacggcgcagatggcgatggagcatcgccacgcgctcgccgccctctacctcgtcgcctccgtcggcctcggcctctgtgccgcggcggcgggcgtagccctggcgcgggcgtag

SEQ ID NO: 8625 - DNA, 309 bp, Methylobacterium sp.
ttgtccgccggtctcgttcaggccgaaacctccaccgggaagagcgccgataagaatcaagaaaagttggcgagcaagccgctcgaaaaagttacctgcgaggagttcaacgggttcgaagacacgttcaaaccaaaagtcgtcgcatgggccgcaggctacaaacaggggcagaagaagcccgatgtggtggcgatcgatatcgctggggtcgagaaggtcacccccctgatcgctgaagagtgcaggaaggcgccgtccgcttcgctgtggtcgaagatcgacggagagctgaaaaaggtgttctga

SEQ ID NO: 8626 - DNA, 519 bp, Methylobacterium sp.
atgcctgtcatcgcagccgtcgtcggggccgtcatgaccgggctgatgtactacttcatctacggaaacgggatggagcagctcgaccgcttcctcggcgatcggcgcaacgccaagctgagggcgcgcagtgcagctgccttccgggcagcgccgctgcgcgcaattcgcgaccctgccgatgccgcaggcgtgctgatgatgctggtcgcgctcgcccgcggcaccccgacgccggagcaggaaacagcgatcgaggcggagatgcgcaaggtcacctctcccgatgacgatcacggcacgcgcatggcctatatccggcatgccgccgcccaggcgtcagacgctgacaccgcggtcgatcatctcgctcccctcttgcgggaaaagctcgatgacgccgaacgcgacgagttggaacagatgctagaggcggtcgccgtcatccatggcggaccgatcgaggcgcaggaaaagctcatcgcccggaccgtgcgggtgctggccgagcagcactga

SEQ ID NO: 8627 - DNA, 1560 bp, Methylobacterium sp.
atgcagcggcttcgatcgcctcggcgcctcgcaccgatcgtcctggcgctcggcatcatgtcgggttggcccggaagcgcatgcggccaagtcatcacccgggcgcaggtcgaggcgaacctgccggccctcgaagcgctggcgcagcgggccatcgctgcgggcgacgtgccgggcctcgcgatcgcagtcgtccacggcgacgagacgctcttcctgaaaggattcggccgcagggaagccggaaagcccgacccggtcggcccggatacggtgtttcagatcgcgtccctgtcgaagcccgtgacctcgaccatcgtggcagccctcgtcggtgacggcgtcgtcgattgggattcgcggatcgccgatctcgatcctgccttccggctccacgagccctatccggcctcgcaggtcaccgtgcgcgatttcctcaatcaccgcagcggcctgcctggcctggccggggacgacctcgagcagatcggatacggtcgcgacgacatccttcgccggctgcgcctcgtgcggccgtcctccagcttccgtgccggctactcctacagcaatttcggtttcaccgagggcgccgtggccaccgccgggccgaccggtcaatcctgggacgttgtggctcgggaaaggctcttcggcccgttgggcatgacatcgacgggcacgacgtacgaagccttcctgacgcgcgtcgaccgtgccgcgctccatgtccagcgcgatggcgtctggacgtcggggatccgacgcgatcccgacgcgcaggcaccggccggcggcgtcagtgcgaatgcccgcgacctcgcgcgctggatgcggctcgtgatcggcaacggcctgttcgagggccggccgctcgtcgccgccgcggccctggcgcagacgcatgggccgctcacggcacgcggcaccaaccccgtcaccggcggcgcctcgttctacggcctgggctggaatatcgagtacggccgccacggcctcgtctggggtcatgcgggcgctttcagcgtcggcgcgcagaccctcgtctcgatccatccggacgcgaagctcggcatcgtccttctgacgaacgcctttccgtcgggcgttccggaaggattggccgacagcttcgccgacctcgtcttcgacgggcggatcggcaaggactggctgagggattggggcgagacctacggaaccatgttcgggccgagcgcggcggcgaaccgcgccgcctacgcccagccgccggcgaatgcctcggcctcgctccccctgtcggcctataccgggcgctacgccaacgcctatgtcggcgacgccgtggtggcggaggtcggcggtggcctgtccttgacggtcgggcccggcggcgcgcggacctatccgttgcggcacttcgatcgcgacctcttcctctgctttccggatgcggaggcgccggacaatccctccgccatccgtttcactgtcggaagcggcggccgggcccatgcggtgacgctcgacgcgctgaacgcgaacggtctcggcaccctcgatcggtcgggcgaatga

SEQ ID NO: 8628 - DNA, 1368 bp, Methylobacterium sp.
atgaagccggcagatcaacccgctccgccctggcagcaggcacgcttcgtcgccgtcgccctgatcgtcggtgccctgacaggcgtgttcggcggcctcttccacctcgccatcgacaggatcatcgattggccggcatggctcgccggccataccgagggctggcggttgatcgcggcgagcgccgccatcaccatggcggccacggtctttgccgtgttcatcacccggcgcttcgccccggaagcaagcgggagcggggttccggagatcgagggagccatcgccggcatccggcatgtacactgggagcgcgtgctgccggtgaagttcgtcgccggcatcgcggcgatcggctcgggcctagttcttggccgcgaggggccgaccattcacatgggcggctcggcggcgctcgcggcgtccgagatgttccggatgcgagacgtcgatcggcgggctctgctcgcggccggtgcgggggcgggtctcgcctgcgccttcaatgccccgatggcggccgtgctgttcgttatcgaggaaacgcgcaagcagttcccctacagcttccggaactacatgggggtgttcgctgcggcgatcaccggaaccgcggtgacccagatgatctcgggcgcgcggccggacctgccgctctccgccgggccggcggacctggcttcgttgccggccttcgccgttctgggcatcctcctgggtgcggtgggcgtgctgttcaatcgatgcatcctggcgatgctggacatcgccgccgtatggcagaagcatgccccgtatgtctggcctgccctggtcgggctactcgtgggcaccctgctgatcctcgctccgcgcaccgcgacgggcggggaacaggtcatttcacacatcgccgttctgaccccgagtgcgggcgtgctcctgatcctggcggtcgcccggctgttcacgtcggtcgtctgttattccgtgggcacgccgggtggcattttcgcgccgatcctgtcgctggcgacctgcatcggcttagccttcggcctgttcgcccagatggtgttccccgaggtcttgtccggcatcggggtgacgcccgtttcctttgccatcgtggcgatggccgcgctcttcagcgcaaccgtgcacgcaccggccgtgggcgtggtgttggtgctcgaactcacgaccgcctatgcgctcgtcctgcccatgctgacggcctgcctagcggccagcctcgtggcccaatggctcggcggccgtccgatttatggacagatgctggagcgcgcccttgcccgggccggccgggggccgggcaacgactcggagatcggtctggcggccgccccggaccgtgcggcgaactga

SEQ ID NO: 8629 - DNA, 105 bp, Methylobacterium sp.
aaggggctgatggccgcccccgtcctcgtcgatctgcgcaatgtctacgcgcccacggaggtcgagcggcacggcttcgcctattccggcatcggaattgcctaa

SEQ ID NO: 8630 - DNA, 1173 bp, Methylobacterium sp.
atgagtcttccccattccggacccatcgacggtgagttcgcaagcctcaaccaactgcgcttctcgcccccgatcgaggcgctgttcgagaaggcagggctcccccaacgcatcgaactcggccggacgacgctcgccgtcgccatcctcctctacgacgtcttccttctggccgattgggtgatcctgccggacgtgttgtggccgctcaccgtgatgcgcctgggcatcgccacgccgctggcccttctgaccatctggaccctgccgcgcagccgatgcgtctggcaggtcgacggcctgctcgtggcgacctccgtcctctcggtgttgatgccctcgacgatcatctcgctcggcacgtcgaactatgtcgcgatctatcagttcggcgcgattctcatcatcatctacctggttctggtgcagcgcgtccggttccggctggccgtcctcggactggtgctcatcgtcctcatccaagtcgcgaccatcgcgagccggcccgaggtggatgccgcgaccttctggtacatcgtgagcttctacatcctcgcgtcggtcatcctcctcctgggatcgttcgtgctggagcggacggagcgctacggcttcctccagcggctccgggccgattcgatgatcgagcacaacgaggcgatggcccggacggatcaactgacgggcctgttcaaccggcatcatctcgcgacgatcggcgccgatctcatccccaagagcgacgccgagcctctcggggcactcctgatcgacatcgaccacttcaagcggttcaacgacacccaggggcatctggcgggcgaccgctgcatccgtgccatcagcgatctggcgcgcgagatgctggctcccgccaacgagaacacgcccccgctgggaacggccgtgcgcttcggcggcgaggagatcctcgtgctgctcccgggcatgtcggccgcgcaggccgccgcgctcggggacgccatccgccgtcgcgtagagggggtgcgcattccccatcccggtctcgggcccgcgggcgtggtgacactgtcgatcggggtcgccgactggaagaacggcgacacggaactggatgcgctcgtgaacgccgccgacgccgccctctatcgagcgaaagacctcggccgcaatcgcgtcatggtggcctga

SEQ ID NO: 8631 - DNA, 1002 bp, Methylobacterium sp.
atgccgaagacgagcggttccttgcaggttgcaggaacggatgccgcggtcgctcgcgagggacgtttcgttccgagtccgccggccccgtcgcagttccagcgcttcctccccgagatcgcgcaccggacgagcggcgagatcctgatccatcccgacttccaccggatgcgacggcgctacatcgcctccacgatggcgtgctacgaaatcgcgaccttccccggcggatggcagagcgcggcctaccgggtcgccatcatcagcgcgatcatctgcctccatgcggcctgggacccggcggaccgggcgacgtggccgacgctcgcgcggctcaaggaggccggcgcctccttcgggctgtcgagtccgcggcagatcgacgatctcatcgcccggctcgtcgagaccggtcacgtcgtccttgagcgccccgccgccgacggccggctgcgcctgctcgtgccgacggacaaacttctcgcttgggatcgggtcctgctgtccgcctattacggcgtgctgcaggagctctatccggatcccggatacggtcccgccgtgacccgcgacccggccttccatcgggcgcatcgccgggtcgcggtcggcatgttcgacgtcatcggccggttcatcgcgcagaacggcgacatcgtcccgtttctccagatgtatcagggcttccaggtcctggtgcgggtgatcctgctgcgggaagaggatgcgcaagccgccatccgcgagagcgacttttccgacatcatcgcgcggttcggggtgtcccggtcgcatgtccgtaacatcctgacggcggccgaggccggtggcctcctcacctcggcgggccgcggcttgaaggatctcgctccgacggcccgcggcctggcggccgtggaccgcttcatcgcggataccctcgcctcccacgacatgacctaccgcatggcgctggcaagcctggcggcggaaccggcccgatcggcgggaaccgcctcctga

SEQ ID NO: 8632 - DNA, 453 bp, Methylobacterium sp.
atgaatcacgccctggttcgtgtttccgatggcgtcgactggcaagtctatcatgccatccgccgctcctcgctgtggcaagaaagggggctcaccggctacgatgatgcgcgccccgaagagcggcttccgaaccaccactcgctgctcttaaagctggacggcgaggacattggcacgacccggctggacgacctcggagaccagaccggcatcgtgaggctggtcgctgtcacggctcgacaacgcggccgggggcatggtcgcgtgctcagtgcaatggtcgaggactacgcaaggaagctcggtctgcacacgttgttcgtgagcgcagttctcgatgctgaggggttctactcagccacaggatgggcgcgggtagcgagcggcgctccgccgctgctggggcatgcggacagctttgcgcagatgaggaagcgcatcgtcccttga

SEQ ID NO: 8633 - DNA, 141 bp, Methylobacterium sp.
gtggacagcggcacgatgaccggcttcctcgtcgcgggcgccatcggcttcgggctcggctggttggtgttcgggcagcactcctactcaggcgattacgtcgcgaggggcatgagccgcagtagcgcgcgcgattattag

SEQ ID NO: 8634 - DNA, 159 bp, Methylobacterium sp.
gtgaccgcacagaacgatcggccgcaatccgagacggagccgaagccggttggcgatccgccccctgccttccagccgccggccggggatcccccggcgccgcggccggatgcgatccccgaggaggatctcgaagaggtcgaggaacagccgagctga

SEQ ID NO: 8635 - DNA, 627 bp, Methylobacterium sp.
gtgaaggtcgagacggccacggatgcggagggccgacagatcacctgtacccgctatcccgatctcgtcgtccgcgagagcgacaccgacacccccgagcccggggatgcggcgctgattccgatccgtggcggtccgcccgtagactgtcgcgccgctcccggcatcaacgcgcgcaggctggaaaccggcgcccagcgcttcatcgggcgggcggacgggttcctcgtgttcgaggatgcgagcaccaacggcacgatgcccttcgcggtgatcgatgccgggaccggccgcaggctgttcaccgacacgacgacctacgacggcatcgaccgcttcgcggccgagggtccgacgctgcggctcggcttccgccgcggtgtgcagggcgcctgctcgatcccgaaaggcggtgcagcctgctgggcgcggatcgtgcgcgaggaaaagatcccggcccccgtcgcgaccctgccggtgccggccaaggcctgcgccgaggcctaccgggccgggaaggcccccagggataccccgagcatcgtctccttcccggtgcggctcgtctggagcggcagcctcaccgtcgaggccgacggtccggtgcgatgcctgccgacgccgtga

SEQ ID NO: 8636 - DNA, 1968 bp, Methylobacterium sp.
atggctggggcccatccaggcgaagaaggccgcgatttcaccgtcgaggcggatgcatcggcagcctattggcaccaccggcccgacaacacgcttccgcccccggacatgatgggcgcctacatgcgaaaccgtcccgtgccggaccaacgggtggaggagctcagggcatggatcatcggcagcggcatcgcaggcctcgccgccgccttctacatgatccgcgacggcggcatgaagggcgaggacatcaccatcctcgacgccttgagcgtcgagggcggctccctcgacggcgccggcaatccgcaggagggctacatcatccgcggcggccgcgagatgaactggaattacgacaacctctgggacatgttccaagatattcaggcgctcgaactgcccgagggctacagcgtcctcgacgagtaccggctcgtcaacgaccgcgaccccaattactccaaggcgcggctcatgcaccagcaggggcagatccgcgacttctcgagatttggcctcacgaaatcccagcaatgggagctgatccggctgctactcaagcgcaaggaagatctcgacgacattacgattgagcaatatttcagcccaggatttctcgagaccaatttctggttcctctggcgctccatgttcgcgttcgagaactggcagagcctcctcgaaatgaagctctacatgcaccgcttcctcgatgcgatcgacggattgacggacatgtcggcgctcgtcttcccgaaatacaatcagtacgacagtttcgtccgcccgctggtgaaccaccttcaggcccgcggcgtgaaggtgcggttcggcgcgcgggccaccgatctcgcgatgcgcgtcgagggcgagacgcggacggtcacgggcatccacatccgggcggacggcaaggacgaggtcatcccggtcgcggccggggacgtggtcttcgccctgacgggctcgatgaccgagggcacggcctacggcgacatggaccatgcgccggtcctcgaacgcggacggcacgatccgggtgaggacagcgattggacgctgtggaggaatttggccgagacgtcgccgatcttcggtaaacccgtaaaattctacggcgataccgagaaatcgatgtgggaatcggtgacgctgacctgcgaaccgtcgcccctcgtcgagcgcttgaaggagctggcggtcaacgatccctattcgggcaagaccgtgacgggcgggatcatcaccttcacggactcgaactgggtcctgagcgtcacctgcaaccgtcagccgcatttccccgaacagcctaaggatgtgctggtcctctgggcctacgcgttgctgatggacaaggacgggaaccatgtccgcaagccgatgccggcctgtaccggccgggagatcctgaacgaactctgcttccatctcgggattgccgatcagagcgaggcggttgcggccaagacgaaagtgcgcctcgcgctcatgccgtacatcacggcgatgttcatgccccgcgccgcgggcgaccggccgcatgtggtgccgaagggctgcacgaatctgggcctgatgggccagttcgtcgaaaccgcaaacgacatcatcttcacgatggacagctcgatccgaaccgcccgcattgctgtctatacgctgctcgacctgaagaagcaggtgccggatatcagcccggtccagtacgacatccgcaacctcctcaaggccgcgcgcgcactcaacaacaacgagcccttccccggcgaacgcctgctgcatcgcttgctcgggcgaacctactacgcgcatatcctgccgcccctgccggacctcgaagggccgcaccgcggatcagctcagctcgaaatgaagcatctgctcagcatgcggcgtcaggccctgaacgccatcagcacatccttcgagcagatccgagggcacctccgacctcccagatag

SEQ ID NO: 8637 - DNA, 294 bp, Methylobacterium sp.
atgccgatcaaaaccatcgctctggccgccgcgctgaccttcgccatggccggcggggccttcgcccagtcgagcaccggcaagggcgggaccggcggtaccacggacagcgcgagcccgatgcggaacaacaccggcgacagcatgcggcccaccaccggcacgggcgccggctcgaccggcaccatggctcccggtgccacgacgggctcgaccaccggcaaggcacccggcggcaccatgggtggcggcgcgggcagtgccgggggcggcaacagcgccgccggccgctga

SEQ ID NO: 8638 - DNA, 2088 bp, Methylobacterium sp.
atgaaggacgggctgagtttgcttccaaccgggaccggcagctccgccgagcagccgagcgcccgcactgagcccaatccggttcgggcgaagattctgatcgtcgatgatgatcggcgcaatctcctcgccgcctccgaggtcctcgccgatccggcgatcgacctcgttcttgcgaactcgccggaagaagccctgcggcaggcgctccggatggacttcgccctgatcctgctcgacgtgcagatgccgcgcatggacggctacgaggtcgcctccctgatccgcagccgttcgcgcacgtcccgtgttccgatcctgttcctcacggcccacaacaaggaggacatccacatcttccgcggatactccgccggagcggtggactacgtgttcaaacccatccagccgctcgtcctcaaatcgaaggtcgatgtcttcgtcgacctgtacctgaagacagcggagatccagcgcaaggcggcggccgagaagcagctgctcctggaaaacctgcgcgtacgtggcgagaagcttgccgccgagcaggctctgcgcaggcgtgaggaacatcaggccgctgtcctgcgcggcctccccattgcgctctacacctcgccactcagtggagacgatcgacggcttcacttcacgaatgacagcatcgagcgcatcaccggcttctcgcgcgaggcctttgccgcctcaaacctctggggggagcagcttgaaccggatgacaggtacaggatctctgcagatttgagcacgatctcggaagctggcgcggtaactctcgaatatcgctggcgtaacgcagacggcagggagcggcatatcctcgatcagatcgtgatcaactgtcatgagaacggtacgccggtcgaactgtttgggatgtggttcgacgtgacagagcgcaaggagcttgaactcagcttgcagcatgcctcaaagcttgaagcagttggccgtctgacaggcggtattgcgcacgacttcaacaacatgctgagcatcgtgatcggcaaccttgacttggtgaagagctcgttgctgggcaacgagaaggcgcttcgccgcgtcgatagcgctatcgagggagcccaccgctgcgcagaacttaccagccgtctgctggccttctcccggcgctctcctctccagccgaaagcgctggatttcacaagcttcatacctggcctgatcaagctcttagaacgcactcttggagagcggattgcgatctccgcggacctggaggatggactgccggaagtctgcgttgatcacgctcagttcgaggccgctctcatcaacctcgctgtgaatgcgcgggacgcgatgccggacggggggggcttgggtattcgcatcaagcgtcatgaggccgtcgcgcaggagggctccgagccgttgcactcagttgagatcgcggtcaccgactcgggcacagggatgtctccagccgtcctcgcccgcgtattcgagcccttcttcacgacgaaggaggccggtaaaggtaccgggctcggtctgagcatggtctacggcttcgtacagcagagcggcggaaccatcgccgttgacagcaatctggaccaaggcacccggttcgttatcacgttgcccgtgcttgctgggcggagttttccgtcggaggaaatcgatccaggggatgcccctggaccgctgaactcggtaaatggtgcagggggagccgtgctcgtcgtcgaggacgacgccgatgttcgctttacagttgtctcgactttcgaagctcttggattcaaggttttcagcgcgcaggacgtcgacgaagctctcagcctcctgcaaacagagtcgaacattgtcctcgtttttagcgacgtgaatatgcctggcgcgatgaacggcatcgagcttgggcacatcatccgtcagcaatggccagacatgccaatattgctgtcgtctggctaccttcgagaagatcaggacacgaacggcttctcattgctgcagaaaccgtaccgctcaactgagttggtccaagccctgcgtggcttgctcagcaatgcacaggggacaatgccactcgaataa

SEQ ID NO: 8639 - DNA, 501 bp, Methylobacterium sp.
atggaagacaacacatcgcccgacctgctgatgatgacggcagatatcgtcgccgcctacgtcagcaaaaacgccgtccgggcaagcgagctgccgaacctgctcgtgcaggtacatggtgcatttgtgagcctgtcgacgacacctccggtcgaacccggaagtgagatcgaaaagccgacagccacgcaggtcaagaaatcgatcacgccggacgcgctaatctcgttcgtcgatggcaagccgtaccgcaccctgaagcggcatctcagcgtgcacggcctcacgatcgaaggatatcgcgctcgctacggactgccgagcgactacccctcagttgccgcaaactactctgcaactcgctcagcgctggccaagcaactcggcctgggcagtcagcgcaagaaggcggagccggcacctgagccggtccccgaaccgacgccggcctctaagccgaagcgcgctggccgcacccgcaaggtcgccgaaccagcttaa

SEQ ID NO: 8640 - DNA, 249 bp, Methylobacterium sp.
atggcatgggacatacgaaccacgacccgctcgggcgatgcccggctcgaaacggttgcccttctcctcgcggccgtgacggcactggtcgccatcgcccgctcggatgcggtctcgcgcagcgtcgacccgccggcagcgacgctccggccggccaccgctgctgcgcccgttcccacggcgccgacggaggccgaggcggaggccgcccggcaggccagcttgcgggacatgctgctccacgattga

SEQ ID NO: 8641 - DNA, 432 bp, Methylobacterium sp.
atgaccatcgccgagaagatcgagcagagactgaccggccggccaaactcgttcgtgccggcccataccctgcaacggctgctcggccgctcgcagcccgatcgggacgatattatgatgaactgggccatgcactggggccagggcattgccctcggcccgcttcgagcaattatggccgagcacggcatgcgaggttcggtcgcctccttcctgttcctgaacgcacggctgttcaacgatcaggccctggagaatgtcacgggagccggcgccccaccgtggacctggccgctcgacgagcaacgcgtcgatcttctgcataaggcggtctacgccttcgtgaccggctacgtggctgaccggctcgcaacgggcgaggttcgaagcagggagcacgatcgcgccttctacaacggaggcgactcttga

SEQ ID NO: 8642 - DNA, 180 bp, Methylobacterium sp.
atggacctgcagaccacgatcagggacgccatcctgactgaacttcagcgtcaagcggaggcgaccgatgccgcaccgaaggtcagcctcgcggaggacggctttgtcgacatccaagggcggatcgatatcgacgcgttgattatggtgatcacgggctctctcgccggagggccgtaa

SEQ ID NO: 8643 - DNA, 498 bp, Methylobacterium sp.
gtgattgccctcggaccgttccgcgtcccgggcctcctcgggacaatcctgctggcggccggcgcgataccgggccttcctaccgcatgggcgacggaccagggcacgacgaaggagaaggggtcgtgccggctgacgctggacgttcccgacgggttcgctgcgcagccgcgcgggaagggtgtcgttctgcggcccatagggcaggcgagccggcgcgccgtcttcgagatcagtttgacgccgaaatccggcggcgatccggcctccctgtccgaaatccgcacgctcggcgggacctacgtccgctaccgtgtgacgcgtctaacggaagggtcgggcggcgaggaatcgacgctcgttgccgaaaagccgggggcgggtggcgtcatccgtctcgaagcctggacacagcgggacgacggcgccgagccggatttcgaaccggcctggcgggccctctcggcagcgcgctgcgcaagggccgaccctcgttga

SEQ ID NO: 8644 - DNA, 297 bp, Methylobacterium sp.
atgtggcgacagggcgacatcttcatccgcgcgattccggcggttccgcaagaggctgtggcccggcctctgccgcacaccgtgctcgctcacggcgagctgaccggccatagccaccgcgtcgtcgatcccgccgccctgttcgccggggacggctgcttctacctggacgtgcgagtcgatcaggcccgcgtcgtccacgacgagcacggcaccatcaccctcgaccgcggcgtctaccgggtctggcggcagcgcgaatacacgccgcagcgcatcgtgacggtgcaggactga

SEQ ID NO: 8645 - DNA, 558 bp, Methylobacterium sp.
atgtgtgccatgaagggcgtggtatttacagaattgttccgtcatgtcgaggctcagcatggggccgacatggtggatgatatcatcgatgccgctcaattgcctcactgcggcgcgtacacgagtgttggtagctatcctttccaggaggccgtcgcgctcctcgtcgcgctcaataaggcaactggcaagccattgcccgaaatcttggacgggttcggcatgcattgcttcaatcgatgggtgagttacgccccacactacttcactcgacagcgcgggcttttcgacatcctggaggggatcgacaatttccacgaaacggaggtgcgcaagctctatcctgatgcggaattaccgtcatttctgtctgagagtcgctctgaccgtcagctcgtgctgggctactacagctgcaagccgctgtctgcattagccgtcggggtgatcaaaggcgcggctgcccacgttgggcagcccgttcatatggcgtgcgaacctgccgtgggtgagcgcggagcctacacccggatcacactcactttgctggacgcttga

SEQ ID NO: 8646 - DNA, 2574 bp, Methylobacterium sp.
atgtcgtcgaagaccgcagcgccctcggccgcgaagccggttcctcgcagggcatgcagggcgcgatgcaagcgcgccggcacttcgccgtggccgctgccggctcccgccgatccgtccggcggcgatcgctccgaaccgcgccggcaaaggccggcacgccgcttcttcgccgctttcctcatcggaagcgcgttcgcggcgtcggacgccgttcgggccgagcaagcgccgagtccggcgccctcctcgtcggcttcctcatccacaccctcatccgagaaggcttcgggcgatcccgtcgggccgggcgaggcctgcgaccgcgccatcgctctcccgaaggagatcgaggccgtaacccccgaccgatcaatcctcgacggcgtgaccgagggacggaatgccgccctggaggccgccgcgaccgtctgcgccgccgcggagccggcggaggcgggcgcctcctaccggctcggcctcgccttcaaggcgctgaaacgcaaggacgcggcgctcgccgccttcacgcgggcgaaggaacgcaactatcccggcggctacgacgcgatcgcggaggggcgcttcgacgggctctacgggcccgccctgccgaaagatccttccgccggcctcgccgtgctgagcgagggcgtcgcgcggaccggtcatcccgagctcaagcgctatctggcccggaacctcgcgagcgccgagtcgccactgcgcgacagcgccagggcgctcaccctcttggaggaagccgcccgcgcggggcacgcccccgccaaggcggattgggcgcggcggatcgcggaggccgcggacgggcagcccgccccggacgaggcacgcatccgctccctcctggaggaggccgtggcaagcggaagccggtacgccgccttcgtctacgggcaattgcacgacagggggatcgggctgaagcgggacctcgcggcagcccggcgcttctacctcctggccgcggagcgggactcgatcgcggccatgctggaacttgccggaatgatgcgggacggcgagggccgccccgtggacatcgccggccagcggcgctggctcctgcgggcgagcggcctcggcaacgccacggcgacgttcgcccttgccaattcccacatcgacaacgcgccgaccaacgtgacgctcggtctcgtgctcctcgaacggatggccgagggcggctcgatcgaggccgcgcacgggctcggcgtccgctatcaggatgccgggggcgtggtgcgcgactacgccctggcgatgaagtggttccgccgagcggcggaggccggcgacggccgggcgatgaaccagatcggcacgatctacgattacggccagggcgtgccggtcgatcacgcggaggcgcggcgctggtacgaccgggcggcggcgcagggggtggcggcggcctacaccgccatcgggatgcagtacgaccacgcccgcggcgtgccgcgcgacctcgccgaggccctggcctggtaccgcaagggcgccgagcgcggctcggccgcctccatgaacaacatcggctacgcctacatggcgggccggggggtgacgcgagccgacgggcaggccgtccgctggctcgaacaggcagtcgcgaagaacgaccggaccgccaagctcaacctcgccaacctccatttcaagggccgcggcgtgaagaaggatccgatccgcggcctcaccctgctgcaggaggcggccgagcaggggctgccccaggcgctcaacgacctcgccctgatggagatggagcggccgcagcccaacggggcgcgggcggtgcggatgctgcggcaggccgccgtggacggggcggccgtcgcctaccacaatctcggcatggccctgatccagggttgggacggtgtccccgacgacgcggaggcgaattactggttccggcagtcaatcgacaaccgctcggacatcgacgccgcagcctattcggaatcgcagttccagctcggccgaaaccttgtggccggccgcggcatcgcccgcgacgtcgagggcggcctggcgctgatccgggcctcggccgcagcgcgcaatcctcgggcgatgagcttcctcaggaccgccggacaggcgcgggcggcgaaatccaagggcggaagcagtgcgtccgtgcggaaggccggggcggccaaagaaggcgcctgccgcgcgaagggcgcagcgttaaggcatcctcccgaacggttgtggccgccgtctcctaccaggggcgcggcgccccgaagagcttgcgctggaggaagcgaccggcggcctcaacccgcggctgatgcagatggcgcagccgccagagacggtgctcccgtggcgagaccggccgcgccagttccggcaccgcgccggcccgcgctcgcagccgcagggcctcggccggcgcgacgccctccagataggcgagggcgtggcgcatctcgtcgagggtcggcccaacccagttctgcgtccggaagcacggctcggcttccgcgtgcggccccgtcgcggaggcagccggggcggggcggggatagtggttga

SEQ ID NO: 8647 - DNA, 231 bp, Methylobacterium sp.
atggtctggatcgacgagggcgcgaagctgaaacaggtgtccgagtgggccgggcacgagtcgcctgagttcacgcagcgcgtctatggccacctcttcgatgccggccggacagaccgtcgggcggctacagcgggagagctatctgtgctcggcgtgccggagactgcaacacaagcgcaacacggcaatgacaacacgcagattatcatagcggcatcagagatttag

SEQ ID NO: 8648 - DNA, 924 bp, Methylobacterium sp.
atgcgggctgaaaatctctcgatccggcgtctcgtcgtcggtggtctcgtctgcgcgactctcggcttgagcgggtgcgttgccatcggcgagcgtgaaccgctcaacgaggcgccgaccgtgaccgagacatcaccgacgggcctgaatctcgagctgctaccaccgccggcgaaggcggtggacctcgccgtctacagcttccccgatctcaccggtcaaaacaaaccgagcgacaacttcgccgagttctcgcgggccgtgacgcagggcggtgcagccttcctcgtggatgccctgcgtcgcacgggcggtggccgctggttccgggtggtcgagcggggcagcctcgccaacatcctgcaggagcgacagctcatccgcgcaacgcgccaggaattcgatcaggatcaggccacgcccctgccgccgatccgcttcgccggcctgctggtcgaaggcggcatcctcgcctacgacgccaacttcgtgaccggaggcatcggcgcccgctatctcggcatcggcggcgacatccgctaccggcgcgacgtcgtgacggtcggcatgcgcatcgtgtccgtgcagtcgggtgaggtgctcaccagcgtcacgacgacgaaaacgatctactcgatcggtctcgccacgaatacgttccgctacgtcgcggtgaacaagctgttcgagttcgatgcgggcgtgacgcgcaacgagccgacccagttcgccgtgcgcgagtcgatcgaactggcggtttactcgacgctcatggaaggggctcgcaagggcctctggaagttccgcgatccggcgatcgggcagcgcctgctccaggaatatatcgagcgggacaagccgctcccgccggtgagtccgaccaccgaggtggttcaggaagccgtcgtggtcgcgaagaactga

SEQ ID NO: 8649 - DNA, 1107 bp, Methylobacterium sp.
atggcgagcctgatgctgcctgccctcgaacaggcgttgggcgcgctcgtcatgggcctcgtcctcgccgacattttcctgacagtcctctacgcgcggatcgggacggggctgatcgcggacagggttgcccatctcacctgggcaatattccgacgtgccgccgatcagttcgggcagaggcgggacgccgtgctctccttctgcggcccggtcatcctcatcgtctacgtcctgctctgggcaatggggctgaccctcggagcaggcctgatcatccaccccgcgcttgggaccgccgttcgagcgagcaccggggagacgccggccgacttcatgaccgccctctatgccggcggtagcagcatggcgatcgtcggagccagcgacttcaagccggtcacgaacgcctatcgcgtcctctatctcgtcaactcgctcgtcgggatttcggcgacgtcgttggttcttacctacgtcatgcaggtctacagcgcgcttcggcagcgcaacgcgctcggattgaagctacatctattggcgggtgaaacgtcggatgccgccgaactcctggcgcggctcgggccacaggggcagttcagctcaggttacagccacttagctgacgccgcagcgtccatggccgagatgaaggaggcgcaccacttctatcccgtgctgttctacttccgcttccggcagcccttctactcggtctcggcacaggcatttatcgccctcgacaccgtgtcactgatccgcagcgggatcgcagaccggcaggcggcatggctgaaggaaaccgccgctgtcgatgcgatctggcgcgttgccatactgctcgtcgtcacgctcgaaacgacgtttctgcccggagacctgcccgccccagccgacgtgaacaacgctgagagcgagtcatggcgcgcccgcttcgcagaggctcttaggcgcctttcggcagctggcgtggagacgatgcctgatggagcaggggtggagacttacctcaccttgaaggcacaatggcagccgcatatcgcacgactggcacccgccatggcttacgacatcgacgaatttgaacccggcgaccagaagcgctga

SEQ ID NO: 8650 - DNA, 1347 bp, Methylobacterium sp.
atgaccgccacgagtcgtcccgccaccggccttcctgtcgcgaatccggcggtcgccgggctgcgcgccgcttcgatcctgagcgggttttccggccagcggtggcgcctcgccttcgtcgtcttcgcggtgatgatgtgcgtgaacgcgttctacgtggtcttcctcggcagcaacaacgaggttggcaacacgaagacgctgatgccgtcgaaccgaaacaacctgctctatgtcggcctctggctcactctctacgccctatccgtctgcgtgatcctgcgcgatgtgctgcgcaacgggatcgacctctgcctgatcgccgttctaccgctcgccggatacatcctgctctctacctgctgggcgaccgatagctgggcctcgctggttcccgcggggatgctcgtcctgaacatcgccatcgccgcggccctggcctccatcgtccatccggcggtgttcctgagcctgtttgcctggaccaacgtcttcctggtggcgtcctccctggtgatggtggtggtgatgcccgatgcggtgcgcaccgacatcacccggccgggcctgctgatgtcgggcgagctgttcggcgcctacggcagcaagaccctgcacggcatgtccgccgcgagcgcgatgctgatcctgctgttcctgcccggcgcaagcccgcggggattgcgggtcccggcgctgggcatcctcgcgctcgggctgatcctggccaactcggcgtcctccgtcagcgccatcgcggtggcgggcgtgacgctgctcgccgctcggctgctccccggctgcggccgagtcatcttcgcgacggtaaccgggttcgcgatcctgctctcgctgatcttgcccttcatcggggtcggcgacatcgccgtcgcactcggccgcagccccgacttcaccggtcgcagcaaattctggccctacgccctcgaagtcttccgcgaccggccgctgttcggccacggctatctgagcttcttcaacaccgatccgttctcgaaggcttggaccgtgtgggagcgcgagatgtatttcttcacgcccgacttccacaacaccttcctcgacaccctggtcggcctcggtctcgtcggaggcgcgttctatctcgtcctgctcttttcctcgtcctgcatcttcgcccatccgagtctggagcgcagcacggccttcctgctctcggcccttctgatcaccttcatcctcaacagcgcgaccaactacattttcctggcgcacaaccggatgtcgacgatcttccagttctactgtctgttcgttctctgccgccggtataaaccccgccggccgcagcctgccctcgcctga

SEQ ID NO: 8651 - DNA, 444 bp, Methylobacterium sp.
atgaagacgcgtttcctggcggcgggtgttctactggccctctcggccggtccggtcctggccggcaatctcatctaccagccggtgaaccccgctttcggcggaagtccactcaacggcggctggctgcagagcgaagcgaccgctcagaatattccgcaggcccgtgagcagcgtctcaatcagctgttcggcacccagggcggccggaacggtctcaatttgacgcagggacagctctttgctcagcagttgcagtcacagctgttcagctcgctcgccaaccagatcacgcgagctatcttcggcgagaacgctcagcagaacggcacgttcgagttccagggtacgacgatcaacttcgctcgcgaaggcgcgaacgtccgtatccagatcttcgatggccaaacgaccagcaccgtggtggtgcctgccggtccctga

SEQ ID NO: 8652 - DNA, 1068 bp, Methylobacterium sp.
atgttcgatacgcccgccgacgcccaggcccagctcgcgcaacagttgacgcgtccgcaggtcgcgatggtcgtcgaggcgctggtgccgacgctggtgttccggcctcaaccgaaggggaaggccaacctcggcggaacgcggatcggcgggacgcccgacctcccgccgggcctcgcatggccgcgccgggccaagcccgccgatatcgaagcgatcgccaagcgcggcaacgcggaggccggggaggagatgcggcggcatttccgcaaggagctgccctacgcgttcttcgcgcaggtcgatctcggggaggcgaaagagaagatgaaagggcagggcgctctcgccgacgctctgccggggcatgggcggctcctgttcttctacgatctctctgccggcccgtgggacaacggcaccgaatccgcccgcgtgatttgggacgagagcccgcgcgaggggctggccgctcacgtcccgccgcccgacctcgcggcggcggccgaggaccaccgggcggagatcgccaaggtcaaccgggagttcaagctgcccctgccgaagcccgattccggcacaccctatggcggcccggcccggccgatgagcctgcacgctatcctccgccccccggcgatcgagagcctggagatggagacgcggccggccctgaaggcggcgctggcgctgcgcagcgatggcgaggagagctttcgcgacgcctacgaagacctcttctcgagggcgttcgacacttatcacggcgccgccaatgcaggccgacgcaaccagctcctcggctcgccgctgccggagcagagcgatccccgcttcgaggcggaggtcgtcagccgtttcggcgtgcagcatctcagccaggaccagtggaaggcgcatcggcccgagatcgaggccggcgcccgctcctggcgtctcctgctccagatcgatgtcggcgacttcctgcaggaaaacggggagggcacggtgtacttcttgatccgcgcctccgatctctctgagcgccgtttcgagcgggtggtggcggtctatcagcagacctga

SEQ ID NO: 8653 - DNA, 2433 bp, Methylobacterium sp.
atgaccaccatgaggctgaccggttacgccgacaaatttggcgtgcatcccggcgatacaattcagttttacgtcaattgcgatggtccgtccgagtacaaggtcgagatcgtccaaatgatcaacggcgacaccaatccgcgcgggcccggctacatcgacaagccggtcgaggcggcggtcaacggcacctatgccggcaagaagcagatcatccacggcggctcctacggctacgtgccggacgcgaagcccttccacgtcgagagcttcacgctccagtgctggatctggccgaccgcgccgaaaacgcatccgcgctactggaagcacgggccgcagggactcgtcaccaagtggtcgaacgagtgcggctacggtctcttcatcagcgaggagggctgcctcgaactgcgcatcaacgagcaccggatcaccaccggcgtaccgatccgcgaccatgcctggcatttctgcgccgcgaccttcgacgccgccaccggcctcgtcacgctgatccacgagccgcaggtcgtctacgccctcgatcccgagatcgccccggtcgaggcgcgcctgaaggtcgccatcgcccacgcccccgttcccctcgcgctcggcgcctatgtcgagcggctggcaccggaggatccgctcgccgcctcctcgaagccgaccggcgtgatctttgccggcaaatataacggcaagctcgacagcccgcgcctctgcaaccgggcgctctcgcgcgccgagatcgagatgatgaaggccggtgcccagcccggcttgaccgagcggcgcaatgccggccccaccggcaagctctccgagtgcatcgtcgccgcctggaatttttccgtcggcatcgacacgctcacgtgcaaggacgaggggccctaccgcttcgacgcgaccttggtgaactgtcccaaccgcggcatgaccggctacaactggtcgggccagaacttcgactggaagcatgcgccgcaggaatacggcgccatcagcttccacgacgacgacgtggacgacgcccgctggtcttgcgacttcgcctggaccgtgccggagaccggcgtgaagagccgcttctacgccgccaagctgaccacgcctgagggcgacgaggagttcatcccgttctgggtggtgccgcgcatcggtcaggagaccgccaagatcgcggtgatggtgccgaccatcagctacatggcctatgccaacgagcacgtggcctgcaacgcgggcggcgcggagctgttcgtctaccgcgtgccgatcatgcagcagcagaacatgttcctgtccgagcaccgcgaatacggcggctcgatctacgacacccacaccgacggcaccggcatctcgatctcgtcgcgcctgcggccgatcctgtcgatccggccgaaatacgaccacttcctcgcccaggcgccgtggcaataccccgccgacctccacctgatctactggctggagacgatgggttacgagtacgacgtcttcaccgacgaggatatcacctacgacgggctcgccagaatcgagaactacaacgtcatcatcaccggctcgcacccggagcacaattccggtacccagctcgacgcgctccacaactacacccagcgcggcggccggctgatgtatatgggcgctgacgcgtggtactgggtccactcgttccaccctgcctacgaggacaagggccgcggcgtcgtcaccgagatgcgccgctgcgaatccggcatccgcacgtggcgggccgatccgggcgagtactaccaccagggcacgggcgagctcggcggcatgtggcgcttccgcgggcgctacctccactcggtggccggcgtcggcatgtcgtcggaaggtttcgacgtgtcgagctacttctcccgcacgccggacagcctggaccagcgcgtcgcctgggccttcgagggcatcgactacgacgagaagctcggcaatttcggtctcgtcggcggcggcgcggcgggtctcgaactcgacatcgtcgacacgatgctgggctcgcccccgcacaccctgacagtggcgacctcggccgggcggcacacggaggcctatctcctcgtgatggaggattttggcttcaaccagcaggggctcgacggcaccacccatccgcgggtgcgcggcgacatcgcctatcacgagaccccgaacggcggcgcctgcttcgccttctcctccatcgcctattgcggctcgctgccgtggaacaactgcgacaacaacatctcgcggctgaccaagaacgtgctcgaccgcttcgcgatggacgggcccctgccggccccgccggacagcgcgatcaagcatcgaggccgggccgattatgacccaaccccgatggagcaccgcagccgcaaggagcgcggcgagccgctgcccgcctga

SEQ ID NO: 8654 - DNA, 327 bp, Methylobacterium sp.
atgaccgcctacagcgtgcagcagatcaagttcgagttcatcagctacgtgaaggagttcggcgccgatttctccgcgtggtcggtgggcgtggccgaggacgcgcccgctgcgctgtttcatgagcacggggtcgatgaggcccgcgacatctggctgtggaagccggcggtctcgcccgccgccgcggcgatggtgcgcgactggatctgcgggcgccagggcgccaccgcgctggtgggggaagggcgccaggtgtttctgttccggcgcgggtcggtggcggcatccggagtcgaggggacggccggaacccggttcgcgtga

SEQ ID NO: 8655 - DNA, 987 bp, Methylobacterium sp.
atgcgcgtcgttgcggtgagtcgggtgctcgatgaggtcgatattatcgaggcctttatccggcatgccgccgccttcgtcgatcaccacatcattctcgacaatggcagccgcgacgggaccgtcgagatcatcaggcgtctcgccgaggagggcttctccctgacgctctatcaaacgccgtcgatctgcttctccgagcgcgacatgaacaactggctctataacgaggcggttgatcggcacgacgcggattgggtggcctgtctcgacagcgacgagttctacgacgagcgccacctgccgggaggtttgcgcgcctatctccaggatctggagatcgcgggtgagaacgtcgtcgccgtccggataccctgggcgcattacaattataggacccgcgacgacgccaccgagagtctagttccgcgccgcatcacccaccgcacggaggtcgtcgccgaaggcaaggtgatcgcgagctggcgacttgcgaaggagaagggcttggtgctggaggggcagcacgacgtgtccctcccggagggcagccgcagcacggtcgtcaccgagcagcggcttcggatcgcgcatttctcggtacgaaacgccgcgcaatacgtcacgaaggtcgtgcgaggatgggcgaagatcctgacggccggtcaggcgtgcgtgaatcgcggcttttcggaccattaccgcggaccgttcgagcttcttagggaccatcccgagaaactgctgaggtccgaatggatcctcgagaaggagaacgaagaccgctgcattatccatgacccgatcgagtatcgcggcggaccccttcgctacacgcccccgaacgatcccgagatgcagtcggttcgggcgctcctcggttttctgtcggaggtctgtacccgctatggcgaattgaccgacgccctgcccgtagcgagggcctattccgagcggatcgagcggcggatcgataggctcatctga

SEQ ID NO: 8656 - DNA, 786 bp, Methylobacterium sp.
atggtcaaccccgacagggccgagcagaccggccgcacggcacggcaagccccagaactgctctgctatcccgaatatgagggcgcgccggagatcattgccggccgctcggcgcgcgactggatggacgcgacggcgcagcgcttcgcctatcgctgcacgccgctggcgatcgccaacgcgacggggtgggagatcacgcttcccttcagcttctcggccacgtggaacggcggtccgctcgtctccgacgtctggaccttcctcgaaggatgggacagccgctaccgccaggtcgtctcgtcggtgttcggcaacggcgtgttgaccttccatccgggatggctgtttcggacctcacccggatgggcgctgatcgcgcgcggcccgcccaacacgccgagggacggcatcgcgccgctggaaggtctcgtcgaaaccgactggctgcccttcaccttcaccatgaactggcgcttcacccggccgggcacggtgcggttcgggaagggcgagtgcttctgcttcatcacccccgtcccgcacgaaacgtacgatacgatccgcccgcggatcagaagcctcgacgatgatccggacctgaaggccgcctacgacgattggcgcagccgccgctccgctttccaagcccgcgtggccgtgggagaaccggacgcgatccgcgccggctggcagcgagactacatcgccggacgcgatccgaccggaagcgccggcccggccttccaccgcaccaagcgagtcctgcccaagccggttcgttag

SEQ ID NO: 8657 - DNA, 195 bp, Methylobacterium sp.
gtgcggacgaacgaggtagaaacgctcgtcgagcagtaccttgaacggttgcagggcatcgccgtggctgtcctccggcaggcggtcgcagatgtgctcatggacgccgtcgaatgccgacagaggatccaagcagctgaacgggccgcctcgcgcgggttcatgcgacagttgccagcggcggccttcgagtag

SEQ ID NO: 8658 - DNA, 666 bp, Methylobacterium sp.
gtgctggacctcgccaccggcactggctggacttcgcgcgtcgtcgcccggcggggtgcgcaggtgactggggctgacatcagcgccgatctcttgtcgttcgccgccgagcaggctcgggccgagggcctcgacatcaattaccacctgggcgacgccgagaatctgcccttcgccgacggcgcgtttgacgccatcatctctacctgcggggtgatgttcgcgagccggcctgaggccgcagccgctgagttggcgcgagtctgccgcaagggcgggcggatctgcatcaccacctggctgtcggacgacaatgtgttcaggatgttcatggtgatgaagtcctacatgccgccaccgcccgatcccgctcctccctcgccgttcgagtggggccgcactgagcggcttgaggaactgctgggtcgggacttcgagttggctttcgaaaacggtgtctcgttctatcgcgagctgagcgcagaggcggcctgggagcgattcgccggcggctacggtccgaccaaggccctggccgccagcctcgacgaagatcggcgcgccgatctgcgccgcgacttcatcgccttccatgctcagttctcgacgccgttcggcatctgcgttccccgccagtactggctcacgcacggcattcgccgctag

SEQ ID NO: 8659 - DNA, 1590 bp, Methylobacterium sp.
gtggccgccctcgctgccgccctcctggccggcgcatcggccggacaggcgcgcaccttggtctactgctccgagggcaacccggaatccctcgatcccggcctcgtcaccacgacgacggcgatgagtgcgacgtggcagctgttcaacagcctcgtcgagttcgcccccggcaccaccgatctgcggccggcgctcgccgaatcatggcaggtctccgacgagggacggacctacgacttcaccctgcgggcgggcgtgcgcttccatgcccagcccggcttcacgccgagccgcgcgctcaacgccgacgacgtgctgttcagttttcttcgccagtggaagccggaccacccctatcacggggtcggcggcgatttcgcctacttccgcgatctcggcctcgccggcctgatcaaggggatcgagcggctcgacgagcgccggatccgcttccggctgaaagagccggacgcgaccttcctgcccaacctcgcccaggccttcggcgccatcctgtcggcggaatatgccgagcatctcgcgcgccggggaacgccggaggtgctcgcccgcgcgccggtcggcaccggcccgttccgcttcgtcgattaccgccccgacgtggccctgcgctatcgccgcttcccggactactggcgccagccggccgaagccggggcgggcgcggtcgacgcgctcgtattctcaatcacgccgaacaccgcggtgcggctgaccaagctcaaggcgggcgagtgccacgtgatggcgttccccggcaccgctgatctcgaggcggtgcgggccgatcccgatctcacgctggtctcgggtgaggaactgaacgtcgcctatctcgccctcaacaccgcgcgcccgccgatgagcgatccgcgggtgcgccgcgccgtcagtcttgccatcgaccgccgcgccatcgtcgaggccgtctacgggccggccggcacggtggcgcacaacccgctgccgccgacgagctgggccttccacagtgagctgcccgagcccgtcttcgaccgggaggccgccgggcgcctgctcgccgaggccggctttgccgacgggttcgagaccgatctctggttcctgccggtgagtcgcccctacaaccccaacggacggcgcgtggccgatatgatccgcgccgacctcgcccgcatcggcatccgcgcccggctgaccacccgcgactggaccgcctaccgggccgcgctctacggcggcgagccaacgatgatgctctacggctggaccagcgacaacggcgacccggacaacttcatgaacgtgctgctcggctgccgggcggcggcgccgggcggcgccaacctcgcccgctggtgcgatcccgcatacgatgcggcggtccaggccgctcgacgcaccgacgaccgcgggatccgcacccggctctaccgggacgcgcaggcccgctttcgcgaggccgccccctgggtgccgctcgcccacaccgtcgttcacatggcggtccgacgcacggtcaacggcttccgggctgatccgctcgggcgcaccctgttcgaaggcgtgacgttggcggagtaa

SEQ ID NO: 8660 - DNA, 1062 bp, Methylobacterium sp.
atgcggccgatcctgccaatgcccgtcctgctcgcctgggccgtcctcctctgcgggggcacctacgtcgtgaccgcacgctcggacgccgccacggcgatcgacggcccctcacaacaggatatcaccgcactgaaagagcgcttccgccggccggacggcgtcccgcaccccaaagccaacccggcgacaccggaaaaggtgacgctcggtaaggccctgttcttcgacccaaggctgtcgcgctcgggcagcgtctcctgcgcgacctgccacaatccgagcctcggttggagcgacggtctcacccgggcggtgggcttcggcatggtcttgctgccgcggcgaaccccgccggtgcgcaacctcgcctggggcgccgccttccagtgggacgggcgcgccgacagcctggaggcgcaggcgcggatgccgatcacggcgcccgacgagatgaacatgtcgatggatctcgtcgtcgagcgcctgaaggctgtgccgggctacgccccgctcttccgcgaagccttcggcggcgaggagcccatcagcgcgcgcaatgtcaccgcggcgctcgccaccttccagcggacgctggtctcgggcaaggctccgttcgatcgctggatcgagggcgaggaggcggccctcggggccgacgcccgccgcggcttcgctctcttcaccggcaaggccaattgcgcggcctgccattccggatggcgcttcaccgacgacagcttccacgacatcggcctgaaggccggcgacgatctcggccgcggcaagttcgcgccgccgagcgtgacggccatgcgctacgccttcaagacgccgtcgctgcgcgacctgcggatgcagggcccctacatgcacgatggccagctcggcagcctggacgcggtgatcgagcactacgtcgagggcggcgagcggcgtccgagcctgtccttcgagatgaagccggtcgcgctcagcgcgcaggagcggcgcgatctcaccgccttcctcgaatccctggcggcggatcccgccgccctcaccctgccgcacctgccgtga

SEQ ID NO: 8661 - DNA, 984 bp, Methylobacterium sp.
atgcagctcttcgtcggctgcctcgctctcgcacccgcgggggctcagagcctcgacgccgtcaaagccgactacaagcggccgacgcacatcccgttcccggaggatgcgccctactcgccccaattggcgacgatgggcaagatgctgttcttcgatccccgtctgagcggccagcagaacctgagctgcgcgagctgccacaacccgtccttcggcttcgaggtgccggttcccggcgcgatcggcgccaccaacaagcctctcgcccgcaaggccccgtcggtgctcaacgcggcctggatcccgaccctgttctgggacgggcgcgcgccgaacctcgagacgcaggcgatgggcccgatcaccgccgatgccgagatggacggcaagttcccggagatcatcgcccgcctcaagcgcatccccgaatacaagacctccttcgatgcgctgttccccggcaagggcgtgacgcaggacacgatcctgacggccatcgccacttacgagcggaccatcgtctccggctgggcgccgttcgaccgatgggtcgagggcgacgaggcggcgatgtcgagcgaggccaagcgcggcttcgccctattcaccggcaaggccgcctgctccggctgccacaccggctggaacttcaccgacaacaagtttcacgatctcgggatcgagaccaaggatatcggccgtgccgccttcgacccggacgaccgctacgccaagcacgccttcaagacgccgggcctgcgcaacctgagctaccgggcgccgttcgggcatgccggccaattcgccgacctcgacgcgatcatggcacactacgaatccggcggcctcccacgcccctcgaagtcgccgctgatgaagccggtcgacctcacgccgagcgagcgcgcggacgtgatcgccttcctgcgctccctcacggcggatcagaccgagacggctctgccgaacctgccgaactga

SEQ ID NO: 8662 - DNA, 360 bp, Methylobacterium sp.
atgaaccggccgacgggaagcatcttccaagaggccgagcccccggccggagccgatactgtggtgaagttccgcggcgactccgtgcggttcctcaatccgcagggccagtgggtgcgcatcacctacgagtgcgattacgatacagccggccgatcggttcgtggcgtcaaggtgcgcgtcggacggatcgacggtaagggggtgaatacgagcgcggccgcgcttcctgccggctcgggcagtgcgggacgcggacaggctgctccggcgccgcctcaggcgcaggtgaagcggccccgaccaagcgagcccagcgaggttgagatccgccaggtcgccccgtcggcgggccgctga

SEQ ID NO: 8663 - DNA, 873 bp, Methylobacterium sp.
atgcgcggcctgctcgcacggatggcgccagccctggcggcggtcgccctggtcgcctcaccctcgcaggccgatgttcgcgcccgcgccgcggtgctggatctgaccgcaccggcgcagaccgttgcgtcgaccgaaccgcagagcgcgggcatgatcgccatcgtcgagaagatcacaccggaagccccggtctcggcgttcgcgacgctgatcgctcaggcggccaccagcaccggcgtcccttccgattttttcttgagattgttgaagcgcgaaagcggcttgaacccgatggccgtgagcccgaagggcgccctcggcattgcgcaattcatgccggcgacggcggccgagcgcggtctggccgatcccttcgacccggttcaggccattccgaaggcggccgaacttctgcgcgatctgcgccagcgctacggaaactgggcgctggccgccgctgcctacaatgcagggcccggccgggtcgacgcttggttggtcggccgcttggagctgccgaaggagacggtggattacgtcgccaacatcaccggcgtgaacacgcagagttggacatccgcctatcgtccggccggacccggctggccacttcagctcgcatccctcgcgccgccgatcccattgttcagcgtcgcgtccgacgccacccagatccggatatcggatcgccgcgagacggggactaatgcgaagcgggggacgaagccggcggacggcaccggcgcaccgctgacgaccgcgcagcttcgtgccgcggccggaggcgttctgcggtcggcgggtgcgagcaatccctgtgcggccctgctgaactcggccgcacaatgtctcaacttcagccgatattga

SEQ ID NO: 8664 - DNA, 1047 bp, Methylobacterium sp.
gtgtcgctcgtggcgttctgggccgcattccagggcatcctcgaacccgcaggcgcctgctctcgcttcgtctaccttggacaggacggcaagattttcacggcccggtcgatggactgggcaaagcccatcggaaccgacctctacatcctgccgcgagggatggcgcgcaacggtgaggtcgggccggattcgatccggtggacgtcgaaatatggatccctggtcgcgacagcgttgggcaattcgacctcggacggcgccaacgaagagggccttacggccaatgtgctctggctcgaggaatcgcagtacccgcctttcgacggcaaggggccgcctggattggcgatctcggcctgggcgcaatacgctctcgacaacttcgcgaccgtcgatgaagccgtgaccgcgctcgagaagcagcccttcacgctcgtgacgagcgtgattcccggcagccagatcaaagcaaacgtgcatctgtccttgtccgatgcgagcggggacagtgccatcatcgaatatatcgacggcaagcaggtcatccatcacggccgccaataccaagtgatgaccaactcgccgacctacgaacagcagcttgccctggcatcctactggtcacagatcggcggaacggtgatgctgcccggcacgggtcgtgcgtccgatcgcttcgcccgcgccgccttctacgtcaaatcgatcccgccggacggagacctcgatcaactcctggccagcgtctacggcatcatccgcaatatttccgtgccgctcgggctttcgacgccggacaaaccggaaatatcctccacacgctggcgcacggtgttcgatcacaagcgccgcctctatttcttcgaatcggcgctttcacccaacacgttctggaccgacctcaatcagatcgatttctcccgggagtcggggaaagtgctgaaactcgatctcggcgtcgatcaggccaacgtcttcgccgggaatgcgacaggggcctatcgcccgtctgagccttttccgtttgccggattgccgcgatag

SEQ ID NO: 8665 - DNA, 423 bp, Methylobacterium sp.
atgagcctacgcggtcatggacggagttggggggccgaacgcatccgggactggggactggccgattacgtcgccgatctcgtcgaggtatccgggcggatcgacgggccggtcgtgctggtcggccactccttgggaggtgccatcgtccagaagttcatacagggcggcgggcaggccgcaggcatggcgttgatggcatcggtcccaccgtggggtctcgcgccgtcggccattcgcatggccgctcggtcaccaggaatgttcgcggtgttgctggagatgtcgtccggccgccatccgccggacgacaaagcgctgttgcgtcgaatgctgttctcgccggagaccgtagacgacgagctcgaccaattcctttcccgcgtcgggccggagtcacccaggttgggctcagaactctag

SEQ ID NO: 8666 - DNA, 684 bp, Methylobacterium sp.
atgtcgatgagtctagcccagcctctcgcccccgcgccggtcctcgccgacggcgtcgcggccttcgaagcccacgcctacgactgggcgctcgcagtgttccggccgctcgccgaggcgggtaatccggaggcgcaggcgtggctcggcgcgctccatgccggcgggaccggcgtgcccgcctcgctgaccaaggccttcgaatggtatcgccgcgccgccgagcaggggcacggcccggccgcaaccaatgtcggcgcgatgctggccatgggccagggcgtggcgcaggaccgggccgagggcgcgcgctggctggagcgggccgccgccggcggcgacgtgatggccgcctacaacctcgccaccctgctggcgaagggcgacgggttgtccgccgatcccgctcgcgccgctgccctctaccgtagcgcggcggaagccgggcactacccgtcccaggcccggctcggccatctctacgcccagggcatcggggtggagcgcgaccgggtcgaggccttcgcctggctctcgctcgccgccggtcacggcgtcggcacggcgctcaacgcgctggaggaggtgatccgggagatgtcggccgaggagaagcgcgagggcgccgcccgggcgcaggcgcgccgaagcgagcccggccgcattgccccgatccccgcgtga

SEQ ID NO: 8667 - DNA, 723 bp, Methylobacterium sp.
atgagcagcaccctgcaggaccgcaccgtcgtcgtctttggcggcacctccggcatcggcctcgccgcggcccggcaggccaaggcggcgggagcccaggtcatcgtggtcggcttcaacgccgagggcgccgagcacgtcgcggcggagaacggcttcgccggctggcgcgccgccgatgtcacccggcccgagaccgtcgcggcggcgctggccgacatcccccacgtcgaccacctcgtcctgctcgccggcaccttcgtggccggcaaggtgctggaggccgaggtcgattacctgaagcgcgccttcgacgagcgcatctgggccgccgtccacaccctgcgcgctctcggcggccggttggccggggatggctccgtcaccttcatctccggcgccctggcggatcgccccacggcgcagggtaccgccgtgctggccgccgcctcggccgcgatggaggcgctcgcccgcggactggcgctcgaattggcgccggtgcgggtcaacaccctgtcacctggcaccaccgacacgccgctcctcgcccgcacgctcggcgcccatcgcgacgcctacgtcgccgcgctgaccgagaagctgccgcagcggcgcctcggcacggccgaggaggcgggtgcggcggtcctcttcctgatgagcaacggcttcatgaacggcgagaccctgcacgtcgacggcggcgcacgcctcgtctga

SEQ ID NO: 8668 - DNA, 1614 bp, Methylobacterium sp.
atggcggcgattcagggcccctacgcggttctgttcctcgcctgtcagttcctcgcggttgcaatcacgatcttcggcttcatcgcctatgcttggatgcccctgttcgggcgggacgcggtgattggctcgatcgcgctcatcctcgtggcttgctcgatcggacatgcgattccacttcgtcgcatcaaggttctgcacggcgtcgtcctgatcctgggcgtgtgcgccggcctcgcggcggtcgccggactgacgggtggctccagcggtcccggcgtcccgctatcctccttcgatcagcggttctacggcctcgtgcttccctcgctcgtcggctttctgctcggcccctggatggacgtgcagcagtggcagcgcgcggtcgagattcaccgcgagggcgcgtccgtccggacggcctatgcgatcggggcggtcctcttcgtcggcctgctgaccatcaatgccctgctcgcatccgtggcgggcctgggcgagccggtcgtgtcgttcgacggcctgcccggagcctacgccgccgtggcgcaggccacggagcggactcacctcgcgggcgtgacggcggccttcctgatctggacggtcgtggcggcggccaccacgatcgacggtttctacagcgcgacgcgctggctcatgacggctatcacgacgcgcagcaactcgccgctcctcgccttcgtgccggcctcaatggtgtcgtcgccgatctggatcctgatggccgccttcacggccgcggtcgttgcgatccaactcaatctctcgctgatgtacctgatggtgcccttcgcgacgctcctcgtcggcggaggggcctgcctggtctgcgagacgctcggggcctcccggcgctacgacccggtcctcagctacatgatcggtctggccgcgagcctcgtcttcctgaccggctacatcgagccgaacgcggcgtatctggccctggcgccggtcatcgggctcgtcggcgcgctgccgatgatcgcggagctgctcggcttcagtgaccggccggccgcgtcggcgacgccggcaccggtgccggcggacgagcccgccgcgcggacggtggtggttgccgtgcctcgggatgaggcgatcgcctcgcacggcttcgacggggaatggttcaccctgaatctgaccccgacctacgacgataccaattccgtcgggaacgtctacttcgcgaactacgtccgctgggtcggcaaggcgcgagagctgttcttcaacacctgcatgcccgacttcgacctgaaatcgacggatttctacgtgctgacgaagtcgttccagcacgatttccgacgcgaggccgccgagttcgagcccatcaccgttcgtgtccgcatcgccagccacaaccggaaattcgtgacgctcgcgcatgaaatccatagcgggatcaacggcctgctcggtcgcggagagcagtccctgatgttcgtggacacggtccagtatcgcccgctggatataccacggaccatcatcgagggctttcttccctactggcccaaaacctctccgcacgcgacctcgaccgtgccgagcccgttgggcgccgggagcatcagcgtctga

SEQ ID NO: 8669 - DNA, 309 bp, Methylobacterium sp.
atggctgcttctctgaccgtcggcgatctcttcaaggccaaggccgtcaccgatgagcaggtgaacgcggcggtcgagcggtacctcgccgcgcctgagacgtcggcccatccgattgcggagggctacaccgtcgatctcgccgcggccgtcgcgggacatggctgggcgagccgggtcgcggccaatccccgaacccaccccttgctgaagcgggcggcggttcagacggcgatcctgctggcgcgcgcgcgcaaggcccggaccgcgagcagaaaggcgcgaaccgatcccccggccccgcgctga

SEQ ID NO: 8670 - DNA, 1311 bp, Methylobacterium sp.
atggatttcacgcgccgcaagctcttgaagcagtcttcgctcgccgcggcggcaatcgccgcgcctcatctctggctgccgacggcccgtgaggcttggggggcgacgctcaagaagggcgaacccatcaaggtcggcttgctgttctccctcaccggccagctcgcggtgccggaggaagattccacgctcgtgatgcagtacgccatcgacgagattaacaagaacggcggtattgctgggcatccgatccagccggtgatcgtcgatgccaagtcggactttaacgtttactcggagaaggccaaggagctcatcattcgcgagaaggtgatcgcgctgttcggctgctacacctcggcgagccgcaaggcgatcctgccggtggtgatgtcgcagaacagcctgctgtactacccgacctgctacgagggtgccgaatgcacccagaacacgatttgcacgggtccgctggccaaccagcactcgaaggacctgatcccgtacatggtcaagaacttcgggaaaaaggtctttttcgtcggctcgaactacgtttggccgaaggagtcgaacaaaaacgccaagatctggctccaagaggccggcggcgagctggtgggcgaggaatacatcccgctcggcagctcggaattcgggcccgtgctcggcaagatccgcgacgccaagccgaacttcatcttctcgaccgtggtcggcgcctccgacatcgccttccacaagcagttcaagcaggagggtttcaaggtcgattccatgccgatcgcctcgctcaccaccggtgagatcgagaccaaggcgatgggtgccgaattcggcgccgggcacttcctctcggcgccctacttccagtcgctggagaacccaaccaaccaaaagttcgtcgagaacttcctcaagagcaagtacggcaagaatggctccacccattacaacatggaggagacttacctctcggcctacgtgttcaaggccggtctcgaggccgcgatcaagaagaccggcaatgtcgaggagatcacctcgcgtatgatccgcgacgtcagcggcggcgtgcgggtcgaggacgacatctcgccggaaggcctgatctggatcgacggcgacaacttcaattcctggctcaagcccaagatcggccagtgccaggcggatggcagcttcaagatcgtctccgaagccaaagagcacgtcgcgcccgatccgtactcgatctacccgaatgccggaaaatgcaccgccgcgggcctcgtcgcccccgacggtaagagccgcaagaacgtcatctga

SEQ ID NO: 8671 - DNA, 1089 bp, Methylobacterium sp.
atgaacgagtttgccgatggggtgtccgtggccgtggcggtcaggcttggcggtacgctgcagatcggtacgaacacggtcgaggtgctcgatcttctggtggtgttcgacgccattcgacggacgggctcgatcaagggcctagccgaaacgctcggcctgtcctatcgcgcggcctgggcgcggctgcaggcgtatgaagcagctctcgggcagccgctcgtgcgtaagacccgcggccagggctcggaactcacggaattcggagcggctctggcggagtcgttcacctccgcgattccagggctcgatgcgagcctcgggcgcgagacccgcgccatcgagcaccgtgtgcggcgcctgctcaccggccggtccggcacgctcaggctcgcggcaagccatgatccgctgctgatcgaggtcctgcgcgagatcccggccgagcagggcgcgatcgaaccgtcggtgatgggcagcagcgcggcggtgaagctcctcctcgacggcggggtcgatgcggcgggcttccactgcggcgtgctcgatcccgaacaggccgatgcgccgttctcggagctggcaacgagcgccgggctcgtgacgcacaggctgttcgagcgcgagcagggtctgctgctcgcccccggcaaccccctcggcatccgcaccctcgccgacctgacggcggagggcgtgcgctacgtcaaccgccagcggggatcgggcacgcgcaactggttcgaccgcatgctggcagagaccggcctctcgcccgacgcgatccatggctacgcggacgaggagttcacgcatcaggcggtggcggcggtgatcgcctgcggcgcggccgatgccgggctcggcgtgcgggcggcggccgagaggctcggtctcgatttcctgtcggtcggctgggagacgtactacctcgccgcgagccgcgccctcgccggctcggcgttcgacgcgttgatcgccaccgtgaggtcgcgtgccgcgggcacctccggctaccggcctgccggtccggaagcggccgatgccctggcggtgtccgcgtcacgcgacggactttcaggccggtga

SEQ ID NO: 8672 - DNA, 885 bp, Methylobacterium sp.
gtgacgtccctcgacattgctccctttgccaacgccctggtgctgggcttgagcatcgccagcatctggctcatcgccgcgatcggtctgacgatcatctacggcaccgtcggggtcatcaacatggcccacggcgagttcatcatgctgggcgcctatacctcctacgccctgcaatcctcgttcggcctgccgttcctgctctgcctgcccgcctccttcatcgtggtggcgcttgtcgggctggtgatcgagcgcgggctgatccgctacctgtacaaccgcccgctcgacacgctcctcgccacttggggcgtctcgctggtgctgatgcagggcgtgcggctgatcttcggttcggacccgaaatacatcgccgtgccggagatcttccagagcaacgtcgaggtgggctttgccagcctctcggtgttccgcctcgtggtgcttgcgatcaccgcgctcatcgtcgcggccacggcctggctgttctaccgcacccgcttcggcatgcaggtgcgcgcggtgatgcagaacaaggagatggccgcctccttcggcatcaatgccgaccgggtctacatgacgaccttcgcgatcggtgccggccttgccggcattgcgggctcgctgttcggcgtgctggcgatcgtgctgccgaccatgggcacggcctacgtggtgcaagccttcctcgtcgtggtggtcggcggcggcacgctgatgggcagcgtcgcggcggcgggtctgacgggcgaactccagtcggtcttcgctttcatgaccaacgataccttcgcgcgcttcctcctctacgtgctgatcgtcgtgttcctgcgcttccgcccgcgcggcctcttcgccgtcgccaaaggccgccggtga

SEQ ID NO: 8673 - DNA, 1122 bp, Methylobacterium sp.
atgacgacgcgcaatctctatcacagcaagccggcgcaatgggcagtctacggactgttcttcttaggcatcgccgggatcccggccttcgtctcggacggcttcctgctcaaccagttcgccgtctacggcatctacggcatgctcgccctgtcgatcagcctatgctggggcttcggcggcatcctcaatctcggccagggcatcgccttcgggctcgccgcctacggcatggccatgaccatgcagatgcagtcgcaggatccggattcgaacccgatcccgcccttcatgctcaacaacagcctggagcacttgccctggttctggcagccgttctggagcaccggcggcggcatcctgctggcgctcgccgtgcccaccttgttctacgtcgtgttcggcacgctgatgttccgcgcccgggtctcggggccgttcttcgcgatcatgtcgctggcgatgctctccgccttcgccacgctgatcctcgacatgcagccctacaccaacggtgccaacggtctctcgccgcccgcgccgctgagcctcttcggcaccgatatcgatccctacggcccgacggcctactggatcgtctgcggcctgctcatcgccgtcacggtcggcgccaagctcttgacccagagcaagttcggcctcgtggtccaggccctgcgcggcgaccctgagcgggtgcgcttcctcggctacaacgtcgccctctacgagacctgcatctacgcgatctccggcttcatcgccgcgctcgccggctgcctctgggtgatgctgatccagtacgtctcgccggcccagctcgaccccaccttcagcatcggcatggtgatctgggctgggatcggcgggcgcctgtcgctgcttggcgcgatcctcggcgccttcctgatccagggcggccagagctatctcggcgaccagtttctggcgacctggctgctcgtgctcggcgccttcttcatcgtggtcgtgcgcttcctgcccaagggcttggcggggcttctcgaaaaggtgctcggcgcgctggcgcgccagccgggcaagcacacccggcccgacctgccgcacgcgatcaccggcgccccggcggcgggcgagtaa

SEQ ID NO: 8674 - DNA, 741 bp, Methylobacterium sp.
atgggcgttctcgaaatccgcgacctgcacaagagcttcggcggcaccaaggttatcaacggcttcagcctcgacgtgaccgaactgaccctgtgctgcctcgtcggccccaacggggccggcaagaccaccaccatggacctcatcaccgggcgtcagaagccgacctcgggctccatcgtcttgcgcggcgacgacatcacgtccttgagcgagcacgagatcgcccagcgcggcatcgggcgcaaattccaggtgccggcggtgttccgcgagttgagcgtccgccagaacttcgaggtggcctattcccgcgaggtcaatccgttccgcaacatgcttcggcggcggcccgcgggcttcagcgacaaactcgacgaggtggccacactcaccggcctcaaggatcgccttgaggtcgaggcgggcttcctctcccacggcgagacgcagtggctcgagatcggcatggtgctgatgcagaacccggcgatcctcctgctggacgagccggtcgcgggcatgaccgagtccgagatcgagaagaccatcgtcttcctcaacgaactcaagcgcaccaacaccctgatcgtggtcgagcatgacatgggcttcgtccggcagatcgccgacgtggtgaccgtaatgcacatgggcgccttcctggcgcagggaaagctcagcgacatcgagaacgacccgcgggtgcgcgaggtctatctcggcgagccggaggtctaa

SEQ ID NO: 8675 - DNA, 699 bp, Methylobacterium sp.
atgctgctcgatctcgaccgcgtgacctcctattacggcaagacgccgatcctgaaggagatcggcctcggcctgcccgaggggcagtgcttgtgcgtcctcggccgcaacggggtgggcaagaccacgctcctgcgcaccatcatggggctgaccgaccgcacttccggcgagatccggatcgacggtgcgtccgttgggaaggcgccgacccatgtgcgggccaaatacggcctcggctacatcccgcaagggcgccagatcctgccgcacttcacggtcaaggagaacatcctgctcggtaccttcgcccgcaccgacgggcgccaggacgtgccggaactgtgcctgacgctgtttccctacctcgcgcagaacctgcaccggaaggcgggcctgctctcgggcggccagcagcagcagctcgccatcgcgcgggcgcttgccaccaacccgcgcatcctgctcctcgacgaaccgacagagggcatccagcccaacatcgtcgccgagatcggccagacgctggggcggctcaacaaggaattcggtatcacgctgatcctcaccgagcagcacatcaaggtcgcgcgcaagctcggcgacgccttcctgatgatggagaacggccgcatcgtcgcccgcgggccgatccatgagatgaccgacgaactgatcgagcggcacatgacgatctga

SEQ ID NO: 8676 - DNA, 441 bp, Methylobacterium sp.
atggaaccgatcccgaagaagggcacgcccgagcgccagcgcctgatcgaggcgcacaaggcctgcatggactcgatgaagggggtcgccggcaactcggtgctgctgtgcgagacgcccggcgacaccaccgtggtgacgggcggcgtccacaccgatcctgtgctcaagcgggtgctgctgcgcatgcgcggccagagcccgaagggcaagctgatcgtgatctgcaccaaggtcgatgccgagtggcgcatcgcccggctctccggcgtccgcggcgtgccccccgaattcgtcggcgacaaaatctacaccgacgagcaggagatccagcacgagatcttcctgatgcgcctcgacgagctctccgacagctacggcttcccggaagactatcacgagggctggaagcgcaaggacgataactggccgatcacctga

SEQ ID NO: 8677 - DNA, 1101 bp, Methylobacterium sp.
atggccctcgccgtcgcctcggctggcttcgtgccggaccgccccgatctcggccaccgcgccgaagggttcgacctcgccaaccccgccttcttcgccgacagcctcgatccaggggcgccgcgcctgctgccgccggccgcctaccgcgcgctcgccttcgccgagctggaggacgacgcggtctggacccgctcctggctcgccatcggcctcggcgccgagattccctcgcccggcgatctcctgcccttcaccgccggccatcacggcctccatgtccagcgcgagcccgacggcggtctcgtcgggcgcttcaacaaggcccagcacggcggctgccgcgcggtgccgctgcaatgccgcaccggcacgaagacccgctgctccttcaccgcctgcggctacagccgcgacggggccgtgctgccggccggccccgacgggccgacaccggcaatgcaccagtatctcggcctgcgcccggagcggctgctgccggtcgccgcccgtgcctgggggccattggtgcggatcaacctcgaccccgcggccgccccgcccgaaccgcagcccgagggcctgaccgcgcgggccggcgagacccgccgggcggagttctccgccaactggaaacttgcgatgcaggccctggccgagggcgatttcttagcggaggcttcggacagcctgcgcctgagcggacggctcgccaccggagatcttgtgacgatcgccgtccacttcccgaacctcgtcctgatcgcggcgcgggccgagacctgcgcggtgatgctccagccgacggcgctggggcagacgctgctgcggatcgggctgctcggctcgggcgacgcggaaccggccgctgccgctccggggcgaatgtcttgggatgcgtggcttgctgagatcgccgcccggatggcgccggccgtcgccacgcaggcggcgctcaccggcccggaggcggacgaccctcgttcaacgaacgcagccggtctctggctgcagcgaaacatcgccgcccgcgtgctggcgcggccggccgccacggagacccagcccctctacgccacggcccagggccgcggctgctga

SEQ ID NO: 8678 - DNA, 1011 bp, Methylobacterium sp.
atggacgttacgatcttcagcaccaaggcctatgaccggcgcttcctcgatgaggccaacgcggcggcgggcggaccgcaccgcctgcgctacctcgaagcgcggctggcccgcgagagcgctcctctgggccagggagccgcggccgtgtgcgtcttcgtcaacgacgtgctcgaccggcccgtgctggaggtgctggccgcctccggcacccggatggtggcgttgcgcagtgccggcttcaacaacgtcgatctcgcggccgccgcgcagctcggcatcgtggtcggccgcgtgccggcctactcgccggattcgatcgccgagcacacggtcgccctgatccttgcgctcaaccgcaatatccagcgagcctatgcccgtgtccgtgaggggaacttcgcgctcgaaggacttttgggcttcgatctgaaggggcgcacggccggcatcgtcggcaccggcaacatcggcgtggccgtcgcacgtatccttgccggtttcggctgccgcgtgctggcctacgatcctcggccctcggccgaactcgccgccttcggcgcgcaggcggtgggcctcgaccggctcctggccgaggcggacatcgtctccctgcactgcccgctgacgcccgacacgcaccacatgatcgaccgggccgcgctggcccggatgaagcgcggcgtgatgttgatcaacaccgggcgcggtgcgctggtcgataccgccgcgctgatcgagggtttgaagtcgggtgccatcggccatctcggtctcgacgtctacgaggaggaaggcggcctgttctttgaggatctgtcgaaccagatcatccgggacgacgtcttcgcgcgcctgctcaccttcccgaacgtgctcgtgacggggcatcaggccttcttcaccgccgaggcgctggcggcgatcgcggcgactaccatcgagaaactgtccgcctacgagcggcagggcgtcccgcgctatccggtctcggtcgaacgcctcgcctga

SEQ ID NO: 8679 - DNA, 1479 bp, Methylobacterium sp.
atgcatgttgacgacgataaggattggaaggcctcggattgcaccgtgaccgagccggccacgatccgccgcgccatctcggccgcttcgatcgggaacgtcgccgaatggtacgatttcggcgtctacgccttcttcgagccgaccattcagaaggtgttcttctccaatctctcccaccaaatgggtgagatcgcgaccttcgggctcttcgcggtcgcgtttctgatccgaccgctcggcggcatgttcttcggccccttggccgaccggatcggccgcaacaaggttctcgcggccacgatgatcctgatggccgtcggcaccttcgccatcggctgcatcccgagccaggagagcatcggcatcgccgcgccgctccttcttctcgtcgcccgcctggtccagggcttctccaccggcggcgagtacggcagcgccatgaccttcatcgccgaatacgcccccgaccggcggcgcggctatctcggcagttggttggaattcgggaccttcacgggatacctgctgggcgcgatcgtcgtgaccgtagcgggcgttgccctgaccgaggagcaactgctcgactggggctggcgcctgccgttcttcctggccctgccgctcggcctcgtcggcgtctacatgcgctcgcagttggccgagacgccggccttcgccgccctcgagcaggaggcggaggatcgcgagaagcgtctgcgtgcggggcagaccgcgaaggacatcgtcgccctgtggccctacgtcctcgtctgcatgggcctcgcgctcgcctggaacgtgccgaactacatgctgacgtcctacatgccgacctacgtgacgcagaccctgccgatgatgcagcaatccggcggcatctcgccgagggagtcgcaggtcctgcagatcgtggtgatggtcctcgcgctcctgtcgatccccttcatcggccgcctgtccgaccggttcggtcgcaagcccttcgtcctgatcgggtcgctcggcctcgtcgtgctcgccctgccgatgatcatgctgatccgcagccagagcgagatcgcggtcttcctcggcctgctgatcatgggcctgctgctgatctgctttagcgccacgatgccgtcgacgctgccggccctcttccccacgaacgtccgtgcgagcggcctgtccatctccttcaacgtgtcggtgtcgctgtttgccgggacgacttccgtcgtcgtcggatcgctcgtggcctacacgggcaacctcgattggccggcctattacctgatgatcgcgggcgcgatcggcgccgtctcgatcctcgtcatccgtgagcccaacgggacgagcatgtgggggtctccgcccgcggcggcgagcgagcaggaggcgcacgacctcgtccagggctacggctcaggtgcggccggcggcggatcgggactatccgtgccggtccccatcgcgccgcgccagatcgtttga

SEQ ID NO: 8680 - DNA, 1377 bp, Methylobacterium sp.
atgcaggatcgcaagcccgagagacgtgtcctcgcggtcacccccgtcctggcgggtctcgggatggcggcgctgccgaccacgggaatggcgatgctgatgccgtggctgatgcagcagggggcctacccggtcgccacggccggtgtgatccagacggcgcatacctacggcctgatcctggccgcgctgccaatggcggcgctcgccgcgcggctgggaccgcgccgcgctttcctcacggcgatcctcacgctggccgtcctcgtccccgccgcttccctgccgctcgacctcgtgccgctgctggccttgcgccttgcgcaaggggcgggctccgcgctgctcctctgcgcgggctggagcctgctgcgccgcctcttcggcgaggcgcgccttgggcttggcctcggctgcgcggaactcgccgccttgccggcgctgctgctggttcagatgggggccgggttcgcgctctccttcctgggaagcctcgggatcctcgtccccaccctgctcttggctctgccgagcctgatcctcggtgtgatcgccctaccggaggacgacgcgccgcggccgcgcttcgatgggctcggcgccgtcctgtcggtgctttgtctcgggctgctcttggccgccgtgccgctcgcggtgatccggccggtcgtggcgctgctcgtgctcaatctcggcctgatgctctcggcgctctggatctggcagcaatggcggcggccggcgccgctgctgccgctcgatcttctcgcgcgcccgcggaccgggtggctgctcgccgcggcgttcgcgggcaacgtcgcgctcaccgctgcggatacgggcctgctcgcccgcctcagcggcttcgccggcctgtcgcaggacggcatcggcttcgtgttcctggggctcgcggccctcaccgccggggcgggcttcctcgccggccggtccggcgcgccgccgctcgcccggattgggatggggctgaccgcggccggtctcgccgtccttgccgtggcctccccgggcggcgggacggcggccgcatggccgatcccggcggccggcctcgtcgccttcggcctcggccgcgggctgttcagcgtcgccaacgcgctggccctgctgcgggccgcgccgcccgcgcgcaatgccgcggcgaccgggctgttcgtcctcgcgggcgggctcgggacgctgcttgggccgctttatctgacgcagctcccgagcctattccttcccgccggcgcgatgtccaccgaactctggctcgggctcgcggcgggggcggcagggatcgcggccctgctcagccggtcgggcgcgaagaccgcgccgcgtggcgggcacctcgcgcgcgaacccgtctga

SEQ ID NO: 8681 - DNA, 246 bp, Methylobacterium sp.
atgaaaaccatgcaagccgcgccgaagtcgctcgaacgcgacaacacggagaagaagggcgcccgacgccggtacgagcaggaaggggcctacggacgcgacatctcccgcatgatccacaatcaggccccgggcggggagatgacgctgaaggaccgcgccccgtcctcggcggcggagggtgacatcggcgtgatgtccggcgccaagcccacgacgacgggcaacccgcgggtggcgtgctga

SEQ ID NO: 8682 - DNA, 495 bp, Methylobacterium sp.
atgctgcgccttgtgtccgccgtccttactctcgtcctaagcctctctgccgtctcggccgagacgccgcccagcgtcgcgccgggcgtgccgtcgggctcgggcacgcagcccgtcgccgtctacggccccgatgggcggatcgtcgcgtttcccgacccgtccggcatcgtcgtcaccacgatgccgtttcggcggctgcattcgacgccgatccggctgaaggggctgaccaccgccccgaaggtcttcccgatcagccgcccagccgacgccaccacttaccgggtcgtggtgccgtgcaacgtcaacatccgcctgctcggcgcgaagacggccgacgaggtgctgaccgacgacaacggcgtgctctacctcgccggcaccgacgtcacgatgggcacgagcaagcccgacttcatcatcgccaagacgacggcggagccggtcggcgactgcaccccggagatgcactacggcatgggaggcggctga

SEQ ID NO: 8683 - DNA, 243 bp, Methylobacterium sp.
atgaacagggcttacggtgtgcaggtgacggcgcagggaccggacggaggcgagccgaggaccgtgccggttctggtggtcgcaggcgacgagcaggacgcgcttctggtcgtctccgaggcggtcggtgacgacgccgaagccgagttgctgcgcgaacttaccgatgcggagatccgggaacacggtctcgatctagagcagcgcggagctgcgaaatcgctcgcagtgctgaaactctga

SEQ ID NO: 8684 - DNA, 876 bp, Methylobacterium sp.
atgaagcgttgcgcaatcctcactttggcagtgctcacgactggtccggcatcggccgagccggtggaactcgcggtttttcgggatctcgtgcggcctccgccgacgctgcaagtcgcttacggtgaagccccgtctcagggcatcgacgtgttcctacccgccagctctggcccacacccagtcgcggtcctcatccacggcggctgctggagtgttgccaccgctgggcgcgagcagatgcggcacctgggcccagacttgacgcggcgcggcattgccgtgtggagcatcggctaccgccgtgccaacgaggtcggtggtggctatcccggaacctatcaggacgtgggcgccgctctcgaccgcctcgctgaagaggcaggagcccaccacttggacctctcacgagtggtgttcgtcggccattcggcaggtggccatctcgccctctgggcggcctcgcgcggctcacttcccgccacgagccctcttcacgcagcgcccaggtttgtcccgcgggcggtgatcagcctgggcggcgtgggcgatcttgcgacgttcgtgcggttcgtccctgtgctctgcggcccgggcattgtcgagcagctcgccccagcagacaagctatcggaggtctcacccgcatccctcccgctcgcagggatgccgatctttttggtcagcggcgtacgggaccgactcacaccaccatgggtcgcctacgactatgcccgcgctatgcgaggaagatccggacgtgcgccgcagctcatctatgccccggatgccggacatttcgacttgatcacgccgccggcgccggcttggcaggaggtgcgcggtcttatcgaggcatccttagatcttaagtag

SEQ ID NO: 8685 - DNA, 537 bp, Methylobacterium sp.
atgctgcagtccggaaccaagatcctgcttgcggcacttgtcgctggcctcgcgcctgcggccgcgttggcgcagaacgtcatcgctttggatggcagcggctctcaggcgatcgtgaccgctgcgggtgacgtgacatcgacggcagccacccggaacgtgatcacgccagatgggatgggttatcgggtcgatgtcttcggtgcatcgcccggttcgcgtgtcgtggttgcgcagaacctcatcactccgaacggcgcggcacccgttccgaatgtgaatgattgtaccttcattcgcgatccgatcgccctgcgcgactgcatcaatctctacgagggccagcgcctggcgccggggccgcgtaacggcgctcttcggccgggcctgattaccgacgagaaccttctcgatgcggcgggccccattcccggctcgatcaaaggccggtccggcagcggccgggaccggacgagtgttcccgagccgagccgatccaacgccgcctacatcgatcaggtcacacggccgcgctag

SEQ ID NO: 8686 - DNA, 342 bp, Methylobacterium sp.
atgcgacggatcttgaccgcttttgtcatcctgttttcggcgtcgccggtgccgagcatggctcaaaccatcaccaacgtgaacgaatgcacgttcatcaccgatccgattgcgctccgacgctgcatcgacgggtttcagctgcgcggcccggcggcgcaatacccgcaatccgcgccgatcccggccgtcgagagccctgcccaggctgagcgcgaccagctcaacagcaagacgccgccggctgcggattacaaggattcgcccgagtggcttggcagcgccgacaaggcgccaaatcgatcgccgccgaagcgcggggtgatcgatctcaacaagtag

SEQ ID NO: 8687 - DNA, 213 bp, Methylobacterium sp.
atgaaccgtgtagcgccgagcctcgataccgcgccgaacccaggccaaggcaacgccttctacggtgtgcaggatggcatgtataaccggatcgacgcgacgcagaccggcatcggcaatctcatccgcatcacgcaaagcgggatgtccaacaacgccgtcatcacgcaatccgggtcgtacaaccagatcaccctgagacagggccgctga

SEQ ID NO: 8688 - DNA, 735 bp, Methylobacterium sp.
ttgctcgacacaccacccgctccggccttcgaccgcatcactcagctggctcagtcgctcttcgaggtcccgatcgcactcatctcgctccttgatgaggatcggcaatggttcaaggccaagtgcggcctgaacgtccctggcacaccgcgggagcaggcgttttgtaactacacaatcctgcacgacagcgtgttcgtggtttccgacgcccgcgcccatgctgacttcgccttgaaccctctggtgaccggggagccgttcatccgtttctatgctggcgcgcctctcgtcgtcgcaccggaaatcaggatcggctcactgtgcattatcgacagacagccacgcaccttcagcgatgaggatcggtggctgctagcccgactggctcaagttattatagatgaaatctggctgagaagtcttgcatctggacagggtcggatgccgcccgattcccggcagctcgaacgcagttccgcagtatcttctgtgatcaccggcgtgcaggttcgtgccgccagggcgatgctcagttggtccatcgacgaactcagcctgaaaaccggtctctcagcaaacacgatcaagcgagtagaggccgatgatcaaagccggccgagcagccgctccacgataactaaggttaaggaggtgctggaaggcgaaggggttctatttatcggcaacgacgcagccgccccgggcgtacaacttgtgcgaaatattgattaa

SEQ ID NO: 8689 - DNA, 1269 bp, Methylobacterium sp.
atgctgcgctcggttcaggccgagcaggagcggctgagacgcgagaaccaggaagccaaagccgagcttgtcgaggcgcggcggcgtctgcgcgatctccaggccgtctcgcgcccgtcgccttcgcgcaaggcgtccatcgccgagccggtgcccgtatcaggaccgcttccccctttgccgcccttgcgcgccgtctcgggcgtcgtcggcgcgatcgaaggcggcgccggcggcttccgggccggaaacggtgcctatgccgcgggctcgctggcctttcccatcgggcggtcgttcggcttccaggcggatctcgcggcgatcgcgaacgggggcgacctcggcctgggagcggccgggcgtgccttcctgcgcgacccgaccaagggcctgatcggcctctacggctccgtcgattacgccacgtccatccggagctacggccttcaggatgtcggcacgaccatggggcgcatcgccggcgagggcgccctgttccttgatcgcttcaccgtggacggcatcgccggctggcagatgggggatcgcgcgcagcatttcttcgaccagatcgacctgtcctggtacgcgaccgacgacctccgcttcagcgtcggccaccgctacgagaaccgaatccatgccgtcgccgccggggcggagtatctgctcccgctgctgagccccgtcggcatctcggtctttgccgaggggcggatcggcgaacgcgattaccgtgccggcctcggcgggcttcgcgtctatttcggccaggaagacaagtcgctgctgcggcggcagcgcgaggataccctcaaggttcgcctggtcgatcccttcgctgcgcggccgaacgggtttcgcgtcgttccggcggtcggcccgcaaggtccagccgggccgcagggagcgacaggggctcagggagccgcaggagcacagggtccggcgggggcgccgggattggcaggggctcagggaccggcggggccacagggagtggccggcgcgcaggggccgaccggcgcaccaggattggccggaccgcagggaccagctggggcacagggagcgacgggcgccactggagcacaaggaccgaccgggtcccagggcgttgccggggtaccgggagcggccggcgcgcagggtcccgcaggtccgcaggggccggtcggcgcaaccggagcccagggagcgacgggtgccaccggcgcacagggaccggccggaccacaggggccggaaggtcagatccgtctctga

SEQ ID NO: 8690 - DNA, 771 bp, Methylobacterium sp.
gtgacggatctcaacccgctgcggttggacggccgccatatcctggtgaccggtgcgagttcgggcatcggacgcaggacggccgtgatgctgcacgcccttggcgcgcgtctgtcggtcgtggaccaggacgaggccggcctcgtctccctcggcgcggaactgggtgccggcgaggcggtcgcccggcacgtggctgacctgtccgacattgccggcatcgagcccctggtcggtcgctgcgtcgatgccggcggacggctccacggcgttgtgcattgcgccggcgtccaggcgatcgtgccggtcagaacgctgcagatcgacggctggcggcggatcttcgcgatcaataccgaggcggcgctgatgctcggcaagtgcctgtcgagccggaaggtctatgccggccagcacgggtccatcgtgttcatctcgagcgtcatggggatggtcggctcggtcggcgccgtggcctactcaatgagcaaggcggccctcggcgggatggcccggtcgatgtcgctcgaactcgcgccccgcggcatccgcgtcaactgcatctcgcccggcttcgtccgaacccctctcctcgagcagacggagaggctttgggatgaggaaacgaagcgggccgtcgaagccctgcatccgctcggcttcggcgaggcggaagacgtcgcccatgccgtggcgtttctggtcgccgagaccgggcgttggatcaccggttcgacactcgtcgtcgacggtggttatctggcgcgctaa

SEQ ID NO: 8691 - DNA, 1062 bp, Methylobacterium sp.
atgaagcacttcaccgtcgccacgatcagcacgctcgcgctcctcgttggtgcgcctgctctcgccgccggcaacaacgaggccgccacggagcagcggggctacagcaacacgctcgacctcacgcagtctggcaagtacaacaccgtcactgtcgagcagagcggcagccggaacgcgttcgacggcgatcagaccaatggctcccgcaacctgatcgacctgacgcaggaaggccgctacaactacgccgccagcgggcaggccggcagcagcaacgccaccacgacgatcaaccaggataccgcccgcaccgcgcccagagatgccggccattttgctgtcacgcagcaggacgacaccaggaactcggagatcgaggtcaagcaggtcggtcagagccagatcgctctcgcgactcaggctgacaacacccgtaacaactccaagattgtcatcgatcagtctctgaccactaacgaagcctacgcttcgcagtggaatgtctccggctccaccatgtatgtcggccaggccggtgagttcaacacggccaacgtggcccaggataactcgacgggcacgcacgccaacgtcattcagtggggatccgctaactacgcggaagtcgggcagaccaacaacaagtactcctcgacgaacgtctcgcagtccggcgctttcaacgcggctgctgttcttcagagcggttcgaaaaacagcgacatcatcgcggaccagtacggcttcgataacctgctggtcgcgacgcagaccaactcgaatggcgcccggatctccacgcagcagtacggctggagcaacgtcgccgacatttctcagaacaactcgaatggcgcaggcatctacctgctccaggctggcactctgaactacgcgaacctcacgcaggataactcgggtgcgagcacgatcacgggcgcccagctcggcaccggcaactcgctcacggctgcgcagtacaacaatgtgggcagcaccatcctgagcgcgcagtacggcaccagcaacaccgcgaagatcgttcagcacggcaagtaa

SEQ ID NO: 8692 - DNA, 477 bp, Methylobacterium sp.
gtggccgtcgagtacgcgaccatcgggtcggtctcgctcccgatccggatcctcggcctcaacggcggtaccggcggtcaggtcgcgaccaacttgcaagtcggcaatgcgaaccggaccgacatcagccaaaccggcaggggcaacgcggccgcgatccagattttcggcgacggcaattcggcggcgatcgcgcagcagggctcgaacaatgtcgggcagggtttgctggtcgggtcgagcgtccgcttcgatctgcagcagaccggaatcggcaatcaggccgacctgagcgtgaacgcgcccgggggggcgaacctccaattgcggcaggacggcaacggcaacagcttgaccggttccgttccgggcgcagccaacatcgtcgtgaaccaggtcggcaacggcctttccgccgacgtaacccaagtcggtgttcccaagaacatcagcgtccagcaagtccgcgcccgctga

SEQ ID NO: 8693 - DNA, 1653 bp, Methylobacterium sp.
atgtcgattcgccataagatcctgttgccgctcctcggcttcatgctgctcggggggctcctgtcggcgatgacgggcctgacgggcctctccgccttcggggaactctcgggcctcgccgggcgcgcggtggaggccagcgaggccagccgcaccgcccgcgaccgcttccgccgggccgaagccctggtggcgcgggtcacggccatgaccgatctcctcgatatcggccggatcggcagcgagttcaccgcgaatgccgacgccctcgaggagggcctcggccgcttgaaggcctcggcgctctcggagcggatgcttaccctgtccaactcggccgaggccgagtcccggcagtggcgcgcgggcgcggagatccttctcgggctgcgcaaggcgcgcgagatcccgaccctggccgtcatggcacgctacagtgccgcgatcggccgcgacctcgacgaggccgtggcgctggccggccaggaggctcaggctcagatcggcgccaccggtgcggcgatgtcgtggaagatcgggctcatgctcgctctctccgccgcgaccgtcggggcgggtgcgggcgtggccttctggctggcggggaccctgtcgaagcccctcgtcggcctggcccgcgacaccacccggctggcggggggcgacctcgacgtggccctgccggccaccgaccgccgcgacgagatcggggccatggtcgccgccgtccgggtgttcaaggacaacctcatccgaagccggactctcgaagccgagaccgcccaggccggcgcggccgccgagcgccgggcgatggtgcgcagcctcgccgacggtttcgaggcgtcggtcgtccggatcgtcggcacggtcgggacctccgccgctcagctccgcgagaccgcgcagacgatgagcgtcaccgcgcagcgcacggccgagcggaccacgcggatgtccgccgcagccggcgcggccgcctcgaacgtcaatgcggtggcggcggcgaccgagcagctcgggaactcggtcgtcgagatcggccgccagatgcagacatcggcggacctcgcgcgcggggcggtgtcggatgccgaccggacggctggcgtggtgcgggagttgagcgccgctaccgcgcagatcggcgagatggtcgctctgatctccaacatcgccagccagaccaaccttttggcgctgaacgcgaccatcgaggcggcccgcgccggcgaggccggacggggcttcgcggtggtggcttccgaggtgaaggcgctcgccacccagaccacgcgggtgacggacgagatcacgtcgcagatcacgcggatccagggcgtcaccggccaagccgtttcggcaatcggcggcatcacgacgcggatcggtgaaatcgatacggtggctgtctcgatcaccggggccgtcggcgagcagggcgcggccacgaacgagatcgtgcatcgcgtcggccgaaccgcgcaggacacccgtgccgtgacgggccacgtcgccgaggtcgcggaggccgcggagcggaccggtctcgccgccgaccacgttctgcaggccgcctccgacatgtcggctcaggccgaccagttgcggcaggaggtcgcccgcttcctcgtcaacgtcagggccgcgtga

SEQ ID NO: 8694 - DNA, 1194 bp, Methylobacterium sp.
atgcctcaattgaccgacccaggccggcgcatcgccctcggtctcgccgcggcggcggtcggggcgggactcgcggcctcgctcgccaagctcttcccgtggcaacgggcgagccgcgaaggagaccagccggtggccgatgccccctacgatcctcgcgagaatgagtccaacctgtccgtgaccgggttgcccgacgacgctctgcgggagcggggtatcacgcgcatggtgctcggccccctgccgctgccgaacggggcggtaatcgccaccgatccgctggtgcagcccgagcgcgaggccttcacccgccgggtcgcgccgggcgactatcccgtcacgctctatcaggcgcaaggtcgggtcgccctggccgagcttcgcttcgccgacgggacgccggcgcgctgggaactcgccctcgtgccgcgccaggacatcgccagcctgaaggcgggcgagatcttcggttatcccgtcgatgccgggctcggctgcttcatggacacggccgcgcgcgccgcgatggcgcgtcgcgaggcgcaggagcagaagcggagccgctacagcaactactacgacgacgtgctggccggcgagctgaaggattcgaacctgaactgggtcatgcaccggccgctgccggatgatccggcgcgggtcgcggtcttctccagcggctggggcgacggcgtctacgcctcgtactggggcctcgatgcagccgggcagccgctccggctcgtcacggatttcgggatcatcgagaacggcgacgggcgcgatccgcgggagatcgccgtcgccgcggccctggccgggctgacgccggagcagcgccgcgacagcgagcggggctacgcggcgctgaagtccgatgatcgtgccgccttcgcagccctgctcgatgcgggccggatcgcacccgagacgccgatcgaagccgtcgagggcaccttcaccttcgaagcgatccgcctcgacaagccggaggcgctcgaacgcctcgtccggcacggcgcgcccaccctgatgccgccgtacctgcagttcggcgacgagcggaagacctatccggcttacgcccgctccctcaagacaccccggtcgccgcaactcctcgccgtcatcgaggcctgggagcgcaccggctcaaccgacacgccatcacgaggacagacccaaccatga

SEQ ID NO: 8695 - DNA, 438 bp, Methylobacterium sp.
atggcggcagcaagagccgagagcgccgcggctgaggccgccaaatccgaagcactcaagaccgaagcactcaagaccgaagccgccaggaccaggaccgccaaggccgaggccaccgagagcgggcggggcggagcgtcgccggagagccgcgcgccgtcggcctccgctcgcggcaagccgctcccttcggtccctgcgcgggacggcacagatgccgcctcggcgcgggtgccgggcgccgccgattccgccgctcaccggccggaaggcccgaccgaaggcgaggcggcaaaagcagcggcacaggaggcggctgccgaaggcgtggctgcggaagaggccggggccgtcgtcctgtccgagggcgagacgcgggacgagacagatgcggcggcaccggacgccgtcgatccctccgccctcctctcgccccct

SEQ ID NO: 8696 - DNA, 1059 bp, Methylobacterium sp.
atgcgcaagcccaagccgaccgccgaagccacctcgcacgagaccgaactcgccggcctcgtcaccacccgcgacaacctccaggctcggcaggccgcgatcgcggccgagttggagcaggctgtcacccgacgccgcgagctgctgatccaaggtagcaatgccgccgccatcgccgaagccgagcgcgcctgccgcgaggccgagggcaccgctgccggcatcgccgacgctctggccgaggtcgagcgccggatcggcgccaccgaggacaagatcgaggacgcccgcatcgcgaacgtgcgcgaggccgccgcggccttgctggagcacgacggcaaagcgatcgacgccgccgccgaacgtgttcggcaggccgtagccgatctggcgaaggcacaggtcgggctcgcggcggcgatcaccgtcacgtccaccccgcacttcggcaagtacgacttcggtggccggcgcagcggcgaggcgcccgaggtcgtggccgcctacctcaccggccacatgatcgcgaccacgctgcccggcctcgatgtgtcggaggcgatgcggaagatcccggccggcggctggactgaccggcgcctgatcgagccgaccgagcacgatctgcccgcgcgggcgcttcttaccgacccgatgcgcgaggcggcggcgcaggtccgtgcgggtgaggcgtcgccggacctgccgcgcttccaccgccccgagcccgacttcacgccggatgtttccctcgtgcaggtctatgtcctgaccccgttccggtacgggaccggcgaagggcgtatgcccggaatcgtatcgggcgttatcgagcatatcccggcgcctgttgctgagcgggcaattgccgctgggctcgcttccgaggttgagccccgcaacctcactgacctgaaggcgcggcggccggctgccaccagcggcgtcaacgtcttcgccttccacgatctcggcttcgatctcgcggagtggaaggccgaggaggtcgcccgccggcgtgccgcgtggctggccgagcaggagcgcgaggccgcctga

SEQ ID NO: 8697 - DNA, 249 bp, Methylobacterium sp.
atgaaagagcacacaccggagaccgacggcgccgcgaccatcctggcgatgcacgccatggtgacgtggctggtgcgacgcgaggtcgagcggggcgaaggcgccggcgacgaactcacccggcacatggtcgaggcgatgctcggcgtggtgcaggtagacccggcgctcgccgaggcggcgcacgaggcgagcaacgtcgtcgcccgcgtcatcgacacccggccgatgctggcggtgctgaactga

SEQ ID NO: 8698 - DNA, 654 bp, Methylobacterium sp.
atgttcttcgagcttccggacgaaagctggatggcccgggcccggccgctcggtccgttcttgtgcgatgccgccttccgcatcgccgacagcctctatgtcggccccgaccacggcatcggcccggacgattgggagcggctgcgcgtgcccctcgatccgaaagacctgccgtgccgcgtcgccaatctcgttgcggcgatcgatctgccgggccacgaggcggccctggctgcccattacgagaggctgatcgccgaagcccagcagcacaataagcccgccgccctggcgcatccgttcccgtatttctcggtgacgcccttgctgctggaggccgaccggccggtcgtgaccttcccatggaccgatgacgtcccgcagacgagtgccgttctgacggccctcgccggcacaggcgccaacggcgtggtttgggacgagatcgaccagggctggttcatgcgcatcgttgcccgggacggaatgctgttcatcgccgagggcgatccggacgaggggccggacgtcgtgctccgcgtcgaggcgagggcggccgccgctcaggccggagcggccctcgcgcgtctgaggacgctgcacgcgcatctgatccgggtgttcggacgcgatctctggtcctatgcgggctga

SEQ ID NO: 8699 - DNA, 2265 bp, Methylobacterium sp.
atgcggaaggccgtcctgcccgtcctatccgcgggccgggccgccttcggctggatcggccgccgcatcgggccggggcggctgctggcgagcggcctgctcttgctgctgctcgccctgcggatcaccgatccgccgccggtcgaggccctgcgcgtgcgcaccttcgacgcgctgcaggtgctctcgccacgggtgccgccggccgatcgcccggtggccatcgtcgatatcgacgaggcgagcctgcgggaattcggccagtggccgtggacgcgcacgcggctcgccgcgatgtgccgcaagctccaagagggcggggcgctcatcgccgccttcgacatcgtcttctccgagcccgaccggctgtcgccgccgctgctcgccgaaaccctaccggacctgagcgaggcggcccgcgccgacctcagggcgcagcccgacagcgacgcggtcttcgccgaggcgatcggacgcctgcccgtggtgctgggccagaccgccgcgagcacgcccatcgcctggaccggacgcgagccgccgccgcagaccggcaccgccgtagtggggacagatttcgatccggagacggcgctgatcggttttccgggcctgatccgcaacctgccggtcttggagcgggccgccgcggggcggggcgtcttcaccatcagccccgagcgggacggcgtggtgcggcgggtgccgctggtgctgcgggccggcggcaccgtggtgccgaccctggcactcgacatcctgcgggtggcgaccggggccgacaccctgctgatccgcaccgacgaggcgggcgtcgtctcgatccgcctgcccgagctcaccgtgccgaccgatccgcacgggcagatctgggtgcgcttcagcccgcacgatccgggactctacgtgtcggcccgcgacctcctcaacggcacggtgccgccggagcggctgcgcgacaaaatcgtcctcgtcggcacctcctccgtcggcctgctcgacaaccgcaccacgccgctcgaccgttcgatgccgggcgtcgagatccacgcgcagctcctcgaaaacctgctgaccggcgccaccctcaccgtgccgaacgaggcgaccctgatcgaggtcggcgcgacggcggcggtgtcgctcgccatcatcctgtttgccccgatcctcggcgcgctcggactgctgctgttcggcagcctcgtggcgggacagctcgtcttcgtctcgtggtaccggttctccgcccacggcatcctgttcgatgccacctacccgctgctgacaaccttcctcgtctatctcaccctcgtcttcaccaactacttccgagagcaggccgggcggaagcggatccgcaccgccttcggccgctacctgtcgccggacctcgtggagcagctcgcccactcgcccgagccgctgcggctcggcggcgaggagcggcgcctgacgatcatgttctcggacgtgcgcggcttcaccgcgatcgcggagttctacaaggacgatccggccgggctgaccgccctgatgaaccgcttcctcaccccgctgacgaacgccatcctcgaccggcaggggacgatcgacaaatacatgggcgacgcgatcatggcgttctggaacgcgccgctgcccgtcgcggaccacgaggcccaggccgcggcggccgccctcgacatgctggcacggatggacgccctgaacgcggcgcgccggcgcgaggcgaaagccggcgggcacccggtcctgccgctcgatgtcggcatcggcatcaacaccgggccctgcgtcgtcggcaatatgggctccgacctgcgcttcgactattcggtgctcggcgaccccgtgaacgtcgcctcccggctcgaggggcaatcgaagctctacggggttaagatcgttctcggcgcggcgacggccgacgccatccgcgcgcgcttcccggtgctcgaactcgatcgcgtccgggtgaagggcaagagcgagcccgagaccgtcttcaccctcgtcggggatgaggattttcggatgtccgagccgttccagcaactcgcggcccggcacggcgcgatgatcgcagcctatcacgcccggcaatgggacgagaccggcgcggccgcgcacgcctgccgggcgctggcggaggggctgcggatcgacggcctctacgcgctctacgccgagcgcgccgagactttccgccgggagccgccgcccgccgattgggacggcgtcaccgtcgccacgacgaagtag

SEQ ID NO: 8700 - DNA, 330 bp, Methylobacterium sp.
atgcacggcgaccttccacctccgcccatcacctgcaccctttccgagcagcggcagggctcacaggttcgaatcgacgcggagatccgctcggccacatcgcaatcgggaatctaccgcctggtggtttcgaagcggggatcgtccggcaacgcacagctcagccagcaatccgacctcgcacttgcaccgggctccacgctgcggattccgggaccacgcctgtcgatcgaacctgaagggcactatcgagcccgcctcgtcatccatgccggtgacgccgaatatgtctgcgagcatgaggggccgaatgcgtccgatccgccctga

SEQ ID NO: 8701 - DNA, 147 bp, Methylobacterium sp.
gtgatcaatgaggagggcactccgacggatacgcccggcctgacggccaaggacttcgtccagtcaggcggcaacacggagacgttgaccctcaagccgactgcgccgaacaagttcgtggccgacctcaaggccccaatgccctga

SEQ ID NO: 8702 - DNA, 408 bp, Methylobacterium sp.
gtgcctgatccaaaccccaccgtcggcgaactcttcaaggccaaggccgtcaccgacgagcaggtgagcgcgctggtcgagtcagtgctagccggaaagctcgacgagcgtgccgaactcgccgaggcctacgtggtcaatgtggcggctgcggtgaaggccagcgcgttcgcgacctccgtccccccgagacaagacgagcaagcccggcgcacggtggaatgcggcgcggactgcgatcctgctggcgcgggcgcagaaagctttagtggcgatcacgtcgcgcgctttggcggccgtctgatgtccgctaagatgcgcctgagaggcggaccagcaataaaagaccacacgagatgggaacgtaccggctgcatcgcggatggcgcgagcctaacggacttgtaa

SEQ ID NO: 8703 - DNA, 291 bp, Methylobacterium sp.
atgaagacctttctgacctttgcaagcgcggtcggattcgcggccgcgtgcctcgtgcccctcacggctggtcccgcggatgcccgctcgcgtcacaagagccgcagcatcgtcacgaacgacggcagcgtgaccggcggacgcggccgcagccaaacgatctcccgtggagcgaccggagccagcagcatcaacagaaactccgcggccggcggcaacgcgaaccaacccgagcgcgcggtcccgcagggcagcggcggcgggggaagcggcggcgccggcgctcaataa

SEQ ID NO: 8704 - DNA, 195 bp, Methylobacterium sp.
atgaccgaagccgagcgggagcagcagctccgggatcagttgttggtcgaaatggccgcggccgttgaaatgatgctggagctgacaaggcatgcccatcgttccgaatcgatgatttgtctcggcgcaacgcaacagcagagcaggcttgaagcggcccgggagcggttcgtgggctcgctggggaaacgctag

SEQ ID NO: 8705 - DNA, 513 bp, Methylobacterium sp.
atgcctcgtctcctgcccctcgtcttcgcggccacgatcgcttccctgggcatcgcgcaagccgatgaactcaccatcgaaggtgtcgggatcagccgcgacgtggactgcgaaggcaaggacgtgggcgtctatggggcggagaatgaaatcgcgctgaccggcaagtgcggcctcatcaccgtgcacggttcgaaccacaaggtcagcttcgaggaagggaccgggctcgccgtctccggtatggacaacaaggtgaagggcggccgagcccagaacgtgaccgtcgccgtgacgcagaacaccgtcacggcgaccctgggaggcggtggcgcacctggaaagctgagcacctccggcgccaacaaccgcgtctccctcgttctcgccggtccgacgcgattggaggtccagggcgcggatcacgtcgtggagtggactcgcagcgaccgcgccccgaatcccgaagtcacggcatcgggggccaagaacgtcatcaagaagaagctgtag

SEQ ID NO: 8706 - DNA, 804 bp, Methylobacterium sp.
atgatccgcgccgccgaatgcgtgggctcgcacgacatcctgctcgtgacgctcgattccctgcgctacgacgtggccgcgaccgcgttggcggaggggtgcacgccgaacctcgcccgccttctgccgggaggcacctgggagcgccgccacgcgcccggcagcttcacctatgccgcgcatcaagcgatcttcgccggcttcctgccgacacccgccgagccgggggcgcatccgcgcctcttcgcattgcgcttcgagggcagccgcaccaccgggccggacaccgccgtgttcgacgcgcccgacatcgtctcggggcttttcgcgcgcgggtaccatacgctgtgcatcggcggcgtcggcttcttcaacaagcgcaccccgctcggccgcgtcctgccggacctgttcgccgagagccactggcacggcggcttcggcgtgcaggcgcgggactcgaccgcagcacaggtcggcttcgccgtggaacggatcgcggcgctcgaactggagcggcggcttttcctgttcctcaacgtctcggcgacccaccacccgactcgcgtctacctgccgggcgcggcgcgggagagcgcggcgacgcaagcggcggcgctggcctatgccgatggcgccctgcccccgctcttcgcggcgctcagggcacgcgggccggccctctgcatcctgtgcgcggatcacggcaccgccttcggcgaggacggctatcgcggccaccgcctcgcgcatccgaccgtgtgggacgtgccctacgccgaattcatccaggaggcggcatga

SEQ ID NO: 8707 - DNA, 930 bp, Methylobacterium sp.
atgtcagtgccactgtcccgaccgtcgcgacgcgcggtcgtcctgtcttccctggcggggggcgcgtccggcctgcttgccgagggtgggccagccaaaggctcgcaagccccggaaaggcgtatcgagggcccaggcgagccgccggcgggtcgcaaggtcacggtcgagcgacggggcgggatctgtctgatcggcctcaacaggccccacgttcacaaccgagtcgatcccgaagcgttcggcgccctggcgcgggcttacgccgcgtacgatgccgatgacgaccttcgcgccgccgtgttgttcgggcacggcgagaacttcacgcgtggcatcgacgtcgatgccttcgccgaggtgttgaggtcgggcaaggcgcgcgagcccgatgcagacgggagcgacccgttgggacggcgcgccctcctgagcaagccgctcgtcgtggtcgtgcatggcgatacctggaacatgggccacgaactcttcctcgtggccgacatccgcatcgcatccgccgagacgcgcttcgcccaggacgagaacgcccacggacgctttccaggcggaggctcgacggtacggtttccgcgcgaggccgggtggggcaacgcgatgcgatacatgctgaccggcgaccgttggggagcagaggaggcgcggcgcatgggtctggtgcaggaaatcgccccgaaccctcacaccgctctggaactggggctgggcatggcagccaggatcgcccgctgcggccccctgggcatccgggccaccctcgcctccgcccgcaatgcggtcgaccaatgggagagaagggcattctccaacctcggcgagcagtatcgcgccctctatggcaccgaggattttcttgaaggccgcaaggccgaagccgagggtcgaacacccgtctgccgcggacgatga

SEQ ID NO: 8708 - DNA, 1677 bp, Methylobacterium sp.
atgccatctgaagcgaccactgagcccttcgacgccgaggtcatcgtcgtgggcgccggtcccgtcggcctgaccacggggtgcgccctgcgccaccacgggatcgattgcctgatcctggaggagcggaccgaggttcgggcgtattcgcgagccaacaacctctgggcacggccgcaggagctcctggccgccatcggcctgcgcgacgttatcgcggagcgcgcctacccgatccggctggtcaacttcttcatgaacggcacgcccaccacgccgatccggatcgacgacgtgggcagcccccatccgcaggtgctctacagcgggcaggacgtcatcgagacgaccctgatcgaaacctacgaagggcgcggcggccggacgcagcgcggccgcaaggtcgtcgccgtcgcccaggacggggacggcgtgaccgtcacagtgatgcggggcgacgatggaccggaggagcgcctgcgctgccgctacctcgtcgccgcagatggcgccacgagcacggttcggacccaactgggcctggatttcgaacccgagcggttcgagggccggatgaaccggcaggtcgatgccaggctctcctggcgacgttcgctggaacccgaccagctctggttcttctactacgagcgcgggttctgcggcgtgatgccggtctggggcggctatcaccgcctgttcttcctggccgacgatgcgggcgtgcccgaccgggacccgacgctggctgagatccaggcggtggcccgcgaggtgacgggggacgagacgctgacgctgactgacccgcaatggctgacccacagccgcttccagtacggcgtctcaccgggctatgcccgtggtcgcgtctacctggccggcgatgccgggcacctgtccctgccgatcggcggccagggcatgaacgcgggcctgcacgatgcggtcgagatcgcgtggcggctcgcggcggtgctgcggggcgagacggcgccggtggtgctggactcctacgacgccgagcgcgggggcgagcacgcgaggctcagcgagcaacaggcgaaagggttccgtcggaccgtctaccgtggagccgtgaccgatgccgcgctaggaatggctgccaaggtcatgccaagcattggctccctgcttcagggcacggatgacctgcagcagctctcggtcagctatccgaagagcccgctcaacgaggaccatctctcgggagtggcccatctccttcaacgcggtccgaagccgggcgagcgggcgcccgatgcggaagtgacccaggacggccggacgacctcgctgttcccgttcctctacaacccggatgggcggacgacgggctgggcgctgctgtgcttcgacggacggtccccggaagctggcgcctcgctgcgcgccgccatcgaggctgtcgcaccctgggaatgggtgcgtccgcgcctcgtcctctccggccctgccatcgcagccgccgacgtacccgtgctgtcggacctcgacggcaaggcgcacggcgcctacggcctggacggtcagcctgccctcgtcctggtccgacccgacggacacatcgccttccgcgacgccgcggaaagtcccgaccgcgtggctgcgtactgtcggcgggtcttcgccgccgaggaccagccgtcaggctga

SEQ ID NO: 8709 - DNA, 1476 bp, Methylobacterium sp.
atgacgaactcgatcagcgcgcgcctgcgagaggcgatcgcgcagcatgcgcaggccggccggacggccatcgccgggcctgaagccgtcacctacgccgaactgggtcggctgatcgacggctacgccgcgggcatcagcgattggggcatagagcgcggcgtcaagctcggcctcatcgcgccgaagagcatcgccgcgatcgccgcctatttcggcgcgatgcaggcaggcgcctgcgtttgtttcatcgagcccggactcgcgcccgaggtcgtcgccgagcaggcggaggccgtcggcatgcgccacctcgtcgtcgatgaaagtctgaccgaccgcttcgccaatcgatcgccccgttacccttcggtgcagggtttgaacaccctgaacggcggcggcgctttcatggacgacggcctaagcagcgacgacagcgcgatgctgctgttcacctcgggcagcacgggccgcccgaagggcgtcgtcctgcgtcacggcagcctgatctgcaatgcggacggggtcctacgccacaccggcacgaacccgcgggaccgcctcctccacgtcatgccgctctaccatacgaacggcgtcaacaatcaactgatcgttccctttctggccggcgccagcctgatcctccacgaccgcttcaagccggagaccgtcatcgaatcgctgcggaacgacgggccgacctacatgaccggcgtaccgacgatctacgcccggatgctcccgcatctcgaatccggcgaacggtttccgacgctccgcttcctccgctgcggctcggcaccgatcacgccaacgcttcaccagcagatcgaggcggctttcggcgtaccgctgctcgtctcctacggcctgtcggaagcgacctgcacctcgacgatgaacccgcccgagcatcgcaagattggtacgatcggcacggtgctgtccggccagaccgtccgcttgttcgatcctgtcaccaacgttgaggcggcgcagggaagcgagggcgagatccggatctcggggcccgccctcatggccggatatctcggaagcacggagcagccgatcgtcgacggctggctgcggacgggcgacctcgggcggttcgacgcggacggcttcctgtctatcacgggtcgcataaaggatgtgatcatccgcggcggcgagaacatctcgcccgccctgatcgagcgtcacctgacgacccatccggccatccgcgactgttgcgtggtgggtgcaccggacgccgatctcggcgaggtgccgatcgccttcgtggttctgaaggagggggaacgacttgacgagcccgctctcaaggcgttcgtgaagggctctctcgcgcgcatctacgtccctgccgagatccggggcattaatgtgttgccaacgaacagcgttggtaagaccgaccgaaaggcgctgcggaccgttttggcgatcgaacctcatcgctaa

SEQ ID NO: 8710 - DNA, 2802 bp, Methylobacterium sp.
atggcgaataacatcgcgatccgcatccaggccgagggcggcgccgagctacggcgcgatttcgaggaggcaggccgcgccggtcaggacgctttccggcaggtcggcacggcggccgatcaggcgagcgcggccacagatcgcctgacgcagaagacgcagactgcggccgatgctgcgcgacgcgcgtccacggctgcgggaggcgccagcggccagccgtcgccgagcgcggccaccttgcgcgaggtcgaacgggtccggtctcgcctcgatgaagaattcagaaattcgcgccagttggagcgtgatcttgcagtcatcgagcgcggcacggcctcgggcagcctgtcggcggactatgcagcgcggctgcgcgggctggccgagacgcgctacggcgggcccggcaacgacaacgacccgacgcgccgtggactcgacgccaatcagcgtcgggatctggcgtaccaaactggcgacgttgttgcgtcgctcggatctggcgcaggacttggcacggtcgcatttcagcagggtccgcagatcctgcagggtctcgccactggcgaaggcggcctgtccggagggctgaaggcgctggggcagagtgccctcagcctcgtcacgccgctgaccgttaccgcaacggcggtcacggctctcggcggcgccttcctctatgccggcacccaggccgacaaggatagagaggtgctggagcgggcgacgcagggcatcggccgcatgaccggcgccacgacaagccagcttgatgcactcgcgaaggccaacgcggaggcgggcaaagtctcgacctcgaccgcccgcgagatcgttgccggctacgcctctaccggccagatcgcacttccgctcatcgccgacctgacgcgcgtgacgtcggactatgcgcgcctgcttcagatcgatgtagcggcggcaacctctgaactcgcacgcatgttctcagaccctgcggcgggcgctgacgagttggcgaagcgcatcggcggcctcgacgaccgcacccggcagttcatccagacccagatggagcagggcgaccgctccggcgcgcaggcgacagcggctgactacctgcgcagcacgatcgaggcgaacacctctgctacaacgggctgggctgctgcctgggaccgggcgaaggccgcagccgacgggtactgggaagccgccaaacgcatcgccggcatcaagctcggcatcgtgccggagggtgcgcaggaggcggttgatcggctcaacagtgagatcgagaaaactaaccggatccggcagttcagcggcctgcagcctctcggcctgggcgacaagcaggtccgcgagcgggacgccgccgccatcatcgccgacactcaacgccgcgaggccgaggctaaggccgcagaggagcgggcgagctcggcatctaggatagcgggcgacattgctcggagcatcgacccgcagaccgcggcctacagccggctccggaagcagcagagcgaccttcgggacgcgctcgccgacccgctcgcccggaacaagctcgccgacttcgaccagacggagaccgcctaccgcgccaccacccgcgcgatcgagagcctgaccgacgccaacggcaagctgatttcttccgaggagatggtgcgccggcaggaccagcttcggttggacgctgtgaaggccaagaccgccgccgagaaggccgatgtggccgagcggcagaaggcgctcgatctcgtcggcaagacgatcaccggcagcgatgcgcgcgggcagatcgagcgtgccggcatcctggcgcgggcagaagccgactcgaagaaggacgggtccgacaaagacaagcgcgacgacttcgaccgggccctgcgctcagccgaggaccggacccggcgcctcgaggagcagggcgcgacctacggcatgggtgccgaggcgatcgagcgctaccgggtgcagacggaattgctgactgccgcccagcgcgccggccgggaggtgacgccagagctgacgcgtcagatcgaggagtacgcgaacaaggccggcgacgccgccaagcggaacgaggaggtgcgcgagaacctgcgcgacaccgatagcctgcgcggtgtcggctccgacggcgtccggtccctggtgcgggatctcggcgacgcccggagcggtgcggacgtcctcgggaatgcccttagccgtgtgaagcaacgcgtgctcgacctcgcgtccgacagcgtcgcggagatgctgttcggcaagcgcggctcggccggttccggtctgttcggcggcggcggcggcgtcggcagcctgatctctggcctgttcggcggtggcggtggcgactcgcccaccggcggcgtgcgtctcttcgacgttggcggcttcacaggccacggcgagcgatacgacgtggccggtctcgtccaccgtggcgaggtggtgttctcgcaggacgatgttgcccggcacggcggcgttgctgcggtcgagatcctgcgccggagcggcgggctcaggggctatgccgacggcggctatgtcggacgcgacgccttcaccatgccgagcgccgcagcgatgcggccggccaacgtcaacggtgctccgccgatcaacttcatcaccccacccggtgtcgcgctcgagcgagatgggccgccgcagcgccgcgccgacggcggctatgaccaggccatccgtgtggtcgagggcggcctcgggcaacggatggcacgcggacagggcccgttccgcggtgtgagcggcgccggctatcggaacggctga

SEQ ID NO: 8711 - DNA, 1164 bp, Methylobacterium sp.
ttgcgaccgctttccggtatccgggtcatcgagttctgcagcgtcgctgccggtccgttctgcgccatgctcctcgccgacatgggcgcggacgtcatcaaggtggagcacccggacggtggcgacaccatgcgggcctggcccccgatcagcgagggctacagcgagaacttcgcctcgctgaaccgcaacaagcgctcggtcacgctcgacctcaaggattcggccggcaacgcgcaggcccgggacctcatccgctccgccgacatcgtgctggaaaacaatcgccccggcgtcatgcagcgtctcggtctcgactatgcgaccgtcagcgccgaccggcccgccctcgtctactgctcgatctcggcttacgggcaggaggggccgcgctcgacggaagccggtttcgacctaaccctgcaggcgatgagcggcgtgatgagcgtgaccggcgagcccggtgcaccgccggtcaagtgcggcgtgccgatctcggatttcggcaccgggctctacgcggcctacgccattgcggccgccttgctggaggcacgcgccaccggccggggcgtgcatatcgacgcctcgatgttcggcgcctcgctggcgatgggcgcgctccaaaccagcgagttttttggcagcggtcgcgatcctcgtcgcctcggctccgcgcacccgcgcaacgccccctaccaagcctttcgcgccaaggacggctacttcgcgatggcggccggcaacaacgcgctctatcgctcggcctgcgacgcgatcgagcgcccggacctgtacgaggacccgcgctttgcctcgactctcctgcgagcgcagaaccagggcgagctcctcgagatcctggagacgctcttcgcggacttcacctgcgaggagcttctcgcgcgcttccgcgcagccggcgtgccctgctcgccgatcaacagctactccgaggccctcgccgacccgcaggtcgcgcatatgggctgggtgcagccggtgaggctgccgtcgggcgtggagacgcgcaccttcatctctcccttgcggttctccggcgagggattcccgatctaccgggacccgccggctctcggtgagcacaacgaggaagtgttcggagccgaacagccggcggccgccctggcccggacggcttga

SEQ ID NO: 8712 - DNA, 744 bp, Methylobacterium sp.
atgagcgagcttctcgtcgagcgcgatggcacgaccctgatcctcacactgaaccggccggacaagatgaacgctctctcggccactttggtcgaggccctgctcgaacaggtcgccgaggccggccacaccggcatccgcctgctcgtcctcaagggcaacggccgcaacttcagcgccgggttcgatttcggcggctacgaggatcagtccgagggcgatctggttctgcgcttcgttctcgtcgagcaattgctgcaggccgtccgtcacgcgcccttcgagacgatggcgctggcgcaggggcgcaacttcggcgccggcgtcgatctgatctgctcctgcgggcgccgcatcggtgatctagacgcgaccttccgaatgccggggctcgctttcggcctcgtgctcggcacccgccgctacgccgagcgcgtcggcgaagcccgcgcccgtgcggtcctcggcgacggcctcgtcttcgacgtcgacgaggcgctgcaggacggcttcctgacaggccgcgtccccatcacggaatggccggaggccgtcgcgaacgccgtcgaggcggcctgccggctctcgcccgaagcggccgcggccctctacggcgcgaccacggccgacacgcgggcgcaggacctcgccgacctcgtcacctccgccgcccgtccggggctcaaggagcgcatcggcgcctaccgcgcccaaacatcgtcgcatcgggagaaacgcccgtga

SEQ ID NO: 8713 - DNA, 828 bp, Methylobacterium sp.
gtgagtctcggcacaccgaaaattgtccccctcgaagatctcgccgcccgcgtggccgacggcagctcgctcgccctcggcggcagcttcctgcaccgcggccccttcgccctcgtgcgcgagctgatccgccaggggcgcagggacctggaggtcatcaagcaatcccccggctacgatatcgacatcctctgccgcgccggggcgctcggccgggcgcgcgccggtatcgtcgcgatggagggcaatttcggtctcgcaccgtggtatcggcgcgcggtcgagaccgggcagatccgcctggaggagcacgcctgcgccagcctcaccgcgggcctgcgcgcggcggccttcggcgtgccctttatgccctgcggcgggattcacggctccgatctgcccgccctgaacggttggaagacggtcgaggatccctacgggagcggcgagacggtctacgtcatcccgcggatcaccccggacttcgccgtcatccacgttaacgaggtcagcgaggagggcgacgtgcgcgtttacggcacatcgcactgggatcgcatcatgagccggtcggccaagcgcgtcctcgtcgtcgccgagcgcgtcgcgtcgagcgcgtcgttccgcgaacagccggagctgaccctcgtgccccatttcctcgtcgaggccgtcagcatcgtccccgacggagcctggcccggctcatgctggccgcactacgcggtcgattacccggcggtcgaggcctacatggacgacgcccccggcgtgctccaggcccatctcgacgcggcgcccgaggcgcgggaggcggccgatgtctga

SEQ ID NO: 8714 - DNA, 732 bp, Methylobacterium sp.
atgtctgagtggtcccccttctcctacgtcgtgacgaacctcgcccgcttcgtgcgagcgaacgagatcaccttcagcggcgtcaactcggccctgccgatgctggcctgcctgctggccaagcgcgcatacccgtttgctttcacctacatcaacgtggcgggcggcgtggatccgagcccgtcgatggttccgatctcctcctccgacccggtgctggcggaaggctcccgctcgatcttcgccaacgaggacttctacgacctctgcacccgcgggcagatggacctttgcttcctcggcgcggcccaggtcgacgggctcggacgcaccaacgtctcctgcatcggcgattggcacgccccgaaggtgcgcctgccgggcggcgggggcggcgcggtgatgctaccgaccgcccgccgggcggtgacgtggcgaaccgagcactcgcgccggaccttggtcgaaacgctggatttcgtcaccgcttccggtggcatgcacggcgtggtgacgccaatcgccgtcttcacgaaacgcgacgggcgcctcgtcctggcctcctggcatccggaggcaagtctcgacgaagtgcgggatcggaccgggttccgcttcgaggccgacggcgcggagccgacgccgcctccgactccggccgaagcggaggcactcgccgctctcgaccacgacgcccggttcgaacgcgatgcggcgatccgcctgcgctga

SEQ ID NO: 8715 - DNA, 489 bp, Methylobacterium sp.
atgcgtgcactcattctcgcgatcaccaccggcatcctcgtggcgggcgccgcgtatgctcacggcctcagctccgagccccccgcccagcagaccgccggcatcctcacctgtgtgaccaagcccgaggccactctcgtgttcggccggacgcctgtcgcggactgcaccttcgtggccgagcgtggcggcttccggcagagctatctcgccgtcttctcccgtgcggcgacgctggcggagttggagaccacgcagagggtggcgtggcgggtgatgaccaaggacggcttcgcccggccggggatgctcgcggacgacttcacggcaccgcaggagcaggccaccgatcggcccacgctgttcggtcgcacggccagccttcagttcctcagccactccggacaatcgagtgcgaagttcgccctggctcagcctcgggtccagctcgcggcggctcggcagggcaggacgcgcggaggaaagtag

SEQ ID NO: 8716 - DNA, 1092 bp, Methylobacterium sp.
gtggtgtggtttctcatcctgctcggcgcggtctcgggctgggcgacggcgggcgggcgccgcacgctgtccgcgttctggcgcgacctgtccggcttcgatccgctgccgctcgccgcctatctcgggctgatcacgctcgccctgctcgccttttacgcgctccacccctggtttgcccgccgccgcgtgcgggccctgatggggccgccgggcggcgacggtcgcgatccgggtcccgtgccggtgggctaccggctcgacggcgccgggctgacccagaccgcgccggatctcacgagcttcgtgccctggccgcgcatcggcgcgctcggggaggaccggcaccacctcttcctgccgacggagatcggcgaggtcccgatcgtcctgcccaaggcgtctctgagcccggagacgatcgcgggcatccggcgctgggtccaggcctgcgccggccgacccgctcccgcactgccgccgaccgaaccggccgccgggccagaggcagtgcgcgcgacgatgcgcctgacggccgacgaacgggtgccgctcatcctgcgcagcctcggcaatccctgggcccgccgcgcccggctcaccggcgccgccgcgtggctcgtcggcctgaccctgctctatccggccctgctggcgatgctctgggcggtcgatccctaccgggtgccgctcgccgacgcgctgccgctcttcgccgagatggtggcaagcgacgtctggaagcccgccgccttcgccgcggcggtgatcgtggggttcttcgcggtccatccccgcgcgagccgctggttcgccggcgatctcgcccggcagctcgaggccgaggcgccgcccggcgaggccgagatcgtgttcgacgaatccggcatcaccaccgcgaaggacggcgcccgcgcgcatctcggctggccgctgttccgcgggcgcgagcggatcggcgacctgatgatcctgccgatgcgctgggacgaggtgctgcccgtgccactgcggatcttcgagccggaggcacgcgcccgcgtcgaggctctcgccgaacgccacatctcagcggagacacgcgcccgatga

SEQ ID NO: 8717 - DNA, 675 bp, Methylobacterium sp.
atgaccgatgcgtccgcccaccgcctgcgcgcggcccttctcgcctcctgcctgttggccggcttatccgccttcaccccggcccgggccgaagagatgccggactcgaccgaggaaccggcaccggatgtgagcacggacccggcggataccccggcggacccgatcaccctgcgcctggatcagggcttccggctcgatctgccgccgggctgggtgctggaggaggcgggcggggatcccggtgatgcctccggacggcgcgtggtgcgaatcgtgtgcgagaccccggcctgcgcccgcacgcgggaggcctgcacgcttcgcctgcgcccgaaggcggtcgagggcgaggacgacgacgcccgcctcgccggcctccacgccacgccgctctcccgctatgtccgcctgcgcgcggtcctgaagagcacgagcgcgggcgcctcgatccgcaggccgctcgggccggagcgattcggcgcccgcgattggatcgcggtcgagaccgaggcggcgccgcgcttcaaatcgggcctgttcgccgagacggtggtcgacggccgctatctcggagcgatctgcaagacctgcgagaccggcgcggtccggcacgaagcggcccggtccattctcgccagcgtgcggcgggtcgagcgctcggccgcacgctga

SEQ ID NO: 8718 - DNA, 717 bp, Methylobacterium sp.
atgccacgaggccagttcggcaagggctacaacaccgcccaggccacgccgcagcacaactccgtcatcgcgaaggatgagccgatcccggctgagcgccggaacaagaccccgaacctctacgccgcggcggtgcgctggtacgtctgcacgacggcgccgagccgggagctatcggcagcggccagcatcaagcgcgccatgcttcgcggcgccagggaggacgagaccccgttcatcccctacgtgccctgcgagtacctgtggcggcgatcggtgcgctcgaacctgcgggtgccgcggcgtgagcagcagcggccggccatgcggtcctacctcttcctcggcgtcttgggcggcttgtgcgacgcgacgttggcagagctgcgcgagcgggacatcgacggccgcaacatgcacgggctgtccggcatcctcggttcggccaaccgtggccctctcgccatgaacccggccggcctgcgctggctccggaagtggggcgaggacgagttggcagggcgcacgaacctcacgccgctcgcgggcatgcaggcaggcgaggaggtacgggccggctcaggcctgttcagtggcttcgtcggcaagttcgtcggcacgtcggacggtggcgcggtcggcatcatctcgctggaggtgatgggcgcgccctttgactaccgcctgcccatcgaggatgtgcacagggcagcgtaa

SEQ ID NO: 8719 - DNA, 576 bp, Methylobacterium sp.
atgaggtggggactcgcctacgcggtcggattatcgcagcttctgttcctctccagtgcgccggtgcgcggcgaggtgttcacggatccctcgaccggcttctcggtgaccgtaccggccgggttcgccattggatctcggcgcaaagattccaatcatgaaatcctggttgatatcctcagccagaccgggcagccgcccgtcgcgggacgaagcgaagcactgtgtgctgcagggatcaggcggaacccgccgggggcggtttcttcgcaggcggagttgaacgcgctgccggcgcttcgcgagcgggtcgccgaagccaggacgatcctggcgggccagggcctgcagacggaaaccgtagagtcgatcaagagcagcgaatttgcggggtttgaagtcgtctcggtcccgacttcagggtcggaccaccgaaatgtccgcatctacatggcgatcatggatcgtgtgatcggttggatcgacatcgtgtgcgcgacaacgaagcaggcactacccgacgcccttccgatttttcgcgcgatacgcgacggcacgcgcccgcccacacggtag

SEQ ID NO: 8720 - DNA, 297 bp, Methylobacterium sp.
gtggctgacgtcgttcgacggccccttgcgcgccaggatctcctcgacctgtgggactacatcgcagacagggatgagactgcagccgacggcgtcctcgatcggatcgaggctgtcctggcaatgctggctgacaatcccgaggccggacggcttcgggccgagttgtcggacgacctgcggagcttcccggtgggaagctccgtgctgttctactgtccgagacagtccgggattgaactcatccgcgtcctcagcgggtaccgcgatatcgggcgcgaggacttcgacacgtga

SEQ ID NO: 8721 - DNA, 726 bp, Methylobacterium sp.
atggccggcatcagcgacaaaattatcctcatcaccggtgcttcgagcggcatcggtgaggccaccgtccgcgagctcgcccaggtcggcgcacagctcttcatcggcgcacgccggaccgacagactgaaggtactggccttggaattgggcgatcatgtcgcctggagcgcgctcgacgtgaccaatggcgccgacttcgaggcctttgcggcagcggccgaggcccggttcggacgcatagacgccctcgtgaacaacgcgggtgtgatgcccctctcccccctcgccgccctcaagcgcgaggagtggaggaggatggtcgacgtcaacatccacggtgttctgaacggcatcgccgctgtgctgccgcgctttgtcgcgcagcggtcaggacacatcctgaacgtcgcctctatcgcggcgcacatggtcgtgcccacgggcgcggtctactgcgcgacgaagtacgccgtctgggccatcaccgaagggctgagacaggagcacgacgacatcagggccaccgtcatttcgcccggcgttgtcgccaccgagcttggcagcgacatcaccgatccgcaggttgcggatgccctcaaggtctggaggcagaagtcgttgacccccgatgccatcgcgcgtgccattcgctacgccctggaacaacccgaaggtgtggacatcaacgaggtcatcgttcggccgacggccgccggcatgtag

SEQ ID NO: 8722 - DNA, 267 bp, Methylobacterium sp.
atggccgctccagaccgcaccgtcgccgactggatcgccgaggggctgaagacgatggccctgcactgctcctgcggacactatgcgacggtgacgctggccgatctcccgccaaccctgacccgcacccggctcggccagaaagcccgctgcgccgagtgcggcaagcggggcgcccaggtgatgcgggacatgaaggcgcactacgccgggctcgaggcgaccggctggagctgcgagccgaagccgtggccagccaggtcatga

SEQ ID NO: 8723 - DNA, 507 bp, Methylobacterium sp.
atgtgcgcgccgttcagccaggccgatcagcccgagcctgccatctcgtctctcgacctcgctgatgcggtcgagcatctgcatctcgcggctcaggtctacggcgagatggtgcgcaaggtcgccatcgatgacgccaccagcgcgcagctcggcccgcgcgggtcgcagagtgcgaatatggcacggctgcgcctcgaggaggcgatgatcggcctccgcgccacctgccgcaacgcgctggcttccacctccggcacctatgccagcgagagcgacctcgcggaggcgcagtcgcagcggatccagcagaacgaccgcaacatcacccgcaccgcgatgcgccgggtcgacacggtcgaagccgccgagcgctcgctgctggaccgggcgcacgccgtcggcgccgaactctcccgcctcgacgccgctcacccctacggcaagagcgcagcgcccgcccacggctcgcacgaggccggcttcgtctctcccgctgcggcctga

SEQ ID NO: 8724 - DNA, 402 bp, Methylobacterium sp.
atggccgccgccagcaagttccccgcgctcggccacatgcccgagcgtatccgcgcagcaaagcgcgtgcacgtcgagtcgtcggactttctgtccgactggtgggtcggctacggcaaagaccatagctgccagatcgagggcacggccaaccactggaattggctggctctcatcatcctcggtctcgctgacccggcggaagccccctacgacgaggacaagccgctcccggtcgacccggccgaggtccgcgcctcgctctcggctatgaccgcagctcgcaaggctctgctcgccgtccgcgacgcctgccgcgatcccgacaccgacacggctctcccgatcgccaccggcgaactcgtcgaggctgcccttgctgcgatgggggagcggtcgtga

SEQ ID NO: 8725 - DNA, 1224 bp, Methylobacterium sp.
atggcgttcgtccacaccgacccaccgccgccgacttggcgtctcacggcctggctgaccacctcgcccgcgcaggttcctccggacgtgctcaccatcctgcgtgggcgcctcgtcgtcggaggcgcccccctgatcgtggccgccctcgtcggcgctgcgctggccagtctcgccatccttcgcgttcccacgccagccatgctcgcgtggttctgcgccgacctcgccctcaccctcgtgcgtctcacgaccatgctggtgatgaggcacaccctccgcaactcgggtcagcggtcgggagagtggcttccgctcacagatctgtacgtgctcagctccttgctctggtgcgctcagattggctgcggcgtcggcctctgcatggcctcggccgaccccgtgctggttccgttcgcctgccttgtcacgaccggactggtgggtgggttggccgcccgcaatcccggcgcaccgcgcatgaccctggtacagatgatcagcgttgtcgtgcccttcacggccggtgcggtttcggacggccagccatggttcttactcctttgggcactggcgccgctctacctcgtagcggtcgcggccgtgaaccgacggctgcatgccgactacgtggcgctgctgtgcgcagagcgggcactgcgtcaccaagcactccactgtgggctcaccggccttcccaaccgtaccttcttcaatcaagtcctgaccgccgtaccatccggtcggaagaatgaggagcatgcggtagccctactctacctcgacttggacggcttcaagctcgtgaacgatacctacgggcacgcggcgggtgacgtcgtcttgcagcaggtcgcgatccgcttgcgccacgtagtcatggtcaccgacgtgatcgcacgtcttggaggagacgaattcgcggtgttgctgaccggtcggcgggtcgcctctgccgagagggtggctcgctcgatcatcgcggccgtgggtctgccctacgacttaggtcaaggaacgatcgccagcatcggagtcagcgttggtatcgcagagtgcgactcgggcctcaccgaccgccatgcgctcctagtgcgcgcggatcgggctctgtacacagccaaacagcggggcaagggtaccttccaccacgcctgccccgtccgaggcgatgatggccgcacggcatgggcaatagcggagtgtgaagcctccaagcggtga

SEQ ID NO: 8726 - DNA, 1392 bp, Methylobacterium sp.
atgaccgcgatcaacggacgcgatctcatcgcctggggcttccagcccggcgaatggttcaagcgggcggtttccattgccaacgccatgcgcctcgagggcagtgacgacgcggggatccgcgcgcacctgaccaccctcgacccggccgcccacgcggtcccgatgcgcacgaacagcctcgacttcggcgtcttcctcgacgccgagacggaggccgagcgggcgaacgcggcggccgtgatcgcgcatatggacgcgctgatgcgggtgccgaccatcgtcaagggcgcggtgatgccggatgcctgcccttcggggctggcagagggcacgatccccgtgggtggcgcggtggcctgcgaggatgcgatccatccgggcttccactcggccgacatctgctgctcggtggcgatcacggtgttccgacgggccgacgacccgaagcgtgtgctcgacgcgatgcaggcggtcacgcatttcggccctggtggccgcaagggcgtggtccaaccgccggacgcggtgatggcgggggtggcgggcaaccggttcctcgccgagttcgcgggcatggcggtcggccacttcgcgagccagggcgatggcaatcacttcgcctatgtcgggcacctcgcgtcgacggggcaggtggcgctcgtcacccatcacggctcgcgggggctcggggcgcagctcttcaagaagggcatggcggtcgcgcgccgccacacgtcgatcgtcgccccgcgggttccggcgcacaatgcctggatcaaggcggaatccgacgacggccgggcctattgggaggcgctgcagatcgtgcgggactggaccaaggccagccacttcgcgctccacgacctcgtggcgcgcaaggtgggcaacgccgtcgcggaccggttctggaacgagcacaacttcgtctttcgccgcgacgacgggctctactatcacggcaagggggcgaccccgtcgtggaaggggttctcggccgacgatgacgggcgcacgctgatcccgctcaacatggccgagccgatcctgatcacccgtcaccgcgaccacgcggcttcgctcggcttcgccccgcatggggcgggccgcaacatgagccggacggccttcctacgggagcacgcgcccgccctgcccgagggcatcgacgtgcgcttcttctgcgggcggtccgacctctcggagttgccgggcgcctacaaggatgcgggcagcgtccgagcccagatcgccaagtacgatctggccgagatcgtcgacacggtggagccctacggctgcatcatggcgggcgactgggaggccgaggcgccgtggcggaagaaggcggtggcaaagtgggcagcgaagatggcccaaggccagtga

SEQ ID NO: 8727 - DNA, 549 bp, Methylobacterium sp.
atgcacgcggtccatgaactcccgcccatcaccgtcacaaccctcgacttcgaccggctcgtggccttcggcctcgacgcctacctgcgtggcgaccgccgcgccgacttcctgctgtcggaactgaagcgggcgaccctgtgcccgccgcgcgcactgccgggcgaggtcgtctcggtccaccgctgggtgcactaccggctcgacgacgatccgaccgtgcgggggcaactcctcgtgcatcccctcgacctcacagacctgccggacgggctctcggtggcaagcccgctcggcacggcgctgctcggtctgcgcgtgggcgaccggatgcccttccgcatcgacggtaccggcacccggcacgtcgcgacggtcgagggcgtcggctggcgcctcatcgacgagccgatccccggccacgacgcactgacgaaggccgccctctccctctctgtggctgccgcaacgaaagctgcgtcatgcccggacggcctcggcgcacccggaatcgatctccgcgcgctcctttgcccggccttgggctga

SEQ ID NO: 8728 - DNA, 228 bp, Methylobacterium sp.
atgaacgaactcacctatccggtcgtgatcaccccactcaccgccgacgatggcggcgggtttgctgccacggtgcccgacctgcccggatgcatgtccgatggggacaccccggaggaggcgcttcggaacgtgcgcgaggcgatcgatgcttggatcgagatggcacgcgaactcggccatggaatcccggagcccacgcacacgcccttacgcgccgtctgttga

SEQ ID NO: 8729 - DNA, 375 bp, Methylobacterium sp.
atgtcggccacccgatccttctggcgctcgctgctaacggtctttcagatcgtggcacttgtcgccttctcggtggcgggtgccgggcactcgcacgcggggacggcgcatgccggccatgccgcgtccgtgcatctggaatcggccggaccgcaggcgctcggtggcctggcagaccatgccgagccggtcggcgacaaggcggcatgcggtgcatgcagcccgtgctgctgtcacgcatcgttcctccgcctggacgccgctgccgtgacggtcgcgccgcagctcggccgaaccttatccggaaatccgacggtcgcgttcgagagcgtggcccgcgagatgccgtcggaaccccctcgaaccttcgcctga

SEQ ID NO: 8730 - DNA, 177 bp, Methylobacterium sp.
atgggtcacgggagcgctctcggtgcgatgatgcgaacggcgatcaggcggtggatcgtgtcggctttggccctgaccgttgccgcggcggctgtctggcacctgcgggatgcatgggcgcaggatgcctgcctcgatgcgggcggggcatggcgcgacggcgcctgccggcactga

SEQ ID NO: 8731 - DNA, 1353 bp, Methylobacterium sp.
atgcgggaggagttgaaggcactctacggagacgagcggcttccccgctacacgagctatccggccagcccgcattttaccgaggcggtcgacgcggcaacctatgccgggtggctgcgggctctcccggcggatgcgacagcctccctctatctgcacgtgccgttctgccgctcgatgtgctggtattgcgggtgccatacgcacatcacccggcacgccgcgccgattgccggttatctcgcgacgctccggcgcgaggtggacttggtgaccgggcatctccaccatcggccgctggtgcgtcacgtccatttcggcggcggcacacccactctcatcgcgcccgacgcgttccgcgcactcgtcgcgtttctccgtgatcggttccccttcgccgccgatgcggaaatcgccgtcgagatcgatccgcgcacgctcgcgcccgcaatgacgcgcgcgctcggtgcggccggcgtcacgcgggcgagcctcggcgttcagagcttcgaccctgtggtgcaggaggccatcggtcgccgccaggacttctccgtgacggaagctgccgtcaccgggctgagagcggccgggatccgcgggatcaatctcgacctgatctacggcctgccgcatcagagcgtcgaatcctgcatcgagacggtgcgtcaatgcctggcactccggcccgaccgtctcgcggtgttcggctatgcccacgtgcccggcttcaagaagcatcagcgccggatcgacgaagcgatgctgccgaatggggcagcccggcgggcgcaggcggacgcgatcgccgagacgctgacgcgggccggctaccggaggatcggcctcgatcactatgcccgtccggatgaccctttgacgatcgcctgcgtcgagggcgaactgcaccgcaatttccagggctacaccacggatgccagcgacgccctgatcggcttcggcgcttcggcgatcgggcggctgccccagggccacgtgcagaacgacacggtgcttcgcagctacgccgaacgcatcgaccgaggtgatttcgcttcactcaagggctacgcgctgacatgggatgaccggctacgggcgacgctgatcgagcggattatgtgcgatttcgccgttgatgtcgggcaggtctgccgatcccatggccaagaccccgacgtcctgctcgcctcccttccccggttgcgcattctcgcggatcacggtgtggtcaggctcgatggccacacgctgagcattccggaggatgccaagcccttcgtccgcaatgttgcggcgctcttcgacgcgcatctcgggacatccgccgccttgcacagccgggccgcgtga

SEQ ID NO: 8732 - DNA, 222 bp, Methylobacterium sp.
gtgaacactgcggactacgagcttgaagacaaccgctccggcaacttcaccgtgaggatcggccgagccgtggcgggctacgtgtccgaggatgccgagcatccagagctttggatcgttgaggatcaggacggccagttcatgggccggcaccgcagtcaggacgccggcgcggagttcctggccgcttggttcatcgcggaagagcaggattggtcatga

SEQ ID NO: 8733 - DNA, 420 bp, Methylobacterium sp.
ttgcggaaactgaggcctggagcctcgaccgatcttgtcgggctcggcctgctcgctggggcggccggcctcctcttcatcgctgtgagcgacatcgggtcggccctggccgacttctcggccggcgccgagccgatcacggtgtcgagccacgcacccgccgcccttcccgctgccatcggtctcggcgtcttcgcggctttgctgctgcggcgacgcgggacgccgcggggcgacacgcggctcatggcggcggccctcctgtgcattccgctgatgctcctgctaccgatcccgtacctgctcgtgtggcggagggtgctcaccgatcacggctacgagcaatgcgagacgggtgttgccggccggcgcgccctgtaccgctggtcccatcggacgtccgccagcctctgcctctga

SEQ ID NO: 8734 - DNA, 906 bp, Methylobacterium sp.
atgaccgatgcctcggaccggcgcctgacgatgcaggacccgcgcacgcagtacccgcagccgccgttcaagcgccagccgcaggacgcgctcggcctcgcgcaggagatgcagcccaagccggatcacggggagacgagctaccggggccacgggcgcctggccggacggaaggccctggtgacgggcgccgattccggcatcggacgggcggcggccatcgccttcgcccgggagggcgcagacgtggcgctcagcttcgtcgaggcggagatgccggacgcccaggaggtcgccaagctgatcgaggcggaaggacgtaaggcggtactgctgcccggcgacatcaccgacaaggcgttctgcgagacccttgtgaggaaggcggtgaccgacctcggcggcctcgacatcctggtcaacaacgccggcaagcagaccaaccagggggacatcggcgacatcacggacgagcagttcgaccggacgctcaagaccaacctctacgccatgttctggatcaccaaggcggccctgccgcacatgccggcgggtgcctccatcatcaacaccgcctcggtcgtggcctacaacccgccccagatcctggtcgactacgcgaccacgaaggccggcatcgtcgccttctcgaaggcgttggccaagcagcaggtggcgaagggcattcgcgtgaacgcggtggcgcccggtccgttctggacggcgttgcagccctcgggcggtcagccgcaggagaacgtcgagacgttcggctccgaggtgccgctcggccgacccggtcagcccgtcgagctggcgccggtcttcgtgttcctggcgagccaggaggcgagctacgtcaccggcgaggtctacggcgccaccggcggcaacggcaccgcttga

SEQ ID NO: 8735 - DNA, 249 bp, Methylobacterium sp.
atgcacgctgtcgttgggcgtcggacggtgctgcgcgacgatctgccgaccacggtggatgcgcgacgtgcagaggcgcagatcatcgccgaggcctatcgaactgcgcatcgcggcaatgaccatgccgcacttgtggctgccattgctgacgccttggacgacctcgcggctgccgagcagcgaatggaggtggtgcagcgtcaggtttcccacggctacgtgcgtggtacggcgggtacggcatga

SEQ ID NO: 8736 - DNA, 441 bp, Methylobacterium sp.
atggcgcggttcatctgtggtgcggatcgccaccaagtgatgctgttgccgaaccggttggacgactatgtgtccgaagacaatctggtgcgcgtcgtcgacctgttcgtagacgagcttgatctcacggccctgggctttgcgagcatgatgccggccgcgaccggacggcccgggtaccatcccgcgacgctgctgaagctctacctcggtggggagcagaccctacccctctgcccgagagcggacgttccgtttccgacccatgtcggtcgtcgatcgacctgctcggcccgcttggaagcggatgtagatactctcggctggaagataatccgctttgtgagagaatgcggcatcgcatgtcacactcgagttgcttggctcgtcatggcttcgaacgtcgatctccggcgctccgagcacaaggacgagacatga

SEQ ID NO: 8737 - DNA, 615 bp, Methylobacterium sp.
atgccgcgcctcctcgtcgtcgaaaccagcccacgcggcgagcactccatctcgcgagcgctcacccgccgcttcgtggcccgatggcaagccgcgaacctcgagggcgaggtggtcgagcgcgacctcatacggaccgagctgccgttcgtgaacgcgccctggctccaggcctacttcaccccgcccgagcggcattccgccgagatgcgggaggtgctccgcctctcggacgaactcgtcgccgagttgctgtccgccgaccacctcgtcatcgccacgccggtctacaactacaacgtccccgccgcgctcaaggcctgggtcgaccacgtggtgcgcaaggggctgaccctcggcgacgacggcaggggtctcgtcgtcggcaggaaggcgaccgtgctgctcgcctccggtggcgtctacacggaaggctcgccgatccgggaccgggacatcgcgaccggatacctgcgcctgatcctgggggtcctcggcatcacggacgtgagcttcgtcgcggcgggtggcgccaaggccgtcgatctcggcgaggtcggacgcgacacgttcctcgacgccctgcagtccgagatcgaggctcgggccgcctga

SEQ ID NO: 8738 - DNA, 5787 bp, Methylobacterium sp.
accggggcgcaggtcaccggcaccgagttcggcaatgtcggtctcatcaccggcggcgggggcggtacgggcggagccgtgggcgcgcaggatcccgcggcgggcctcgatgcggtcgtcctcgccgggagcggcggcaccggcggcaccggcctcctgctcgaaagcgctacccgcctcaccaacaccactctcggtcgcattgcgggcgggaccggcggcctcggcggcgcgggcgcggccggcggtgcgggcgggatcggcgtgctcgcccccgcaggtggcaccctgatcaatctcgggacgatcaccggcggtgccggagcctccggcgcgagcggcgccgcgggcagcgggggtctcggcgggacggcgatcgtcggcgccggcctcaccatcgtcaattccggcctcatcgccggtggcgccggcgccaccggccccgccgccgtggagacgggccgggccatcagtttcaccggcgggctgaacagcctgaccctaaccgcgacctcgcagatcgacggggcggtcgccgccttcagcgccggcgaccggctcatcctcggcggcgccagtgacggcaggttctccgccgcggcgatcggtgcgcagttccagaatttcggcgtgttccagaaggtcgatgccggcacgtggacgctcaccggcacgacgcccgcggcgaccccctggcaggttctcggcggaacgctggcggtcagcgcggatgccaatctcggcgcgccgtcgggcggaatcttgctgaacggcggaaccctgcaggccaccgccgcactctcgatcggccgcactttcaccctgggcgcggccggcggagcaatccgggcggaacccggcgtcgcgatgaccgcgagcggaccgctcgtcggcacgggcgggctgacgaagacgggactcggcaccctgaccctgaccggcgccaacagctataccggcgcgacgaggatcgaagccggcacgctggcgctggcgggctcgggtaccctcgccgcatcgagcggggtcgccctggccagcggcaccaccttcgacatcgccggactcggcaacggcgccgccatccggagcctcggcgacaccgccgcgggccaagccggcacggtggtgctcggcaccaaccgcctgaccctgacggacgcctccggcacgttctccggcgcgatcaccgggatcggcgacgtagtgctctccggcgggagccagaccctggcgggggtcagcaccttcagcggaacgacgaccgtgaccggcggcacgctgagcctcgcccccggcggttcgctggcctccccggtgacgacgcagaccggggggaacttcgccaatgcgggagcggtgggcggtggtctcaccaatgccggctccgcaaccaacgacggcaccatcgccgggccggtctccaacagcggcaacttcgtcaaccgcgccacggtgatagctcagggtcggatcacgggcccggtgataaatctcgccgggggcaccttcgccaataccgggacagtgaccggtagcctgggcaatgccggcgccgcgaccaacgacggtactatcaacggtcaggtctccaacggcggcagcttcgttaaccgcggcacggccggctcgctgacgagcacggcggggtcggcaaccaacaccggcacgctgaatggcgaggtaatcgtcaccggcggcagcctcgcgctcggccccggcagcctcgttaacggcgcgctgacgaacgctgccacggtgacggcgcaggggcggatcacggatttggtgacgaacggggtcggggcgagcttcacgctttccgggccgctcgccgacctcagcgccctgaccaatgccggctcggtgaccttggcaggcaacgctctcggcgccggcactgtgatgggcgagggcggcgtgatccagaacgccgccgccacggcggcgacgctgacgttggggtccggcaatgccacgcggatcgtgctgcaggacggtgcgggcggcggcgcgctgtccctggccaaggtcggccccggcattctgacgctgtcgggccccaacacctatagcggcggcacggcgctgaacggcggcaccctcctcgtgtcgagcgatgccagcctcggcgcggcgaccggcggcttgagcttcggcggcggcacgctcgcctccggcgcaagcttcaccaccggccgcgcgctcgccctcggcgcctcgggcggaacgctggcgccggacgggggcacgagtctcaccctgaccggcgtggtcggcggccccggcggcctcaccgtgggcggggccggccgcgtcgtcctgaccggcgccaacagctacggcggcgacacgcgggtgaatgccggcgcgaccctgcaagtcggcgacggcggcacggccggcacgatccccggcaatgtcgtggccaacggcacgctcacgctcaaccgttcggatcgcctggattttgccggcgtcatctccggctcaggggtcctgaaccagtcgggcgccggcatcacgacactgaccggcagcaacggcccggcggcccttttcaccggcacggccaacgtgaatgccgggacgctggcaatcaacggcaccttcggcgacaccgccggcaaccgcgcgagcgtcatcgtccagtccggcggcaccctgaacgggtccggcaccatcgccggttcggtgaccatcaacggcggcaccgtctcggccggcaattcgccgggcacgctgacggtcgccggcaactacaccctcaatcccggctcggcctccctgttcgagttcgggagcccaggcatcgtcggcggggcgagcaacgacctcatcaatgtcggcggcaatctcgggctcggcggcacgctcagcctcgtctcggcggccggcgctacggctccgccggtctcgggcgcctaccggctgttcaactacggcggcacggtctcgggcgcctttgccggcgtcacgacgccgggcgccggcaccagcgcgctcgtctacaccgacatcccgaatcaggtgaacgtgctcgtcaccaacggcaaccaatcggtgcagctctgggacggcgccgacaccaccggcgccgccgccggcgcccagggcggcgctggcacctggagcgcgggcggcaccaactggacgcgcctgcccggcgggcagatcaacgacctctggcgctccggcgtcggcctgttcggcggcagcgcaggcacggtgacggtggccgggacgcaggccgtgcagggcctgcaattcacgagcgaaggctaccgcctcgccgggccgggcgcgcttctcctgaccggcgatccgttctcgacgccgagccagagcttcgtcaccgtcgatgccggcgtctcggccaccatcgccacggggctgaacggaggggcggggatcggcctgcgcaagctcggatccggcacgctgacgctcgcgggcgccggcagctataccggcgcgacgacggtcgaggccggaaccctggcgctcgccgccggcggatcgctggcgggcccggtcacgacaggggccgggggccgcttcgccaatgcgggaaccgtgggcggcggcctcaccaatgccggctccacgaccaacgacggcaccatcaatggccccgccgccaacaatggcaccttcctcaaccgcggcaccgccggcgcactgacgagcgatgcgggcaccgtgaccaacaccggcacgctgaacggcgcggtgacaatcaacggcggcagcctcgcgctcggccccggcagcctcgtcaacggcgcgctgacgaacgccgccgcggtgacggcgcaagggcggatcgccgggccggtgacgaacgcggccggggcgagcttcacgctctccggcccgctcgccgacctcaccagcctgaccaatgccggcaccgtgagcctcgcgggcaacgcccttggcatcggcaccctgacggggcagggcggcgtgatccagaacggtgccgccaccgctgcgacgctgacgctcggcgccggcagcacggccggaaccgttctgcaggacggcgcgggtggcggcgcgctgtccctggcgaaggtcggggccggcacgctgacgctgacgggggccagccccttcagcggcggcaccacggtggtaggcggcaccctggcgctcggcgggccgggctcggccggcagcggcgccatcgccctcgagaccggcacccgcctcgccttcctcggcagcggctacacggtcgagaacgccatccgcctcgcgaatcccggcctcgcgacgatcgattccggtccgggcacgatcgccctgtccgggccgatctccgggcccggcagcctggagaaggctggcctcggcacgctggtggtgtccggaaccggcagctatgccggcgccaccgcggtcacggccggcatcctccaggtcgatggcgcactcactggctcgtcgatcctcacggtcgggccgggcgcgggcctgaccggaaccggccgcgtcggcgcgctcaccgtccagccggggggattcgtgacgccgggcaacgcggccaatcccaccggcacgctgacggcggaggggccggtggtgctcggggcgggctccaccctggcgacgaccctgtcgctgacggcggcgagccggctcgtcacgcccgccaccgcgacgatcgcctccgggggcatcctgcagatcacgccctcgacgctggcctacaccacgccggtgcggctgccgatcctggtggcgagcgcggggctgaccggccagttcaccaccgtcaccttcaccgcgccggtgcgggggttgcagccggtcgtcggctacgatgcgggcagcgcctacctccagttcggcgagaccgagcccggccgtccgaccgaaccggggccggacctgaccagcgcgatcgcgtcggcacaggggctggcgcgcgaccgcttcggcgccttcgtgacgcagcgcatcctcggcagcgtgctcaccggcttcaaccagcagatcagttgcggcgactgtttcagcggcttcggcatggccggctcctacagcgtcggagcgcagggccgcagggcgctcaccgacgagctgatcgccatcggcggcttcgcctataccggctacgacagcggccgggtccgcgtctccggcgggccgatcttcgccggcctgctgcgctacgatccggcgggcttgggctcggcgcggcccttcgtggatgtcggcggcctgttcgcgccgagccagaacacgagctacagccggggctacaccttcgggaccatggccggccagggcaccgggcgggtatcgaccctcggcggctcggtcttcggccgggtcggctacgtcgccaggctgtcgccgcaggacgaggtcgcggcagccgtcgagtatagccgcggctggcaatatgccggcgcctacaatgagggcctgctcgccccgaacccctacgccctggcgagccgcggcggcaccgacatcatcaatatcgccaagatcggcgggcagtacacgcgcctgttcggcgccgcgatcgaggcacaagccaatctcggcgtcgcccacggcttcggcctgaagagcggcctgaacgggacggtagcggatgtgccgttcacgaccccgatcaaggatctcacctgggtggagtacggggcacggatcagctaccgcctgcagcaggatctggcgctcgacggcttcatcctcggcacgctcgggccgcagccggtcggcgacaccatccacggcggcgcctcggtgcgctacgcgttctga

SEQ ID NO: 8739 - DNA, 717 bp, Methylobacterium sp.
atggactgccccgtgatgcgcctcgtcagacggatctgtttcgccggcctggccggcggcctcgcgctaagcctgccggcctcggcccagcagatcggtgcgacgacggtggtgaagaacgacgtgtcccgcctgaagggggcgcagaagaacagcctcgccgcgggcgatacggtgttccgcgacgaggcggtgcagaccggcgccgacagcctcgccaagatcgtcttcctcgaccagaccaatctctcgatcgggccgaacgcgcgcatcgccctcaaccagtacgtctattcggaggagcggccggcggggaaggtggcgctcaacctgttgaagggcacctaccgcttcgtgaccggcgacctcgacaagaaggcctatgagatcaagactcccgtcgcgacgatcggcgtccgcgggacggtgttcgacgtctggaccaccggcgcacgctcggtcatcaccctcaccgagggcgaggttcgggtctgcacccgcaaggcgagcccgcaggcctgcctcaccctcgaccagcccggcgccgtcgccatcgtgaccgccggcggcgtgacctccggcccgcccggctccgcgacgcgcttcggcttcaacggctattgcggcgccaatcccggcctgtgcacgccgacccgcttcgcggagggcggcggcgagccgcaaccggccgccttcgccgctctgtgcggacgctga

SEQ ID NO: 8740 - DNA, 765 bp, Methylobacterium sp.
atgaccgcctccccgcaggatcggcccggcccggtcgtcttcctcggcggcggccccggcctcgaagtcgcctacgccgcggatccgctgcggcgcgcgggcttcgcgcgggactgggccttcttcgaacagcccggatgcggcggcgggtccgaacccgccaccgcggacagcgtgctcgccgcggccgcccgcttcgtgaccgagcgggcggaggaggggccggtgacactcgtcgcccattcctggggggcgtggctcgccctcgcgctgctcgatcgcctgccgccagacacgatcgcccgtgccgtgctgctccacccgaccccgccgacccgtgccgggctcgacgcgagcgtggccgccctgttcgcccggctctcgcccgaggcgatgggccgggccgcgccgctgatggcgcgcaccgacccggaagccggccgcgccgtcatggcgatcctgctgccggcctattgcggccggcagaccgacctgccggcgctcgacctcgctctggtcccgccggtctatcacggcgtctcggccagcctcggcgatttcgatcagcgcggaatcgtggcggcgcgggcggaccgcctcaccttcgtcttcggcgaggccgatgtgttctcgcacgatctctacatggctcacggcggcgacctgacgggcctcgacgtcgccaccctgcccggcggccatttcggcttccttgaggatgtgaccggcttcgaagccatcctgcgccggcggggcgtgatctag

SEQ ID NO: 8741 - DNA, 231 bp, Methylobacterium sp.
atgaccttcgtgcgcgaccggttcgggcagctccgcgaggggcgcgtctatccgtgtagcgacggcgaagtcgcccggaaggtcgcggaggatcgcgtcgagcagggttgggcgcccggcgcggccgctttcctgcgccggggcggcggcgagttcgacgagggcgagacgattacccttgccgcgtttggcgatgtgccgcgcgaggtgcgggatcagatgcccttttaa

SEQ ID NO: 8742 - DNA, 225 bp, Methylobacterium sp.
atgatgacaacaagcacgaaacacacggatcggatcggaaggccggggcgccgcggcggcatcgggacgggagcggccggcgcgctgctcgcggcggggctggccacgagcctcgcgacggcgccggccgcgctggcgcagcagccctcaccggtgggcgagttcaacgaccagacccagccgcgcaccgatccccgcatcgccgagaagccggccgatccggtg

SEQ ID NO: 8743 - DNA, 135 bp, Methylobacterium sp.
atgtcgggggaggcgttcagcaggagccagcgttccccgtccggagagaccgcgatgctcgactgcgtgcgtggtttgaccctgggatcaccggcccaggccaaggagcagatggagcagcggcagttccactga

SEQ ID NO: 8744 - DNA, 1323 bp, Methylobacterium sp.
gtgagcacccctgcaaacgccccaggcgagcgctaccagctgtttcggcgcgccggcagcacccggtggcaggtgcgcttcagcatcaaaggccaggggcagttcaagcgctcgctcgacaccgatgacgagcgcgaggcagagcggcgagccgaggccatctggttcgaggctacctaccgcgccaagcaggggctcacggccaagacccacactttcgatagcgtggcggaggcgtacatcgcgcagatcctccgggaggtggagaggggcgaacgccgggcggatcagggaaagagcgagcccgccgtgattcgccgctacttcatcggctatttcggcgacaagccggttgacgcggtcaccgaggccgatttggagcgctacgcggaatggcggcgcacctactggacggagggccctggcaagctcgtcatgcacatcgagtacgagagggacggtcatcgccttcgacgccctgtacgacgctctgcgccgtccctgagccgccagcgcggtgagaccgtggtgctgcgtgggttgctgcgttgggcctcacggcagggctacatgaagaccccgccggagatcagcatcaaagcgcgtcgctcgcccgacaaccggcggccgagcttcgagccccacgagtttgcacggttggaggcggtgagcctcagccgcctcgtcgaccccatcatggacggcaccggtgcagaggtgcgggctagcgaccggcgcagctggcgcatcaaacgactggacgatcacacccggcgtgatcgcaccgtgctgcacgcctacgtgatgatcggcgcgttctcaggcctgcggcctactgagatgtacaacctgacctggggcgacgtgctgggctatcgcgctggcaggaaaaagagcgtggatgaacgggacatccggctgcaggtgcgcggtaagggcaagagcggcaaggccatcccgcagaaggcggcaatcccttggttcgacaccctatggatgctgttcgagcgcagccttggccgggaacccgctgattcggacccggtgtttgccagcgaccagggcaagcgaatcacctcggtggcgaacggcttcaccgaactgctgagggccgcgggtcttgagcgggaccatcgcggcatcaagcgcacgccgtactcgctgcgccacttctacatcagcgagcaactggcgaatggggctgaggtgctcgacgtggcacgaaactgccgcacgtccttgtcaatgatcgacaagcactacggccaagtgcggcttgagcgggtggtagaccggctacggccggagtggacacgcgcataa

SEQ ID NO: 8745 - DNA, 465 bp, Methylobacterium sp.
ttgttcaatctcgatccatggcaggctgcgatcggattgccgctggcggattatgccgaggcgatcctgccggccgaccgggaggagttcttcaccaacatcgatcgcgtgagcgagcatggcggattgttcgtcggcgagtatcgcgtgtgctcggcagcgagcggcgtacggtgggtgctggcgcgggggtactatgagcgcgatgacagtacgggcgacgtcgtcggacgcggcatcgtcgtcaacaccaccgagagcaagctgaaacggcccgtcggagatcgcgccttcttcatcctgcaccggaatgagccgccgctcgagcgcctcgcagcctgcgcgctccaggcccggcgcacaatcgatgaggtgggcgaacacgagaagccggcgctgcgtccggcggtcgatgccttgctgtgggcggtcgggcgtgtgctcgccaaacgggggtgcttctag

SEQ ID NO: 8746 - DNA, 264 bp, Methylobacterium sp.
gtgcaggtggcgtcgatcaccatccgcaacgtgcccgacgaggtgcaccgcgccctgcgcatccgcgccgcgcagcacgggcgcagcaccgaagccgagatccgcgccatcctggaacaggcggccaaaccggccggccggatgaagctcggctcgctcctgtcctccatcgctcgcgaggccggcggcctggccgacgccgaagcggacgccttcgatcggcttcgcgacagggcgccggccgaaccgatgcggttcgattga

SEQ ID NO: 8747 - DNA, 1620 bp, Methylobacterium sp.
ttgtcgctggctgcccgcgttgctctgctcggcagcctcttcgttctggtcgcgaccctcgcggtcggcggcaatctgctgctcgaagcacgcgccgtcatgcacgcccgggcggcggcttcattggatagctcgatgcgcctgctccgggccggcatggagcatgcggccggagaaaaaccggaccttaacgccgccgtcgatcgtgtcgagagcgtgaccggcgggaccgcgactgtcttcaccggcgaggtccgatccgccaccacggtgcgcaaggccgatggcagccgcgcggtcggcacccggctcgcccccggccccgtccacgacaccgtgctcggccgcggcgcgatctatcgcggcgaggcggacatcctcggcacgccgtacctgactctgtatgagccgatcctcggcgcggacggccatgtcaccggtatcctctatgtcggtctgaagcgggccgacgtgctggccgggctcgaccacatgacccgtcaggcggccctggtgggcggcggcatgatcgcggcggcgatggtcctgctctggctcgccatccgccgtaccctgcgtccgctcgacggattgggccggacgatgacccggctggctgagggcgatgttgcggccgaggtgcccggcctgaatcggcgtgacgagatcggcgccatggccgccgcggttcaggtgttcaaggagagcctgatccgcacccgcgaactcgaacgggaaggtgagaaggcccgcgccgcctccgaggacgagcgcaagcgggcgctcggcgccatcgccgaagggttcgagcaggcggtgggcggcatcgtcggcatggtggccgcctccgctacagagctgcaggtcacggccgagaccatggcggcgacggcgcgccagaccgcaacccgatccgggcacgtcgccggcgcggccgaggacgccgcctcgaatgtcggcaccgtggcggccgccgccgagcagctcggcgcctcggtgcaggagatcggccggcaggtctcgaactcgtccgacctcgccgcatgcgcagtcaccgaggcggatcggaccgcgatcctggttcatgaactcgatgccgtcgtgaaccggatcggcgacgtcgtcggcctgatcgcaaccatcgcgggacagaccaacctgctcgcgctcaatgcgaccatcgaggcggcgcgcgccggcgaggctggccgcggcttcgccgtggtcgcggccgaggtgaaggaactcgccaaccagacggcgcgggcaaccgaggagatctccggccagatcggccgcgtccagggagcgacgggccaagccgtcgccgcgatcggcggcatcaccgcccgtatccgcgagatcagcgaagtcgccaacgggatcgcggctgcggtcgaggagcagggtgcggcgacgcaggaaatcgtgcgcaacgtcgcccaggctgcgagcggcaccggcgccgtgacatcgaacattgccggcgtggcgcgagcctccgaggagaccggggccgccgccgcacaggtgctgtcctccgcctccgaattgtcgcgccaatccgagcatctcagcgccgaggtcactcgcttcctcggcaccgtgcgggcggcttga

SEQ ID NO: 8748 - DNA, 201 bp, Methylobacterium sp.
atggctgatctctcggctgcggtcgcgcagatgctgatcaagggcgaaggcgttcgccaggaggacagccccaacgtttgggtcgacgccatcctcgaccgctggcccgagatctcggccgacgagatcgagcgcggcttccgcatcgcgatcgagatccagcgggccgacgacattgcggagggacggacccatggctga

SEQ ID NO: 8749 - DNA, 630 bp, Methylobacterium sp.
atgttcgagaccgcgactgcgaccctggattggctggggctgatcgtcttcacgatcaccggtgccctggtggcctcccgcaaggagatggatttcgtcggcttcgccgtgctgggcaccgcgacgggaatcgggggcggaacgctccgcgacctgctgctcggagcgcccgtgttctggacgcagcggcccagcgctctcctggcgtgcctcggcatctcctgtgccgtcttcttctgcgcgcacatcccgcaatcccgctaccgcaccctggtccggctcgatgccctcggtctcgcgctcttcgcggtggccggcgccgaaaaggccatccaggccggggccggcagcgccgtggccgtcgtcatgggcgtggtgaccgcgaccttcggcggcgtgatccgcgatctcctcggaggcgacagcccggtgatcctcagccgggagatctacgcctcggcggcgggcgcgggtgcgctcacctacgtgtccctggccgcgctcggcgcgccgcgggaactcgccctcggctccggcttcctcgtcgccctgctcctgcgggcgctctccctccgcctgggatggacgctgccgcgatatcgtcctcgggctcgccgcccctattcttga

SEQ ID NO: 8750 - DNA, 732 bp, Methylobacterium sp.
atgccggccacccgccgctcccttctcctcgccgccgccctcttcgcaccgggtcgcgcgcacgccttcttctgggactccgccccggagcccaaggctccggaaccggtcgaaccggccgcgaaccgcgacgcgtggttcatcggcgagatcccggacgagcccttcaacgttccgatggtcgatctgaccctcgttccggcgcagtaccgccggcagatcgtggattacgacggcccggagcgcgccggcacgctggtcgtcgacacgcaccagcgcttcctcttcctcatccgcgaggaccggaccgccctgcgctacggcatcggggtgggccgggccggcttcacctggtcgggtgtcgcggtggtcaagcgcaaggcgaaatggccgggctggcgcccgacgccggccatgctgaagcggcggcccgacatcccgcgctacgtcgagcccggcatccacaacccgctcggctgccgcgcgctctacctctaccagggcgaccgcgacacgctctaccgcatccacggcaccaacgagccctggaccgtcggcggcaccgattcgtccggctgcatccgcctcctcaacgaggacatccacgacctctacggccgcgttccgctcggcacgacggtcgtcgtgaagaccgcgcaggcggaggtgatggtgcagcgcgagtgggacggcccctcccgctccgacaaccaggtgctgctcttccgctag

SEQ ID NO: 8751 - DNA, 132 bp, Methylobacterium sp.
atggctgtcgccctcgccgacggcgacttcatagtcactgaggacatcaacttggtctggctcacggacgagcaaggcaccatggtttggtccttgaggctagacgatgaagacgtagtgcccagagcatga

SEQ ID NO: 8752 - DNA, 759 bp, Methylobacterium sp.
atgaccgcgttcaaggatcacttctcgaccaacaatgccagctatgccgcgcaccgcccggcctacccgcccgccctggtggatttcctggcggacgcggcaccggaccgggacctcgcgctggatgtcggatgcggaacgggccagctctcggcgctcctcgcccgccggttcgcacaggtcgtcgccatcgatgccagtgccgggcagatcgcggcggcggcgccggttgagcgtgtgcgctaccatgtggctccggccgagcgttccggcctgccggattcgagcgccagcctcatcaccgtcgcgcaagccgcgcactggctcgacctcgcgccgttctacgacgaggtccgtcgcgccgcccggccgcgagcggtcctggctctcatcacctacggcgtgctccacctcgccgacgcggcggccgaccgggtcgtgcggcacttctacgaggacgtgatcgggcctttctggccgccggagcgcaagcatgtcgaggacggctatcgcgccttacccttccccttcgcggcactggagaccccggccctcgatatcgaggtgaggtggaggctcgcggacctgatcggctatgtcgagacgtggtcggcggtgcgggccgccgagacgtccgtcgggcgcggacccatcgagaggttccgtgctgatctcgctgcggcgtggggggagcctgacacgatcagggacgtgcgctggcctctgtcgctccgggtcgggcgggttcgggacacgtga

SEQ ID NO: 8753 - DNA, 108 bp, Methylobacterium sp.
atgagcaagtacaacgaagagcaggtgctgtcggtgcatcactggaccgacaccctcttctccttccgcacgacgcgcgatccctcgttccgcttccgcaacggcgag

SEQ ID NO: 8754 - DNA, 603 bp, Methylobacterium sp.
ttgtcgccgatctcagcgatacatgaggtttccgtgaagcaggcgcgtgttccaactgacgccgagttcaagcgcttggtggcggtggcaagtcagggtcggtacggggttcgcaaccggttggctcttatgctgagctatctcgccggcttgcgggtgggggagattgcatcgctccgttggggcgacctcctcgacggcgaggggaaggtgcgcgagcagctccggctcagcgcggccgtcaccaagggcgggcatgcccgggtggtgttcatgaacgcgaggctccgcaaggaggtcgagcagtaccgggcgagcctagcgaatccacctgccctgctgcagccagtgctggtcacccagaagcgctcggccttcagcgcgaatacgttgtgtcagcacatgagaggttggtacgatcaggctggcttggatggcggctccagccatagcggtcggcgctggttcatcacccgcctagcgcactccggtatatcgcccaaggcgatcatgatgctcgcagggcaccgacatctctcgacgacgcagcgctacatcgacgtcaatgatgaaatgatgcgcgctgccgtggaggtgctctga

SEQ ID NO: 8755 - DNA, 684 bp, Methylobacterium sp.
gtgaagcgcgcactgatcgtcggggcctcacgcgggctcggtctcgggctggtggcgcggttcctggcccgcggctgggacgtcaccgccaccgtgcggcggccctcgcaggccctcgccgacctgtccatggacgctcccctgcggatcgaggcgggcgtcgacatcgacgacgacggggccgtggccgatctgcggacgcggctggcggaggtgccggacttcgacctcgtcttcgtcgtggccggcatcgccacgcaggccggcacgcccgctttcctcctgtcgcgggaggtcgtcggcgcggtgttccagaccaatgcggtgagcccgatccgcttcgccgaggccttccatcgccgggtggcgccgggcgggctcatcgtgctgatgacctcgaagctcggctcggtctcgctgaaccgcggcggcggctggagcagctatcgggcgagcaaggcggcgctcaacaccctcgcacgctccttcgccggccagcacaaggaagcggattggggggtcgtgctcatgcatccgggctgggtgcgcacggatctcggcggacggcgcgccacccttgacgttgagacgagcgcgcgtggcatggtcggcgtgctggaggcacatctcggccagcgcggctgcgtctacctcgaccatgccggggagaaggtgccctggtga

SEQ ID NO: 8756 - DNA, 402 bp, Methylobacterium sp.
atgtccgagaccacgaacgccggcggaccggcgaccgaacccgactacgaccgcctgctgcgcgccaatctggagcgcgtcttcgacgaacgcgacgcgggcaagcgcgcggcggccctggccgagctcttcgtggacgagccggtcatgtacgaaccgaccggcatcgtgcaggggcaagccaccatcgcggcggtcgccggcaacctgctgaagcagttcgggccgacattccggttcacgcccatcgggacggcggtcgggcatcatggcctgggcgcgctgcggtggcaggccggcccggacggcgggccggtcgcggtgatcggaacggatgtggccgaggtcgtggacggcaggatcgcgcgtctctgggtgctgcgcgaccagccagccgcctga

SEQ ID NO: 8757 - DNA, 588 bp, Methylobacterium sp.
atgccgaaccctggccgcctgctcctcgcgcttctcgccttccttcccctctgccttggctgcgctcgggcgcaggggatcggctttgccgccgagcgcgccttcccggtggccggcgcctgctacggacggcgctacgacgcggaccatcttgcccgtcatccagggcaggtggtgagcgcgatccatctttcgggctcgtcccgcggcctgatcgggttgcgtccggaggccggccggatcgatccggaactcggtctgacgctgcgcatcgcctttaccgacgggggacgggccgagggcgagatcggctgcgccgaggctggcgggcgcatccgccgctgcggacgcggcgcgagctgcgccggcagcttcgccgtcgatcttctgcccgacgggcggctgcggatcgtcaacgacgacgcggattcgcgcatcgccgagccggtggtgggcgagcccggcttcagcccggatgcggtctgccggggaaagggccgcttcgtgccgccggatgcgcagaaccgtgtcttcctcctcacccgcctgcccctctccgcctgcgatccgaagcggaccggagattga

SEQ ID NO: 8758 - DNA, 570 bp, Methylobacterium sp.
atgcaacgcgcccccgacgatctgatctccctcagcgaggcggcccggcagatcggggtcaacaagagcacgctcagccggcaggtagcctcgggcgcgatccgctctcacagcggcaaggtccggctgtctgaggttttggccgaccgcgcggcgaacatcgacctgagcaatcccgctcgcgggccccgcgttgcacgcaacgatgcaacgcaacgctcggcggccagccaggacgatgacggggcagaggatttcgtagtggtcgacggcgtcgtgatgccgttcgctcaagcccaagcgatgaaggagacgtacctcgcgcgtctgcggaagctggagttcgagcagaagtccggcgctctggttgatggggagcgtgcacgcgccgaggtcttcgacattgcgcgggtcgaacgggatgcctgggtgaactggccttcgcgcgtagccccgctgatcgcggccgagatcggtgtcgatgcggtcgcattaggggtcgcgctggagcgccatgtccgagaacacctcgccgagcgagccgaacccagacttcgcctcgcgggctga

SEQ ID NO: 8759 - DNA, 570 bp, Methylobacterium sp.
atgaccgaactcgtctccggccggcggctcgctgccatcctcggtgtctcgccgaccgccgtgcgcaacgcgatccgtgacggccgtatcaccgcgcagcccgatggccggctcgatcccgatgccgtccggcgtgagtggaccgcttcgaccgacccatcccggagccgggtgcgcacgtcatcgagggtgcgcgagcagagtgcgcggcctgccacaggcccatcggtcccggacgaacctgctcagccgtcggcgttccagcttcaccgagcggacaaggaaggctggaccgcgcagctgcggcgcttggagtacgagcgcaaggcagggcggctcgtcgacgccgatgaggtgcacaccgcggtgttcagcctcgcccgcacagcccgcgaccgctggctgaactggccgaaccgcgtcgccgccatcatggcgcacgagatcgggattgatccggtgaccggcaaagccgacgccaactccgttgccatcgtgctcgaacggatggtgcgcgagcatctcacagagatgggcgaagagacgctgaacctgaggagatcacgatga

SEQ ID NO: 8760 - DNA, 297 bp, Methylobacterium sp.
atgtacgttcgcatgaaccgggcgttctccttcaaggacgagaacggcacgaagatcaccgcgccgcgcggctgggtcggaaacttgcccgacaaagccgcgaaggaggccgtcagcggcgggtacgccgtcgacggcaatcagcggtcggccacggtagtcgaaacgccggccccggccgatggcctcgacgccatgaccaagcccgagttggaagctctggccaaggaccgcggcctcgacgtctcggcggccaagaacaaggccgacctgatcgagacgctgcgcaaggcgtga

SEQ ID NO: 8761 - DNA, 1344 bp, Methylobacterium sp.
atgagcattgtcttgaacaaggcggcggcactgctcgcggggccggtctatggcggctaccaatatgcctacccgcacaagaccgcctatcggccgctgccgcacccggtgcccctgcgcgaggcctgggcggcggagccgaaggacggcttgttcctctacgtgcacgtgccgttctgcgcgatgcgctgcggcttctgcaatctgttcaccctgacccgcggcgagggccgggtcgcaccctatctcgacgccctgcggctccaggccgagacggtcgccgacagcctcggccggtttcgagtggcccgcatggcgctcggcggcggcaccccgaccttccttgaaccggccgacctcgaccgcctgctcgcggatctgcgcgacaccttcggcgccacgcccctggcggttccggcctcggtcgaaaccgcgcccggcaccaccacgccggagcggctcgccgtgctgcgggcgcacggggtcgagcggatcagcatcggcgtcgagtcgtttcgcgacgacgaggcgcgggcgatgggccggccgcaaagccggggcagcgtcgaggcggcgctcggcgcgatccgcgaggccggccttccggtcctcaacatcgacctgatctacggcgcgaccgggcagactcccgaaagcttcctcgaatccgtcgaggcggcgctcgcctggaagcccgaggaactcttcctctatcccctctacgtccggccgctgaccgggctcggacgacgcggaggcgccgccgaggacgaccgcgactgggacgcccgccgactcgcgatctaccgcgccgcccgcgaccggctgcgggaagcgggctacagccaggtctcgatgcggatgttccgccgggcgccggaggccgtgtggggcccggcctacgattgcgcccgcgacggcatggtggggctgggcgccggggcgcgctcctacaccgccgccctgcactacgcgaccgcctacgccgtggggcagccgggcgtcgccgccatcatcgccgactacaccgcccgcgacgccgagcgccacggccgggccgattacggcgcgtggctcgatgcggaggaccggcgccgccgcttcgtgctgatgcacctgctccaggccgccggcctgaagcggcacgcctacgcggcgcgcttcggcacggcgctcctcgacgacctgccggaactcgccgatctcgtggaggcggggctggccaccctcgacgccgatcgcctcaccctgaccgaggcgggcctggaacgctccgactcgatcggcccgtggcttcaggcggcgggcgtgcgcgagcgcatgcgcgcctacgcgctgcgctga

SEQ ID NO: 8762 - DNA, 240 bp, Methylobacterium sp.
ttgcctcgctactacttcgatatccatgaagacgccgtcgtcatcgacatcaacggccgggatctgcccgatcgcgccgccgcgcgggctgaggcgctggcgcgcggggccgccttcgccgccgatccgcagaagctcggcggctccggcgtcgtcgtcgtgacggtgcgcgacggacccgaccgcgcggtgatgcgcctgcgcctcgtcagtcagatcgaggacgtggcgggcggctga

SEQ ID NO: 8763 - DNA, 396 bp, Methylobacterium sp.
atgcgcgcgccctcatcccatcatcagggcgcgcgccgcctcgccgcccgcaacgtgccgatgcgcgagagtgcgatccaggccgccgttgtccagcactggcgcctgttcggccagccgcacactctggtggctgcgatcccgaacgaggcggccaagggtcaggcaggtctcaccaagggcttgccggacctgctcgtgatcggtggccgcgtccgcatcgccttccttgagctcaaggtgccgaccgggcgcctgagcctcgaacaaaagctgttccgcaacctctgcgccttcgtcgggatcgagttcgtcgccgcttatggccgggatgagccgatcgccgtgctcgagcgctgggggatcctgcggccgaacctgaacggtccggtctga

SEQ ID NO: 8764 - DNA, 435 bp, Methylobacterium sp.
atgaccaccgaaatcaccggtaggccgccgcgcatcatcgcgcttggcggacctgtgtcccgcgccgttgccgccatgcgccacgagcccgagcctgcgcgccgcggcttcctgcgtggcttgctgacgctcccgctcctcggaggagcggtgagcctaatcggcgcgccctcggctgtcgccgagcccgtcacgcctcgtctgctcgccacctacagcgattggctgcttctggagcgtcgcaggctccacatggcgctcttccccgatcccgccgagcgctcaactgcccgatcgttcctcatcgggccggataccgcagccaacgccttccacctgcctatggacgggcaagctgggtcgcccgaccccgctacccgcgccgcgctcgtgctgagcacggtcggctgcgattggcgggagggcggcctgtga

SEQ ID NO: 8765 - DNA, 441 bp, Methylobacterium sp.
atgatccgctgcgacgcccctgccttcgaggatgtcggcaccacgcggcggaagccgctcacggcgaagcagaagctcgacctctacgagtcacagaaggggatctgccccctctgcggcaagccgatgctgccgggcgacaagctcaccgatgagcacctgcgggcgctcgggctcggcggctcaaatgccttcgggaaccgggccatggtgcacaccaagccttgcgccgaggccaaaacccacgggcccgccggcgacctcgccacgatcgccaaggccaaggcgcagaagcgcgcctcgctcggcttcaagacgcagaagagccggccgctgcagggtgcgccattcccgaaggccgagccgcagcgccgggcctccaagcccctcgacaaaccccgccttcctccccgccaactctacgtggagcgccagtcgtga

SEQ ID NO: 8766 - DNA, 936 bp, Methylobacterium sp.
gtgggccccctcgatcagctcgacatgccgcgcaacgaggcggtgcatgcactgccggacgggctcgtctgccaccacatccaggcgcctgcgagccggctggaaacgctcggccacggcatcgtttgccgggaactcgtgctcgacggctcggccattgcgcggatcgacgacggcaacgcgatcacttaccgcctctccgcccgcgcctgccaccggctgaagaccctgccggcgaacttgcgcgccggcatcgtcgatctgcgcgactgccttgccctggaaactctgccgcccggcctgtcgccggccttcctcgacctcgaaggctgctcggcgctgaaggcgctgcccgacgatctctccttgcgcggcgggcggctcaatatccgcgattgtgccttgatcggcgccctgccgtcgcggggctcggttgccgcgctcgacatcgccggctgcgggcggatcgaccgcgtgccggagggcttccgcgtcacctcgtggatcgacgtcgccggttccggccttacggcgctgccgccgcacctgtccgggatcgggctgcgctggcgcggggtgccggtggatgcgcgcatcgccatccggccgcacgagctcggcattgcggagatcctgggtgagcgcaacgccgagcggcggcgggtgatgctggagcgcttcggctttgagaccttcatggaagcggccgaggcggaggagctcgaccgggaccgcgatcccggcggcgagcgccggctgctgcgcgtcgaactcgcgggcgacgagcccctcgtctgcgtctcggtcggctgcccctcgaccgggcggcgctacttcctgcgcgtcccgccgagcatgagaacctgccaccaggccgtggcctggaccgccggcttcgatgacccggccgactacgcgccgctggtcgagacctga

SEQ ID NO: 8767 - DNA, 927 bp, Methylobacterium sp.
atgccctacgagaacctgacgaccttcttcggcaagccggtcgaggatttccaaagcggaatggaggcgtgggacttcgagcgcgcggtgccgcgctttcgtgtcgagtacgattccgaggacagcgtcccggagatgctcggccattacgcggctttgcccggcgctgacgccaccgacgccctcgtcatcggctactggcagggcgacgattcctcggaaagctcgcaagtggtcgtggaggccctggtctcttacgccgaacgctttcccaacctgcgcgctctcttcctcggcgacatcgtctcggaggagaacgagatttcctggatcaaccagagcgacctctcggcgctctggccggccttcccgcacctggaacacatgcaggtgcgcggcgccaccgatcttgcgctcggccggttcgaggcgccgagcttgacggcattgatcgtcgaatcgggcggcctgccgcgccgggtggtgcaggaggcgctggccgccggggcgccggagctgcgccatttcgaactctggctcggcaccgacgagtatggcggcgacagcgcgccggaggatttcgccgacctcttcgccggccgaatgtttccgaagctcaacaccctggcgctccgtaactgcgcctatgccgacgacctcgcggcggcggtcgctaccgccccggttctggagcgcgtctcgaccctcgacctctcgctgggcaacctgacggatgcgggcgccgaagccctgctcgcctcgccagcggtggcgaagctgtcgcggctcgacctgcaccaccacttcctcaccgaggcgacgacgacccgtctcgccgcgctcgggccggcggtcgacctctccgagcagcaggagccagacgagtatgccggcgagttctaccgcaacatcgccgtttcggaatga

SEQ ID NO: 8768 - DNA, 1146 bp, Methylobacterium sp.
atgatccgcgccgccggctcgatcgatccttgcgtcatcctcggcgtcgcgggcgacgagcgcacggagggcttcggcgccgcccgggtccgagccgggcactcgcccgcgacggtgctcgactatgcccgtttcatcgaggcgccggagcggctcggcgccctgttccctgaggggcgcggcctgctgcgcatcgattcgcccggcggcgagccgcgcatccgccgggccctgctgcgcctcgtcggcgagaacgacgccaaggatcacggcgaggcgacgcggctgcggcccgatcacgccgtccagcgcggactcgcggcggcgctccggctcgcacgccgggtcgtaccgccgggcgtcgccctgacccacgaggccgagacggtcgcgctgttctacgacaagcgggcctgccacgccgccatgaccgcgcagggcttgccggtgccccgggcgctgccgccggccgcctccttcgatgcgctggcggaagcgatgcgcgcggccggactcacccgcgtcttcgtcaagccgcgcttcggctcgggcgccgccggcattgccgcgctcacggttgcccgcgacgggatcgtggcggactcggcggccgagcatgtgccgggcgctggagccggcgtgctgcaccattcccaccggatgcggcgctaccgcgggcccgcggccgtggcgctgatcgacgcgatcctggcgcaggacgcgcatgtggagcagtgggtgccgaaggcggcgctcgacggcgggccttgcgacctgcgcgtgctcgtggtcggcggcgagcccgcccatatcgtggtgcgcaaggcctgctgcccgatcaccaatctcgacctcggcggccgccgggccgaggcggaggcgctgcgctccctggcgccgcccgtcgcttgggaagcaatgctgtcggattgccgccgcttcgcgaggctgttcccgcagaccttccacgtcgctttcgacgtggcgctgacggtgggcttgcgccgccacgtcttcttcgaggccaacgccttcggcgatctgatccgccgcgtccggcacgaggggctcgacccctacgcgtggcaggtcgcccgcctgcccggctggctcgccgcccgctggccggtggagtgcgccgcatga

SEQ ID NO: 8769 - DNA, 975 bp, Methylobacterium sp.
atggcaggcgccccactcgacatcctctaccgggggccgctggcgagctgcaattacgcctgcccctactgccccttcgccaagcgtcgggacagccgcgagaccctgcggcgggacgccgaacagctcgcccgcttcgtcgattgggcgggcggccagacccggcgcagcctcggcatcctgttcacgccctggggcgaggcgctgatccggccggcctaccgcaacgcgatgaccgccttgagccggatgccgcatatccggcgcgtggccgcgcagacgaacctgtcctggccgaccggctggctcgatggctgcgaccccgagcgcgttgccttctggtgcaccttccatccgggcgagacgccgctcgaccgcttcctcgggcgctgcgccgagctcgacgcgcgcggcatcagctacagcgtcggcatcgtgggcaaacgggagcatttcgacgcgctcgccgcgctccggcagcggctccggcccgagatctatctctgggtcaacgcctaccgcgacgagggggcgacctattacgggccggacgagctcgcgctgctccgcgccgtcgatcccctgttcgacctcaaccgcaccggcatccgcagccgcggccgggcctgcgccacgggggagagcgtggtcagcgtcgatggcgatggcgaggtccgccgctgccacgtggtgccggcccggatcggcaacctctacgacccggatttcgacgccgccctgaaaccgcacccctgcccgctggcgcagtgccgctgccatatcggctacgcccacatgccgcatctcggttttcgcgagcttttcggagcggggctgctggagcgggcgctgccgcatccggccgcaacgctgaacggggtcagagcaacgggtcccgcgggccgcgcgaggaggtcatcatcggcaacgctttcggcaacaccctcagccgcgatgaggtcgacgccatcttga

SEQ ID NO: 8770 - DNA, 426 bp, Methylobacterium sp.
atgatccggcgcgccctcctcgtcgccctcgccgtcgggccggcgctcgcggcctgctccttcccgccgacgacgatgacgccagaggcggtcgaggcctttctcgaagcgccgctgccgcccggccgccgcgacatgcggacctacaccgaggcggggatcgaccgcttggtgctgctgtgcctcgacgcgccggaggcggaggccgatgccttcgccgcgcgcctcgtgccgggcggcctcgaagcgggcgccgatccgggactcggcttgctgagcacgacattcgagggctggatcgcggtgccgccggagggaagcctcggcggcgagaggccgtatgacgggcggcggtcggtgaaggtcgtcatcgccccggctggacccggctggcggcgggtctgggtcgcgagcttcaccctgtga

SEQ ID NO: 8771 - DNA, 426 bp, Methylobacterium sp.
ttgatcgtcctggacaccaacgtcctgtccgagctgtggcgggtgacgcccgatcccggcgtgctggcctgggtcgatgcgcaggcgatcgagaccctctacctcaccgccgtcaccgtcgccgaactccgcttcggctttgccatgatgccggcgggcaaacggcgcgacatctttcgcgatcggctggagcgcgaggtgcttccggccttctcgggccgcgtgctgccgttcgatctcgacgcgtcgcgccactacgccgagttcatggcgcgcgcccgcgccgcagggaaggccatcggcatggcggacggcaccatcgccgctgccgccgcggttcgaggcttcgtcatcgcgacacgggataccagtccgttcgaagcagccgggatcggcgtgatcaatccctggcgaaacgcgcgctga

SEQ ID NO: 8772 - DNA, 288 bp, Methylobacterium sp.
gtgaccgcgacccgcccggcgggcacccgggctgcggtcgcggcctggctagcggaggggctcgaccgcgcgacagtggtcgcgccggaggcgttgctgccgcgcgtggtgaccatgcacgcgcaggtctcgtatcgggacggcttcatggatcagatcgggcgcgtgacgctcgtctacgccggcgagacctcctgcacgatttgctgcggagcgatgaactcggtcccgaaccgggcgaagaggatgcccgcctcacccgtcgtcagatcctcggcgccgccgtag

SEQ ID NO: 8773 - DNA, 105 bp, Methylobacterium sp.
atgaccaagcgcgtgttccttaccagcgttgtcgagttcaccgccttcggcctgctcttcggagccgttgcgctctgggcggtagccttggcgccgatccattaa

SEQ ID NO: 8774 - DNA, 288 bp, Methylobacterium sp.
atggctcagcataagcgcgacgcgctgctcacgaccgtcttcgtcggaagcgccgttctcgccctgttgctccccggcgcaccggcatggccggccagcggcggggccggcgggcggagttcgggcgacacgctgggcaacggcaggcccggcactgacgcgcccgcgggcagcgccgaccccgagggccgtctcgacaattccggggccggcgggggcggcagcggcggcggggccggtcgcgccggcgggagcggcgggagcggctacaccttccccgagggcgaa

SEQ ID NO: 8775 - DNA, 486 bp, Methylobacterium sp.
atgacaatccgttacgtcgagggcgacatctttgccggcccggagcgcgtcctcgtccacggctgcaacgccttcggaaagacgggcgccggcctcgcgctgcaggtcaagcggctctacccggaggcctttcgcgcctaccgcgcggccttcgagagcctggacgaccggcaagcgggcctgccgctcggcagcgcgacctgggtccgcgccgccgacgggcgcctcatcgtcaacgcggtgacgcagcgtgaccacgggcgggcgaagggacgcgtctacgtcgattacgaagcggtgcggacggccctgcgcgccatcgatgcgcgcgcccgcagcgacggattcgaggcggtcgctttcccgctcatcggcgccgggctcgcgggcggatcgtggacgatcctttcgcagatcatcgaggcggaggcacgggccttcgagcccgtcgtctacctgttcgacgggctacggcccgagtcctga

SEQ ID NO: 8776 - DNA, 888 bp, Methylobacterium sp.
atgcgaactttcgtgcgcgtcgtcgagagcggaagcttctcgcaggcggcgcgggatctgaacgtcagccagccgacggtcagcaagcaactcgccgcgcttgagtcacgcctggggacgcagctcctggcgaggaactcccgtaccctcgccgtgacgcccgcggggcaggactattacgaagacaccctgcgcatcctgcaggacctcgactttgccgaggagagggtcactgcgggacagtcggccccctcggggctggtccgcgtcaccctctcgcccgcattcgggaggatgctcgtcatcccccggctggcggcgttcagggaagcattccccgacgtgtcggtcgagatggaggtctccgggcggcacgtcgacctcatcgaggagggaatggacgtcgcgatccgcatcggccggctctcggattccgcactcgtggcccgccgcatcggcgacatgcggatgatcaccctggcctccgccggctaccttgcccggcacggcacgcctaagaccctggacgaactcagccaccatcaacgcatcggctatgtctaccaggggaacatcgtcgggtggggcttcgacgtggacggccggcaggtgacggtcgacggcgggggagcgttccgcacgaacgacgccgagcatgtccgcggcgcggtcctcgcgggcctcggcatcgcccatcacgcgagctggctgttcaccgacgtcctggcctccggcgaggtcgtccgggtcctggaggagtatgcgccgccgaccttcccgatcaacgcggtcaccgccgccggacggcgcatgccctcccgtgtgcgacactacatcgagttcctagcggcgatctgcgccgaggagccggaattgaaggtgggctag

SEQ ID NO: 8777 - DNA, 135 bp, Methylobacterium sp.
gtgccaagcctgtactccgcgatcgtgtacagcgccgtccttctgttcatgacccttctgggcacgaacctctgggccctgcggatggccgcggcgatgaccgccgcggacgaggagggacaggcgagccactga

SEQ ID NO: 8778 - DNA, 216 bp, Methylobacterium sp.
atggacgacgacgacatcattcgtacggacatcgagttcgccgtggccgatgcctgctggcgtcacgaggtcacccggcaactcggcacgtccctggtcgaggatgcgttgacaccgcctgagatgaagggcgaacccgagaccgcgctccggcttgcctacgaggagcgcctgcgcgcactccaggcatggcgacgcgcccgcggcctggcctga

SEQ ID NO: 8779 - DNA, 363 bp, Methylobacterium sp.
atgaccgacccctgggcgtgcgcggcgcttgcgaaggtcgaacagaccgcgcaactggcgtcggaaatccgtgcgatcgtcgagcgcacgcggcgcatcatcgccaattcgcgcgaaatcctggcggcgcacggcgcgcaggatcccccaagccatcccccgctcccctgcccgccgaagacgacggtgccgccggacgctctctgtggggtcttcgacgcgctcctcgaagcagcgcggcaagccgaaaatgccgacgatcccgagctgctcgctctcgtcgagcgagccctgctccggaccggagaccgcatcgagcaggccgccgcggccctcgcgcgccgtcagccgccgatccagtag

SEQ ID NO: 8780 - DNA, 975 bp, Methylobacterium sp.
atggcgggcacgccctacggcatcgcggatgcggagcgcgaccttcgcgccagcctcgggcgcgccccggcgggggcggtcgtggggggctggagcgccacgaccatgcaggcggggcacgcgcagatctcgggcggctacaccgatgccggcggccgtcacctcgatcccgagccgcgccacgccttcgacgccgtcggcgcggcggtcgagcgcctcgccgcggccggcggggcggccttcaaccgggtcgaggtccgctggacgcgggcacgcttcccactgtcgctcctcgggcagccgggccgcatccgcgtcgagacggcattcgaccccaccatcgtcccgcggggtcccgaagacccggcctacgaggccgccgcggcggcccgccgccggttctgggaggggcgtggccgtctcctctccggcttcgccgcgcaggatcctgtcgccaacatccacgggcagacgaagtggttcggcccccatcgccgggtcctgctgctgcacccggccagcggtacggcagacggcgtggtgctcgccaccgacggcctgtccacgacctgggccggcatccccgacccggagaacggcgtcgcctgcgaaatcgccctgcggctgccggagggggagggggaggcgaccgagcgcgtggggcgctggaccaacatcctgatgagcctcggcgaccgcgtcgcggacggataccgcgtggcgagggatgtggagaagcacggcgcgatcctgttctcccgtctcccggccgcctgtgcgccgttcgagttcgtgatcctcgccgcggcggcggacgacgcggtgatccgcgatctgccattcggctccgttccgctgctcgaagccgtccccgtgaccgcggccgaggtggccggaggcgatccggatgaggcgtgggaggcgagcacagcccgcgcggctctcgcccgacgggaccggtcggcgccgctctga

SEQ ID NO: 8781 - DNA, 621 bp, Methylobacterium sp.
cccggcctggcggctccgcccgccgcatctctgcccggcgcgcaggccgaggcgcgtcccgccgcgaccggccttctcctcggcggcgggcgtgtgctgacggcggcctctgccctcgatgcctgcgccgcgcctcgcatcggcggagtggcggcacggatcgagcggcgcgacgcggcgggcagcctcgcgctgctctccgccgaagggctcgcgggcgcgccaccgccgctgcgcaccgaaccggtgggtgagggcgaggcgctgctcgtactcgtcgctcaggccaagggacgcccgagcgtcgcccccgccagcgccgcggtcgagggcgtctacgccccgcttcagcccggcgcaggcggcgcgccggtgctcgaccgggcgggccggctcgtcggactcgtcgcccgctttcccgctacacctcgcctgatcgccggggtgatgccgccgacgcgctacggcatcgtgccggggaaggccgtggcagcgttcctagcggagagcggcgtgccggccggggcgggcacggggtccgcgaagggcgccgcgaccacgctgggcggggcggcggcgccggttctcggcgcggtcgtggcgatcacctgcacccggtaa

SEQ ID NO: 8782 - DNA, 207 bp, Methylobacterium sp.
atgcgtgccgcagcttcctatttccgccagaaggccgacctttgccgcgaattggcagaagcgctggcctctcagcacgacccggtcgtttcgaagctctgcgaaatggccgatgagtttgacgataacgcgcgcattctcgaacggcgggtcgcaagagaagaggcggaagaggctgtctccagcggtgccggcaacgttcactga

SEQ ID NO: 8783 - DNA, 891 bp, Methylobacterium sp.
atggccccgaccgacccgacagccctggcggagcatctcggccgactcgtcgacgagatcacagccggggccgatgcggcgcgcacgggcggtgacatcctgcgcctgcgggaccggctcaaccgcgaatgggacggcgcgaagccgggcgcccatctctccggggaaacctacgccgccctgcggcgtcgcagcgaggcggcgcatacccgcctcactgagcgcttcgtcgccctgaaggatgcgactccgcagcctgaaccgcgcctggtcatcgagcctgacggtccgaccctggactccttcttcgagcccgaagcgccggatgccgtatgggccgcaggggtggaaaccgcgatccgcacggcggaagcccgcctcggcgtgaggctacccgagacgctgagggcgctctaccggcgccggaacggcggggcgaccgacttcttcctcgccacggatgttcccgacgcccccctcgcattcggaggcgatgcgggggtgcgcgaagccgacgaagtctggcggacggtgctgcccggcttcggcctcacggccctggagcggctggaatccctcggcgcgatcgccgacgggatcgatttcggcagcgacgaggagtcctggcgcgccgcattgcccgagatcgatcgcatgatcccgatcagccatcacggctccgacctctggctctgcctgacctacgccgatccagaccctgaaccgtcggtggtgctgttcgacgcgaccgcgccgaatggcggacccggccgcaccaccttccgccggccggattttgcggacttcttcgccggattgaggcggtacggcgtcaccgtcgaggacggcgtcgccatgcgcggcacccggctcctcggcacggaggcctga

SEQ ID NO: 8784 - DNA, 975 bp, Methylobacterium sp.
gtgcgggccgcgatcgcggccctgttgttgtctgctgtcccggcccaggcttgggagccgacgaagccgatcgagattatcgttcccttcccgcccggcggatcgtccgaccagatggcgcgcacgatccagggggcgattcagaagaacaacctcgtcaagcagccgatcattatcgtgaacaagcccgccgcagcgggcggcgaggcgatgctcgatatccagaagtcggccggcgacccccacaagctcatcaccacgtcgagcggcatctacatgacgcccctctccaccaagcttccggtgagctggaaggatttcaccccgattgcgatgatggcgcaggatgccttcgtgctctgggtcaacagcgagaagccctacaagacggccggtgaattcttcgaggctgccaaggccgccaagccgccgctcaagaccggcggcaatggctcgaagcgcgaggatcacctgatctccgtgacgatggagcaggcaacgggcacgaagatcacctacgtgccctaccagggcggcggaccggcctccgtgcagctcgccggcggccatatcgacgccaacatgaacaacccggccgaagaggtcgccaactggcgctccggcgcggtgaagccgctctgtgccttctccgacaagccgatcgagtacacgcagaaggtcaccgccgagatggcgtggtccgacatcccgacctgccagtcgcagggtgtgaacgtcacctaccagatgctgcgcggcatgttcatgcccggcaaggtcacccccgagcagcaggccttctacgtcgatctgttcaagaaggtcaccgagaccccggactggaaggcctatctcgagcgcaacgccctggttcccgacttccgctccggccagagcttcgtcgacttcctcaccgaggacgagcgcaagcacaaggagctgatgaccaaggccgggttcatcgcgacgaactga

SEQ ID NO: 8785 - DNA, 498 bp, Methylobacterium sp.
atgaccgaagcctctcccccgctccccgagcgcggcctgtcgcgccgtgccgtcgagatcgtcgtggcgctgctgctgctcggccttgccgggctggccctgtgggattcctacgggcggggcgcgggctgggacaacgggccggaaaacggcttcttcccggcccgcgtcgccgcgatcctaggcgtcgcggccattgccgccctcgtgagcgctctgcggcgggaggacagcatcttcgtcacctacggccagctccggctggtggcccaggtcttcgtgccgctgttcctctacctgctggggatcgccttcctcggcatctacctgtcctcggccctgttcatggccctgttcatggtcacgctcggctccttccgctggtggcagacggcgctcgccaccgttctcgtgccgctcgtcatcttctgggtgttcgagcaacagttccgggttccgctgccgaagggaccgatcgaagccttcctcggctactga

SEQ ID NO: 8786 - DNA, 1527 bp, Methylobacterium sp.
atggacgacctcaaccagctcctgctcggcttccaggtcgcgctgacgtggcacaacatcctgttcatggtggtgggcgtgctgctcggcatcgtggtgggcgtgcttccgggcctcggcggccccaacggcgtcgcgatcctgctgccgctgaccttcggcatggacccgacctcggcgatcatcctcttgtcgtcgatctactggggcgccctgttcggcggcgcgatcacctcgatcctgttcaacatccccggcgaggcgtggtcggtcgccaccaccttcgacggctacccgctggcgcagaaggggcgggccggcgaggcgttgacggcggccttcaccgcctccttcatcggcgcgctctcgggcgtggtgctcatcaccttcgtggcgccgctggtcgccaagttcgccctgcgcttcggcccggccgagttctttggcgtcttcttcctgaccttctgctcgttcatcggcatgggccgggagaacaaggccaagatcatcgtctcgctggcgctcggcttcctgctcgcggcggtcggcctcgacaccatctccggcgacctgcggctgaccttcggcacgcccgagttgatgaagggcttcgacttcctcgtcgtggtgatcggcctgttcggcgtctccgagatcctgctcaccattgaggagggcctgcacttcaagggcaagcgggcagccatggatctcggcgtggtgctacgcacctgggcctcgctgccgcgctactgggcgacgctgatccgctcctcggtcgtgggcatgtggatgggcgtcaccccgggtggcgcgatcgcggcctcgttcatgggctacggcctcgccaagcgcttctcccgccagcccgaggagttcgggcgcggtgatatcgagggcgtgctggcccccgagaccgcggcccacgccgccggcacctcggcgctcctgcccatgctggccctcggcatccccggctcggccaccgcggcggtgctgctcggcggcctgatgatctggggcctgcagcccggcccgctgctcttcgtcgagaagaaggagttcgtctggggcctgatcgcctcgatgtatctcggcaacctcgccggcctcctgatcgtgctcgcgaccgtgccagtcttcgccgcgatcatgcgcattcccttcgcgctggttgcaccgatcatcctcgtcgtctgcgccatcggcgccttcacggtcgagtcctcgcgcttcgacatctggctgatgctgatcttcggggtcgtcggctacgtcttcaagaagctcgactatccgctcgcccccctcgtgctcgcgctcgtcctcggcgatcgcgccgaggacgcgttccgccaagccttgctcggctcgggcggggatctgtccgtcttcttctcgaacggcctcgtctcgagcctgatggtcctcggcctgctgctcctgttctgggggccgctcggcgacctgcgcaaacggctggcgcgcaaggccggcctcacccggccggccccggtctcccattga

SEQ ID NO: 8787 - DNA, 126 bp, Methylobacterium sp.
atgagcgggcgggacgaattcgtcgtcctcgccctgctcggcgcgctgacgctggtcggcgcgctgctctgggcgcgggaaggcgtgacgctctggcttgccgccgcctttcccctctgcctctga

SEQ ID NO: 8788 - DNA, 294 bp, Methylobacterium sp.
gtgttggccccgccggacctcaaggagagccaggtgcagcagggcagccaggagagcgtggagcggttgggccggcaggctctgcaggtgcagcaggcaacgctggacctgtgggaccaatgggtccggctgggcctcgcggcgcagatggcgtggctggacctgtgggtccggccggtgctgcaggcgagcgaggccttcaaggcccagcaggaccggcaggcccgagtggaccgtctggtgcgaagggggataccggcgccagtggcgcgacaggggctccgggtgctgtag

SEQ ID NO: 8789 - DNA, 930 bp, Methylobacterium sp.
atgcgcatcctcgtcgccaccgacttctcgccccgctcgcaacgagccgtgcggcgcgccggcatcctggcaggacagagcggaggcggcgtcatcctgatgcatgtcgtcgagggcgccggcgcacgcgaggtcgcaagggacgtttgcgaggcgcagcggatgaccgtcgagttggtcacggtcgtgccggaactcttccgcgtggaatgccgggcgctcgtcgtcgcgggggccttacccgatgcggtgctcgacgcggcgacggctcgcgaagccgacttgatcgtcgtcggcgtacccctccgggggaccgcgcgtgatcccggcagaatggttcgcaacctgatccgctcgccgccgtgtcccgtcctcgtggtcaaccggccggccgcggggccctacgccagggtcatgctcccggtcgacctcacggacgcatcggcgcgggccctgcgcagcgccgcctcccttggactcgccgatgacgcccatgtcacggtcgtccacgccttcgaggtcttgggcaagccgaagctatccgggttcggcgttccgcacgagcagatcgacggctacgtcgagggctggcgctcctcgttcgccgaggaagtcgaggccttcctcggagccgagggtcttgcgggaagggattgggtgaggcgggtggaggagggacgcgcggacgaggtcattgccaacctcgcggcgcggacgtgctccgagctcctcgtcatgggcacgcatgcccggaccgggatcaggagggcccttctggggagcgtcaccgaagccgtcctctctgtcggtggcgcggacgtgctggtggtcccgccgccccggtccggcgccgacagcaggttggaccggccaggacggccctcggctgtcagggccgagcgacctgccttgcgggtcgtctccgcatga

SEQ ID NO: 8790 - DNA, 594 bp, Methylobacterium sp.
atgaacccgttgacgcactacgatctatatggctggccagaaggccgcgacccgtcggccggcttcgacaacgagctctacctcgcccgtaatggggacgtttcggcggccggcatgaacccgctcgcgcacttcctgcaatacgggcaggcagagggccggcaagcctacgccgccgtcggcaaagcggccgatctggccaaggaccccggcttcgatgccgagtactacctgctggccaaccccgacgtggcgcgggccgcgcttaacgctggcggcgacaccttcgagttcgcccaccagcactacgagagctacggctggcaggacggccgcaatccgaacgccgtgttcgacaccaagggctatctcaacacgtacaaggatgtggcggcagcaggcatggatccgctggagcactatcacaagtacggcttcagcgagggccgtgacccctcggcgcagttcgacaccaaggcgtacgaggcagcctatgcggacgtggaagccgctggtgtcgatcccatgttgcattacctgcagtacggcgctgtcgagggccgcactgccttcaacgacggccacttcggctga

SEQ ID NO: 8791 - DNA, 207 bp, Methylobacterium sp.
gtgtcggacagcaccgtcgcgagccgcgtcgatgctgcccttgatgagctggaacaggcctaccgcaggccaagtgaacggatcgtggcgctggaagcggtcttgcaggaggtctgccgggactacaggaccggtggcacaccgctcggccgcttcgtccaggtaagcgttgagcgccgtcaggagcggcttgctcgccgcgcctga

SEQ ID NO: 8792 - DNA, 81 bp, Methylobacterium sp.
cgggagatgttcgccgcggtggacggggttctgcgccagcatcccgaggtgggagcctacaatcagacgatccaaaaataa

SEQ ID NO: 8793 - DNA, 156 bp, Methylobacterium sp.
ctgttcagcgccgatgcggtgctcaacctgctcgcgcgtggccgcgagagcgtcccgccagcaccggtgccaacgcccgctggcctgacgcttggtgtcgagcctgcggctgattgcgcgcgctacgacggcctgcgcgctctggaggcgatctga

SEQ ID NO: 8794 - DNA, 924 bp, Methylobacterium sp.
gtgcgcgagttcgagcgcctgaacgacgacggcgggcttgccgtgaatctctatcccgtctcccgcgcaacccctcaggtccgggtggagggcggacagagcccgaccatgagcctttggctcacccagtccgccacgggcttcctgaccgttcccacgctggaagccgatctgttcaccatccgcttcgtcaccggcggccagatgatccgccgaaacgtgcgcggggagcaggtggtcacccagggctacgcaacgttcagcgcactggaggatatgcgaagcggcgaggcctcgtcgggtttcttggccatcagcagcaccatcgcgcgcgcatcgcttctgtcgagctaccacgctctggagggaaaagtggatcgcccgcttcctgcgctggagccgctcacctcaatcgacggtttggggatgcgtgcgctcttgctgtcgctggagcagatgcagatccggctacgcgatgtgcgtacggtggacgatctgttctttccgctgctggaagagatcgtttcctaccaattgctgagtgtgtggccgcgggcgccggttgccgaactgccttcgcccggcagtctctcggcgtctcacgttcaccgcgcggtcgaatacatcggggctcatctggcgacgccgttccggttggcagatgtcgcggccggggtgggtgtgagtgtccggatgttgcagatgtcgttcaagcgggagttgggcgtgacaccggtcgaattcatcatcgagcgtcgtctgcaacaggttcaccgcgatctctgcagcgaggcgcagcgggatgtttcgatcgcggagctgagccgccgatggggcttcgcgcacatgagcgacttcgcgcaacgctatcggcgccgcttcggctgcacgccgagggaaacgcgacgggatatgctgcgctga

SEQ ID NO: 8795 - DNA, 1362 bp, Methylobacterium sp.
atggccgtcggcaaacatcgtcgcaggcttgcgctggcggccttcgtgtccctggcagtgctttcgagccatgcgttcgcgcaagccgagacaaaggggttgcccggcccgaccgaggagcaactcgcgaagcttcaggccatctacgaggacctgcacgcaaaccccgaactctcgatgcaggagaagcgcacggccggcatcgctgcgaagtggctccaggagcagggtttcgaggtcaccgagggcgtgggcggcaccggcgtggtcggcctcctgcgcaacggcgacggcccaaccgtgctcctgcgcgccgatatggacggcctgccgatgaaggagaacaccggccttccctatgccagcaccaagagggggaccgatcccgcctccagtcgggagacggccatcgcgcattcctgcggacacgacctgcacgtgacctggctgatgggtgcgacccagatcctagccgcgaacaaggacaagtggcgtggcaccatcatggccgtgttccagccgggcgaggagatcggcgagggtgccaaggcgatggtcgacgacggcatggtcaagcgcttcccgaagccggccgtcaccctggggcagcacgtactgccgttcccggccggccaggtgcgcctcgcccccggccccgtgctgtcccgcagcgacagcctgaaggtgacgctgtacgggcgcggcgggcacggctccggcccggaatcgaccgtcgatccggtggtgatggccgctgcgacggtgatgcggctccagaccatcgtctcgcgcgaggtctcgatgtccgacagtgccgtgatctcggtcgggtcgatgcaggccggctccagcgcgaacatcatcccggacgaggcgcagctccagcttaacgtccggacctacgacgacgccgtgcgcgacaaggtactggcctcgatcaagcgggtggtcgaaggggaagccgccatctcgggcgccccgaagccgccgctcctcaccatgctcgggcagttcccgctgacggtgaacgacgaggacgcgaccgccaaggtggccgaggcgctgaagcagcgcctgggcgcggaccgggtgcagcctgccagcagcgcgaacgccagcgaggacttcaccgtcttcgcccgagcctgggacgtgccgtcggtgttctggttcgtcggagggaccgacccgaagaagtacgccgaggcggagcgggctgggacgctgaacgcgcttccgtccaaccactcgcccgaatacgcccctgtcctgacgccaacccttcgcaccggggtggagacgatgctggcggcggccggcccctggctggcgccggcgagcgcgggtttgccgccgcgctga

SEQ ID NO: 8796 - DNA, 402 bp, Methylobacterium sp.
gtgccggtctatggcactggatcaggcggcgatggcggcgacttcagcttcaacgggcaactcatcgaccacgcgccgcgaccgccgggcatcgccagccgcaaggacgtttatgtcgtctatctggtcggtgacagcatctcgcccgcctacgaggacggaagtccgatctacgtcgatccgcaccgccgcccggcgccgcgcgattacgtcgtggtcgagctacgcggcaagcgcgaggacgagccggggccagccttcgttaagcgccttgtcgcccgcggcgccggcaagctgaagctcgaacagcacaacccatcaggtccactcgatccgatcgacgagagcgaggtcgtgagagtgcacagggtcataccctggctggagttgatcggcatctaa

SEQ ID NO: 8797 - DNA, 279 bp, Methylobacterium sp.
gtgatcgccctggcccaggatctcctcgcggccggggttgcggtcgccctctacgccctcggcatccgcctgttcctcggccggtgccagcgcctcgcgccgtcggcgcagccctttcccccatcctccaacgacaacaggcacgccatgcgcacgcagcagccggcccctgagccgctcgacatcaacgccatctcggtcgccgtcggcatggccgtgctgctgctcggcagcggcgtgagcctcgtggcctgcctgcgcatcaacggctggctctga

SEQ ID NO: 8798 - DNA, 327 bp, Methylobacterium sp.
gtgcgcaagctggcgttagggctcttcgccctgtccatcctgttagggggtggtcgcctttctaccggggtggtctacctgtcggacgagccgaccgccctgctggtgctcaagcgcggaccagccctttggatcgaacgcccggagagccaagacagacccctgtcggaacagatcgtgctcgaccgggaggagcccgatctcgcctacggctggctgtattctccgttgatgcggctggcaccgatcctcgcgcccggcttggcgggtgtagctgtgctcctcctcgcgatttcccgccgaaggcggaccggggcgcagggctga

SEQ ID NO: 8799 - DNA, 672 bp, Methylobacterium sp.
atggccaagcggcttcgtcgatggagggcggctgcccgtttttcgtccgcagagcttcggctgctcagggagcgtcgcctgatcgccagctccgagctgtttgacgagacgctctatctctacgaagctcccgacgtcatgagcgaggaggcggagccgatcgagcatttctgccgcttcggctggcgcgagggccgacggcccaacctctacttcgacccactctggtaccgcgaccgctacctcaagggagccgaccagaacccgctcgtgcattacctcacggtcggtgaggcgtctggctgccgcccagtctgctacttcgatccgcactggtacgcgcgaacctacgggctgccacgtcgagtctgcgcgctggcccacttcctcactcatcgacgcagtcaacgtttcgcgccaaacccaaacttcgatctcgctttctatctcgaccgttacggtgtcgagatcggtccgaatcgcgatccgtttgcgcaccacctgcgcttcggggccgtacgagacatcgatccgtcgccgtacttcgactcggagcgttaccgacattcaaagatgacggatccacccccggggatgcgcacaccctgggcagaggccgatctgcgcgtgcctctcgtccaccacctggacacgcaatgtcgcagctcctga

SEQ ID NO: 8800 - DNA, 651 bp, Methylobacterium sp.
atgccgaaactgctcgtcgccgctgccatcctcgccgcttccacctcgctcgccattccgcgcaccctgctcgagatcgcaggcgtcgagccgcccccgctcgtcccggaacgggctgcgctcgtcatcatcgacgcgcagcaggaataccggtccggtgtgcttccgctcacggccttcgagccggcggttgcgcacatcgtcaagctgcgggaatgggcgcgggcccgtagcgttcccgtcatccacgtgcagcacgtggcaaagaccggatcggctgccttcgccgccggatcgcccggcgccgacttcgtcccggaactggcgcctgctccgggtgagaccgtgatcgtgaagcggcttcccaacagttttgccgggaccgacttcgacgccgttctgcggcgggaggggcgcacgtccctgatcctgacgggcttcatgacccatatgtgcgtggaggccacggcacgcgccgcgctggatcatgcctatacgagcttcgtcgtcgccgacgcgacggcgacgcgcgatctgaagatgcccggaggcggaacgcttgacgccgacgaggtcaagcggaatgccctcgctgccatggcggatcggttcggatggatcatcaccagcgaccggctcatcggccgttag

SEQ ID NO: 8801 - DNA, 1254 bp, Methylobacterium sp.
atgagcaacaggtggccccacctcgactatctcggatggcgcgagacctgttcggccctgcacctctacctgcagatcgccggcaaataccggctggcgcatagcccgtggctcaaccactcctggaacgccaccttctacgtcacgcctcgtggcctttcctcctcgcccatccctgacgggccggggatcgagctcctattcgatcttcacgagcacaaggtcgtcggcacgaatggtgacggccgcgaggcgtcgttcgcactcggcccatccacggttgcgaagttccatgccgatttcgtccgcctagtgtctgacctcggcggtacgcccactttcgacggacagccgaacgaggtgcccttcccgatgccctttcgcgaggatcatcgcgaccggccctgggatcgcgatgccgtacagcgcttccatcgagcgtcgatggctgtcgaccgggtgttcaaggcgttccggacctccttcctcggcaagtccagcccggtccacctgttctggggcgctctcgacttggccgtgacccgcttctcgggccggcgagcaccgctccatcgaggcggcatcccagcgcttccggacgacgtggcgcgggaagcctacgaccgcgaagttgcctcggtgggcttctggccgggcggcggcggcctcgactatcccgccttctacgcctacgcctacccagcgccgagcggctttcgaagtgcatcagttcggcccgacgccgccttctggcatgaggaactgggcgagttcgttctgccctacgatgcggtgcgatcggcagtcgatcccgacgaggctctcatggcgtttctcgtctcgacctacgaggccgccgccgaccggggagaatgggatcgcgatctgctggaatgcgtgcctggtcggtctcgccgggttcgggcgccggacgctgagcaatccgacaaagcgcctcgcgcgaccgacgtaacggtcgaacgagaggaaggcgcaacgaaggggcgctaccggatcgtcgtcgagggtgtcgaggccgagatgacctacacccgctccagcgagaaactgatcatcatcgactcgaccaacgttccggccgccctgcggggtcgcaggattggcgagcagatggttcgccgggcggttgatgatgcccgacgtgatggggtcgccatcatcccgctctgtccattcgcgaaggcgcagattgagcgccaccctgaatggcaggacgtgctgcgtcgtgcatag

SEQ ID NO: 8802 - DNA, 1224 bp, Methylobacterium sp.
atgacgacggatctgtccgccctgcatcgacgccattttctggtttgtggcaccaccgccgcgttcgggcttgccggcccggcttccgctcagactccggccgatgggggcggccagcccgcggcgaaggccttgcccgcctacgtcgcctggaaggatgcggacgccttcgtcgtccactccaatcagacgctcgagaccaagcgcgcctggatcggaagcgggatcgtcacgcccaccgagcgcctgttcatccgcaacaacgtcaatcccccttccgacgccatcgtcgccgaccgcgatgcgtggcgcgtcgagatcgcgggcgtgacgcagccgcggacgctgacgctcgctgaactgaagcgaatgggtctggcgagcgtggcgaccgtgctgcaatgctcgggcaacggccggaaatacatgcaggacgccctccagccgggtcagaagatttccggaacgccctggacggtcggcgccgcgggctgcgtgatctggaccggcgtgccgctccgggccgtcgtcgatgccctgggcggtcccgtgcagggggcgcaattcgtcaccggcacggggggcgaggatctgcccgcgggactcaagcccaaggacgtgatggtcgagcgctctgtcccgctctccaccctcgacacggtgctgctcgcctgggagctgaacggggagccgatcccgctcgcccatggcggcccgctgcgcatgatcgtcccgggctattcgggcgtcaacaacatcaagtacgtgaaggccgtcgcgctcaccgagcgggagacggaggccaagatccaggccacgagctaccggatgcacggggtcggcgaaaagggcgcccccagtcagccctcgatctgggagcagccggtgcgctcgtggatcaccgcgcccctgggggcgggccccggcggatcgacggtcgtcacgggagtggccttcggcggcatgaacgcggtcacgcgcgtcgaggtgagtgccgacggcgggacaacctgggtcgaggcgccgctcgtcggtccggacctcggccgctacgcgtggcggctcttcgccctgcggatggacctgcccgccgggcgccatctcctggccagccgggcgaccgacgccctcggcaccgtccagcccgaggacacgccgccgaacggcggcggctacagctacaatggctggcgcgggccggtcgtcccgtttgaggcggcttga

SEQ ID NO: 8803 - DNA, 507 bp, Methylobacterium sp.
atggacgatctgcttcgcgagtttctggtcgagagcgccgagcatctggacacggtcgatgcggagcttgtccgtttcgagcaagatcccaataatcagcagatcctgcgcaacatcttccggctcgtccacaccatcaaggggacctgcggcttcctcgggctgccgcggctggaagcgctggcccacgccgccgagaccctgatggggcgcttccgcgacggctatcccgtcagcggcgcctcggtcacgctgatcctcgcaaccctcgaccggctgaaagcgatcctcgccgatctcgaagccaccggctccgagccggccggcgccgacgccgacctgatcggtgcgctggaagcgatggcctccgacgaggcgcccgccgccgccgcgccgcctcccccgccggccctgcccgaattgccgccgatcgtcgagcgtgagctcaagcccggcgaagtctcgctggaggatctggagcgcgccttcatggaggcgcgctccaga

SEQ ID NO: 8804 - DNA, 645 bp, Methylobacterium sp.
gtggctggccgagcaggagcgcgaggccgcctgatccaggtcgccgggcggttcgccatgccgtccgacgatgcgcccgcggtcgacgccccggctccgccggtgccgcgggcgctcccctccactgagacgaaggaccggcacatgcccggctacagccaaaccgaactcgaccgagcccgcctgccgattcgaagcgcggatgaccgagacggcgcggtttgcgtgctcggccacctgctgaccgagcagcgtgaggcacacaccgacgagcgagccgggatcatcacccgcatcacgtcggcggtgcaggacttcgacacccgcaccgcactcggaggagtcagcgccgcaccattcgccggctcgagcggaattcagcgtgacgcgcaggcagcgcccccgcctgcaccccctccttcaccgccacgcccgtcgccgccgcccgcgcccgcctcaagcgcctgcccaccgaccttactcgcggacaacatgcgcgcccggctcgaccccacggccagcatgcgccgcgagcttgctcgtcagggtctcgccccagcgtcgcagcccagtgccggcgcctccaccgcagtggccagcatggagcgcgagctgcgccgcgccggcctcacgccgaaccgctga

SEQ ID NO: 8805 - DNA, 213 bp, Methylobacterium sp.
gtggcgcaggtgcgctggcacaccgtcgccagcgagctactggccgacgtccgtcgctcctcgatccgtctccagttgctgcagcagctccgccaagcgtggatccagaacctcgtccagtaccggctcgtagagggcctgcagctgcagcccgagccgcaggcgtgtgcgggcatccaggattggtccgtggtcagacacggaggccgctga

SEQ ID NO: 8806 - DNA, 303 bp, Methylobacterium sp.
atgcacttcatccatgttgaggatggcctacgtctccgctttcccggacgggatgcagcgttcaacgagggcgtcgagatcggcatcctggccgtgaaccttgccaccggacgcggcgagttcacgctgcagttctctagcgggaccctcgagcaggctcgaaccctcgccacgcagatgggctatcgggttcatgtcgtgcggagcgacgaagcatgggcagaggtgacatttctgaccggtcacaggcgacccaagctgacgctgatccacaatcagccagaggctcagtctgccggctga

SEQ ID NO: 8807 - DNA, 1068 bp, Methylobacterium sp.
gtgagcacgctcgccgcgcatggagccgccttcaccgaagccgtctccggcttcggtccgggtgcccccgtcattctctgtcacgacgatgccgacgggctgtcggcgggtgccctcctctggcgggcactggcccgcgccggccgtgaacccgggccggttcgggtgatcgggcgcggcgaatcggcgtggtcaccggcgatcctcgacgaacttgccgcgctcgcccccgcgggtttcgtcgtgaccgatctcggcgtgcaggccggcaccatcctgccgggcgtgcccaccgtgctcgtcgatcaccacgtgccgcgctcctggcctgaagcttccgaggccaccgtgatcagcggccatgccgacgctccgatcccgacctccagtctgctggctcacgcctgcgccgcagcactcggggcggcggacgatctcgcatggctcgccggcgtcggcctcgtcggcgatctcggcgagcgggcagcgagcgccgacttccccgagatcatgggcccgctgcggaaggcgcacaccgccaaggcgctgcgcgaggcggtcagcctcgtcaacgcgccgcgccgctcggcctcgggcgatgccgggccggcgctgcggatgctgctgcgggcggacgggccccgtgacatcgtcgccggcacggatccggacgcggcggtgctgcacgccgctcgggcggaggtgaaggcggcgctcgatgccgcccgcgccgttccgccgctctttgccggtccggtcgccctgatccgctgcgactcgccctgccagatccatccgctcgtcgcgcaatcgtggacgcaccgcctgcgacgacaggtggtaatcggcgccaatgcgggttttcgtgccggctacgtccacttcgcggcgcgtagcctgggcgtcccggatctgatcggcttcctggaggagcgcgcaccgccgctcgggtcggacgatcaattcgcacaggggcaccgccgcgcgaccggcggccaggtgcggatcgagacctggaaccggtttgccgcgcaactcggcttcgggccggaggcgcagatctcgtga

SEQ ID NO: 8808 - DNA, 870 bp, Methylobacterium sp.
atgaggaagctgatgagcgatcgaaggacgaccccgatcagcatcatcggctttgactcagcttggacggacagccccaaagccccgggggcgatcagcgtcatccggattgatgacaagggccgacgcaccttcgtgccaccctcactggtgtccttcgacgccgcgctcacagtcatccagaccgaggcgtcctttagcgctctgcgcatcgttgcgttggatcagccgacgattgtgccaaacttgaccagcctccgtcccgtcgaccgagtcgccgcctccctgatttcctggctcggaggcggtgtgcagccggcgaaccgctcgaagatcgggatgtttgacgatgcagcccctgtttggcgcttcaaggagcgcctcggggcgacggaggatcctgaggcctcgcggagcgcgagcgcaggtctgttcttgatggaggtcttcccggcgttggcattgccatctttcgggccggcattttgcggcaggttgctcggcccgcgctacaatcccgcgcgtcgcaaaacgtttacgctggccgggtggcaggcagtaatcgatgtcatgcggctacgcgcattgacagaatctgtcgatggactttgcgagtgggcggacgcactcgccgcagtctctgcccccaagaaggcggatcaagatcagcttgatgccgctttgtgcgcactgatcggcctgcattggcaaatggcgccacgcgaggcgtcgattatgatcggcgatcgcacgttcggttacatgatcgttccggcaagcactgacgtgcgagcccggttgaagtcagccgcagataaagcgggggtgcccatcgacgtcgaaatgttggattgctcgaagccattctag

SEQ ID NO: 8809 - DNA, 201 bp, Methylobacterium sp.
atgccccgcatcctcccgaaccggcgcatcccgcgccaccacctcatgccgtaccggccgtcacgacgccggacccacggttccgatgccaagccggtacgcgcctcggacctcgtgctggccctcctcggcgtcgtcctactcggcggcctcgccctcggcgcggccttcaccctggccaccggcgcgaccgccccctga

SEQ ID NO: 8810 - DNA, 240 bp, Methylobacterium sp.
gtgttgcttagggaggctgaggtgcaggtgtcgaacgtgacccggacagctgcggcgcaggagtttgttgagatcctcatacatcgcgctaagcgcagcggagcctgccctgcacagatgctgcgcgaacacggtcggcgtttggccctgctggcgaagctagcgacggacatgcagctccaggcagttcttgctgagctggatcgtcaggcaacaaggctggaactgagcgcggggtaa

SEQ ID NO: 8811 - DNA, 498 bp, Methylobacterium sp.
atggaaccggtcgaggcatcgggctggggacggattgattgtcgcccctatcgcgcaagcaatctggaagccgtgatcggcatcttccattccgccctgcgcgaaaccgcttcagccgaatacgatccggcgcagatcgaggcttggtcgcggatcgatcacgccgtctgggcggagcggcggttgcgggggtgctgccgggtcgcctggatcggcacggaagcagcagggttcgcggatctcgaacccgacggccgcctcgacatgctctacgtccatcccacgcatggacgccgaggcgtcgcgcgggcgctgcttcgagacgtcgagacgctcgccttggatcttggactcgtcgcgttacgaaccgaggcgagcctaaccgcccgaccttttttcgaagcggccggcttccacgtcgttgaggcggaaaccgtagcccggaacgggcaggcgttccggcgctaccggatgcggaaggacgggctcggcgcctga

SEQ ID NO: 8812 - DNA, 363 bp, Methylobacterium sp.
atgtcgggcggcgccgatggacctctccgggagaccgccatgagcgttcgacgccccctcgctgcggtgctgctcgcgtttctggccacccctgccgtggcggacccggcccagctcgaactcggcaagcgcgtcttcaccgagttggccgagccgcgctgcggcgcctgccacacgctcgccgatgccggcaccaagggggaattggggcccgtcctcgatacgctcaagccgagcgcgagccgcgtcgcgaccgccgtgagcaacgggatcggcgtgatgccggccttcgaagacctgagcgaggaacaagtcaaagccgtcgcggtgtatgtgcagaccgtgacgggcgggaaggagtag

SEQ ID NO: 8813 - DNA, 144 bp, Methylobacterium sp.
atggccgacttcaacgagcgcgcgaagcgcgccgtggccaagatgccgacgatcgaaaagcctccggagaagcgccgcaacgcaccgcggccgaacaagccgccggtcgctgccaagcctgatggcgaaggcgagaacgagtag

SEQ ID NO: 8814 - DNA, 906 bp, Methylobacterium sp.
gtggccggggaaacggtgcagttcagcgcgacgcaacgggacgccggcgctggtgcgcccggggcgacggcgctcttcccgtacgaccgaatgaccgtggagcggttccgcaccgcgttcccacgtgcgcggtggcgcgacgacctgggtgcttggttcgtgccgggcactacggcggagcgccgtttgaatgcttggtcgggtcgcgagtggacgggcgtcctggcccatgcggacgagcgcggccgcgacgccttcgcgttcgagccgctcgcgagcccgtacctggaggcagccgacgaccttgtggtccggacgccgtactcccgcgcggtcgtcgccgagttgcggctggtgccttgggcccggtgggacccggcttcgaaggcttggcgggtccccttccggtcgttggaggaactgcgctcgcgctggccagccatcgaggaggccgcccgccgggctgagcccgaggagcggcgcaagcgcgaggcgagccgcagggcctcccccgaacatgcggacaggcgggccgaggccgccgagcgtcgccgcaaccgctaccccgttcccgaggatgcgctcccgccactggggcgcgtgctgatgacccatgtgggatgcgcggtgttcgagtcggtcaacggcgagggcgtcgaggcttcggtggcgacccgcttctactcaggtgtcgcggcaggaagcggcacgctggtttgggcgacccggcgcaggccgacgcatgacgagttggtgcgggcccggcccgctcgggaggaagcgggtccggccgagaccgcgctcggttggtggcagcccaccatcgacgtattgcgcgaggaacgtcgcagagctgcctcgcaggagcgcagacgggcgacgcgtcttaccggtgcgacgggatga

SEQ ID NO: 8815 - DNA, 597 bp, Methylobacterium sp.
atgaacagggtgatacgctggctgctgcggacgctgggtggcgtcgccgcgctcttgatcctgaacggagcgatcctgctggggacgtggatcgtcctgcgcaacatgaccttcaccgatccgttcgccgagcagattgcggcccattatcgtcgctcgataccggcagagatcgacatcacgtcgatggtcgcccaaggatcggatgcgaccctgatcgacctcatcattccggtcagacgggagggctgcggcggggctgcgtttcagctctccgacgcggcggccgcccagatcacgaaacagggtctcgcgtttctcggatcggcccggatcgggcgcggctacaagaacggccccaaggagtattacgcgacctatcagccctggcaggagacgcccgtgccgagcacgtggctgggtgacggcatgtgggcggcagggttcggatgtttgaaggacgatgcccgtcacttcgacgccgacgccgtctaccgagccgttcgtgagccgggcgcctacttcacgaccgggccggagaaagagcttctgatcatcccccgcctgcgcctcgtggtgctcacctacttcggatga

SEQ ID NO: 8816 - DNA, 1239 bp, Methylobacterium sp.
atgaccaagcacgcgcacgaaacgcggggcgtggccctgctcgagaaccctgtgaccaacaagggcacggccttcacacgggccgagcgcgaggcgcttggcctcgaaggcctgctgccgccctccgtcgaggatctcgaccggcaggcggagcgagtggcgagccatctcgccgccaagccgagcgacctcgaacgctacgtctacctcacgggtctgctcgatcggaacgagaccctgttctaccgggtggtgatggccgacccgatgcggttcctgccgatcctctacgatcccacggtcggcgaggcctgcctcaagttcggtcacatcttccgccgcgcccgcggaatgtacgtctcgctcgagcacaaggggcgcatcgccgaggtcctgcgcaactggccggtgaaggatgtgcgcttcctctgcgtctccaccggcgggcgcatcctcggcctcggcgatatcggcgccaacggcatgggcatcccgatcggcaagctccagctctacaccgcctgcgccggcgttccgcccgagatcctgctgccgctgctgctcgacatcggcacgacgaacgcggcgctgcgcgccgacccgctctatctcggcctgcgccgcgagccgcccccgaccgaggaactcgacgccttcgtagacgagttcgtcgcggcggtgcaggaggtgtttccagattgctgcctccacttcgaggactggaaaggcaccgacgcgatccgctatctcgcccgctaccgcgaccgggtactctgctacaacgacgacattcagggcaccgcgagcgtgacgctggccggcctcgccaccgccctccagatcaagggcgaagcgctgcgcgaccaacgcatcctgttcctcggcgcgggctcggccggcatcggcatcgccaacctgatcgtctcggccctggtcgaggagggcctgtcgcaggacgcggcgcgcgccaggatctccctgttcgacatcgacgggctgatcgagccgaagcgcaacgacctcttgccggagcagaaggtcttcgctcacaaggcggagccgtccgacgacttcctggcaaccgtgaagaccttcaagccgacggtgctgatcggcgtctcgacgaagggtggcgcgttcacgcgcgagatcgtcgagacgatggccaagctgaaccagcagccgatcatcttcgctctgtcgaacctgtggatgtcggtggcggcgattgccccgtga

SEQ ID NO: 8817 - DNA, 402 bp, Methylobacterium sp.
atgaagacgcgaaccaagcgcatcttcctgggcatcggcttcaccctaccggtggctttcactttgacaggtgggctcctgctggcagcccactccgcgatgaggccgaaccccgcttcgcgcccgctcttggctgaagggttgccgcacgaactccgatcggcggatcgagtcttcgcgaagcgtgtcctgacggccttcccggtcggattgccggaggccgatcttgttcggacgctcgacgctcaaggtttccagtgccgcgagatcgaggggcggcggcaatcgagtttcgtgcagcaggcaactccctgccagcatacttggagcatcgactggatcgcggacaatgagggtcggattgccgagataaaggcgaatgacgatccggtctgcctctga

SEQ ID NO: 8818 - DNA, 213 bp, Methylobacterium sp.
ttgggtcgcgccgccgccgcaatcgggcgggatgagcactccgtcaagcttctcccgctagacgctctccacgcggcggtgtccgccgccgccctcgacgcctgcccgatttcctctcagccgcgaagcccatccatgacggtcgtcgtccttatcgcctgcaacctgctgctggccggcctgttctctctggtcgccgtcgccctcgactga

SEQ ID NO: 8819 - DNA, 159 bp, Methylobacterium sp.
atgaggatcatcgtcgcgcgtgtcatggccgtcgccgtcatgctgctggtcatggcggcgtggcgcggtcttgagcagctcggggtagcctctctcttcgaggaatgcctcgtcgccgctgcggccgcgaccgctgcgacagttctcgctcgctggtga

SEQ ID NO: 8820 - DNA, 834 bp, Methylobacterium sp.
atgccagacggaaccgacatcatgcatatcgatttcaccggcaggaaagccatcgtgaccgggtccaccgccggcatcggccgagcgacggccgaggggctggcacgcgccggcgcggcggtcgtcgtcaacggtcgcggcagcgggcgggtcgacgaggcggtgcggcagatccgggacgccgttcccggcagcgacgtgtccggcgtcgccgccgacctctcgacgatggaaggcgtggaggcgctcgtcgcgcaggctcccgacgccgacatcctcgtcaacaacgtcggcacggcctttctccgcccctacacgggcatcgacgacatcgccgctatcccagatgcggactggctgggcctgttccacctcaacgtgatgagcggcgtgcgcgcgacccggcactacctgccgaggatggtccgcaagggctggggacgggtcgtgttcgtcagcagcgagtcagcggtcaacacccccaaggagatgctcgactacggcatgaccaagaccgcgcagctcgccgtgtcgcgcggcttggccgaggcggtcgcgggcacgggcgtcacggtcaacgcggtcctgcccggcccgacacggtccgagatcctcggcaacttcatggcgcggcaggcgagggaccagggcatcacccaggaggaggcagagcaggcgttcctgtcgtcgctgagaccgacgagcctcctcgggcggttcgcgacgaccgaggaagtcgccaacatgatcgtctacgcctgctcggagcaggcatccgcgaccagcggcgctacgctgcgtgttgacggcggcgtcgtccgctacgtggcatag

SEQ ID NO: 8821 - DNA, 189 bp, Methylobacterium sp.
ttgggctctgccgctcagcccttcgccctttttcggcgcttctcacaggatgagcgcggagcgacggcgatcgaatatggtatgatctgcgtcttcctcggtcttgcgatcgttacaggaatgcagacgttcgggagcgtgctcatggaagcgcttcccaagacggtccagtttcccaagtgggaataa

SEQ ID NO: 8822 - DNA, 273 bp, Methylobacterium sp.
gtgcgctggcacggagccttcgttcaggaggggcggacgcaggccaagccgatgggcggcgatcaacgctcgcatacaatcgaggcgcaggccgacctgatccggcagacctacgaagcgcagcccgagcttttcctgcatgagctgcgtgaccgtctggccgaacgaggcctgcgggtcggggtcagcagcctgtcccgcttcttcaagcgccacggcatcacgcgcaaaaaaacaccggccacgccgccgagcaggagcgggaggacgtga

SEQ ID NO: 8823 - DNA, 1116 bp, Methylobacterium sp.
atgccgacgatcaacggaacgaatcaggccgataccttgctgggcacagacgatgacgacgtcatcgacgggcgcggaagcaacgacagtctgatcggtggggctgggagcgacaccctgtacggaggatccggcgatgatcttctcgacggcggcgacggcaccgatgtcctgtggggcggcagtgggcgggatacgctgatcggcggcagcggcgacctcctctacggggagagcggtgacgacgatttcgtcctgctgccacctcagccgggtattcccttggacaggactgaagcgttcggcggatccggcgatgacagcttcacgggttcgggatcctacaacttccgcctgactctgcacggcgatgccggtcgcgacagcttcaccttcgacttccttcaggcgagccgtctggaggggggagacggacgcgacacgttcgacatcaacacgatgtcgagcggcacgctgtcgggcgacgacggcaacgacagcatccggatcggcagtgcgctgggcacgatccacggcggcaacggcaacgatacgatcgcgatcggctccgcaaaatccaccgcctacgtctatggggacgccggcaacgacaccatttcggtcaatgtcgggcgcgcggtggtcgagggcggcgagggcaacgatcacctcaccggcggctacgatcgctacgtgtcgagccagttctacggaggggccggcaacgacatcctcaccagccgcgggcacaacattctcgatggcggcgagggacgcgacacgctggagagcggggcctatcagaacgtgatgaccggcggcgcgggcgcagatcgcttcgtctacggcgatctcgtgcaatgggacatgatgagcgccgacaccatcaccgacttctcggtcgcatcgaaggacaagctggacttgtcgggattgctcgccaaagtcggcgcatcggccgaccccttcggcgacggatggctgtcgctcgcccttgtcgatggatcgacggaaatccgtttcgacagcgatggcggcgcggacaacttccagacgctcgtcgttctccagggcgtcgatctcatcgatcagcagagcgcggcattgattgtgtga

SEQ ID NO: 8824 - DNA, 615 bp, Methylobacterium sp.
atgacggtgctggcaggtctcctcgccgccctgttcggcacctccgcctcggcgcaggtcgcgcagggcatcaaggcctatgcgcggggcgactacccggcggcgatgcgcgccttcgaggccggcgcggcgaagggcgacccgcaagcgctctacaatctcggcgtcgcctatgcggaagggcgcgccgtgccggcggatccggcccgcgccctcgattactatcggcaggcggcacagggcggcagcgtcctcgccgccttcaacctgggccaggcctatcggaaagggcagggcgtctccgccgtcccggcgcaggccgcgcactggtacgagcgggcggccaagggcggtcactacaaggccggcaacgagctcggcatcctctacatcgagggcaagggcgtgccgcgcgatcccatcgagggcatggcctggatctacccggcgacccacgcctcgatcatggatgaatccgccatggccaatgcgatccaggcggcgggcatgctcgaccgcgcccagatccaggaggcgcaggcgcggggcaagacctatttcgagcgctacatcgcgccgaaccgggcggtggtgcggacgctttccgggggctga

SEQ ID NO: 8825 - DNA, 1062 bp, Methylobacterium sp.
atggtcggcctcgtgaccgccgtgatgtgtccgccagccctgagctgcgacctcgacgccctccggcactacccgatgaccaaggcgctcgaaaaccgggcagtgccgctgcggatgcccgacctgttcttcacgtccgacaggcacccggatttcgaccgcttctccctggacgcggccggggcagccgaaatgcgggccgccctcacgcggggactggcgaccttcaagccggcggaacggcccgtgctgatgctggccgcgctcgatcactggacgagcggtgcaacaggcctgaagggcttcttcgtcctctccgacagcgtcttcctcgaagacgctctccaggcactcgacgccgagggacttctcgcgcacgccgcgctactgcgtgagggcgcggccctgttcggaccggattacggcggcagccaagcccggcgctacgcccgctggagcgacggccacggcgaaatccgcgacgcggcgctcgacgccgccctcgaccgcctctccgaacgcttccgcgccttgccgcgcctcctcgacgaggcggtggcgcggatcgcccgcgcgccggacctcacggcgctctacgagccgctacggtccgatgcggacgatgacgaccgcctcgcctacctcaccggcgggctctggacgtgcctgaaccactacgacgcgcccgctgcggtcgccgcccgcctcgccgccctgccgacggcgcatgcgcggatcatcgcggtgcgcatcttcgaggccgagatgctgaacggctcggtgcaccaagccttcttcaattcctccggcgtgctggcgcccgacgtggtcgaggcgctgaaggcgatgaacctgcccaagcacgccgctgcggtcgagcgcggcatcgcgatgttcccgaagccctatccgcgcgacaccgaggcgcgccgggccttcatggggcggcaggacaaggctttcgatacggcgctcggcgacctgaccggcgacgtggatgacggagcgatgcacgcggcgatgatcgccaccgcccgcgcggccgacatcctgccgaagtga

SEQ ID NO: 8826 - DNA, 1011 bp, Methylobacterium sp.
atggcgcgggatccctacatcgtcaggcccgagactctaccgtccgccttcccgccgggacacgagccgccccggctcctcctcgacttcgccgactggctcgaggggcggccctggggcagcctcggctgcttccgcctgcaggggacgctgagcgacgaggccccgatcgtcgacggcagcgccctgcgccgggaattctcactcttcctctacctgcccgacggttcactcgtcggcttctggcacccggacggcgtcccgacgccgtcgagcccggtcgtcggtctcggctcggagggcgacgcggccgtgctcgcgggctcactcgaaggcttcctggccaagctcgcccgcgacgcgttttcggattccacctggagcgatctcgccgccgccgaggaagacgaggaagacgacgaggaggaagacgaaggcaacccgacgcgggcggcggatgacgagacgcgcgacgctctcgcggaatggctcgcgggccgggtcgggccggagcgcctggacgcgttggccggcgaggtctgcgattcgacggcgttcgctgccaggatggatgcctggatgcacgagcgtgaggcctactgggccggacattcgatcctgaccgagatcgggcgcgccttggccgcacaccgcccgcctggcaagacgccctgggacaggacgcagctcagggccgccatcgtcgggacgctgtgcgaggtgcaggtctaccgcgccgggccgcagccggtcccggaaattgcccaggtggagccgctgctgcgtgccctgcgggacgagcagcaccgaaccgatcccgatctcggcctctggttcgaggcgcatctgacgctggatgccaagggctgcatcctgccgcgcttcgactaccagacccgcccgatcctcggcggcgccccggcacccgtcgagcaggcacggtcggacctctcgcgggcgccgcggccagcgcggtgggtcccggactggctcgccgattcgcgtgcttga

SEQ ID NO: 8827 - DNA, 375 bp, Methylobacterium sp.
atgtcggacacgaaatggcgcaagctcctgtgcgcgctggacgaggcaggcttcggccgggcgcagatcatcgtgcagttcatcgattgtcccgagccgggggtcatgaccctgccgacgcgagccgatctctggccgccgcggccttacgtcgattcgatgtcggtcggcccgttcgagctacgcgccatcgcgtggctcgaactgcccgccttcgcccgctggcccggccgggacggacgccccgtgcccggcatcccccaggatgtggcgcgcgcccgcgcggtgctggagtccctcggccgcttccccctggaggagacggagcggggcctgcgcgtcatcggctacagcggccggcggagcggggcatga

SEQ ID NO: 8828 - DNA, 1527 bp, Methylobacterium sp.
atgagggttcgcgcgcagatcggcatggtgctcaacctcgacaagtgtatcggctaccacacctgctcgatcacctgcaagaacgtctggaccaatcgtgaaggcgttgaatacgcttggttcaacaatgtcgagtcgaagcccggcatcggttatccaaaggattgggagaaccagcaccgctggaagggcgggtggacccggaagtccaacggtcgcatcgagccgaagatcggcgccaaatggcgcgtcctctcgaagatcttcgccaatcccgacctgcccgagatcgacgatttctacgagccctatacgttcgaatacggctggctgcagcaggcccccgaacttcaggcccagccttccgccaagccacgctctctcatcactggcgaggtgatgaacaagatcgagtggtcgggcaattgggaggacgatctcggcggcgagttctcccgccgttctcaggacgccaatttcgacggcatcgagaaggagatctacggccagtttgagaaaaccttcctgatgtatctgccgcgcctgtgcgagcattgcctcaacccgacctgcgtcgcctcctgcccctcgggcgcgatctacaagcgggaggaggacggcatcgtcctgatcgatcaggaaaagtgccgcggttggcgcatgtgcgtctccggctgcccctacaagaagatctactataactggtcttcaggaaaatcggagaagtgcatcttctgcttcccgcgcatcgaatccggtcagcccaccgtctgttccgaaacctgcgttgggcggatccgctatctcggcgtcatgctctacgatgccgaccgcatcgaggaggcggcctccgtcgagaacccgaagtcgctctacgagtcgcagctctcgatcttcctcgatccgaacgaccccgccgtgcggcggcaggcgctgctcgacggcgtgccggaggagtggctcgacgccgccatcctgtcgcccgtctacaagatggcgatggaatggaaggtcgccttcccgctgcaccccgaataccgcaccctgccgatggtctggtacgtgccgccgctctcgccgatccagtcggcagccgaggccggcaagatctcggccaagaacgggatgccggatgtcgagagcctacgcattccgatgcgctacctcgccaacatgctcaccgcgggcgaggaggcgccgatcgtctcggcgctgcggcggatgctggccatgcgcgccttcatgcgcgccaagacggtggacgggcgcctcgacgagcggatcgcggaggaggtcgggctcaccgcgcatcaggtcgaggagatgtaccgctacatggcgctcgcggcctacgaggaccgctacgtcattccgaccagccatcgcgaggtgaacgagaacgcctaccatctgcgcggctcgaccggcttctccttcgacgagcccaccaacggcgccacgaagacgaacctgttcggcggcgccaagcgcacgccgcgcaagccctacatggacgtgccgctatga

SEQ ID NO: 8829 - DNA, 291 bp, Methylobacterium sp.
atgctgtccggcctcgcctacttccttgcgagcaccctcatccttcagcctgtccaggccgaggtcgccgatcggcttcgccaagccaaggtggcgccggaggtcgttgcccaggcgcaggcctgcgtctcctccgccctgccgaccttggttcagcgggtcggtgacgattattggtgggccgcgacgaccgcggcgggggtctggctcggtctgacgccgctcgagcgggtcgtcgccgacgtggctccgtcctgccgcggaaccatcgacacgatccgtgcgagctga

SEQ ID NO: 8830 - DNA, 411 bp, Methylobacterium sp.
atgcagaccgccgctaacctcgccaacccgctggtcgatgccttggtgcgccacgccgagcgccgcaccggctcgcggatgctggcctacgaggccgtgggccgcacgatcggcaccaccgcatcgtgggtgcgcaagttcgtcggcaatcagcctgtgcggctcgacgccgataccttcctgcgcatccgcgcgacctaccaagccaactgtgaccgctgggacgcccaggcggacgaagatcgggccgcgttcttcgcgctcggagggggagacgatgcaatggatcagggcacgaacgcgcgcctggatgtggcggaaggctcgagggctgcgcgagggcggcaagcctctgccctggtggctccggtggtggatcagggcgcgcagcgactgacgcactcgcgctga

SEQ ID NO: 8831 - DNA, 885 bp, Methylobacterium sp.
atggtcaaactcaggcaggaggccatcgggttcaactacttcgacgtcctgcagcgcaaggggctgatttccgggtccgtaccaggacgcgtcatgggcatcgagggtgccggcaccgtcaccgcgctcggcccgggcgtgggcggcttcgcagtcggggaccgcgtcggctacctgcggtcccagggcgcctatgccgacgagcgactgatcgaagccgacttgctgttccacctgccggaggacgtcggcttcgacatcgccgcggcgctcaccgtgaagggcttcatggcctggctctgcgcgcgccggctctacgaagtccagcacggccagaccgtcctggtgaccaccgccgcgggcggggtcgggtccttggtcacgcggctcgcggcgcatcacggggcccgcgtcatcgggatggtgggaagcgagcccaagcggcgcccggtgcgggatagcggcgccgtggacgtggccgtcggcctcgacgatgcaggcgggatggttgcgcggcttaccggtgaaacgggcgtggatgccgtcttcgacggcctgggcgcggacacggccgagcgcctgctggccgctaacgccgtccggccgggcgggaccatcgtttcgttcggtgcggccgccggttggccgacggcggaccgagaagccatcgcgaggcgagggtactcgttcatggcaccgcaggcacccgactacatcgccagcgcgagcgagttgcgcggcgcgatgacggaggtgtttgccctccatcggaacggtgccttcggcgcgataccgctgacgcggcatcccttgcgcgatgccgccgagcttcaccggcaggtcgaccggcgtgtcgtctccggcatctcgttactcgtgccgtga

SEQ ID NO: 8832 - DNA, 555 bp, Methylobacterium sp.
atggcagtcgtcgtcgaggatgccgcggccgtgcttggcttctggttcggtgaggtgccgccggacaagcgcttcgcgaaggacccggtgctggacagggtcatcgaggaacgtttcggagcgctacgcgaggcggtgctggcaagcgatgccgatggatggcgggacagccctgacaggctgctggcagcaatcatcctgctcgaccagttctcccgcaacatcttccgaggtagcgggagagccttcgctgccgaccccctggcccgctcgctcacgctgcaagcgttcgaccgcgggtgggaagaccgatacgcccatgagcagctgcggtttctctacctgcccctggcccacgccgaggacatcgagatgcaggcgctgtcggtcgccaggtacgaagccctcggcgacccggaggccctgaaggccgcgcgcgaacatgcggatgtgatccggctctacgggcggttcccgtcgcgcaacgcggctctggcgcggcagtcaacgcccgcggagatctcttacctgcgagaaacaacgcatcgttggtag

SEQ ID NO: 8833 - DNA, 309 bp, Methylobacterium sp.
atggtcatcgtcaaaaatgacctgatttacatcgcgcggacacggaatgcgctgacccttacggaggcgtcgtatccgcctgtacaatacatccctcgtggcgatgtcgacatgtcccgattgattagatcccagcacacgacctactgcccatacaagggcgaggcgaactactacagcatccccgctctcggggacgcgggggtgaacgccgtttggacctacgaggcacccttcgaggcggtgggcgacatcgacggatacctggctttctaccccgaccgcgtctccgtcgagttggctgaatag

SEQ ID NO: 8834 - DNA, 864 bp, Methylobacterium sp.
atggtggaagggctcgccgatctagcgcgcaccaaccgtgctgctacggcggacttgaatgccgctgcagctgagatccgcgcctccgcccaggagcaggccgcgagcgtcgaggagcagttcgccgctgtccaagagaccgctgctaccatcgatgaaatttcgcaatccggcgcccagatctcgaagcgggcgacggaagtcattgcgaccgctcaggccgcggcgcagaccgcccgctccgggctgcgcgcggcaggcgacaccgcgaaggcgatggaatcgatccgcgagcagggcgaggcggtcgccggcaacatcgtcgcgctcagcgagcggacccaggcgatcggcgagatcatcgtcaccgtcaacgacatctccgagcgcacccacctgcttgccctcaacgctgcaattgaggctgctgctgcaggcgaacaagggctcagcttcacggtagtggcctccgagatgaagctgctcgccgaccaagccaagaatgccacggtgcaggtgcgcggcatcctcggggagatccagcgcggcatcaacgcttcggtgatgctcaccgaggaggcggtgaagcgcgccgccgccggcaagactcgcaccgactccactgtccgcaccattgaggagatggcggcgcgggtggaggaaagtgtgcagaccttccagcagatcgtggcgtcaaccaaccaacagctgctcggcatcgagcaggtgacgggcgcgcttcacaacatccggcaggcaagccagcagacggccgccggcactcgcgaggtggaaacggcatccgccaacctgaccgaattggccggcgaactgctgacccgctccgaacgctaccggatctag

SEQ ID NO: 8835 - DNA, 342 bp, Methylobacterium sp.
cccctgcccgctcatgccggtcacgggctgccctcgggtccctccgacgggggcggccagggccgcctcgcggctgccttcgccctggccctggcgctccacgccgcggggctcctcggcatcgcttatctgcgcctgacgccgccctctcccccgggggagcaggagatcacgatcgatctcgcgcctcagatgatggaggccgagacccaggcgcctgccgaaacccagcaatcggaagccattccggaagaagccaagcccgagggcgagccggagacggcccagccggtggagaccccgcaggaggtgcagccgccgcccccgccggaaatgacgcag

SEQ ID NO: 8836 - DNA, 132 bp, Methylobacterium sp.
atgcatccgcaggtcgacgtttcgagccggaccgaagccgcgacgccctctgtgctgatggcgttcctgggctttgccacatcgaccgtcggcttcgtaggcatcatgaccgtgctcggcaccttggcctga

SEQ ID NO: 8837 - DNA, 513 bp, Methylobacterium sp.
atggccacgaccgacatcggcacgatctacgcgggtgcccttcgcaatacgcgcgcccttgagaagcagggcctggaacagatggagcgtcagctctccggcctcgaacgttaccctgactacgcggccatcctgcgccgtcatgtcgagaccacgaagctgcagatcgatcgcctcgacacggcgctggagttgatcggcgagagccgctcgacgctgaaggagaccgtcacgagcgtggccggctccatcggcgcggccgttcacgccaccgcgcaggacgagacgctgaagaacctctacgcgggctacgcctaccagtacgatcaggtcgccgcctatcgctcgctcgccgtgatcgccgagcgggctggcaagaccgatcaggtcgccttcttccgtgccgcggtcgatgaggagacgaaggccgcagaggagatcgccgcgctgatcgagccggtcaccaagacctatctcgacctgacgctcagcggcgcgaaggccgacagctga

SEQ ID NO: 8838 - DNA, 339 bp, Methylobacterium sp.
gtgatctgcccgaagtgcagcggctccacaaaggtggtctacggccggccctcggcgaaggaaccggctgtcttcgagcgccagcgcgtgtgcgtgagcgccgactgcggcgagcgcttcatctcctacgagaccacggcgaacatcgtcacccgccgcgtggagaaggcccggcgcggtggcgcgcggaagatccaagacatccctctcgctcggcaactggccctgcggaaagccgcagaggcagagggccgaaagctcaacaagcccgcgtccgagatcctgaagtcttggggtgtgagcgccaagccatcacgccccgccaaccccctcccgtag

SEQ ID NO: 8839 - DNA, 249 bp, Methylobacterium sp.
atggtcgccgccggcttctcggccgagcagattgcgaccgtggtcaaagctgaacttgtcgccgatcaagcccgcttggcaaaggtcgatgaggcgcgccgcgcaaaggccgctgagaagaagcgccgccagagggccgcaaagggcgatgtgtcccccgatgtccctgggacacagggggacaaccggggacacatggggacacatggggacagcccctcccttcatggtctcccccttccccagacc

SEQ ID NO: 8840 - DNA, 774 bp, Methylobacterium sp.
atggctcaggatctcacgacacgttcggccgcggcgttgccagccatcgacacggcggatccagcttcgatgctgttgctaccggattggctcgcgtcgcagctcgccgcggtctcggatctgggggccgggcgaacggaggtggatccggtcacgaggcagatcacagcccgcgtcgcgacgatcccggcatcgaggatgccgactggtccccagcgggcagcgatcgctctgcgcatcgccgacctgcaggccgccactgaggccgggccggtgggagagacgatcgccgccctgggcgacctcattcaggaatacgcgccgacccggctggacgaccgcacggtgagcatcaaggccgaggcctacctcgacgcggtggaggatctgccggcctggacgatccgggcggcgatccggcgctggcgccgcggtgaggtatcggccgatccggccacgctcgacttcgcgccgaagcctgcccgcctgcgcagcatcgctgagcggatggtgctggtcgcccgcggtcaggcggcgcgcctgcagcgcgtcctcgacgccaagcccgaggagcgcatcaccgacgcccagatggccgcgaacagcgagaagctgactgggctcatcgccaagaccgcggacgggcctgtgattgagccccagggcgccatcagcgcggagcggcgcgcggccctggccgatctggaggagcgccggaagcggcgtgaggcggccgagcgcgaggccgcggctgcgcaggagcaggcgtcgtga

SEQ ID NO: 8841 - DNA, 189 bp, Methylobacterium sp.
gtgatcccgggctggatcggcgacaccatcatcatcggcggcgtcacctcgcagaccctttcgggcgcgaccgtgctggcgaagcgatcgcgcgggacgctggcgctctcgtcgggcccgttcgagacggcaacgccgaacctcacgatggcgaccattcccgtcaccgtccgcgtcatctgcaactga

SEQ ID NO: 8842 - DNA, 1614 bp, Methylobacterium sp.
atggataccaccaccgaagacacgctcgcggaagccgatcagcactacgccgccctcggtctgacccgtggtagagtcgcgagcatcacggatgtgactgccgcgttccgccgcctttcgatggagggggggcatcccgacacgggcgggctcgctgagcgctttatcgcgcttaaagcggcttacgattggttcaagcagaagctcaaagaacaaccaagcttcttcaccatcgaggcgcttcgctacgcgggcggattcggcgcttcgggtggctatgatgcgtatgacggtcgtgacggctatgacgaccgtgacgctcatgacggcaagcgcccacaggatgggttgggtgactgccctttcgacggcaaggtcaagacgcgtgccatggatttcatccatgagtacataagcaatcgagaactcgtcgtcgatgctcgcggcgtgatctcgcccagcaacggatacaagaccgtcgagactcacacggttgaagaagttctgagggagcgcgatatcacgttcccgcggctgctcgacgagataaagttttaccgggaccgcacgcactccaaaggcgatgaaggtctatccaactttgagctaaagcaggggctgatgacagtcatcggcaacctcaagaatgagcgccaagcggtgattttcgaaggtctcatgctggaactcagcgatgctgaaaggatcgatgctgatctggcatggtcccgtctcgccgatgttgccttcgatggaaatccggttgtagccatcgcgatcttgaagaagctcatccatcaggtgaaaaggaaggctctcaaggctgaagttgaaaaccatcttgttccggtgatcttctccccgcaccagggactgggaaagtcaaaattcgttcgccagtttctcactcccctggaggagttgttcggtgggaacaccaatgccagcgctctggtcgatcaaagcaacatcggtctgtttgagcacccggtgattttcctcgatgacatgcagagtttcgatgagaagcacatcgccgcgctgaaggatgtcatctctgcggatgagatttcacgacgggtttactttactcagaacatgcaaatattccgccagaagagcactttgatcgcgaccactaacgtggacattacccgtgtcgtgcccgatcccaccggccatcgccgcttcggacagatgctctttcggttttaccctcctggccctgagcggaagaaggtgtgggatgtcatcaaccagaccgattggcttcttctctggcgcagcgtcggtcacggggatgccgaccctatcaaggatgtcctgcccttcttaaacacgcagaacaccgccaaaacccccgaaggacggttgcggacgtgggtgcgcaagcttgacctcaaccgaccggagatcgcagcaactcggcggggagtgaccgaggtgcactacatcgcggcggatttgttcgcagtttatgaaacggacaccggcgggagttcgggcctgaccgtgaacgacttccggcgcattctcgatgaatgctgccgccagggtgtcggcccgttcgttggatcggggaagcacgcgaagggtaagtcctaccgcacgtag

SEQ ID NO: 8843 - DNA, 324 bp, Methylobacterium sp.
atgggctgggtgcgaaccggagccacggtcgagcgcgtcgccgccgaggcggcgatcccggcgcggaccgtcgcccacgctcgcagcctcgtcgcccacgccatcgggcgctggccggcgcccgacgccgtccagcccggctactggccgacactctgcctgatctggccggccctcgaagtcgagatccacgacgaccggttcgaactctaccggttcgggccgaacgccacgcagatccgcgaatggcgctgcggcccggatgcccccgcagccgataccctcgacgctcttctgcacgccgccttcggagaaaccgcatga

SEQ ID NO: 8844 - DNA, 948 bp, Methylobacterium sp.
atgatcgccctcccgttccacaaggctccggcgccgccagccggattcaagttccgcgtgctgatgaaccagtacgacgaggagcttcagttcacgttcgtcgacgacgatgttcccaatcgcgggctttcgaggccgagccagcccgacttcgaccaattcgtcgtcactctcgattatcagcagaagatcgcacaaatcgctgcggaagatcggccgagcagcggcggcctggctggcccggtcggactgccgatccaccacgaacccggcctgtggctctacgagaagaaccgccggagtacggacgatcagatcaagggcgatgcggtgtccgaggtcgagctcgacgtcgcgcggctggcatcgatcccacacggaaattcagtcctggccctcggcaagtcggaggtgcaccacggcatgccgccgatcccgcccatcagcggcctaccctcgggccggttcgaggatgtcacgactccggactatgatttcagatccgccaccgatcccgatccgtatttcgaaccgtaccggcattacatcgacaatcccttcatggggaatgtcacggcgcctggatttcctggcttcagcccggccgacatgaacgcaattctgcgtttcgcgaaccagaacgtcgagatcgttcggacgacgacgctgactgttgattcgacgcgcaagagcgctggaatctcgaatgttcccttttcggttcgcgaggccgaaccggtcagcatgaaatcgacgttctggattcaggagttggcggagaaggacgagcagggcaatccgaaactccgtttgcaatactcacaggtcgtcatgctgcatttcttccgccctcgggaagacgaatttccggaaagagccgtctggccgcatatcagcatcgcgaccctggacaagctgcctgccggttacgaactcgtggagagctag

SEQ ID NO: 8845 - DNA, 927 bp, Methylobacterium sp.
atgagtgccacgctcatcatcgaccgccgtccggacccggcgatgccgaccggctgcggcagcggctgcggctgtgcctcggcgtcgaaaccgcccgtgccgccgccgagcgacggccccgtctccgtcaacggcgtggcgatcgcggccgaggcgatcgcccgcgagatccagcatcatccggccggcgacggcgccgccgcctggcgagcggcggcacaggccctcgtcgtacgcgaattgctgctccaggccggccgggcggcggggtttgcgtcccgcccggaacgggacgaggccgggcggtgggaactggccgaagaagcgctgatccgcgccgccctcgatctcgcacccgagccgcagagggcgggcgcggcggagtgccgtcgctactacgaggcgaacctccaccgcttccgcatgccggacctgttcgaggcgtcccacatcctgttcgagccggcctccgacgacgcggcgggctggcagcaggcggagagggaagcgcgtgcgctggcggccgaactcggcgacgatcccggcgacttcgccgaggccgcgcgcggcttctccgcctgtccgacggcgcgccaggatggatcgctcggccagttgcgccggggcgaactggtgccggagatccaggcggcgctggaggctctgaccgagggcaccacgggacgtgttccggtccggtcccgcttcggctggcacgtgctgcgccaccagcgccggatccccggaaagaccctgtccttcgagatggtggccgacaagatcgccgagatgttggatgcccgtgcctggacgatgagtgccgccggcttcgtcctgcacctggccgaagacgcgacgatcgagggcatcgccctcgatgccgagagcctgtcgcgcctgcccgcctcgggcggcgccccgccgtga

SEQ ID NO: 8846 - DNA, 774 bp, Methylobacterium sp.
atgtgggaggcggtcaattatctcctcttcggctggtatccgtaccttgccgtgacggttctggtgttcggcagcatcctgcgcttcgatcgggcgcagtattcctggcgctcggaatcctcgcagttcctccggcgcaagcagatgctgctcggatcgaacctgttccacctcgggatcctggtcatcctggtcgggcatttcgtcggcctgctgacgccgatcgcgctgttcgagcggttcggcatcagccacacggccaagcagttgatggccatcacggtcggcggcatcgccggcatcgccgccctgatcggctgctcgctccttctgcaccgccgcctgttcgatgcccgcatccggcgcagctcctccatcggcgacatcctcgtgctcgtcctgatctggctgcagctgatcgtcggcatcggcagcttctactggacgttccaggcgctcgacgggcacgagatggtgcgcttcatgggatgggcacagggccttctcaccttccagcccggcgcggcagacctcctgctggaaacggctctggtctaccggctgcacatcgtcatcggcctgacgatcttcctgatcactcccttcacccggctcgttcacgtcttcagcgcaccggtctggtacctgttccggccgggctatcaggtcgtgcggtcgcggcgcggaccggcgcaggcggtggccgacccgttcgccggcgcgatcagcggggcagcctcgatcggacgggctcaggcggagagcgcgcaatga

SEQ ID NO: 8847 - DNA, 699 bp, Methylobacterium sp.
atgaggtacacgctgcgcgccctgtcggtgctgatcgcctatccgagcgaagacctgcaggcccatagcggcgcggtccgcgaggccctgcacggggaggcggaactgccgcccgaggccctggcccgcctcgaaccgctcttcgaggcgttcgcaagccaggacgtcttcgatctgcaggcgcattactgcgaattgttcgacagttcgcgcgcgctctcgctgcatctcttcgagcatgtccacggcgacggccgccagcgcgggcaggcgatgatcgatctgggccaagcctatctcgcccgcggcttcatgatgcgggaggccgagcttcccgattacctgccgatgttcctcgaattcctgtcgatcctgccgaacgacgaggcggaggaatggctcgcccagccggcccacgttctggaggctctggaacagcggctcaccgagcgggagacctattacgcgggcgtgctgcacaacctgctgcatctggccaagcgccggccgtccaccggacaggtccgggacctgcccgactaccgcgatccggcgacccccgccgagatcgaccgggcctgggaggatgcgccgatcgatttcagcgcgcccctcggggacgcatcccagccatccgcgctgatgacacgcctgcgtgccgcccagcgcgatgccagagatcaagcaaaaggaggctga

SEQ ID NO: 8848 - DNA, 3780 bp, Methylobacterium sp.
atgagccacttcctcgaccgcctgaccttcttccgacagcgccgcgagaccttctccgacggctggggtgtggccaccgacgagccgcgcgcctgggagaacacctatcgaaagcgctgggcctcggacaagatcgtccgctccactcacggcgtgaactgcaccggctcctgctcgtggaagatctacgtcaagggcgggatcgtcacctgggagacgcagcagaccgactatccccgcacgcggcccgacctgcccaaccacgagccgcgcggctgcccgcggggcgcgagctacagttggtatctctactcgggaacgcgcatcaaatacccgctcgtgcgcgcccgaatgctgaaagcgtggcgcgaggcccgtgccacgctcgggccggtcgatgcctggcggaagatcgtcacggatggcgagacccgcgccgcttgggtgacacgccgtggacgcggcggcttcgtgcgggcgacctgggacgaggtcgccgacatcatcgcggcggccaacatccacacgatcaaggaatacgggcccgaccggatcgtcggcttctcgccgatccccgccatgtcgatggtctcctacgccgcgggcacgcgctacctgtcgctgatcggcgccacctccttgagcttctacgactggtactgcgacctgccgccgtcctcgccgcagacctggggcgagcagaccgacgttccggagagcgccgactggtacaatgccggcttcctgctcgtctggggctcgaacatcccgcagacccgctcgccggatgcccacttctacacggaggcccgctacaagggcacgaagagcgtcgtcatctcgcccgattacagcgaggcctgcaagttcgccgacctctggctgcacccgaagcagggcaccgacgccgctttggcgctggcgctcggccacgtcgtcctgaaagaattctacatcgaccggcaggtgccgtacttccaggactacgcgcgccgctacagcgacatgccgttcctggtgaaattggtcgagcgggacggcaaattgctccccgaccgcttcctgcgcgcggccgacttcgcggacggtctcggtgaggcggcgaacccggattggaagaccgtcgcgctcgatcaggacggcggcatcgtctgcccccgcggctcggccggcttccgctggggcgatcccggcaagtggaacctggaagagaccaacggcgccggcgagccgactcgcctacgcctgtcgctcgccggcatcgaggaccggctggcgccggtttcgtttccctatttcggcggcatcgcgccgggaggcttcgtcgccaccgatcaccccgaggtgctgagccggctcgtgcctctgcgccgcgtcgcgctgaaggacggggaggcgctcgccgccacggtgttcgatctgctctgcgccaattacggcgtcgaccgcggtctcggtggggacgacgtcgcggcgacctacgacgacgacgtgccgttcagcccggcctgggcggagcgcatctgcggcgtgccgcggcaggcgatcctgcagaccgcgcgggaattcgccgagaccgccgagaagaccgatgggcgcgccatggccatcgtcggggccgggatcaaccactggtaccacatggacatgagctatcgcggtatcatcgcgctgctcatcctgtgcggctgcgtgggcaaatcgggcggcggttgggcgcactacgtcgggcaggagaaactgcgcccgcagaccggctggctaccgctggccttcgccctcgattgggtgcgcccgccgcgccagatgaacgggacgtcgttcttctacgcgcattccgaccagtggcgctacgagacgctcgacgtctccgacatcctctcgccgacggcgccccccggcgactggtcgggctcgatgctcgattacaacctgcgtgcggtgcgcatgggttggctcccgtccgctccgcagctcggcatcaatccgctggcgctagcccgcagcctggaggcgcggggcgaggagcccgccacggccctgccgcgcctcttgaagtcgggtgaagtccaattcgccatggcagacccggatgcgccgcagaactggccgcgcaacatgttcttctggcgctccaacgtactgggcgccagcggcaaggggcacgaatacttcctcaagcatctcgtcggctcctcgcacggcgtcgtcgggaccgaggacggcatccggccgacggaggtcgtgtggcgggaggaggcgcccaaaggcaagctcgacctgatggttaacatcgacttccgcatgtcgaccacaagcctctattccgacatcgtcctgccgacggcgacttggtacgagaagcacgacctcaatacctcggacatgcatcccttcatccatccgctgacggccgcggtggatccggtctgggaagcgcgcagcgactgggacatcttccgcaccatcgcccagaccttctcccgcctctgcgagggcgagctcggtgtcgaaaaggacatcgtcctcaacccgatccagcacgacagcgccgccgaactcgcccagccctacgccccgctcgactggggccgcggcgagaccgagccggtgccgggccgaaccatggcgtcgatcgccgtggtggagcgcgactatcccgcgacctacgagcggttcacggcgctcggccccaagctcgatacgctcggcaacggcggcaagggcctggaatggaacacccaggccgaaatctcccaactcggcgcgctgaacggccgcgtcgaggcggggccggcggcgggacggccgaagatcctgaccgacatcgacgcctgcgagacgatcctgatgctcgcgccggagaccaacgggcaggtcgcggtcaaggcgtgggaggccctgggccgggcgaccggacgcgaccacgcccacctcgcggccggcaaggaggaggagaagatccgcttccgcgacgtcgtctctcagccgcgcaagatcatctcctcaccgatctggtccgggcttgagagcgagaaggtctgttacagcgccggctataccaatgttcacgagctcatcccctggcgcaccctgacggggcggcagcagctcttcctcgaccatccgtggatgctggccttcggcgagggcttcgtgacgtggcgtccgccgatcgacaccaggaccgtggcgcaggtcgccggcaagctgccgaacgggcaccccgagatccagctcaacatcctcacgccgcaccagaaatggggaatccactcgagctataccgaaaacctcctgctgctcagcctcaaccgcggcggcccgacgatctggatcagcgaggtcgatgcccgcaaggccggcatcgaggacaacgactggatcgaagccttcaacgtcaacggagccgtgaccgcccgcgcgatcgtctcccagcgcatcatggagggctcggcgatcatgtatcacgcacaggaaaagctcgtgaatacggtcggctccgagatcaccaatcagcgcggcggcgtgcacaactccatcacgcgcatcaacatgaagccgacgcacatgatcggcggctacgtccagttcgcctacggcttcaattactacggaacggtcggcgccaaccgcgacgaattcgtgatcatccgcaagatgagtcacgtcaactggttcgacaaagccgtcgacgacaccttcaatacggacgccaccgccgattggggcgggcacggcgtcaatccgaacaccaagtcgaaggagacggcggcatga

SEQ ID NO: 8849 - DNA, 303 bp, Methylobacterium sp.
atgtccgagaccagccacagccgatccgccaaggcgcagaaggccgaaggggtgcaggccgtcggcagcgccaaggccggggccggccatccggacgtcaccgaaggcggtccggccgcgtcgccgactgagggcaaggggcatccgaagcccgcggcctccaccgccgacaccgatggctcgcccgaggccggcacgtcatcggccaccgccggcaaggccgagaagctggccgccgccgagaacgcggccctgaccaaggagcagcacggccgcgggcggcgcaaggcggaggaggcgtga

SEQ ID NO: 8850 - DNA, 525 bp, Methylobacterium sp.
gccgtactgacggggctgccccctgcaacgcgcttcggccgctcagggatctatgcccgcttcgaccagatggtctggcgccccgatccgaacggcatcggggggctgaccctgttcggcgtcgccatggccggcaccggcggtcgcctaatcgaggactacttcctggagatcggagcgctgcagaccggcaccttcgccggtcggccctacgacacggtcggcttcgtcatcaacacgcaggccttcagcccgctggcgctcggcaacatcgcggcggcgcaggcctcgctcggcctgttccgcaccatcccgaagcagcagatcatgatggagctgaattacgggattcaggtcacgcccgcgatccggctgacgccgaacctgcaatacatcgtcaacccggatcagacccgcttcccgtactacccgaagaacatccccgacaccctcgtcgtcggcgccaagctctcggtggacctgttcaccctcgccggcctcgccatgggtccgggaagcccctga

SEQ ID NO: 8851 - DNA, 423 bp, Methylobacterium sp.
gtgggggagggggcgatctccggcctgttcaccgtgctcgtcgagggcgacgaccacaacgagccggtggcggatgcggtgcgcggcatcctcgatggccacatcgtcatggagcggcgcattgccgagcaggggcgctatccggcgatcaacgtgctgcgctcggtctcgcgcaccatgccgcgggcctgcgaccccgcgcatcttcccaccgtccgccgggcgcgaaaggtgctcgcgacctatgccgacatggaggagctgatccggcttggcgcctaccgggccggctcgtcgccggaggtggacgaggcggtggccctcatgccggatctgacggcttttctggggcagggtaaggaagaagcaacctccatcggcgagggttacgctcggttggccgccatcgtcggcggcgggtga

SEQ ID NO: 8852 - DNA, 873 bp, Methylobacterium sp.
atgagcaacggcacgacactgctcaagaagtgggagctgctgcaggcgatcaccgccgatcccgctctatcgctcgtagcgaaggtgatcgcaacgcgattgctcgaccaccacaacaaccagacggggcagtgctcgccagcttacgagacgctggcacgtggcgctggtctggagcgccgctccgcaattagggcggtgaaggagctcgaagaggctggctggctgcgggtcagccgggttaacggcggcgctaccgacgcggccaaaggctttgtcacgaactcgttcgtgttcgacttctcccgggctgatcgagcctcgaccccggtgactgatcagacactccccccgagtgtccagccagacactccccccagtgcctcatcagacactcccccgggtgactggttggacacccccctgggtgactcatcagacacccccggagtgactaagcagtccccccccggagtgtctgaccagtcacccaaacacttgaaattagaaaccgggaaaggaaaccgggaatctccccctaccccctcacgcttcgacgagtggtgggagacgtaccctcggcgtgatggaaagatcgccgcccggagagcctacgatcggacgatcaagcagggcctcggctcgcacgacgagctggtgatgggggcgaggcgctacgccgacgcccgggcaggtcaggatcccaagttcaccaagatgccgacgacctggctgaacggcggacactgggccgacgagcccccgccgcagcaccagcccgcccacaatcccgcaagccggcccgacgccggcaggccgagcgcgacggcctacctcatggcgcgccaagcacggagactaggccatggctga

SEQ ID NO: 8853 - DNA, 654 bp, Methylobacterium sp.
atggctgacccgaagcgtcgcggccaggaaatcgccgcggcggcacctcgcgccgccgaacgagccgatctgaaggggctgctcgtgcccgagcagctgctgagccagcacgatcacgccatccgcaggacttgctttccatcgctacgagcaatcgacgagcgctactcgctggaatcccgggctcagcaggagcaggtgcaccgcgatgccctggagcacatgctcgcccgttcagccacgcagcacgaactgctgatggtcggcgaggctctgacggacgctatggcagccgcgccggacgagggcgtgatcgaagcctgcttggccgctctgatcgatacccgggttaagctgccccacaacctaccgatctacctcgaggccctgatctacgacctcaaggacgagggcttcccaccggccgtggtggcagcggcgtgccaacggatccgccgggagaacgtgttcctgccggagatcagcgaagtgctcgcggtctgccgggagacactgacccgatatcgcgagcgagagcggacgatcagcaaggcgctcgaagaccgccgagcggcagaggcctacatcgtccgtctcaacgcaccgaagacgccggctgaggccgtcagcgcggaggacgaggcccatggctga

SEQ ID NO: 8854 - DNA, 261 bp, Methylobacterium sp.
atgagccctgagcagcgtgcggccttcctcgcggctcgggacgccctgcggcgtgccgacgaggtgctgagcgccgtcctcgacgctgatgctgtcccggtgccggatctgttcgacgccgtgccggtggccatcgcggcgcaggcctgggcgatctcgaaggacagcgcccgtcagcgggcccgacgcggcgccggcttccggatccgcggccgctggtacgtgccgcgggccgctctgtcctgccacgtctcgccatga

SEQ ID NO: 8855 - DNA, 219 bp, Methylobacterium sp.
atgacgctccacattacccttcccgagcgcgtcagcgccgccgtcaccgaggacatggctgacgccatccgtcggacggccgccgctcgcggcatcagcgtcgccgactacctgcgcggcgcgctgcagggccgcctcctcatggacggcacgcccatccgcccccttcccgaccttcagcgcctcgccacgccagcgggccgcatccgcacgctctga

SEQ ID NO: 8856 - DNA, 171 bp, Methylobacterium sp.
gtgagactgctcctctgcttcctctccttagcgcagatccggctttctgccttcgaccgggagcgctcgaagatgctcgcccggcaggctgacgaggcgctgatgcgtgcctgctcgcggatggcgctcgccgaggaactggcacgtcgcgctcggctgaacggccactga

SEQ ID NO: 8857 - DNA, 498 bp, Methylobacterium sp.
atgtccgatttgagggtcatcgtcccggccaagcggaggaagctgcaagacgcacgctccggctcccgccctttcgcctatctcgatctctatcgcgcctcgcccttcgaccgcatcgaagtcatcaaggcgggcgtctcagccaagtcggtcaagcgcttcatcaccgcactgcacctcgaccagcaggtgatgttcgacgccctcaatctgaagacggccacggtgaacaagaaggcggccaaggatgagcccctctcggccgaggacagcgagcgggtcgtcggtctcgccaagctcgtcgggcagctcgaagcgatgatcgaggaagctggggaggccgagaatttcgatgcgccggcctggctgtcgcgctggctgcgcgagcccttgccggcgctcggcggcggcaagccgctcgaccttctcgatacgatggaaggccaggcactggtctcgcgcgcgctggcgcagatccagagcggagcctatgcgtga

SEQ ID NO: 8858 - DNA, 327 bp, Methylobacterium sp.
gtgctgttggtggaggatgattacctcatcgcgaaagcgatgggcaccgagttcggcgcgctcggcgccgaggtgattggtcctgccgggagcgtcgaatccgctctggagctgattgccacccacgaactcgatgctgcggtgctcgatatcaacctctatgaggtgatgagctacccggtcgccgaagcgctgctggcgcgcggcgtgccgttcgtgttcgccaccggctacgataaggctgcgctgccagagcgctatgcacatgtgccccactgcgagaagccggtcgaaccatatcagcttgcacaagcgctgttcgcctga

SEQ ID NO: 8859 - DNA, 762 bp, Methylobacterium sp.
atgtcagagccgcccgcgtccgcgacccatgtgctgatcacgggcgcatcgtccggcatcggtcgtgagatggcgctctcgctgtccgggacgtacccgctgatcctcaacggccgcgatgaagagcgtctcgaacagacgcggctggcctgccaggcgcctgatcggcatctgtgctgggcacgtaacctcgcggatgtcacgacgcttgcggaggcgctgcccattttcctgcggcagcacgaggcccgcgtgggcggcttcgtgcactgcgccgccctgctgaaggtgctgccgctgcgcagtgtcaccatcgcgcaggcccaggacgtgatgaacacgaacgtgctcgcggccctggagatcacgcgtctgttgctgcgtaaagacgtcaacggcaagatgctgaggagcatcgtattcgtgtcgagtatcgccagtcagttcggcgccagaggctttgccacctattgcgccagcaaggccgcgctcgacggcctgatgaaggcgctggcggtcgaactcgcgccggaggtgcgggtcaattccgtgttgccgggctcggtccgaacccccatgaccgagaccatgttcgctgattcggacaccgcagaacgcctgatgagggattatccgctcggcgtcggcctgccttccgacatcacggcggccgttgccttcctgatgtccgaccaggcgcgctggatcaccggccatcagatggtggtcgatggcggccgttcggtgaacatctccgcatga

SEQ ID NO: 8860 - DNA, 222 bp, Methylobacterium sp.
atgacgctctccgactaccttcgagcgcattcgctcacccatgccgagtttgctgctcggatcggcgccactcaggccgccgtgacgcgctatgcgaacggccgccggaagccgagcctcgagaagatcatcgtcatcgagcgggagaccgacggccaggtccgcgcgatcgacttcctgccggagatggccggggcgagcgtcagcggggctgcggcatga

SEQ ID NO: 8861 - DNA, 1263 bp, Methylobacterium sp.
atgtccacccaagcacagggcgcggtaggcgccgagacgaagacggcggggcaggttgcctacgaggcatggtgggactgccccgccgtggctcggttcagcaacgaagaccccgaccgcagagcgcggtgggagcgcgttgcctctgctgtcctcgaacatgccgcactcgccgctccccgcatggacagcgccgagaggacggcgggggaggatctgcgggccattctgctccgcgcgaaatggattggccagcgaacgacggcagaggattattcggcgcgggtcgtcttcgatacgcaagaggaagcctacgacgcatatcgcgccctcgtcgcggtgagagacgccacccccgccccgtcatcgccgggcgtgccagatagcgtgcgggagaagatccggctcgccatcgcgtcggtgaacgttcacgccgaggccagcgagtacgagttccaggccgacgaaggcgaccacaccccgaccgatgccgagcgggcaatactggaagacttcggcgagcagatcctctcgcacctcgaagcggccctcctctccacccatccggccgtgcagagcaccgggcagggggcggaagatctcggcaagtgcattgggtgcggcaaggcgctgacggcggaagaggcggagttcctcgtcaacacctgcgacggctgcgagtgggaagagcacgaatgccgaaagaacgccgaggagcttgcccccgacagcacccgcacggggccggtggggacggcgtgggttctcgtgccgaccgagccgacatcggagatgatcgaggcagcgcgcgagaccacgaagtggggcgccggcaactggggcgacctgccgccagggcacgacacctaccgcgccatgatcgccgcccgcccagcagccccggaggcgcaagaggcgtggagatcgcaagcggccgacgacgtgctggccgaacggcgccgtcaggtcgaggcggaaggttggacgcctgcgcacgatgacggccacagccttggcgaactcggcctcgccgctgcgctgtacgcgctgccctacgacgcgcgggttggtggcgagccgcttatcgaacaggatcaccacatcggcctcgatatggcccttgagatcgcctgcggttggcgtctgaagcctgacacagacccgcgccgccgcctcgtgaagtccggcgccctcatcctcgctgaaatcgagcgccgggaccgtctgcccgctcccccgtcctccggtcagggagggcgctga

SEQ ID NO: 8862 - DNA, 1527 bp, Methylobacterium sp.
atgtgggacaccctcacccaactcggcgcaggcttcctcgcctgcctccaccccgtcacgctgctgatgctcgtcgccggcatcgtggtcggccttctggtcggcgtgctgccggggctgacgctcgtcatgggcgtcgtcctgttcctgcccttcacctacaagatggaggtgaccaacgcgatcgtgctgctcagcgcaatgtacgtgtcgggtacctacggcggcgccttcacgtcgatcctgttccgcatcccgggcgagccgatccacgtgccgctgctgtgggacggctacgccatggcgcgcaagggcgagccggcccgggcgctcggctggacgctggtcgcggccttcggcggcggcatgctctcggcggtcgccatggtgctgctgacgaagcccgtggcgagcttcgcgctgcaattctcctccccggaatacttcgcgatcctgctgttcggcctgatgagcgtgattgccctcggcaaggggtcgctcgccaatgccctgatcagcctgtgcctcggcctgctcatcgcctcggtcgggacggacgccacctacggggcctaccgcttcaccttcgatcagccgatcctcgccgacggcatcgagttcctcgtcgtcatggtcggtgcctacggcgtcggagaggtactgtcgcggctcgaatacggattctccagcaagccgctcgacaaggtcgcgaacgcgcggacgcagttgccgtcgctgggggagatggtccgcctcaagggcatgttcctgcgctcgacgctgctcggacacgtcatcggcatcatcccgggcgcgggcgccaccatcgcgtcgttcgtctgctacggggtcgaatcgcagttcggccgccgccgaagggagatgggctcgggcatccccgaggggatcgtcgcgccgcagagcgccgcgacggcctccgtcggcggcgggttgatcccgctgctcgccctcgggattcccggaagcggtgcgaccgccgtgatcctcggcgccttcatgctgcacggcatccagccagggccgcagatcatggtgtcgtcgtcggccatggtctacaccatcttcgcctcgatcttcatcggcatcgccgtgatgtgcgtgctcgggtacttcgcgatccggccgctcgtggcgatcctcgactttcccgaggcgatcgtgtccgccttcgtgatgctgttctgcttcgtcggcgcgctggcgatccgtagcaacacggtcgatctgtggctgatgctcgggttcggcgtgcttggatacctgttcgagcgtctcaaattcccgatcgctccgctggtgctcggcgtcatcctcggaccgctcgccgaggaatcgttcatgaacgcgatgatcagttactcgaacgactggaccgtgttcttcacgaggccgatctccgggacgatcatggcgctcgccctgctgaccatggcgcttcccctcgtcggcatgctgcgcgaacgccgggccgaggcctcgggcgcgctgaagccggcagcccgctga

SEQ ID NO: 8863 - DNA, 1797 bp, Methylobacterium sp.
atgacgatggacggcgtctttcagaattgtatgcgccaagtgcgccgacaagtgatgcccgtgatgtggttcagcctcgcggtcaacttgttgatgctgatcagcagcatctacatgatgcaggtcttcgatcgggtgctcgccagcggttcgctgcatacgctgctgtggttgaccatcgcggcgctcctgggcatcgccgcctacgcggtcatcgagcaggccaggcgccgtgtcctggcgcgcaccggtctgtgggtcgagcagcggctgtcgcagccggtgatccggcgcggtgtcgacgcgaggctcgcgggggtccggagcgaggcgagcgcctccgacgtgggggacttgaagaccttcatctcgggtgaggccctgctcgccttcctcgacgccccctggatgccgatcttcatcgtcgtgatctggctgatgcaccccgccctgggggcggtcgcggtcgccggtgccgtgattctgttcggtcttgctgtcctcaacgatttgctgacccgttccgcctcggctcgatctgccggcgacgcacgccagttgcagttcagcgcgcagcagatggtcgagcacggcgaaacgctgaagccgctcggcatggtggatccgatgctgcgccgctggcgcgaccggcagggcgccgtccatgccggtgcgcagggcacgcaggacgtgaccgagacgatctcgaacctcacccgggcgctccgcttaggcctgcagatcgtcatcctcggtgtcggcgcgctcctcgtcctgcgcggccagctgacatcgggaggcatgatcggcgcctcgatcatcctgggacgcgctctgtcacccgtggagagggcgctgaccgcatggcggagctgggtctccgctcgggccgcgcacacgaacctccgcgccctgttcgacgccctgccggaccatgcgggacccatggatctgccggcgcctgtgggacgccttgacatggaagccgtgcgctacgcgccccccggcgcggtggagccggtgctgcgcggcatcgatgcccgcatcgagcagggcacgacctgcggcatcctcggcccctccggatccggcaagtcgaccctctgccggctcatcgtcggagcctggatgccgagcgctgggcatgtgcgcctggacggggccgacatcaccgcgtggaacccgatgcagctcggccgctcgatcggctacctgccccagcaggtcgatctgttccccggcacggtcgcggagaacatcgcccgcatgggcatcgtcgatgccgagcaggtggcgcgggcggcgatgctggccgacgtgcacgagatgatccttcgcctgcccgagggctacgacaccgatgtcggtcgcctcggcaaccggctttcgggcgggcagcgccagcgcatcggcctcgcccgcgcactctacggcgatccggtcctcgtcgtgctcgatgagcccaactccaacctcgacggcgacggcgagcaggcgctcaatcgcgccctgatcgagctgaagcgtctgggtcgcacggtcgtcatcgtcgcgcaccagcccggcgccctgcgcacggccgacacgctcctcgtgctgcgcgacggtgcggtgggcgcgttcggtccgcgcgacgaggtgctcaagcacctcatggtgcccaagccgcgtgacgaggcgacggcctctgcgcaccggagcgcgccggccggacccgcggcggcatcctccgccgcatccttcgccgccgctccctttgccgccgcccccttcgccgcggctgcccccgccgagtga

SEQ ID NO: 8864 - DNA, 282 bp, Methylobacterium sp.
atgtttgagatgcgccgcgagaagctgatcgatgagcgccgtcagtgcgtcacgctgcgggctttcttcaccgcatcgcaagaacagggagacgctctccccagcagtgttatggcccacatctccgccagtgctgcacacaatgggtttgccctgcgcgtcgagcgtcaagagccagcgcttgccgtccgcatctacatgcaggtgatgaatctctttcgaatcgcggaacgcagtgactggaacgccaagcacatctgcgagttcacgcaggcgatctga

SEQ ID NO: 8865 - DNA, 234 bp, Methylobacterium sp.
atgcgccaagacgctctgccgaacgcgccgttgcctgcccctcgtagcagccccgttgaggacattgcacgggcctacctcgtgaccgctcagggcgacgctgaggccgctcttcacgccgccatcgcggacgcccttgccgacctctgcgaagccgagcgccgcacggttcgccaagaccgactcatctctcgtggctacgtcagagcagcccttcacatggccgttcggtag

SEQ ID NO: 8866 - DNA, 339 bp, Methylobacterium sp.
atggacgccatcgatggcggtgagtgcgacgaggactgggatcaggatctcgccgacgatctgatcggatcaaccctcctcgtcggcctgacctatgtcgaccccgagggcgccttgctcggccggcgtcaggttttcgggatcgtcgagaccgtggatgcccgaaccggcatcgtcatctggaccggtgacgagggtgagcccttcacggtcgcccccctgctcgacgcgatcgaggtgggggagccgggtctctatcaactcgcggatcaggaccgggtcgtcgagaacccggatttcacggccctcttcaccgtcaccgaatcgcgtcggaactga

SEQ ID NO: 8867 - DNA, 579 bp, Methylobacterium sp.
gtgaagtggctcgagcgcgaagtctgggagttgctcagccaaaacgagggcaaggtgcagctcgccaaccgctcgacgccgaccgggtccaagctgcccgaggccgagaccgccagtatgggcaccttcctcggcaacatgatctacgtgctggaggcgttgggcttcgcgttcttcgaggagccgggcgcaccttcaacagagacgcttgcgcttctttcgacgtctccggccgccccggcagtgcaaagcttcttcacgggtgcgcagccgcgcagcgagacccataaggcccacctcgacatggtcggcgacggctacgtcctgcgcgccggctcgatggtcagcgcgaacgccacggatagcctaccttccagcgtcgccaagctgcgcgctcaactcctcgctgagaacgcgctcatgcctcaggacggttgccttcgcctcaccaaggacatcgccttcacgagcccctcgccggcctccgcgctcgttaagggacgcagctccaccggacatggagactggtttcggactacggatcgtaagaagctaggcgacgtgcttcgtgaacggtga

SEQ ID NO: 8868 - DNA, 114 bp, Methylobacterium sp.
atgctgtccgtctcccgcgccgtcgtgtccaagcatcgtgagatttccgcgctgcctgcgacctatgccatgttcctcagcggcgtgctggttctggcctgggccgcagcatag

SEQ ID NO: 8869 - DNA, 474 bp, Methylobacterium sp.
atggccgccaaaaccgacagcgcgggcgtgcgcttccctccgcccctcatttatctaggcgccttgctgctggggtccgcggctgagaggttcgtcactctgcgctcgttcggcatcgactggtggttgctcgttgcggtgggcgtgcttctgtccgctgccggcgcggcggtgatgcttgtggcggtgcggcagttccgccggctgggcaccgagatcccgccctcacggccgacgacccacattgcgcggaccggtccttatcgttggacccgcaatccgatgtatctcggcatgacatcgatctatgccggtcttgccatcggcttcgatgagccggtcgccttcctcttgctcccgttggtgctgattgcgatacagacgcaggtgatcgcccgtgaggagcgctatctcgaagctaaattcggtgacgactacctccgctataaggcagaggttcgccgctggctatga

SEQ ID NO: 8870 - DNA, 1437 bp, Methylobacterium sp.
cccagagcaccaggcgcctcgccgcccccggctcccccggcgccgggcacaccgccccaggccggtccgacgccccaccagaccgcgtcgccgccctgcggcgtcgatgccagcgtcggcacggtctgcgcggccaacaccaacgtgccctgcggcgtcgatctcggagccggaacggcctgcggcgccaacgcggcggcgccctgcggcgagaacctcactgcgggccgggcctgcggcaccaacgcctcggggccctgcgcggccaagaataccggcggcagcctctgcggcggcaaggcgagcgcctgcgcggcggatgcggggctcggcaccgcctgcgcggccgatatcggtgcctgcgcgatgaacgccggcgccggaaccgcctgcgccgccaaggagacggcctgcggcgccaatgccggcatcggcaatgcctgcgccaccaatttcggcgcctgcggggccaagctcaccaccggcaaggcctgcggggtcgacggcagcgtctgcgacgcccgctacagcgggccggccgcctgcggcgtcgacggcaacctcgcctgcgcccagaagggcagcgccggggcgaccggactcggcgccgatatctgcggctcggacaacgcgatcgagctgtgcggctccgatctcggcgtttgcggcggcaatctcggcgcagaggcctgcggcaccgacggcaacctctgcgggaccgacgcgacgatcgaggcctgcggcgccgacggcaatgcctgcgccgcggacgcgacggtcgaagcctgcggcaccgacggcaacctctgcggtgcggatgccggcgccgaggcgtgcggggccgacggcaacgtctgcggcgccgacagcaccgtcgaggcctgcggcgccgacgcggatgcctgcggggcgaatgccggcgccgaggcctgcggcgccgacgccggcgcctgcggcgcggatggaacggtcgaggcctgcggcgccgacggcaacgcctgcggcgggaatgccgcggccgaggcttgcggcgtggacggcaacgcctgcggagcggatgccggcgccgaggcctgcggggccgacggcaacgcctgcggggccgatgcgaatgtcgaggcctgcggcgccgacggcaatgcctgcggggccgacgcccgggcggaggcctgcggtgcggatgccgacgcctgcgccgccaatgccagcgccgacgcctgcggcgcggacgccgatgcctgcgcggccaatgccagcgccgatgcctgcggtgcggatgccgatgcctgcgccgccaaggccggcgccgatgcctgcggcgtcgataccggcctgtgcgcggccaatctcggcggcgtctgcggcgtcgacgcgccgctcggcgaccccatctcgttctgcgccgtcaacgtgatcccgctgctgccgtcatgctga

SEQ ID NO: 8871 - DNA, 852 bp, Methylobacterium sp.
atgatcatcaaccaagtgctgacggtcgtgcggaccgagggcgcggccggcctattcgcgcgcgcgggcagtcgcatcctcaaaccccgcgcgaagagtttccgggctctgcgcgagcgactcgtcgggaagcgtgccctcgagattggtggtccgagcgcgcccttccaggcgcgcggcatctttcccgcctacccgatcctggccaccgtcgataattgcaatttcgccagccggaccatctgggagggcgagatcgatgccggcgcgagcttccgattcgatcccgcgcgcgcggcgggccggcagtacatcgccgaggccaccgcgctgcccgagatcgcgggcggcagctacgacgtcgttctgtcctcccacaccatcgagcatacggccaacccgctgaaggcgcttcaggagtggcggcgcgtgctgcaggatgacggcctcctcgtcctgatcgtcccgcacaaggacggaacctttgaccaccgccggccggtgaccagtctcgggcacctcatggaggacttcgatcgcaacaccgacgaggacgacaccacccacgtccccgagatcctgcggctgcacgacctgcgacgcgatccgggcgggacgacagcagaagcgttcgcgcagcgctcggccgccaacctcgagatccgggccctacatcaccacgtcttcgacacggcgctcgtggaggcaatggtacgacaggcaggcttcaggccgctcgcggtggaggcacgccgcccgtaccacatcctgctcgtggccgagaaaaccggcgaggccggaacgagcacggagccgatgcgcttcgcgagcccgtttcgctcggataggtag

SEQ ID NO: 8872 - DNA, 471 bp, Methylobacterium sp.
atgagtatcttcgggtcgatcatgtcgaagatctttggcagtagcgcgagcgcccaggcggcggccccgcacgcctcggaaacgccgagcgtctcggcggcggcgcagggggcggacggcccgaccggatcggctagcagcgcggccgcaccctcgatgagcggggcgccgtcgccggtcgccgctggtcctgccggcgcaggtcaggcgaacgtcgacgtcggccaggtgctcgccgacctcgcgtcaaagaaggggcagacgctcgactacaagcgctccatcgtcgacctgatgaagctgctcgacctcgatagcagcctgcaggcccgcaagcagctcgccgacgagttgcactacacgggcgacaaggaggactcggccaccatgaacgtctggctgcacaagcaggtcgtccagaagcttgccgagaacggcggcaaggtgccggacgatttcaagcccgcctga

SEQ ID NO: 8873 - DNA, 204 bp, Methylobacterium sp.
gtgaacgatcagcagcgcctcgacggtgcgcccctcaacccgaccctgcggaaggtaagcgacggcacgcacgacacgagccgcaccgccgcccccctggagagcatctcgatccgcacgccgcatggcggccactgggcctggatctgcctcgcggtgttcgtggtctgcgtcctcgtctcgctcgtcctcatcttcggatga

SEQ ID NO: 8874 - DNA, 261 bp, Methylobacterium sp.
gtgtcacgcaagcggccgatcgaggggaagcgacagcgccgccgccgcgcgggccggctcgccctcgcgctgctgccggccctgctttccgcccccgccctggcgcaggaggcgcccgacccctctccgtccgattcggcgccgagcgccgctccgggaacccgcatcgcctccgagccgcccaccgccggccggccgcgccgttccgtcttcgacgcgcccacggcgctgcgcggcgccaacgccttctccgcccccgcc

SEQ ID NO: 8875 - DNA, 147 bp, Methylobacterium sp.
ttgcgccggccgcgaaccgggctacacaccgcactgcaacacgccggacatgatccggtcggccgggcggagacatcgatgcgcatcgcgatgattggctcgggctatgtcggcctcgtctcgggcgcctgcctcgccgatttcggc

SEQ ID NO: 8876 - DNA, 234 bp, Methylobacterium sp.
atgaaggattaccgcttcgatgagcaagtcgccctcttgcagaagaagccgggagacgatgagccgacgatccggctcttcctgaccttgagagaggcggcccaccgggtagctacggcagaagaggctagcttcgagcggctgtcgagcgtcatcataaggaacggcgagccgctccgggatatcgctgagatcgatcggatccaccgcctgttcagcggcgagcagcagtag

SEQ ID NO: 8877 - DNA, 1467 bp, Methylobacterium sp.
atgctcgatgggatgatcgccgagccgggccggtacctcctttgctctccccgcacgagcctgatcgacgagcaggcagtgtacctccgcggctctgccgccgccctcgaccgagccgtcgagatcattccgatccattccgctcagaagggccagcgtggagacgtgctccgccgcctgcgtgaggttgttcgcgaaagtgcagcgaccagcagagacgaccatcggatcgtggtcgtcacgcacgaggcgctgttgacactcgatccgagtacgatcgccggttggcacgtgcgaatcgacgaaacaccgaacatcattgcttcgggctcaatgcggatcggcgcaacctggagtagcctcgaacgtcactacatccttgagtcaatcgacggaacggcgtgggctcgcgttgttgatcgcgatgatgttgctcggttggaccggcggcagatcgttgaggacgatgccacgacgctcaacaccttccgcgcggcggcttggagcccgaaccgcaccacgttcgtggacctgcgtgaatggagcgacgcagcgcgatcccgtagcccagtgcggtggtggtcgatgtggtcgttcaccactctggaggcgtgtgcgtcggtgatgatgaccgccgccagcttctccgacagcatcgcctaccgcagcatccgcaagttcgatgctgagcgggttgaggttgtcgagtacaacgtgtctgctggagcgcgccgaacgcagccgaacgtcctgatccattatttcacgcggtgcccgggctcgaccacgtggtgggagggggatgaaggcagccactgcctcgtgcagatttcgaggcatctggagcgcatcggattcggcgggttttgggcagcgaacgaagctgttgtcccctacttccggcatcggttcaacggaacagggtgtcagccgaagcaggcgggcacgaactcgctgatcgatcaaactgcctgtgcgatggtctactcgaacaaggcgcagaactctgacgcagcttcgattgaggtgcttggcctggatagcgaagccattcggagcgcgcgcgaagaagaggacgtgtttcaattcgttctgaggggagcgatccgcgatccatcatatggcggcacttatcgcgtgtacctccacaaccggcatcaggctgaggcgctcagccgccgcctctgcgcgagcgggatcacgaacaacatcgagatcgtaccggtcgtggaggccgaagttctcgacgtgcagcgccccgcctcgaagcacgaccgcggtactggatcgaagataggtccagaagcgctcggtgatcgagtagcacggaagaaggccagggaccgtgcccgaggcgagcagcggcgcatcgcagcccgtgaggagaagatcgcggctggaacctaccggcggcgcggccgaccgaggaaagaggaacatcagcgagatggcgcgcagacgacgtga

SEQ ID NO: 8878 - DNA, 1281 bp, Methylobacterium sp.
atgtttggcaagcacctgcagcgggcgcttgagcgcacaggtggtgatgcaagggttgccctgctttatctcgatctggatggcttcaaggccgtgaacgacacgctcgggcatgcctgcggcgacgagttgttgaaggcagttggcaagagactcgcggatatcccggacgagaccgtcctggcagcccgactgtccggcgacgagttcgcgatcatccagacgggcggggatcagccgagggttgcggtggccctggccgatgcactgatccaagccatgcaggcaccgttcgggattggggaacgggacatccagatcggcaccagcatcggcattgctgtgagcaacgatccagtggaaactccggagacgctgcttcatcaagccgacattgcactctaccgggctaaggcacggcagcgcggcacctgggagctgttcagcccggagatggacatcgagcggctcgcgcggcttgcgcttgaacgggaccttcggacggccatcgccgacgagcagttcgaggtgttttatcaacctctgcatgaggctgctggaggggttctcgtaggcttcgaggcacttctgcgttggaaccatccagaaaggggaatggtgccgcctatgactttcatccctgtcgcggaggagatcgggctcatccacgagattggggcatgggtcctcagtcaggcttgctccgatgccatcgggtgggacgcggagctcaaggtcgccgtcaacttatcacccgcacaattcacgaggtggagtctcctagacgacgtccgaaacgccttaagcaagtctggtctcgcatcaacgcgactggagctggagatcaccgagtcggtactgatgcaggatagcgagtcgacgcttgcgctgctgcatcaactgcgcgccctaggcatccatatcgccatggatgatttcgggacgggattttcttcactcagctatctaagccgatttcccttcgacaaaattaaaatcgaccgatcgtttgttcagtcgatgacggagcacaagggcagcgcagaaataatacgtgccatcatcgggctcggacgggcactgcacatcaaagttcttgcggaaggggttgaaacgactgagcaaagggaaatgttgcggtctgagggctgtgatgaactccagggctacctgttcagcaagcccaagcctttagtggagttaggcagtctggttgcgaatatgcgccgacacaccgctctgcttgcttcacctcagcaagttctgcaaggagcagcttag

SEQ ID NO: 8879 - DNA, 282 bp, Methylobacterium sp.
atggctgacgtgcgcatcaccggcgtcagcttcgccgagagcgaagcggaccagggtgccggcatcgtggcgcggttcgcctgcgtgattggcccgctgcgcgtgacgggatgcctgctgaagcgcgacggcctcggccggcttcacgctgtcctgccgcgctgccggcgggcgtccggctcgatccgcttctctgaccgcgcggagcacccgcaactcaccgaggctgccaaggctgcattcgacgcccttggcgggaggttgcccgaccatgagccctga

SEQ ID NO: 8880 - DNA, 126 bp, Methylobacterium sp.
atgaagcccagtcagggcttcgattggcgggacctggatcggccgccctcgtttctctttctcatccggatagcgggatcgctgatgtggcgctgcgtgaagcggctgccgatcgggcgaccggct

SEQ ID NO: 8881 - DNA, 810 bp, Methylobacterium sp.
atggagcgtctgcgcgattgggatgcttggcggcggatcggtgcggtgccgcgcgacacggcggcctacaccacgaacctttatgccgcgcgcgagcagatcgaggactggtgtgccgccggtcggctgcatgcgctgagcaccgaaagggccgtgcttctgttgcgcgccgaccgcggctttcatcacgtccatcacgtggcgagtgacctgccggcgctcgccgacgcgctcggtgcgcttcccgccgggacctacacctccgacctagtggggcaaggcgagccgctcgacgacgtgtgcgccgcctacgccgccaacggctttgtggtccatacagtcctgcagcgaatgacccgtgccggaacgccggatgcggcgcgcgcggatgacgcgacggtcgccgcgcctgacgaggcggccgaggtcgtggccctgctcgaacggttgctggatcccttcgcggagccggtgccggaggtggccgcgttgcggcgggaggcgcttgaggaacgtctcctcatcatccgccgggacggtgcgatcgtcgggatgctcctgtacgagatcaaggggcgtgcggcgcatttgcgcctctggcacgtggatgataacgcgcggggcctgggtgtcgggcggcgtctgatgagaaatttcctcgcgcggtgcgcgcaggcgcaggtgcagcggctcgtgctgtgggtgattggcgacaacgagcgatcgatcgccatctatcggcattacggcttcgctcccgacggactgctcgatcgaatcatgatccgacacgaggagccgcatcgatga

SEQ ID NO: 8882 - DNA, 231 bp, Methylobacterium sp.
atgagcacggtgctcgacattctcgcgcaaatccgacccgaattcgatttttcgcaatcgaacgatttcttcgaagacggcatgctcgactcgttcgacctcatcacgctcgtgtcggaactggacaaatcttacggtatctcaatcgatggcctacatatcgtgccggagaacttccagaatgttgcggccattgaggcgcttctgagccgcagcggggtagcgccgtga

SEQ ID NO: 8883 - DNA, 219 bp, Methylobacterium sp.
atggacgagtttctgacggagatgtctgagattctcgaggacgacgtcacgatgtcggacgcgctgggcaaatttgagagctgggattcgctcgccagtctctcggtcatggcgatggccgacagcaagttcggggtcaaaatcacgccgcgcgacctcaacccggcgatgacgctcgaacagctctacgccctgatccggtccaagacggcggcgtga

SEQ ID NO: 8884 - DNA, 456 bp, Methylobacterium sp.
atggagccgccgccgatgtcgaacaagccaccgccttcgttctctcgctggcatgctgagatgcgcggccagcggccggctccccccgaagttcgggaagagcgcctgcgcaccatggcgggcctgcggggtggctctggcgtggccctctcggcctggcgcggccgctccaccactcgctacgtcgtcggcgtccatgaggtcggttcagacatagcccttgaggccgcacctgccgtcgtgatcgccgtccggcgcgacgaggccggcctcgcttctcccatcgacgtcgccagcatcgagaccgccgccgacgcggtggcttgggtccgcctagcccaggcgtcgggcgcctccgagctccacatccatcgccttgccgatgccgcctccgagcgcgccgccgtggtcgccgatctcgcgccggtcctgccgccgagcgaccgcgccgcctga

SEQ ID NO: 8885 - DNA, 129 bp, Methylobacterium sp.
atgccacgcttctcagtcttcttctgcgcctctgccgccctgctcacggcctatctcggctggtcgtatgcccacgccgatgaggtggacgtcgccaggatgccgaccgtggagtggcaggcccgatga

SEQ ID NO: 8886 - DNA, 561 bp, Methylobacterium sp.
atggcgggcgagagcgccgggcgcgcgaacggattgggcgcacgcatcgcgcccgcgatcccctatctcctgctgttggccgtcacgatctggctctggggcgtgtcgggccgcatcgactatcaggagcggccgggcacactcggcccggacttctggccgcgggtcgcgatcggcctcatgggcctgctctgcctcgtccggatcgccaccgttctgaccaccggcggcgcggccgcccgcggcatcggggcggcgatcaccggcggcgaggaggaagaggagaccggcccgcgccgtccgatcctgcttgggctcggaatcgcgctcacccttgcctacggcctcgttctaaacacgatcggcttcccgctcgcgactgccctgttcctgatcgcgttcatgtatctcggcggatcgcgccgccatctcgtggtctgggtttcgagcctcgtcggcgtcgcgctcgtcacggtgctcctgacgaaggtcgtctacgtgtcgctgccccggggggcgccgcccttcgaccgcgtcatcgatctcatctccggcttctga

SEQ ID NO: 8887 - DNA, 957 bp, Methylobacterium sp.
atgggttggacgagacggaacgtcctcggctgcggcgccgccgcggtcgcggcgacggcggcgggcagggccttcgcgcagacctatccgagccgcccgatcgaactcgtcgttccttgggggccgggcggcggcgccgaccagctcgcacgcaagatcgcgcaactcgccgagcccatgctcggccaggggctcccagtggtgaacgtgcccggcggcacgggcgcgaccggcatggccaagctgctcgccaaccccgccgacggccagacggcggcgatctacatcgccgactcgcacgcgctgctcgccgggacgggggcgcgctggaagatcgaggacatcgtcccggccgcggtgctgatccaggcgccgtccttcctcttcgtcggacaggacagccgcttcaagacctgggccgagttcgcgcaggaggcccagacgaagccgggcacgctgaaggtcgcgaccctgggcttcggcagcgtcgacgacttcaccctgaaattcctgggcgccaagggcgtcaaggtcaatccggtgccgttcgccaagccgggcgagcgttacgtctcgatcctcggcggtcacgcggacgcgctctacgagcaggccggcgacgtcgggaccttcctcgcaggccggcagatgcggcctctcctggtgttcggccggcagcggttcccggcctttcccgacatcccgtgctcgacggaggtcggcttcgacatcgcgcttccgcagttccgctcgctcgtcgtccgggccggaaccccgcaggatcgcgtcgacacgctgtccgctacactcgccaaggtcgccggcagcgacgattacaaggcgtttctcaaggagcagtacgcagacgagaacagcttcctctcggccgcgcaggcgggcgatttcgtccgccggcaactcgacgacatgaaggccgccctcaggcaggcgtcgtga

SEQ ID NO: 8888 - DNA, 495 bp, Methylobacterium sp.
atgccgaggacgaccgcgatccgatccgtcgccgcgagcgcgctgctcttcctcggccatcctgtccgggcggagacgccctcagtggaggccgcaccgcttctgacgccgcggccggtcttcgtgcccggcctctacgagaccgagagccgcaacagccaattccaggaccagggggcgaagggcgaggcctgcctcgcctcggccgattatgagtctttccgccgcgagacgatggcacagtaccagtcgaacccgcgcttcctcgacgcctgccgcctgagcgagacccgcgacctgcccgatggcttcgtcttcgccatggcctgcaaggaatcgaaggtcgtcctgacctaccacttctccaaggacagcgtgacgagcaccatccagaccctcatcacccgacaccccgaattctcctccgagatcctgaccctgatgcgtcggcgcggcgactgccccggccgggagaagccgggccgcaacacctaa

SEQ ID NO: 8889 - DNA, 1014 bp, Methylobacterium sp.
ttgacggcggcccgcgggcgcaccgagatcgtggatatgtcactgcctccgacgaaatgcaccctctatccggtcttcgccgccgccagcccgcgcgcggtgatctaccggcgtggcccctcgaaccagacctgtctcatcgcctgggaccgctcggacgattcgttcgcggtggggcaatggttcaagggcacggtgaagccagcctggggcgggctgtcgccgaacggcgaatggctcgtgagcttcctcgggaagtacagggggcccttcgcgacctggacggtgctgtcgcgcccgcccttcctcaccgccgtcgcgctctggccgaagggcgacacctgggccggaggcgggttcttcctgtcggacgacacgctcgtcctgacccatggcgagagcccctacgacagcgcacccggcctttccccgccgcccggcctcacggtgctgcccttcacgcgggcgaacgcgccggccctgacggcgcgggcgcgatccggcccggcggcgaaaagctggcggccggatcctgcgaccgagggcggctgggtcctcgacgccccctcggagacggcctcgagccacgcctgcatccggtcgatcagcgcgtacacggccgacccgctccgatctctgcccgagagtgtgcatcatagcctgtgcgccgacggcccaccggtgccgctgccggtcgccggctgggccgccttcgaccgcaacggcgacctgctgttctcgcgcggcggcgcgctgtttcgcctcgatgcggaccgggtcggcggcctcggctcgacggacgagctcctcgcccgcgcccgctgcctcgccgatttctccgacctgcgcttccggccccttgccgccccctacgccgcgccgacggcagagacggacgacggcttcgctcccgccctcgaccgggtgagccgagaggaccgacaacggcgccggcagatgcgcaaggcccacgagcgggtcgccggggccggctggtccggtgcgctgcgatag

SEQ ID NO: 8890 - DNA, 417 bp, Methylobacterium sp.
atggagtgcgactgcacccggatcagcctgagcatccggcatccgagccggccggcggcggacctctgccgcgccctgcccttcgcgccgagccggacctgggacgtcggggctccgtgcacgaaccccaagggcgtgccgcagcccgggtacttcgcggaaacctacgccaccttcccgctgagcgagagcgccggcccacccgccgaggccgtttcggccgctgccgaacgggtcgcgccgtatggcgaccggctccgagcgtggcaggcggagggtggcgcatgcgcgttcttcgtgggctggttcatggagggcggccaatccggcgatctgttcgagcccgagctactcggccggctcggagcgctcggcatcggcctgtcgctcgacatctattccggagcggatttgtag

SEQ ID NO: 8891 - DNA, 297 bp, Methylobacterium sp.
atgtttagcctcatgtatgcttatcaatccatcatgcttgcgggcgacgattggtttcttgcaatgcgaatgtaccattttgacgcccaggacgagaaaggcgtacttgcgaccgaaagccagtttttggctgaccatgtcgctgcgcgggggcacgctgcacgctttgccgttaggctcgtgaggcaagcggcatcgcttaattcatgcgaagggattgtcgttgttgaggcgtacacggccgaggacggcgcagtgcttaccgtgcggctcgttctcaacgtcgaaatggcatag

SEQ ID NO: 8892 - DNA, 267 bp, Methylobacterium sp.
ttgcgcagcaacagagtgcaacgggccgcgtccgccttcggccatatcggcggccgtacagcgcacaagggcgcgatcggccagggcgtcagtggcttccgggtcgatgtcggatctccggatgggctgcgcgccgtgttccagcgcatcgatgccgatcccgagcggttccgtgcgagcccgccgcagccttcgcatccgccccgggccgctgcggatccgggccaggatctgatcgccctctacgaccggctgctcgcgccgtaa

SEQ ID NO: 8893 - DNA, 528 bp, Methylobacterium sp.
ttgggctaccacgtggccttcgtgcactacctcgaccggaccagcgatcggcgtgtcgcttacacgcggctgcggcaggactttccgctctgggcagagactgtgcgtgatgcagtcgcctggctgtcggatcagcctggcaccgatgcgcagaggctcggcatcgtcgggatctcgctcggtgcggcgctggccttcaccacagcgatgaccgagccgcgagtgcgggcgattgtcgactatttcggtccgctaccggacgagctcgcgcgtgagcgcccacgcctgcccccaacgctgatcctgcacggcagcgcagatgcgatcgtgccgatctctcatgcacgagcgctggagcggttgcttcgggagcagggcacggcgcacgagatcaagatctacgaaggccaagggcatggcctcaccggacctgcgcaactcgatgcggccgcgcgcgtagcacgcttcctcggacagcaccttcagcctgccgtagctgagagcagcaccagctttgcgcgagcttag

SEQ ID NO: 8894 - DNA, 207 bp, Methylobacterium sp.
atgggcctgactggcggcatggcatcgatcgatcccctccgcgacggcctgcgcatcatgcaggcgcagcgggatctccgcttcccacatccggtgagcggcgagttgcagccggccgtgggcgggttctgccagcacaccgtgatcacggcccaaggcatctccacccgcatcgtggagcgatggccggcagcgcatgccgcataa

SEQ ID NO: 8895 - DNA, 207 bp, Methylobacterium sp.
atgagcgcgcccgtagcggccagccacggcctcacgctcgatgagcaagtcctcgaactctggttcgaaggccgcttcgacaccttcacgattgccgacgccctgcgggtcgaaggtcaggaaatcaccgaggcgcaggtcgtcaacatcatcgccgacgagaaagagcgacgacacgtggcgtgtcagcagggaggagctaagtga

SEQ ID NO: 8896 - DNA, 3399 bp, Methylobacterium sp.
atggcctcatccgcttccgtcgccccgcggaccgcgcccccaaccgcgccggccccgccgccggagacacccgagacgggcttctcgcccccggctccggccgagccggccgcggggggagcgtcggcccccgcgagcgccaacgagaacgcgtcctccgacgcgccagcatccgcggagccgcccgcggcggccgaccccctcccgcccgagcgcgagaaggccatcgcagactgggccgaccacaaatccgaccacagcggcggcttcctcggcttcggcggaaccgattcaagcgagaaggtccgcgacgcgctggccgggcgatcggaactcgggcctttggacgccgacgagcagcgcgtcctcgccgaccggatgatcgcgcgctgggaggctggtcacggcgacggcgcgagcgggcccgcccgccttgtcgacgcactggaggatgcgccggacagccgggcgctggtgggcgagcgtcttgccgcccgcgcctcggcgatagcccgcgagacgccgttcgatccggccaaacccgatgagaactgggagacccgcgcccgcgcgcagggctatgccaacaacgcggtgcgcgccgcgggcgaggccgacgacccggcggctgccgatcggctgaggtcgatgaccgaggcgctcggcccggaagccgcgggtggcttcgctcggacgctggccggccgcgacgggatcatggccggcggaatgatcaccgcggcgggcggctcgccgctcggccgcaccctcgcggcgctgaacggcgggaccccgagcgagacgcgcagcagcttggtccagaacgccttcgccgagacgccggcctccgcctatttcgacccacagctgcagggcgccatgggcacggctctggcgcgggaatggaacccggacgatgcggctgccgccgcccgtgacgcgcagcgcctgaccgacatcctcgccaccgaccagggccagcgcctgctcggtgcgggcggcgaggacggcccgtccctcgacacgcgggtgaacgcgctcgccaccgtccgagcggacggcgcaatcaccggcgacccgctgagagaaacggacgatccctgggccaacccggcgatcctctcgcccagcgcccaggccagcgcccggcaatatctcgacgcccgcggcgacgcccccgtggcgctcaccggcaccgacctcgacaacacggtcggcaccgccatgggcatgccgcccgcgctgccgcccggcaccgagaccggagaggccgaggcggcggccgcgcgcggcgccttcaacttctatggcagcggcgaggccgccgagccggtcaagttggtggccgaccagatccgcgcggtcgcgggcgaggcccccgcgaacgttgcggtgctgcccgtgacctactcggacggcaaaaccggcccggtgcaactgccgctgttccgcgtcaccgacccgtccggcaccgagcgctacgtcgacaataccgggcgccgctacgacgatttcgaggactggcgcaccaacaacaagctgccgccgggcacgcaggtctatccgaagggtggccatctcaccgcgggcgccgacggcaaggtgtcactcggccagggcaacacaccggagaccgtcgataccttcggcgagcacgtcgccggcgtcgtggacaaggccgcgctggtcggcggcatcgtcgcgggcggcgtgctgatcgtcggcaccggcggcctcgcgacgcccgcggtggtggcgggcgccagcgcggtcgcggtcggcgcgggtgcctggggcgcctatcgcagcggcagcgagctcgtcgatcgcgaccagcacggccaatcgctcaacccggtcaccgatgcggaggcgcgcggcctctggctcgatctcggggcgagcgtcgcctcggtcggcgccttcggcagcgccacgcggctgtcgcagctcggccaggtaggccgggccgtggcgccgctggaggcctcgctgcacggttatacccaggccggcgccttcgccctcgacacggcggcggtcgcccatcagggcgtcgagaccgcccgcaactgggaccggatgagcggcgaccagcggatcgagtcgatcctgcagatgggcttctggggcgtcggcgcgggggtcggcatgcgcgcctccggcacgcgcaattccggcgacatgttcaatccagtcaccgtccgcgacggtatcctggccaacaacccgcccccggtcgcggccgatcccgccctgcgcggtgacgcggtgcagatcgacttcgatcacggcagcggagtcgtcacgggcatccgccacggaccggaggcgagcccggccgacatcgccctccaccagcgcactgcgcagaacatccagcgcagcctgaccctcgaaggccaggtgagccgcctgttcgccgccggagacgcccccccgcccggctccgtcggctgggcggcgcgccacgacatcgccaaggtgcgcgagcgtctggacgcgcgcgtcgcggaactcgccgaccccggcctgacgcccgtgcgccgcgccgagatcgagcacgccaacaccgtcgaccgcgcccatctcgacgacttgtcgggggaagtctcctccttcgtgcgcgacccgtcagcggcgacgatcgaggcgcgcaacacccggcggatggccatcgacgacgcgctcaacaaccccacgcgcctcaggaccgccgaggatgtcaggacggcgcgggcgagcctgcgcaacgagaccatcgcggtcgagaccgagaacttctccgcaacctggcatctcgacggcgagggccagctcaaggtcgcggacgcctacatcaccgacctgagccacgggaagaagcgctcctcgaccgagagcggtctgaccagcgcggtgagccgcgagggcggcaacgggcgcacggacgaggccaggatcatcaacgccaagggcaaggaggtctacgacctcacccgcgtcgacgacggcggccacggcatcggccaccgcttcttcggcgatatggggctcgccaacctcttcccgcagaacgcccgcttcaaccagcaggatttccgcatgctggaggacgacgtcgccggctggctggaggcgggcgccgaggtccgctaccgggtggcggtcggcgacaacccgtccttcaacgcgagcgcccggaccgagaacggctggggccccgaccaccgccccgacaaggtcttcgtcgagtatcaggtgttcaagcccggcgacccaccgacgccgatcctgaagaagcgctacaagttcgacaacgacacgggcgcccagtaccgcccgctccagcaggaatatgcggcgggcaaccccgccgagctgcagcggttgatgcgcgagcggatcctgggccagtag

SEQ ID NO: 8897 - DNA, 204 bp, Methylobacterium sp.
atggatccggcgcgatcacgacgcgtcggagctaccaaatcgcacggcgccgcacggggcctgtcgggcttgagcgcacgctgccgtccggtcgcggtcgatggtccggtcgccgaggccgagcggcggcgcctcgatgcggtcttcgccggcgccctgagcgagcagtgtgcatggaacgccgcgagcgcctgggcctcctga

SEQ ID NO: 8898 - DNA, 153 bp, Methylobacterium sp.
atgagcgacgacatccacgggccggcccccaccccggaacccgacaccacggacgcgggcgataggaaggtcgtcccgctggtccggccgcgaccgagcccgctgcccgtccccgcgggcgaggatgacgaccccggcccacgcgccgcctga

SEQ ID NO: 8899 - DNA, 186 bp, Methylobacterium sp.
atgcgcccgaagctgttcggtgaagcaaagactcgcaagctcgacatcctgctcaccgacgaacatatcgaaatgcttaaggaagtggcagagcatcacgcccttgcaccttccgcttacgctcgaagcttgatcgtaacccacttgaacaagctcaaggcagccaaggatgccggcaatgactaa

SEQ ID NO: 8900 - DNA, 321 bp, Methylobacterium sp.
atgaacatcctagacgtctccgagcgctgcgcctgtcgggcgctcgggcagcatcgctcgacgcagcgcaaggtgccgcggggaagagaggatgaggccgcgctgacagccgacctcgtgggactggctcgccagtacgggcgctacggctaccggaagatcggtgcattgctgaaggcggcgggctggttcgtcaacgacaagcgggtcgaacggatctggcggcgcgaggggctgaaggtcccgtctcggcagcccaagcgcggccgcatctgggacggggatggttcctgcctgcgattgcgggcggagcgtcgcgat

SEQ ID NO: 8901 - DNA, 798 bp, Methylobacterium sp.
gtgagtggcgtcgaggatctggcgctcgatccgatccatctcgatcctgaaacgcgggagtggatggagtcttatcgcagctcattcggggtcgatccgctcttcgatgacaaagacatgctcctccgggcgtacatcaagtacatcggaaatttggagggcgtgcggcattatttcgtaagcggaaattacgacgcggattggatgctcagtgttctcggaaaatatgtgcaaaagccgagccccaaggttctggaatttgcatcgggcttcgggcgcgtcgggcggttcataacgtccaagcgaccggatctggattttaccgcgtccgacattcatcccgccgcgattgccttcatgcgggagcgactggccatgaaggccgagatctcctctttcgagcccgaacagctcgcgatcccgaagagctccttcgatttcatcttcgtcctatcgctgttttcccatctgcctcacgcctccttcagtcgctggttgagggcgctgttgaatttgttgcagcccaacggcgtgctgttgttcactacatcgggtgagaactcgatggaacatcagccccatatcgccgtgaattacgataagaagaagggatatggctacttcggaaacgactccgaccagccggatttggcgactaccgtctatggaacgatggccgtcgatttcgaatatgtcgtccggcaaatccgatcggcatcggacgatgtcatcgtcagctacgagcggggtgcatggcatcctcaggacgtgtgggtgatccgtcgccggggagcgtga

SEQ ID NO: 8902 - DNA, 1455 bp, Methylobacterium sp.
ttggacgaatacaagaagcgatacgacaatgcggtcaattcgaccttcaagaatatcgatcagttggacgctttggccgataccgcagagcgccgcaagaccaacgacgagatgcggaaaacggctgcggacctgttttccgtcaatgatcgcgtccttcaattcgcactcaggaacgacaacgaagccgccggaaagcttctgctgacggaagcggccgtcttccgtgccaagctgcgcgatgccgtgcagacgcgggtcgatcgtttgggtgaggagcttgccgaggctcgggacatagcggatcaagccgcgagccggtcgatcaccaacctcgccatcgcgtccgtgctgggtattctcgcagcgctcgggcttgccacggccatcaccgtgctcggcatcacccggccgctggcgcgtctcgtcgctgtgctccggcgcatggcggacggggatgtcgatgcgacgatccgcgaggccgcgcgcggcgacgaaatcggtgcggtcggccgcgctgtcgatggcatcaagaccatggttgcgcagaaggcggcggagcaggccgagatgcggcgcatcgccgacgaggctgccgccgccgagcgccgccgcacgatgatccaactcgccgacggcttcgagcgggcggtcggcggcatcgtcggccgggtctcctcctcggccatcgagcttcaggccacggcccagcagatgtccatgaccgccaatcaaacggcgaaccagtcgagcaccgtcgctgcggcggcggaggaggcggcgagcaatgtcggcaccgtggcggccgcggcggaagaactcggggcatccgtccaggagatcggacggcaggttcagggttcctcggggctcgcgcaaaacgccgtcgcggaggcggatcagaccggtcagctcgtgcgcgaattgagccgcacctcggcccgcatcggcgacatggtgagcatgatctccaacatcgcctcgcagacgaacctgctcgccctcaacgccacgatcgaggcggcgcgcgcgggcgaagccggacgcggtttcgcggtcgtcgcgacggaggtgaaggaactcgccagccagacggcccgcgccacggaagagatcggcggtcagatcagcgagatccaaagcgtcaccgagcgggcggtctcggccattggttcgatcaccggacgaatcggggagatcaacaccgtcgccgcgaccatcgcggccgcggtcgagcagcagggcgcggccacccaggagatcgtgcgcaacgtctcccaggcctcgatcgggacgaccgaggtgacgcgcaacgtcacgggactggcgcaggcctcggacgaggccggcgcagcggcgagcgaagtgctggcggcggcgaccgagctgtcgcgcgaatcggagcatctcaccagcgaggtcgaccgcatcctggccaccattcgcgcggcctga

SEQ ID NO: 8903 - DNA, 273 bp, Methylobacterium sp.
atgatgggcctgatcggcagcagaggatgctacctctctccggttcggcatccggaggatgcggtgatgaccgaaaacgctctggacgacgccctggccgatcttgtggaggcgttcgggcacgtttccgaggccgagttgcaggccttcctcgatggtacgccgcgctcagatgcaggcctcgctgcgacagagcggggttcgggcgcgctcccattgccgctccctgcgagagccgttcccgacctgatggcatcaagccagcgactctag

SEQ ID NO: 8904 - DNA, 261 bp, Methylobacterium sp.
atggtcaaggctgccgccctggcgattgcggtgaccggcctcgggctcgcctcggcgccccgcgccgcacaggccgctccgctcccgattcagaccgaggcggcggcgaccgcaggggatgccatcgaaacggtgcagtaccgcccgcaccgccactaccgccggcattaccaccaccgccgccacatgcaccgccaccaccgcttccaccacccgcgccatcatcatcaccgccgccaccaccatcaccgccgctggtga

SEQ ID NO: 8905 - DNA, 198 bp, Methylobacterium sp.
atgatcaagcgcaccggcctcgcaatccttctcggcctcggcggctttgccctgggcagcgtcgtcgcgcgggtgatgggggagggcggcccccgccccggcgggacggcggaggccccgcccgccctgcgccacatcacgcagcttccgccgcccgccgtgaaggccgcccgagacgtcccgctttcaggccgctga

SEQ ID NO: 8906 - DNA, 855 bp, Methylobacterium sp.
atgcgcctgagcctgacagcggaagcgcgaagggagggcgtggcggcaaagggttgggtgcgcgcgcacaaatggtggatcctgcgccgcctgacgcaggtcacggcgctgggcgtcttcatggccggcccgctcgccggaatctggctcgtccgaggcaatttcgcgtcgagcgaaatcctcggactcctgccgctcagcgatcccttcatcgccgtccaatctctcgccgccggtgcagtgccggcacgcgtcgccctcttgggcgccctcttgatcacgctgttttacatcgtggtgggaggccgcgcctattgcggctggatctgtcccgtcaacatcgtcaccgatacagcctattggcttcgggagaaactcggcatcacgcgcgaccgcaagctcgaccggcgcacgcggctctgggttctgggcggtgcactgttcgcctcgcttctgagcggcacggtcgcctgggagtttgtcaatccggtgagcctgctgcagcgcggcctgatcttcggactcggcgcgggctggaccatcatcgcggccgtgttcctcctcgacctgctgatcacgcgacggggctggtgcggtcatctctgcccggtcggcgccttctacggaatcatgggcaaggccagcgtcgtgcgggtcgccgcatcgcggcgggaggcatgcaccaattgcggggcgtgctttcagatctgcacagagccccacgtcatcacgccggccctgaagggacgtggaacgatgtcgatcctgaatcaggattgcctcaattgcggtggctgcatcgatgcgtgcccagtcgatgtcttcgagatatcagtacgaagaagtattagttga

SEQ ID NO: 8907 - DNA, 213 bp, Methylobacterium sp.
atgtggtggccctcctcaaacttctatccggacctcgcgccgatcatcgcaggggtgctgctcgagcatccgccccggcagatgccgccgatgcatcggcttgcctgggtcctgaggacgtggccgcactgctcgcgcgaggaggctgtccgcgccctgcgcatctgcatcgagatcgagctcgccgatcacctgtacgaggcccttcgatga

SEQ ID NO: 8908 - DNA, 234 bp, Methylobacterium sp.
atgacgcgcgagatgatgccactgcaggacgcgatcggccgcctcgcagacatgcaggaggccgagcgtgaccggctgaaggcatgggcggacgaggtggcgccgcagattgcagctgaactcggcatcccgcttgagcgattgcggccggtgctcgacgcacatctcgcgcatcaccgcgaggtgatacgcgagatgatgcatcaagacgtggcagagctaaaatatttgtaa

SEQ ID NO: 8909 - DNA, 237 bp, Methylobacterium sp.
atggccatggcacgagacggcgaagaccgggccgaggggtttgccgggcagagcgtggccggcactcccggacatccgagcctgagcagcccggaccacgccgaggccggcgacggcagcccgagccaccgcagcctcaccggcggggcatcgccgcggcccgccaggagtgagacgaccgggaaggacgaggtgggcgggacggaaccggccgatccgccctccggcagccggtga

SEQ ID NO: 8910 - DNA, 177 bp, Methylobacterium sp.
ttggcgtgcgagatcaacctcatcgacaggaagcaacgcatggcggccacagatccacggcatcgcatcggtcaggacgtaaataccgtcgatcaactcagcagcgtcgtcatcctcggccttgccgtcgcgggcggtgccgccgccatcgtgctcagcctgctcctgatcggctga

SEQ ID NO: 8911 - DNA, 174 bp, Methylobacterium sp.
atgaaaagcctgcttctcgcttcgagcgcgctcgttgccgccaccgttgccgcctcggccgccgacctgccacgccgcgccgctccgcccccggtgttccagccggtgccggtcttcacttggacgggcttctacgccggtttcaacgccggttacggcttcggcacccaggac

SEQ ID NO: 8912 - DNA, 579 bp, Methylobacterium sp.
gtgctcacctccgtcatggcacgcttcctggcacgccacccggccatcgagcccgacatcgactacagcgaccgattggtcgacatcgtcgacgagggcttcgacgcggtgatccgctccggggaacagaccgactcccgcctgatgcatcgccggctcctgagctttccgtggcggctcgtggccgcgccacgctacctggagcgcgccggcgtccccgggacggtggccgacctcgcccggtacgtctgcctgaggcagaagctgccgacgggacgcctcgcgccctggcccatccgggatgccggcgcgacggagccgcccgcctcgctcaccaccaacatcatcgacccgctgatcgagatgaccctcgccggggccggcatcgcggcccttccggatttcctcgtccgcgagcacctcgcttccggcgccctagtgacggtcctggaaaaggaaacggagcgcaccgggacgctcagcgtcctttgggcggccaaccgtttccggacaccgaaggtgagggccttcgtcgacttccttcacgaatggtcccgaggcgagaaccacggcggctga

SEQ ID NO: 8913 - DNA, 249 bp, Methylobacterium sp.
atgagcgctgagcgcttcaccatccagcagcagatcgacgaggtgcagtgctgcctcgtcagcatccgctcggccgtcgaggcgtggcagcgcgcccccgagcggttccgcagcgtcgagaccggcgcctgccgctcgaagatcgcgcccctggaagccgccgtccgcaccctggaatgggtcagggacaacgccgagcatctgcggcaggcgcgcggcgccgccgatccgtcccaagctgcagagtag

SEQ ID NO: 8914 - DNA, 138 bp, Methylobacterium sp.
atgggggagcatgcgcaggccttcgtcgggtccgcggggcccaacgagccctcgccgttctccaacctctgccttgccaccggccaccagcaggttgcgccggtgccggccatcctcgcaattctcgacctatggtga

SEQ ID NO: 8915 - DNA, 219 bp, Methylobacterium sp.
ttgaggccgtccagtacggatacggcggcgggtacgggtacggacgtcctcgcggctaccgtggtggtggctatggtcgtgggttcggcggatacggacctcgcccgaggttctacggtcggggtgggtatggaggccggcacttcggcggtccaggccgcggctacggtcgtcattttcgttgaggtagccgcagacggttcttcgatgcccacatga

SEQ ID NO: 8916 - DNA, 822 bp, Methylobacterium sp.
atgccgcttgtctcgacgcgctcggagggcgtcgcggactgccttgtcttcgctcaagagtattctcgtcggacgcgactggccggcctcgtcggcgccgcgctgaccggcgccgccggcgccgccttcatcgcccggatcgatgcgcaggcgagcaccctgccggccctgatcctcggcttctccttcgtgggcggcctgctgtcgacctggtcgccctgcggttattcgagcctctgtctcctgcgcccggtcgggcggcacgcacgcagcgccctcgtcacctacacgcccaccttcctgctccatggggccggctacgccctcggggccgtgatcctcggcggcctgctcgggctggccggagggcttctgggctttgccggcatctcggttctgacgctcgccgcgctcggtgtcgccggcctcgtctacggcgcgcatcagctcggcttcctgcgcgtcccctatccgcagcgccgggcccaggtgccgcacgacgcgcggcagcgcttcccgatgtggttcatcggtggcctctacgggatctcgctcggcctcaactatctcacctacgtccagactccgatcctgtacctcgtgaccgcggcggccgtggcgagcggcaacgtcacctccgcgatcgtactgttcctggccttcaacgcgggccgcttcctgccgatggcggtgaattacctgccggtgagcgacatcgccgtgcagaactggctcgcccgccgccaggaaagtgcagcttttctcgacggtggattgctgattgcgttcggcgcggcgctgctgaccttcgccgtgctctga

SEQ ID NO: 8917 - DNA, 1230 bp, Methylobacterium sp.
atgatgacgcacgcccatgcccggcttcggcacgccttccgctacggctcttccgtgatcggtgccgcggcactcgcggccctcctcgccgccggccccgtcgcggctgccgagccagggaccgccgccaagcaggccgccgccgacctcggcgccggaaaggccgacgatccggtggtgctgaaggcgcccgcgccgaatgcccggcgcgtctacgtctacgatccgaagcacttcgctgcgatctcgcagagcttcatcatcgacggcgacaccgcccgcgtccttggcacggccgacagcggcttcatgggcaatccgatcgtggccagcgacggctccttcttcgggcacgccaacacggtgttctcgcggatcgcacgcggcaagcgcaccgactacgtcgagctgctcgacccgcggaccgccgacccgatcgccgatatcgagctgccgaacgcgccccgcttcctcgtcggcacctatccctggatgacggcgctgacgcccaacaacaagacgctgctgttctaccagttctcgccgcagccggccgtcggcgtcgtcgacctcgccggcaagaagttcgaccggatgatcgaggtgccggactgctatcacatcttcccgtcgagcaacgacaccttcttcatgcattgccgcgacggcagcctgctgaaggtcagcatcggagccgacggcaagtcgcagaccaaacggaccgagatcttccacaaggagaacgagtacgtcatcaaccacccggcttattcgcccaagaacggccgcctcgtgtggccgacctatacgggcaagatcttccaggtcgacctgtcctcccaggaggccaagttccttcccgcgatcgaggccttcaccgaggccgagaagaaggaaggctgggcgccgggcggctggcagcaggtcgcctaccaccgcgacagcgaccggatcttcctgctcggcgaccagcgcgcggcctccaagcacaaggcgccgagccgcttcgtgttcgtgatcgatgccaagaccggcaagcgcatcaacaagctcgaactcaagcatgagatcgactcggtcggcgtgagccaggatgccaagccccagctctacgcgctctccaccggcgccaagacgctgttcatcttcgatcccgagaccggcaaggagacctcgagcgtcaaccagctcggcgccggcccgcaggtcatcacaacctcggacatgtga

SEQ ID NO: 8918 - DNA, 594 bp, Methylobacterium sp.
gtgacgatcatgtccgccatcgccctgtctgacatcgctctgccgctcctcggcgagcccgtcgtcacggtcttcctgcggtcgttcctgatcctgctcttcgtcgcggccgccctgccgaagctgcgtcacggcgacgagttcttcggggtcgtgcggaacttccggctgatgcccgaggcgatggcccgccccttcgccgccgtgcttcccctcgcggaactggcgctcgcggcgggtctcgcggtcccggcgacggccgcgatcgccgcggcgggcctcggcggcttgctgattctgttcggcctcgccatcgcgattaacgtggtccgcggccggaccgcgatcgattgcggatgcttccgcaacggcatgcggcagccgctcagctggctgctcgtcggccgcaacgccggtctcgccctcgcggccttcggcctcgcttggatcctgccggcggcgcccgccgccggccccttcgatcttgccgtcggcttcgcggccgccggcctcgccctcctcatcggctacggcgcttcgctcctgaacgggcttcaagccggcgcgcgtccctcttccctctcgaaaggctga

SEQ ID NO: 8919 - DNA, 618 bp, Methylobacterium sp.
atgaccatgcagttcctgatcgcctcgaacgtcctgctctggctcgccctgatcggctgcgccgtgctcctactcggcctgctgcgacaggtcggccttctccacgaacgctcgtcgcccatgggcgccatgatcaccgatcacggccccgacatcggcgacgccgcgccggtcttcgaccttcccgaccatgccggcgccaccgtgcgcatcggcggaccgagcgccgagggtcgcccgactctgctgatgttcaccgccccgacctgtccggtctgcgacaagctcttcccgctgatcaagtcgatcgcccgggccgagaagttcgcggtggtgatgatcagcgacggccagccggacgagcaccagcgcttcctggccaagcacgagctcggcgacatccgctacgtcgtctcggccgaggtcggcatggccttccaagtcgggaagatcccctacggcgtgctgctcgatgccgagggcgtgatccgcgccaagggcctcaccaacacccgcgagcatctcgagagcctgcttgaggcggacaagagcggcttcgcgtcgatccagcaactcatgacgagccggaagcacagccacggcgccaaggccgcctga

SEQ ID NO: 8920 - DNA, 561 bp, Methylobacterium sp.
atgctcggaaaatcccaattcgacgatctcttcgagaagatgtcccgcaaggtggcgggacataccagccgccgcggcttcatcggacgcgtcggcacggcggtggccggcgtggcgctggtgcccctgcttccggtcgaccgccgcgggcgcgtcagccgcgccaacgccgctgagagcgcgggcgatcctcggggcaagtggacgccgcaggaccacgacgtgcaggcctgcgattactggcgccactgctccatcgacggcaacatctgcgactgttccggcggctcgctcaccaattgcccgcccggcaccaagctcgcgtccagctcctgggtcgccagctgctacaacccgaccgacaagcagagctacctgatctcctaccgcgactgctgcggcgccaacatgtccacccggtgctcgtgcctgaacaccgaaggcgagctgccggtctaccgcccggaattcggcaacgacatcatctggtgcttcggcgccgaggacgatgccatgacctaccactgcacgatctcgcccatcgtcggaaaggccggctga

SEQ ID NO: 8921 - DNA, 360 bp, Methylobacterium sp.
atgcgcatcctcgttctcgcagcaacgcttgctgccctctccgccggtgcggcgcttgccgccggcgcgctcgaagtggtgccggaggcgcctgccggcagcaccgaggtcaagatcgccaagatgaagttcgcgaccccggaggtccgcatcaaggcgggctcggccgtgacctggaccaataccgaagccctgccgcacaacgtgcacttcaagcccggcggcagcgtcgacaaggagctggaggggccgatgctgcgctccaaccagaccttctcggtccagttcaacacgccgggcacctacgactacatctgcacgccccatcccttcatgaagggcaaggtcgtcgtcgagtag

SEQ ID NO: 8922 - DNA, 888 bp, Methylobacterium sp.
atgtggattccctacgacctgaccggctcgctcaagggcgagacatcagccgcgagccttcagcgctcacaggcggaccgttccgttcgcgacgtgctggtcggcttcttcgtgcgcaatcccatcacccagagctgggagatcgacatccgagccgagtccgccaagcaggtgatgacggtcgcgctggacggcatgccggccgagatcgcctgctacggcgacgcgtcgggcaagctcagcgagatcatctaccgcatcaaaagcgccgagccctacgccgccttcgatgcctgccgacacgatctggaggaccggctcgcccgctggacactggaactcggccgcggcatggccatcgccggttggcgcgtggccgatccggccaacgaggcgcgctggcgctgcaccccgttccgtccgagcgcgctcgacctcgacctcgacgccgtggccttcgcgccggacgacctcaagccgctgttgcgcgtctaccagcgcgcccgcaacgcctcggacccggcctggcgcctgctgaacgcctacgcggtgctgacatgctggcgcgccggcagggctcccttcccggcaaagccgccacggcccgtccccaccgtgaccctggagatgctggtgcatagcggcacccttggctgcgccgtgaccttcaaggaccagccgctgacggtcctcgttgatgccctggaggtttggcgcgacgccgtcctgcaggatctggagtcccccggcgacggcgcgcaggggctgcggggcgaggcgcgctggcgtctcgcgcacatggcgagcctcgccgacctcgccgcccgcgagacgctcctgcgcgagatcgcgcgccgccgcggcgccgatctggcgctcgcttcctga

SEQ ID NO: 8923 - DNA, 357 bp, Methylobacterium sp.
atggcccttgatcccgcattccgtcgccttgccgctgtcttctccctgagccttgcggtgctgaccgctccggcgagcgccgaagagttcgaggtcacgatccatcacgcggaactgcaggaggtgacgatcaagccccgcgtgggcgacacgatccgcttcgtcaatcaggccgacatcgctcacaacctgtacctcacctacgaggacggtcaggtcgaaaccctcgacacgcaaccgccgcgcacgaccaagcaggtggtgctgcgccgagccggccacgtcgtcgtgcgctgctggatccatcccatcatccggatggaactcgatgtcgccgacaaggccgcgagccagtag

SEQ ID NO: 8924 - DNA, 663 bp, Methylobacterium sp.
atggcaaagcctaaacctccgtcgcggcgggaccttctgacgagcggcgccaaggccgccggcgtcgcctgcctcgccggtctctcgctcacggcctacgtcgagtcggcgcgcagggccgaggcgacggcgttgcgcccgcccggcgccctgccggaggacgatttccagggggcttgcgtccgctgcggcctatgcgtgcgggcctgcccgttcgacaccctgcgcctcgccgagttgggagaggaggcgccgctgggcacccccttcttcgtcgcccgcgaaacgccctgcttcatgtgcgcggacgtaccctgcgccaaggcctgcccaaccggcgccctcgaccgtgacatcccgagcatccggcaggccgacatgggcgtcgccgtcctcgtcggccacgagagctgcctgaactacaagggcatcacctgcagcatctgccaccgcgtctgcccgatccgcgacgaggcgatcacgctggagccgcaggcgatcaggggacgccggatggtgatcccgacggtgcattccgacaaatgcaccggttgcggtacctgcgagaagcactgcgtgttgggccacgccgcgatccgggtgctgccgcgcgaactcgggctcggcggccgcgggcgcaacccggcggggagggcagtgtga

SEQ ID NO: 8925 - DNA, 372 bp, Methylobacterium sp.
gtgtggctgcgatcgattcggagcctcgccgcgctgatcctgtgcggctgcctcgccgcggagccctgcagagccgagggtgcgaacgctgccggctttgggctaacgtcttgcgccgacgctgcgccgctgttcgatcagccggcttatcggcaggccttcttcacctggacgctcgggttcgccaccggcatcaacaacgtgctggtggtgcgcgatcggcagctccgcgacctgtccggtctgaacgccgatctggtggtgggatccctgcgcgcgttctgcgcccagtacccaacggcgttcctgattcagggggctgagcgattccacgcaggcctgccgctgcgcgcctggacggtgccacggtaa

SEQ ID NO: 8926 - DNA, 585 bp, Methylobacterium sp.
gtgccctcgaccgagccgacgcgcatcttcaccacgcaggtggagttcggcgaggcgcgcgcgaccaacctgatcgaggccgccgccgacggcacgcagaagggcctcggcgtcgccgtcgcggtcggcgcgatgctgatcgccttcgtcgggctgatcgcgctggtgaatgccgccatcggctggaccggcggcgtgttcggcttcaccggcctctcgatcgagggcatcctcggcgtcgcgctggcgccgctcgcctggctgctcggcgtgccgtgggagcaggcgacgctcgtgggcggcgccatcggccagaagatcgccttcaacgaattcctggcctatgccggcctgtctccgaccttgaaggcgggcaccctcgatccgcgcacgggcgcgatcctgtgcttcgcgctgtgcggcttcgccaacctcacctcggtggcgatccagctcgcgagcttcaccagcctcgcccccgagcgccggcccgagatcgcccggttcggcctgcgggcgatcctggccggcaccctgtcgaacctcaccagcgcggccatcgccggcctgttcatcaccgggtga

SEQ ID NO: 8927 - DNA, 648 bp, Methylobacterium sp.
gtgaccgaaaccagcaaggctcggcgcggccgtccccccaacgaggcgctgcgccagacgattctcgacgctgcgggtgaactatttttggaattgggtattcaggcgacgaccttggacaaggtcgctcagagagcgagaatatcgaagcttagcatctatcggcacttcgagaccaaggaggcgctatttagcgcagctatcgcttcccactgccatcaatttgcatctctggccctttccgaacgtattggcggatcggccgaagatcagctcatggcggcgggatcattcctgcttcgcacactgttgggccggaatgtgcgcagtgttgaagcgatgattatgagcgacaaggcgaatcagaattcgctaagtaagctttttttcgaagctggtcccgcccatgtcatttctgaaatcgaggccttgttgcgtcaattgcacgcgaagtcggttttgaacgtacctgatcctcggcagtccgcccgcttgttcgcagccattatcaaagggtcggacctccttatgatcgtgcgcttcgacgaggcgagagcgacggatgacaacgaaatcgcatcctattgccggtctgccgtcgcgatgttcatcgcagcgcacggcagcaacgaccatgcgggcagatag

SEQ ID NO: 8928 - DNA, 351 bp, Methylobacterium sp.
atgaactggaacgacgtcctcgccgtcggcttggcgctgccggagatggaggccgcgacctcctacggcacgcccgcgctcaaagtccgcggcaagctcgtgacgcgcctgcggaccgaggacgacagtctcgtcctcctcgaagtcccgccggacgagcgcgacatgctgatcgccgccgatcccgagaccttccacgtcacgccccattacgaggggcacgcgatcgtcctcgctcggctggcggccctggagccggagcggctccggcccttcttcctgcgccgctggcgggcggtggcacccaagcgcctcgttgcgcgcttcgagactgcgcaggaggaggcgtga

SEQ ID NO: 8929 - DNA, 1449 bp, Methylobacterium sp.
atgccgatccgacattcgcccccctcgcttcgccgcctccgaaccgggtggccggccggggcgctgctctgggcgggggcggccgtggccgccccggaggtgccgcccgctgcggcgggacccgatccgatcaggatccccatcggcgacgcggtgcatgtggtgcgcctcgacgcgctccagcgcttcggcgcgaccccgatagccgagatctacggggggccgccggagacggagacgatgcaggccttcctgctcaccctgatctgcgacgccgagcaggggaagacgtccgagaacggcagcggggcgccgagaccgggcgaggccgccctgatgctcgcggcggaaaggctcgacgcgttgaaggatcggcccgccgcagagcgcgagacgccgctgcgggcggtgaacgggctgatcctcgccggtctgcgccgcggcgaaggccggctgctcgaatccctggccagccgcttctccgacctcggcgaagaggcccgcgacggcaccccgttcgccatcgccggcgaactcctgctggcccggaccgcgttctgcgacgcggccgacgggcattgccgcgccggggccgagaccgcttcggcggacgagttcgtgcaggccggccgctggcacaacgacgtcgatcaactgcggcgggccggcgagaaggcggagcgggccgagcgcggcgaggggccggaaccccgccagctcgacgaaagagggctgttcaaggcccgcaacgcggctggcgccgcctacagctacgccgccgccttcgccgaactggcggagcgccggcccttcatcgagcgatcggtggcggcctacgagcgggcgctgccgagcgcggaggcacaggcgccgtccttcgcctcggcacggctgtggcacaatctcggcgcggcctatgtcgaccgcgcggcgctgaccaggaacctgaacgatttcgagcgtggcgttgctctctacaagcgggcgatcccgcttttcgatccccgggacgaccggcgggccctggcccgcgcccgctccaatatgggccgcgcccgcagctggatcgcgacgcgcacgcgcgacctcgcgatccacgaccgggcggtggccgaccagcgcgcggcgatcaagggctacgaggcggcctccgagacgttcgacgccgccttcgcccgctaccggctggcgcaggatcttttcgaccgggcgaagaccgccgacggtctcgcccgcgaccttgcggcgagctgggccggcgacgcggcgctgcggcgcgacgtgctgatccggatcgccgcggagagtcgcgagcaggcgctggcccggatcgcgcacgccgtgccggtgctcgaacgggcgggcgcgacgcagtatctcgaatgggcgcgggagctcgaagcggagatccgcgccgccgagcccaagattgagtccaagacgagatga

SEQ ID NO: 8930 - DNA, 1845 bp, Methylobacterium sp.
atgttcgcgaacgaagggcgtcgaggcgtcgatgtcatcacgcggctgcgacggttcgcgcgttggctggagctccgggccgtcgggctgatgccggaatacttcgatccggccgaaggcgcgcgcgcggcattcatcatcgccgttcctctcgtgctgatcgccgccacgggggaacgagggttcggctggatcatcttcgcggccttctggacatgtctcgccgacaccgggggcccggagcggacccggcgcgcgctgctggcgggtttcgtgctgctcggcacgctcacgaccttcgtggcctcgtggctggccgggttgagtccggaggcggccctcgccgcgggaccggtcctcgtcgtcatgaccgcactcctgccgatccggtggaacgcctcgtccctcgtggccacgttgctcggtgtcgtggcggtcgtggcggtgggctatccgagaccggccgtcgaggccgccgtgctggccggcgcgttcctgtgcggcagcgcctgggcgttcgtgattgggatcctggtctggcggacggatcgctggctgccgacgcgccaggccgtcacggccgtcgatgcacggctccacgatatggcctcggatctcgtgcatcggcgcgcggacaagccgcatatcgggcagacccagcaccgcagagccgttcgcggcgccctcgaacgcgctcacctgcgcttggcccggatccaggaggacgacgcggtcggcgcggtcaggctgcgcaaggcgctgctcgccgcagacgaagtcttccacgcgctcctggcgctggagcacctgcatccgcggctcgatcgggagacgaaggccatgctggaggcgataccgccgctgctgcgcgcgagcggcggcaccctgtcgagccgggggtccgaggccgccgaagccgccgaggttgcgcgccaggcggaggcgctgaggcagcgcgtcgccgggcggcgcggcgccgcggccgcggccatgcgggccatggcggcggcgttggccgtcccgaacgaccgttcacccgaggctgcgctcgcccgcgaacaggcctcggccgatgcgagccgccggatcctccaggccgcgatccgcagcggaaccggcgtgggcatcgtcacgctcgtcgcccattggttcgcactcggctatccgtactgggctgccatggccgtggtcgtggtcctgtccccggtgcggcggatcagctggagccgggccatcgagcgcatagtcggctccgtggtcggcggcatcctggcgcagatgctgctgacgctcgtgtcctcgtccccgctgctcatcggcatcatcgtggccgcgacggccgccacgatcgcggtgcgttcggtgaactacacgctgttcgtcgtcttcctcaccctgctgttcgtcctgaccatgggcgtgctgaatcccggccacgggatcgcgtcggcgcgcatgctcgacaacatcctcgggagtttcgcggcgatcacggcgacggttctcgtctggcccgaacggccggcctccacggcagcgctcgccggtgcagcgctcacggcgaaccgggcctatctcgacgccgtcctatcgggggacccggcgctgatcgcgacgacccgccgttccgccgggatcgccagcaccgaggccgagatcgccttctatgcccccgaccggattctcggggcagcgccgacggaggccgacatcgccgacctgatggccgcgcgccggctggccggcgaggctgccgccctctggtacgaccgaagggccgcttccgattctcccgagaccgacgaccccgccccatccacgtcctcggcaaggacgggcgcctga

SEQ ID NO: 8931 - DNA, 282 bp, Methylobacterium sp.
atgaagaacccaccgacgatcacttgcgtgatcggcttcgcccttgccgccgtcgcctgcttgcccgccaccgctcagcctcggcaaggatcgggcgtgatcgtgacggatgacggcagcgtcaccggcggccgcgaccgcggcgtgtcggtctcgcgcggcgcgacgggcgccgacaccatcaccaacaacgcggctgccggcggcaacgccaaccagcccgagcgcgccgttccccagggcagcgccggcggcggaagcggcaacggcccgggccagtag

SEQ ID NO: 8932 - DNA, 96 bp, Methylobacterium sp.
atgatgaaggcgttttcttacggaatgatcggtgcgcttgcggtcggaatcgcgaccgccgtgtttggcgccacgagcctgttgttcaacccatga

SEQ ID NO: 8933 - DNA, 393 bp, Methylobacterium sp.
atgggcgacatccatcccccgaccaatctcgtccacgaggtgggccgcctgatcgttcaggacgagcagatcggcgcccatgactggcagtcgctgtcgctcgtcgtcgtcctcgacggcgcgccgtcgatgagcggctacgtctacgacgcggccggcaaggcgacgccggaactgcccgacgacaacggcatcttcgacgccttcgagcgcctgcgcgacgcgatgcagcaggacaatccgacgaagcgtccctggcgggcggcgctgttccagatccgccggccggagatgaaggccaccttccagttcgagtacgacgaccctaaccgctgggacgtgacgccgcgcaacttcgagaccaagcccgaggagttacggccgaaggcgtga

SEQ ID NO: 8934 - DNA, 495 bp, Methylobacterium sp.
gtgaggcccgccgacctcgcccgcctcgccacgttgcgcgcgcgccgcgaggcggaggccggccgcgccgcccaggcggcggccgaacggcgcctcgcggccgaggcggcggaagcgcgcgccgaccaggcggtccttgaccgcgaggcgacgcgggtttccggcgagcgcgcgctctatgccgagctgaaagcgggcggcgcgatcccgctcgccgccctggaggagcgccgtgccgcgctggcgggcctcggcgaggcggtcgaggccgcgcgcgcggaggcggcgaccgaggccgaggcggcgaatgcggcgcgcgcggcgcacgaggacacgctggccgccctggcgcgccgcgcccgcgagacccggaagtggcagcgtgcgcaggacaagatcctcggcctgcgcaggacgctggcggagcgggccgaggagcacgaggccgaggacgaaatcctgatgcgcctcggctgcgtgggagcagcgctatga

SEQ ID NO: 8935 - DNA, 516 bp, Methylobacterium sp.
atgaccctgacgcgatgcccggattgcgggcggcaggtcagcgaccgggccgtcgcctgcccgaattgcggccgccccatcgcgccgggcggggcatcccgcaccgcgctcgctgggcgaaagggggcgggcttcgagtaccggtccgagcggaccctgttcggctggcccctcgtccacgtcgtctacggcgcgtcggacaacgccaccctgcggccggcccgcggcatcctcgccttcggcaacatcgccatcggcctcgtcgccttcggcggcatcgccgtcggcgggatcgcgctgggcgggatcaccctcggtccggttgccctgggcggcgtcgcgatcggcctgatgctcggcgcgggcggcatcgccaccggctactgggcgctcggcggggtggcgctcggcgcgacggcgatcgggggcgtggccttgggcgcgatgatcgggccggcggctcagcgcgaaaccggtccgccgctgccgagcaccgtgccgcccggcggaccgtag

SEQ ID NO: 8936 - DNA, 627 bp, Methylobacterium sp.
atgcccacgctctacacgatgccgggtacctgttcgctttcgccgaacatcgccattgcatggctcgacgcgccggtcgaagttcacaacatagcttacggcgatcagaagaaggccgcctatctcgccatcaaccccaaaggccaggtcccagcgctacgcttcgatgacggtgatgtgctgacggaggcgtcggccatcctcgcctggcttggcgcggcgcacggcaaggcgggctacggccgcgacacgaggctcggccgcaaggaagccgaggcgctgtcgtacatgacttcggaggtccatgccgcttatggggggcacttcaatactcagaagctcgccgagagcgaagccgcgcgggaagaggtcaaacgaaagacctacgaaaccctcatcggtcactataagcggatggatggcatcctgagtgagaacggtggcgagtggtatctcgggcagcggtcttttgctgacactttcctctacgtactgacgcgttggatcgagaagacgccgctatccattgaagactatccggcattgaaggcacatcgcgcacgcatggaggcggacgagggtgtcaaacgtgccctcgcgcgccaggacatggagccgattggctga

SEQ ID NO: 8937 - DNA, 636 bp, Methylobacterium sp.
atgacgagcgagacgacacgcaatcctaagaccgatcatctgctcacgcctgagaactcggccctcatcatcatcgactatcagccgatccaggtctcctcgatccggtcgatgccgcgcgaggagcttctgttcaatatcgtgggcgttaccaaggcggcgctcaactatgatcttccgattatccactcgacggtgaatgtcggaacgggccgtaacaagccgccgatccaggaactccaagacatcatcgggcacctgccgacctatgaccggacgacggtcaattcctgggaggacgtcggcttcaagcaggcggtcaaggcgctcgggcgcaggaagctcatcatgaccgccctgtggaccgaggtgtgcttggccttccccgccctcgacgcgatccaggaaggcttcgaggtctacgtccccgtggacgcagtaggcggcacctcggtcgcggcacatgagaccgcgttgcgtcgcatggaacaggcgggcgccaagctgatcagccgcgtccaactgtactgcgaactccagcgggattgggcgcgcgaggctaccatctctggcttcatggacgtcttcgagaacttcgacggcttcaaccctgaaaaggcggctgaagcggcttag

SEQ ID NO: 8938 - DNA, 189 bp, Methylobacterium sp.
atgtcctcggtcgcgccctcctcgggcagcagcacctcccaggcggcgcgtcgcggcgctgacgtcgacggcatctgggcctcgccctgcgacgggccgggccgcgggcttcccgccgtgctgtccggaacctcgctcaacgccccaatcctccgcaaagccgcgaacggccaccccgctcagggttaa

SEQ ID NO: 8939 - DNA, 150 bp, Methylobacterium sp.
atggcgcgcgttcttcatccgcccggaacatcgatcgtcgagatgcccgcccaccgtcctcgcctggtttacggggtcctgttcatcgtggcttcgatcgtgctgtggggtacggcatcatggatgaccggcagcatcctctgggtctga

SEQ ID NO: 8940 - DNA, 138 bp, Methylobacterium sp.
atgccgcggatcttcggcgagccgacacccagaggtttcgagacccaaggacttcaggcggcctcctcggagcgccgcccttttttcgtggcgatgctggacgccggccaaggccgcgacgacgaccatcttggatga

SEQ ID NO: 8941 - DNA, 147 bp, Methylobacterium sp.
gtgccgtccacagttctgtccccgctggaacggcggccggtcgagctgcatccgatcgaatccgagacgcgcccgccgcgtagcttcaccgccaatgaactcatcgccatggcccgcgccgcccgcgcccgccgtctcgatccgtaa

SEQ ID NO: 8942 - DNA, 291 bp, Methylobacterium sp.
atgatgcggcagaccttcttcctggccacggcgctcatgatcgcgacgccgaccgtcgcactcgccctggatccgggaatgatcgcacagggacaggtgctctccggtatggcgcggggctacgccgaacgcggctacgccgagcgcaggggtgtccgatcacgacgcaccgagccgagtgaggcgagaacccggcagacttgcgccaacgggcgcgcgatggcgcgccgcggaaacgccgatccacggcttcgctatctgctcgcgctgtgccgcaggggcggctggtag

SEQ ID NO: 8943 - DNA, 87 bp, Methylobacterium sp.
atggcgagcgtcggcgaagggatccagccgcgcgaccttgccggaaagttcggcgcgctggactgcttcggcttcgcctcgcggtga

SEQ ID NO: 8944 - DNA, 81 bp, Methylobacterium sp.
atggcgccggcccatcagcaccttcagccgcttccgggagcggtcgaggaggatcagcgtcgcggcatcgcgcgggcgtaa

SEQ ID NO: 8945 - DNA, 141 bp, Methylobacterium sp.
gtgaacgcggcgaccgagacgggccggacgaccggccgcgagacgaagatgccgcagccggatcatcgtgccggcctcgaatttctggagcgcgacgcgatcgccccctggcgcccgagccccggcgcgtctatctctgac

SEQ ID NO: 8946 - DNA, 105 bp, Methylobacterium sp.
atgtccgtgatcctgggccggatcgccgggtccatccgcggtggcgtcgcgacgacgtcgcctgtcgacatcgatggtgaggaacggcgtggcgaagccgtgtga

SEQ ID NO: 8947 - DNA, 258 bp, Methylobacterium sp.
atggggtctacgttacaggagcagcgcggcaatggcagtcgaggtttcgcccccaggtcccttgtgatcgacgacgagaccgatcggctggctcagggtctggcggctttgcggcgggtggacaagatcgaagccttgcgggtttccctcgtcaacgcgttgcggctctccgagaagacaacggtgcgcaaattcgcgttgtaccggccaaaggcagacggtgtggcagaacgggataccaccccgctcggtccttga

SEQ ID NO: 8948 - DNA, 177 bp, Methylobacterium sp.
gtgacggcgctcgacggcggcggccgtgaaggcctcgcgggtcatggtgcgatcaagccgataggcgagacccgcgccgtcgagcacgacggcgagaagctccgcgtccagatcgctgtcttcgagcagcaggatgtccagggttgcctcggcgccgcgcgacgcgccgtcctttag

SEQ ID NO: 8949 - DNA, 294 bp, Methylobacterium sp.
atgtttgttgaaggcgtgcggtggatcgtgcgtaccggttcaccgaggcgtgatcggctggacgccctcggcgagtggaataacgtgttccgtcgcttcagcagccggagccggaagggcaacgtgccatggaccgaggcgctgctgaagggtctgccgaccgacgtgatcctggctgatgccgccgacgacagcggccggctgtgcaagctggcggctggcaaaggcgcacaggccgtcatcccgaacaccatgtcacgggcgaagaaatacgaccaccacgaggctcactag

SEQ ID NO: 8950 - DNA, 258 bp, Methylobacterium sp.
gtgagcggcccagaccgcagcaagcggaccgagttccgccagtcaatcacgcgcgccgtcgccagccggatcaacgacgtgaacttcagcgtcagcgttggcaccgcgatccggcgcgcggtcatggcgcacaccctggcgccggttatgctgggccctgtgccggccaaccggagcgaccgccacatgctcatgcgcgacgacatccacacgatcgactcaaatacctgcgagatcggggttgtgatccagggttga

SEQ ID NO: 8951 - DNA, 498 bp, Methylobacterium sp.
gtggtctccagcctgccgcgtgcggccggcgcccagcgaacgagcgcgcctgttgaacttccccgcggctcggcgacggtgctggtggtggaggacgaggccgcggtgcgcgagatcgcctgcgcgatcctggccgacctcggctaccgggtgctggaggccgctgacggcgaggaggcgcttcgggttttcggggcgaacatggcggccatcgacctgctgcttaccgacgtggtgctgcccgggaaggtccggggccgcgagctctcggagcgcgtcctcgcgctgcggccgaacgtgcgcgtggtgttcatgtcgggctacaccgagaactccatcgtacatcacggccggctcgacgatggggtgcatctcgtcggcaagccgttcaagcgcgagcaactcgaccgcagggtcgccgaagtgctagggacagcggccgcctcgacacccgaggctcccaatgtcgtggcgctgcggcccaagcgggacgcgtag

SEQ ID NO: 8952 - DNA, 84 bp, Methylobacterium sp.
atgctcgacatcgccttcctggttggagccgtcgccttcttcggcctggccgccgcctacgccacgctctgcgaacgcctctga

SEQ ID NO: 8953 - DNA, 126 bp, Methylobacterium sp.
atggttatggcaaggggagcggtcatcggaggaaacctggcgctgatggtggactgccggttcgatctggaccttaagcctgccgggctccagagccataaggatatcggctatcacgaaccatga

SEQ ID NO: 8954 - DNA, 642 bp, Methylobacterium sp.
atgggccattttcgcatgatctacgagggcacggcctacacaccggacatcaaatcgtacagcctctcgttgaatgcggcggacgggcgctggcgcgggcaggagcccggcgacatggtcggcctcaccctgagcctgcaggggcggcccttcacctacgacgtgccggaggacgaggacgaacatctggccatcgccccgaacgtcgatacgcagtggctcgaggtgccgacgcgtctgttcgcggggcgggacatgagcagcctcggcggcctcgatctcgcttacgaggggccgcgggcgatcaacccgctcaccggcgagacctggcgcgaaccgccgggcctgctcggcacctacggcgacgaagccttcggcccctgtcggatcacggcgacgcatcgcggcggcgaccgcttcgccctgcatctcaccggcgagaccgagatcggcaccggcttcgacgtggccgtcgaagcgccgttgacggtcgcactgacgagctacaccggacaggccggcgaggatcgcctgcgccgctggttcgacgcgttcctgcgctgggacgacttcttttgggagcgcaccgtccatcccggcgagccgccgcagcacagcctgatcggcaccctgcgccgctga

SEQ ID NO: 8955 - DNA, 1437 bp, Methylobacterium sp.
atgaacgacagcgcctggcgcctgctcgggctcgaaccgacgcgggacacgtcggcgatccggcgcgcctatgcccgccgcctcaaactcacccggcccgacgaggatgccgagggcttccaggcccttctcgccgcccgcgagcgcgccctggcggaggcgcggcggcccctgcccgaagcgtggcaggaggttgaggacgatccctgcgacgcggagcaagggcccgcggacgaaacgcccggcgatccggccggggcggcgcagaagccgaggccggcgaacgagccggacggcggcacggaggtgacggcagagcgcgcggcggaggccggatcgaaggcgccgcccggtgacgtcctcccgccggccgtgctcctcgtgcgcgatctcgacggtccggcggcacccatgcccgaggtgccggccctcctcgtgcgcgacctcgaccctccgccggcgcccccggaccccgtgccgggggcgccgacgcccctggtgatcgacatcgcgccgctcgaagccggaccggccgaatgggaggaggcgcgcgcgctcgaggcggatctgccgctcttcctccgcgacggcgccgacagcctgaccgcgtggctcgcgcgggcgcggcggctgcccgctgggccccgcgccctggcggaggcggcgctgctgcgggcgctgttcggcctctggcgcggcccggacgggcggatcacggccaagcgcgtcgaggccacccgcccggcgatcctacgggccgcaccggtcttcggctggccgcgggaggatgcggttctcgccacccgcttcgatgcgcgcgacgccgcgctcgccacccagatcctgcgcgatacgtttccccccgagcccggcgatccggccgtcgtggcggtgccggtcttcccccgcggccgcctgccgctccaggcgggcgacgcccgtgccttcctcgaatccgcgccgcacgccctcaaggcctacgaggcgatgcggcggcaggctccgccgccccgccgcctgtccgtctacgcgttgctggcaccgcatgtctgggcggtggcgcatcgccgctggggcgtgacgctcgcggcgcttgcggggctgtggctctccttcctgctgtcggatacggccgtggaggcgagcgggaccagagcggtcgccctcggcgttctcgcgctgctcctctgggccggcaccgccgccgcgacggcgttcggggcggatcgcatccagatcgccgcagccgcccgagtcgcccgccgcgccggacgcaagggcgtgtacgcgccggtcgagcgggcggcacgccttcgtgcggccggagcccgcctgagcggctggggctggctcgccctggtgtggggcggctccatcgtcttcatcggtccctacttcgggctggccgccatgatcagcgccgcgctcaggcggtag

SEQ ID NO: 8956 - DNA, 1698 bp, Methylobacterium sp.
atggcgatcgtcggcatcgatctcggcaccacgaattcggcggtcgccgtctggacgccggaagggccgcggctcattcccaacgcgctgggcgagccgctgacgccctccgtggtcggcctcgacgcggacgggacggtgctggtcggccgcgcggcgcgggaccggctcgccaccgagcccgagcgcaccgtcgcctcgttcaagcgctggatgggctcgggccacgtcacccggctcggccgcggccagagcttccgccccgaggaactgtcggccctggtgctgaagagcctcaaggccgacgcccaggcgcatctcggcacggaggtgaccgaggcggtgatctcggtgccggcctatttcaacgacatccagcgcaaggccaccctcgacgccgcccgcctcgccggcctgccggtggagcggctggtcaacgagccgaccgcggcggcgctcgcctacggagtcgagtccaagcaagagggcagcgtcctcgtgttcgacctcggcggcggcaccttcgacgtttcgctgctcgaactctacgagggcgtgatggaggtgcgcgccaccgccggcgacgtggcgctcggcggcgatgacttttccgagattctggcggcggcgatcgccgaggaccagcgcgtcgcactcgacactctctcgcccggcgaccgcgcccgcctgctgcgggtcgccgaggcggtcaagcgcgggctcaccgccgcgccggtgacggcctacgagatccggctcggcgaggaagtgcggcggggcgagctcgaccgcgcccggctggagaccgccgccgccccgctcctgcaccgcctgcgcgcgccgctggagcgggccctgtcggattccggcaagcggctggccgacctcgacggggtgatcctcgttggcggcgcgacccggatgcccgtgatccgcagcctcgtcgcccggctgttcgggcgcctgcccctggtccatgtcgatcccgacacggcggtggcgcagggagcggcggtgcaggccgggctcaaggcgcgccacgccgccctggaggaggtggtgatgaccgatgtctgccccttcaccctgggcatcgccatcaccgagaacgcccgcaccgccggggcgacgcaggtgatgctgccgatcatcgagcgcaacgccgccgtgccggtgagccgagcccaccgcatcaccacggtccatgacgggcaggaccacatcgcggtggaggtgttccagggcgagagcctgcgcccggacgacaacattccgctggggcaggttccggtgacgctgccgaaggcgccggccggcaccgagaccgccgaggtgcgcttcacctacgacatcaacggcgccctagaggtcgaagtcgccgtgatctccaccggcctgcgccggcggcaggtcttccgcaacggcgccaatctcgacgaggcggagatcgaggcccgcttcgccgcgctcgccgcgatcaagctcgcgccgcgggagcaggcggagaaccgggcgctgctggcccgcgccgacgcgctctatgcggatttgcgcggcgacctgcgccagcacgtcgccggccgcgtcgcccgcttcgagcgggagatcgccgaggcttccggcagcgagcccgaggccctgcgcgcggccttcgccgccgatctcgacgccctcgaagaccaccgcttccggttctga

SEQ ID NO: 8957 - DNA, 177 bp, Methylobacterium sp.
atgccgtccctgaagcccgtcatctgcgccggcctgctggcgctcacgctcgccgcctgctccaccgctccggccgcgcccgccctcgatccggtgcccccgcctgcgccccggcccgacgccaagacgcagctcgaatacggcaacccgccgccgatcgggcgcgggggctactga

SEQ ID NO: 8958 - DNA, 114 bp, Methylobacterium sp.
atgcgcgtcggaggcatcctcttcaattccggggaaacggtgcttgcccccgagacggttcggatgaggctttcgcatcatccgaaccgcttcaaccgccgcgtctaccagtga

SEQ ID NO: 8959 - DNA, 216 bp, Methylobacterium sp.
atgtccctcatccgtcatccgttggattgcttcgggttctacgaccctccgtcatcgcgaggcgaagccgaagcgatccagggcgcgacctttccggacaatgcggagccctggattgccacggcttcgcctcgcaatgacggaatgacagccgaagcgatcaactggaaaccgttcgaccaagcggaatttgtgccgccccgcatcccgcgctaa

SEQ ID NO: 8960 - DNA, 270 bp, Methylobacterium sp.
atggaggcgggcccattgaaaatcgtcaggacgttggaaacgatagaaactgactcacccatgcacccgatcaggagggtcgttgttattgagcggaacgatggcttttactgctacgcacagcaatattacttccgatcggagtatgaaggggagttcatttcggagggttggcacaccatctccttcgacggcatctatgaaacgcctgagatggctgagatcgaaggaagagcttcatttgcaggctgctatggcgtcgagaattga

SEQ ID NO: 8961 - DNA, 894 bp, Methylobacterium sp.
gtgccgacccctctgctactcacctgcgccgatccgctcgagccgaaaaagccggatcccgcgttccgggtggaggtgggggcggcgcgcgcggccggtttcgcggttgccctgctcgatcacgacgagctggaccggcgcgtcgatcccgccgccgccctgcgccgggcgcgcctcgatgggggcggtccggcggtctatcgcggctggatgctgcgcagcgacgcctatgcacgtctgttcgaagccctggccgaacgcggcgtcgccctgctgacgacgccggcggcttacgccgcctgccaccacgtgccgggctcgtacccggcgctcgcgcggtggatgccccggacggcgtggctgccgctcgcccgaattgacgatgcggcggcgctccgcaccaccctggatcccttcggatcgtcgccggtcatcctcaaggactgggtcaagtcgcaggcctccggctactgggacgaggcctgcttcatccccgacgcgtccgacacggcgcgcgccgcccaagtgatcggacgtttccgcgctttgcagggagagagcctggagggcggcctcgtgttcaaggcttacgttccactcaagcccgtcggcgggccggcgcacgagcaccgcgccttcatcgtgcgcggttccgtcgtgggatgctggccccgcggggacggcccttccccgtcgccgccggccgacctgctcgcctccatcgccgccgccgtgccgagcccgttcgcctcagccgatctcgcccaggaccatgacgggtgctggtggctgctggaggtcggtgacggaggggtctccggactgccggtcgtggaagcggccgctccgctcttcgaggcgctcgccggggccgcggcgcaggagcaagcgtga

SEQ ID NO: 8962 - DNA, 153 bp, Methylobacterium sp.
gtggaggcagacgaaagcttcgttcccaccgcgcaaaacacgatgatgctccggcgcaacggcgccggctggcgcggccccggcgatcgggcgcgccacgaaatcgccggttgctgcacggaagcaggctgcggcgcatcggcgcgctcgtaa

SEQ ID NO: 8963 - DNA, 606 bp, Methylobacterium sp.
gtgagcgcccgcgacaccatcttggcccgcatccgcgaaaaccggccggcgggcgcgcatccgcggccggacgtgccccgctttcccgtactccacgacggtcggccgctggagccgggcgaccacgtcagcgtgttcgagaccaacctgaaggcgatgggcggcaagcccgcaccctcgatggagggcgaccttgccgccctcgtgcgccggctgttcccgcaggccggcgtggtggcctcccgcgtgccggaactggcgggcgacctcgacatcgcggcctgccgaccgcaggatctcgccaacgtcgacgtcgcggtcgtgcgcgccgccttcgccatcgccgagaccggctcgatcctgctcagcgaagatgagctcggggtcaacgcgctcgcctatctggcccagcacctcctggtgctgctcgaccccgccgacatcgtgccctcgacccaggacgcctatcaccggcccgagttcaaggagcggcgctacgccgccttccacaccggcccctcggccaccgccgacatcgagggcgtgctgatccacggcgcgcaaggcgtgcgctccctcaccgtggcgatgcgtccccgagcctga

SEQ ID NO: 8964 - DNA, 792 bp, Methylobacterium sp.
atgttcccgcgcatggtgcgcgcaatgatgaccaaggaagagagcgcgatgcgcgtcggattgttcatcccctgctacatggatgccttcgagcccgaggttggcatagccaccctcgaactgctgcggcggttcgatctcgacgtcacctatccgttcgaccagacctgctgcggccagccgatgacgaacaccggctgccacgccgaggccgccgccaccgaggcgctgttcgtccggaacttctccgggttcgactacgtcgtggcgccgtccggctcctgcacgcaccaagtgcgcgagcacatgacggcgatcccgcagacccccgacgtcgtcgcggtgcgcgagcggacctacgaactggtcgagttcctgcacgacgtgctcaaggtggacgcctttccctgggccgagtttccgcaccgggtcagctaccacaacaactgcaacgccctgcggggcatcggccatgctcgcccgtccgagctgcacgcgccgttctactccaagcccctggacctgctggccaaggtcaagggtgtcgaggtggtcgatctcgcccgacccgacgagtgctgcggcttcggcggcaccttctgcgtgttcgagccggcggtctcggccaagatgggccacgacaaggtccgtgatcacgtccgggccggggccgaatacgtcgtctccgccgattcctcttgcatgatgcaccagcgcggctccgccgagcgcctggggctaccgctcaagttcatccacatcgcccaggtcctcaacggagccgccgcatga

SEQ ID NO: 8965 - DNA, 600 bp, Methylobacterium sp.
atgacgaccgggctgcgccccggaccggagggcgacggcggcgcctcgccgtccggcccggcggccgaccggctcggcatgaggcctttcggcccgcgcggtctgctgttcgtgctgcgctgctcgctctcgtccaccgtcgccttcctggcggcgagtgccctcggcctcggccacccggtctgggcctcgatctcggcccttatcgtgtcccaggaaagcttggccgagacgcaccgctccctcggcggccggatcctggggacggtgctcggcatcgcgaccgccgtcgcggtccacgcgacgttccgattgttcggcctcgaagccacggcggtgcagctggcggtcatcacggcggcctgcgccgtcatcgcccgggagcgaccgaccatccgcgtgtgcctctggaccggccccctggtgctgctcaccgccacgcccgcggcgccgatcggcctgaccgccctgcaccggggcggggaggtgatcctcggcggcctcgtcggcgccgggctgcacagcgtgatcgagtggtgcgcgcaaagggtcctcgaccgcccgcacccgcaggacggaggaccgggccgcgccggctag

SEQ ID NO: 8966 - DNA, 1107 bp, Methylobacterium sp.
atggcacgtaggcggacgacgaagccgcggcggctctggcggctgctggctgcctccgccgtcctggcggcgagcacggcgtcggccgcggtgatctggatcgatctcgatgcgcgtccctggacacgggacggccgcgtgcgcgcgcaggtctctcgcatggcgccacaggtcagcgggcagatcgtggacctgcgcatcgtcgacaaccagttcgtccataagggcgatgttctctacctgatcgatccgttcgattatcgggtcgcgctcgataaggcgcgcgcggaactcggaaaccgtgccgccgaccttgaggtgaagcgggcccaggccgcgcgccgggcggccctgaccaccgtgtcgacgtcgatcgaggagaagcagcgcaccgccggcgtggcccagcaggcggaggctgcctacgacctcgcccaagcgcagctcgcccaggccaaggtcaacctcgaacgcacgcaggtgcgcagcgccgtcaacggctacgtcaacaacctgctgctgcgcgtcggcgacttcgccacaacgggcatcgccaacgtctcggtcctcgacagcgactcctactggatcgacggctacttcgaggagacgaagataagccatgtccgcgtcggcgccgacgcggagatccgcctcatgggtgacgaccggccgctgcgggggcgggtcgacagcatcacccgcggcatcagcacgctcaacgcgacgccgagcacgcaaggactgccgagcgtcaaccccgtctacacctgggtccggctcgcccagcgcgtgccggtgcgcatccgcatcgagcacctgccggaggggctttcgctcgttgccggaacgacggctaccatcgacatccgcgacgacgtttggaagcccggcaccgggctgtcacgcctgatcgacaggatcctcggccggagcggccgcgagaccggggcgccggatgagaccacgcgggtgcgcggaaccgcgacgcgggaatcgatccccgtcccgacggcgccgggcgccattcccccggagcgggcggcgccgggtgtcgcaccgggcatggcgcagccgcccgaacaatcccgccccggacagagctga

SEQ ID NO: 8967 - DNA, 207 bp, Methylobacterium sp.
gtggcgcccggccgcatctgccgcctgatcgccgacgcggcacgcctgctcgctaacgagaagcgcctgctgatcctgtgcctgctggttgcccgcggcgagatggacgggaccagcctcgccggagaggtcgaactcagcccctcggccccatcgcagcacctcgcaaagctgcgagaggacgggctggtcgtgttccagtcctga

SEQ ID NO: 8968 - DNA, 1545 bp, Methylobacterium sp.
atgcagacgaatgttcttgagttcttcctggcgggggcattggagcggtgtccggagaagaccgccatcattgacggtgacgtccggatctccttcgcggagttggaccgtcgatcgaagaacctcgccgccgcgatcctggcgcgggtggggggtctgaatgagccggtagcggtctatctgcccaaatcggccgatgtcgtgatcgcaaatatcgcgatcatgtatgtcggcggcatctacatgaacctggacaccaagattccgccgcttcggctgaagaacatcttggatcacatcgggccgaagctcgttatcacatcgcgcgcgcatgcggccgacatccccagcgcgacagccgggatgacaccggatcaaatcctctgcgtggatgacatcgcggcccgtgacctctgggaagaggcggatggtgcctcctttccgttccggcagctgatcgatacggaccccgtttgcatcatcaacacctccggatcgaccggtacccccaagggcgtggtgctcaatcaccgcggcgtcatcgacttcatgggttgggtgttcgaagagttcggcttcgatgaaagcaccaagatcggaagcctttcgccattttatttcgacatttacatactggagttgatcgcttgtctggccaagggagcgacgctggtcatcattccggacaagcttccgatctttccggccaaattgatggagttcgttgcggcggaggacgtcgatttcgtgttctgggtgccgtcgatcatggtcaatatcgcaaatctcgggcttctcgacaaagtgtcgcttcccgcgctgcgcacggtcttctttgccggggaggtgtttccgacgcgccacctcaatatgtggcgccgtgctctgacggacgccgtattcgtcaacctgtacggcccgatcgagattcacgtcgattgcacttatcatgtcgtgaaaggcgacattgcggatgatcagcctctgccgatcggccggccatgccgcaacaccgacattttgatcctcaatgaggccgaccagctctgcgcggccgatgagcagggcgaactctgcgtgcgcggcagttcgctctgcggggggtactggaacgatccggagaagacggcgcgcgtcttcgtgcaaaatccgctcaacacccgctatccggaattgatctatcgcaccggcgatctcgcggtgcgccgtgccgacggcttgatctatctcgcaggtcgtaaggactaccagatcaagcatatggggtatcggatcgagctacctgagatcgagcataaggtcttgggaattccgggcatcgccaatgcctgcgtggtctatgatgatcccaagaaggcgatcacgttgttctaccagtcatccagcggcgaagtatccaagacgaaaatccgtcaagctttgtcggagatttttccgaaatacatgctgccgacggcgtaccacgccatggagcagcttcccatgaacccgaatggaaagatcgaccgcaacggcttggtgctcatgctcgcggagaacggctga

SEQ ID NO: 8969 - DNA, 321 bp, Methylobacterium sp.
atgcagtccaagtatcgaaaatttgcatcgatcgtagcggagaagattgctttcttcgcactggtgggggcggcctcggggatcggtatgatgatccggccgggacctggccttgatgagtatctgctgcattgggattcgtcgaagatcgtcatcggcgccgtgaccggtgcgacgacgggaatcgtcgtcggcgtgctcgaggcccggcggtggttgaaacagtactgggagacggttcaaaccctggcagccgagggcaaagacgcgtcggtgctcttcacgccgcgatcgcgcgctcggtcgccgttcgggccgtga

SEQ ID NO: 8970 - DNA, 150 bp, Methylobacterium sp.
atgcccgagaccaaacccgccccgctcccgccggccgatgaggatgccggcctgccgacgccgccgagccccggccgcctgccgccgccgaccttgcctcccgccgacgattcgtccgacgaccggacggacggggccggcacggagtga

SEQ ID NO: 8971 - DNA, 165 bp, Methylobacterium sp.
atgggccgcgccatcttcggcgccgtcgcgctgcccctctcccgcctcgttgcgctcggcacccttcccccattcaaatcgggcttgcccgatttgggcaaccctattgcagacctcgggcaagcccgggatctgttgaggggagggttaatgatccttcagtaa

SEQ ID NO: 8972 - DNA, 81 bp, Methylobacterium sp.
atgggcttcgaggccgctgcgcggccgctcagcatgaggagcggcgcggatatcgaaaaggccccatcgaccgatctgtag

SEQ ID NO: 8973 - DNA, 411 bp, Methylobacterium sp.
atgatcgcagcccggcccggcgccggctggacggttgagaatgcgctgcccgcgcggaattcgaacgtgagcggggagtcactcatcgtggcagacggtatcgtcctcggctacccccttcgccaaatccgggacttcctccacgtcgcactgctcacccggttgggcttactcaacgaagctgtgtcgccactcggcaatgcgatgcggcgcctcgtcacggcggataatcccgcaaatcgcgatgatccagcggcggatctcatcgcaaagctggaagagttcgttatggaatacggtttcatgccgtcgggagaagagttgtacttgctcgccgagcagttcgggctcgacgcgttacctccgctcccgcctaacctcgaagtcctccgccaccagatcgctccctga

SEQ ID NO: 8974 - DNA, 621 bp, Methylobacterium sp.
atgacgcgtatgacaaaaatcgcggtgagcctcatgctcctgtcgatgacggcggtatccgcgcaggcgcagatgcagtccgcggggcgcctggaccgccccggcatctctcgtacggccaacgagctgttcagtcaggtcggcgtcgagcggttcggagatcgcgccggcatgggacgggctttggaggaacacggcttcaacccggccccgccggaggccgcagcccaggctgcagcccgcctgccgatcggggagccaggacaggtgtggcgttggaacgacgcgacacagcccatgctcgtggtgatccgcgatgcgggcgtacggtgccagctcatggcccctttcgtggacgtggaggaatcccctgagcggttccgccagaccatgacggggttgcgtcgggcgggggtgaaagtcgagacggaacgggacgaacccgccgaattgggcgggcagccggggcggcaggtgttcttccgcgtccacctgccggacggcaatggggaaagccggctcttcgcgctgtccgtggctccgccacgggccgggggcgtctccctcatcatgacggcatcctccctgccgccgcagaagaagtccgggccgatgcggtga

SEQ ID NO: 8975 - DNA, 108 bp, Methylobacterium sp.
atgcaagacgggtcgcttctccttcaactcctgcacgcagccttgatggcttcgagcatgatgctgacgtggcaggtccatcgcttgcgtaaaccgaaggcggagtaa

SEQ ID NO: 8976 - DNA, 339 bp, Methylobacterium sp.
atgaccgcaagacaacccgccgaccgcacgacctatgccccgttcatcctagggcaaagcctcttgctggtggacccgggtctgacggcgaaggcggcgatcttccaacggaaagccggctggatcggcaacggccacgattggcagtcgatcgcgaagaccctgctgaaggaacagcatcccgcactgtccgagcggatcgagttcgactccgaagcggagatgttcgttgcacggggcgagcatgtggatctgatcacgctggcggaggccatgtgccgtgtctaccacggcgacggaaggctgatcgacctgcagagccgcgccgaactcgactga

SEQ ID NO: 8977 - DNA, 1236 bp, Methylobacterium sp.
gtggcggatgtaggtcgtgtcgcggtcgcgcacgatgatgcggcccggctcgcggtaataggtgcggccaccgacgtcgtactcgcggcgatcgcggcggatcgtgtcgtagtcgcgcacgcgataatcgtcgtcacggaagccgccaggcacgtaggcgggcgtgccgggaacgttgaaccggtcgccgcgccggtcatcgttcctacggtcgtcacgccgatcatcgcgacgatcgtcgtcacggcgatcaaatcggtcgccacgccggtcgccatcacgccgctcaccgtcgcggcgatcatcgaggccgcgctgatccgagcctctgtcgagctgggtcggcgccgtgggatcggtgggcgtgccggggggctgaaccggacgaccgggaacacccggctgctggttcggcgctgtgcgcccgccgggagcctcgcgggcagcatcgggttgggccgccgtcggcggcgtcggctgatccggacgggcgggctgctgcgcgttcggcgccactgggcgcccgggaacgcccggcctctggttcggtgccgtctcgggcgcggatggattcgggatggaaggcggcgtcggacgggtcgggcgctccgacgagggcggcgtcggcgcctccggggctcggcgctggctcggcgcgatgtcggggcggtcggtgtcgcgatcgcggccggcggggcgggccggacggtcggcgccatcacggtccggccgatccggcgcatcgcgacgggccggtgcctcgcgctcgggcgcttcgcggcgggcgggcgtctcacgatcgggagtccgctcgcgggcagcgggcggggtcgggcgctcctcggatcgatccggcctctgagcgggcgccagcgggcgctcgggacgctcctgtcgttcctgaggcgccggccgctcgggacgggccggacgttcagcgggctccggtcgctcgcggccggcgggcgcctgacgcggctccggcctctccggccgctcgggtcgatccggccgctcccgtgccggcggtccgccgcgctccacgccaccccgctcggccggaccagcgccgcccggcgcacccggaccgccggggccgcgcccaccgccgcgtggtccctcaccgtcatcctcgcgctgtgcaagctcgatccgcccaccgtcgccgagcgaccgcgccagggacagatcggacaggacgagcgccggcagcatcgtgccggccaggagcagtga

SEQ ID NO: 8978 - DNA, 123 bp, Methylobacterium sp.
atggcggatgcttccttgaagctcgtgctgggagtgtcgttggggccggcgctcctcaaggagcggggtcggggcctcaacttgtgcggtgcatgcatgttccggcagcgcaccatcctgtga

SEQ ID NO: 8979 - DNA, 87 bp, Methylobacterium sp.
atgaccgccgcagacacacctctgctcgcggcggcgttcctgctcggcctcggagcggccgttctcctcaacgcccttctcgtttga

SEQ ID NO: 8980 - DNA, 948 bp, Methylobacterium sp.
atgaagacgggcggtcccgctccggatgcgcaggacgacccggccgacctgctcggacggtcggttcacgacgagcgggtggtcgcccgcctgaaccgtgtcggcgcgagcgaaccggacacgcttatcgtgggggcctttgccgcctacggccggccaggcgagacggggttcggcctctcggccgagggccttgccagctaccgcgagacgaacggcgaaccccgctcgcgcgtgatcggcaccgaggcggaattgatcgtctcccgcatcgatttctccgacgccgactgcgcggcaccggggtcgcgggcctatgagggaccgttgccgttcggcctgcgcttcggtgacccggccgagggcgtcaccaaaaaactcggggcgaagccgcggcggaaggggcgctccagcgatcttcccggacgcagcccggtcgtcttcgtgtggaactatgaggtcggcggcctcgcggtgatcgtgaagctgacggcgcagcaccgcctcgcggcgatctacctcgccccgctcgaccgcccgacgcggcaggcgcgcgaacgggaagcttccctcagggccatgagcggacggatcgatcccacttccgtgccacgcatcgaggcgctgcggtctgtggtcccgaccgcgcgctggcgggaggccgccgccgaggtggacatggcggagcgggacatcgccgaggcggatcggctgctccactgctacctcgacgcagcgaaggccgccgcggctcggcggtcggcgccggccctccatcgggccacgcagcgcctcgtcctgggcctcaaccggatcaaccgcaggaacggcttgatcgagaccctggagcgcgacgaactgggcgtcttcatcgaggccgtgctgaccgaggccgggttcgaacgcgctcggggcgaggacattaccctgacctggcgggaatggtga

SEQ ID NO: 8981 - DNA, 267 bp, Methylobacterium sp.
atggcgtggcgtctgaacatacagttcaccatcggcctcacgagcaagagggagctaccgcaatggcagacattcgctcacacgacccgcttggccggtctgatggcggaccagcatctggccggggcggctcatcgagtggcggcggcggggcagcggatcaggctcgacaggcattgcgtgatgcgactgatagagcgtccgatgcgtgggacagtgcctcggagcacggcgcacgctactaccagcagggaagccgagccgtag

SEQ ID NO: 8982 - DNA, 399 bp, Methylobacterium sp.
gctccggccgcagagcccccgccctccccctatccggtcggcacgctctggacggattggctcaacggactgaccgccgccgcgcaggctaatccctcggcaaagccgtcggcgccgcggcccgaattgcgctcgaccggccggaaagcggaggccgcgcccctgccggacgcgacgaaggcctcgatggacgtgctccagcagatgctccagaccggagcggaggttcaggagcagaacgtcaaggcgatgaaggaggcgttcgacgccttctggagtcagcccaagccggagcccgaaccagccggccccagagcggccccctcgtcaccgccggcatctccctcccgcgccggagagggaagcccaccgaaacgcaagcctgtcgccaagagctag

SEQ ID NO: 8983 - DNA, 156 bp, Methylobacterium sp.
atgaccatcaccaccatcctcctcatcctactgatcctgctgctgttcggcggcggcaacttctacggcggcggacgcttccgcggccctggcttcgggctcggcggcatcctgatcatcatcctgatcgttctgctggtgacaggccgagtctga

SEQ ID NO: 8984 - DNA, 501 bp, Methylobacterium sp.
gtggcggtcgccctctttctggccggatggctcaccgtgccggaggtccgcgcccagacgcagcgccagatcggtcgctacaccgtgaccgagcgcatggtcggcgcatggctgctcaaatcgtcgagtggcccgctcggagcctattgcaccatcgagcggcgcgcgaacgggcagaccttcggctaccaagtcacgcgcgccggcgagcgttatgtcggcctctcctcctccgcttggcagcgggcgccgggatcgttcgaaacggtccggctcaccgtcggcggcgcgacactgtggtcgggccgcgccgcggcgccggtgccggtgccggacagtctggtgctgccgattaagccggagcaacgtgatccggcggagatcctgtcgcgggccgacagcgcgcgggcggagatctcagggcaggtgacgccgttcgacctgtcgggggccgccgaagcgctgcgggcccaacggacctgccttgccgaggcgcagtga

SEQ ID NO: 8985 - DNA, 105 bp, Methylobacterium sp.
gtgcaactcgacgccgacgacctcgcgcggctcgacgcggccacccgactcccgccggaatatcccggctggatgctggagcggcagggcgcctaccgcggctga

SEQ ID NO: 8986 - DNA, 2931 bp, Methylobacterium sp.
gtgaacgtcgcaccgacaacagggaccgatgccatcgtcaacggcggccaggattccgcgatcattttccgggatggcgccccctcaacgatcaatatcggcacagtcggcaacacgaccacaacctcggggccacttggaatagcaactggtaatgttcccaatcggattatcgatccgggcgagaacaccattcaggttcgcagcaactatacgatcaacatctgggccaatggacgggtcctccaactcggaagcagttcgcgagccgaggccatcaacccgctcggcaccaacaacacgatcaccaattacggcgtggtcgagagcacgaatggcggcggttccgccatctggttccaggacgacatcacgggcggcctcaacaccatcgacaaccacggcacgctcagcgtcggcgtcaacaccggccggagcgtgatcggctccagctcacaggaggcgggcgccggagatgtcctgttcatcaatcagaccggtgcgactgtcctcggtgacatcagcttcgcctccggcaacgacacgctgcagttcttcccgaactcgaccgtgaccggcaacatcaatggcggcggcggcaccaacgccctcgaactgaatggcatcgctggttcgttcgacacgctgcccggtgcgctgaccaacttcacgaccctgaccaagctgggggaaggccagtggaacatcaccggcacgctgatcggcttcacagcggtgacggtggaagacggcgtcctcggtctgacgggtgacaacaccggctatacgggcacagtgctggtcgaaccctccggcattctggaggcgcgggcgcagagcctaccgacctcgtcgccgaacctcaacaacgtcaccaacaacggcatcgtgcgcttcgcgcagccggacaacggcacctatgtcggacagatcaccggatcgggcgccatcgagaaaacgggtgccggcatcaccacgctcgacccggaggccgccatcggcaacacctacacgggtgggacgacgatcttggagggcgggctcggaatcgcgcgcgacgcggccctgggcgatgcggtcggccctctgacgatgaatggcggcttcctgcaactgaacgcggatctcgatctcgccccgacacgcgccgtcacgctcgggccgctgggcggcgcgatcgatacgcaagccttcacctcgaacctgtcgcagggcatgacgggccccggcgccttcacgaagctcgggacgggcaccctgcgtctggcgggcgagaacgcctatctcggcacgaccaccgtcgcggccggtacgcttcaggcgctcgcgacggatactttcagcccgaattcgtcccacgtcgtgaacgcgggcggcgtgctcgacctgaacggattcaatcagacgatccccggcctgaccaatgccggcctggtcagcacgaacggcccgacggccagtacgatcctgaccgtagccggcccctatatcgggcagggcggcacgctccagctcaacaccttcgtggccggcgacaattcgccttccgaccggctggtgatcaatggcgggaccgcgaccggctccactgcgctcagaatcgtcaacacgggcggcacgggcgccctgaccgtcagcaacggcattctcgtggtggaggccgtcaacagcggcacgacgagcaccggcgccttcgcgctgtcggcaccggtggtggcaggcccctacaactacatccttgcccggggcggcaacgccaccgaggtggccgacaactggtatctgcgcaacaccgctcagccgacgccgacacccactccgacaccaacgcccaccccgacgccgacacccactccgacgcccactccgacgccaacacccactccgacgcccactccgacaccgacgccgacacccactccgacgcccactccgacaccgacgccgacacccactccgacgccgacaccggatcccacaccgctctaccgcgccgaggtcgcgacctataaggcactgctcgggacggaattcatggtcggccgggccatgatcggcaccttccaccagcgccgcggcgaccagtatcttcagctcggccccggggctggcaccggcttctgggggcgcttcttcgggcagagcagcgaccggcgctggaaaggcgccgtcgcgccggagttcgacggcaacatcctcggcttccaggccggcctcgacctgttctcctacgaggcgttctccggtttcggaagcctcggcgtcttcgctgcctacgggaagggcgacggcgacgtacgcggcttcgccgatgccatccagcgcggccgcgtcggccgcctcaatctcgagaacatcggttacggcgcgacctggacccatgtcggcccgacgggatggtatctcgacagcctcgtgatgggccaacacctctctggcacggcgacgtcgctacgcagctacggcatcaaggccgatggcaccggctttgccctgtcggtcgagggcggctatccgcttcccctctatcccggagtcgtgatcgaaccgcaggcgcagttcatctggcagcggctggatttggatgcccggaccgacgccttctcccggctcgatttcggttcgccgggccttgccaccggccggctcggggttcgggtgcagggcgccttactctcgcaggagatcgagtggcggccctatctgctcgccaatctctggcacaacttccgcgaggtcagcacggtccgcttcgagaacatcccgatcgcgacacggctcggcggcacctcgatcgaggtcggcggcgggttggtcgcccgcttcaatgccaatgtcggcttcttcgttcaggccagctacgccgaaggcaccgctggatcctacgagaagaccgtgcagggcgtggtcgggctgcgggtgacgtggtga

SEQ ID NO: 8987 - DNA, 342 bp, Methylobacterium sp.
ttgggtctggccctgttcgccgtggccgggacggaaggggccttttgggccggggcgagccccgtcgtcgccatcgtcatgggagtggtcacggccaccttcgggggcgtgatccgcgatcttctgggaggtgagagcccggtcatcctcagccgcgagatctatgcctcggcagcgggagccggcgcggcggtcttcgcgggtctgacccttctcgatgccccgcgcgagttcgcgttgtgcaccggcttcgccgtcgccctgctggtgcgggccgcatcgctccacctcggtttgacgctcccgcgatatcgccctcgcgccggcctcccctatcattga

SEQ ID NO: 8988 - DNA, 153 bp, Methylobacterium sp.
atggctgccggtgagctggatcgcctgaatcttgaatgtcagcaagccatcgatcggcttggcccgaatgggccgtttcggctgaaaaccttgttgcagatggtcctcttggagttgaggcgggaacgagaagggcgtgagcagcgcgactaa

SEQ ID NO: 8989 - DNA, 192 bp, Methylobacterium sp.
atggatgatcccacccccatcgccgtcaccgtcgagacctgtcccgatagccaggaaccctaccgctggcacctgaccgacggcgacggcgtctccgtgcgcgtgtcaccggaatcctacgcttcaccggaggatgcgggttcggctggcgatgccgcacttcgggcgttcgggacggcacaattcgtttga

SEQ ID NO: 8990 - DNA, 222 bp, Methylobacterium sp.
ctgggctacttcgcgacctacttcaacggtccgttctcagcggatttcacctacaaagcagacctgctcagcctcagcgagcgcttcaacgactcgctggccttcacggctcagccgacggcatcgcctacgacggccccgttcttcggtggcggccgcgccagcctgaccacgcacagcctgatcggcaacgtgaactaccggattcccgtcggtcccaca

SEQ ID NO: 8991 - DNA, 129 bp, Methylobacterium sp.
ttggtggcgaatgccggtctcgatctgcaggtctcggccagcgcgacgctcggtctggcctataccggtcaggtcggcgcccgcgcccaggatcacgccgtcaagggaggcttcacctaccgttggtga

SEQ ID NO: 8992 - DNA, 93 bp, Methylobacterium sp.
atggtgcaaaacaccgaggaccgctcgcatcgacgcgagagtgccgcgtccggcttcgagattctggaccgtcgcgaggtcgaggcgggctga

SEQ ID NO: 8993 - DNA, 1197 bp, Methylobacterium sp.
ttgcgcacgcgcgggggcgccctcggcgcggaccgcatgaagaagctgacgttctcccacaaagtctggctcgcgcggcatgcgcggcgcgcgcacgttcggcggatcgtcgagaaggaccggcgtcacgaacggcgcacgggtcatcggaccaagcgggcggtcggctaccacgatggaacgaggcgcaaaatctgggtctcggccaagcccgacccggtgcctgccttgctgtgcttcgatcggaatttcgaggagacagcagccttcatcgagcatgcgacgacgaagctttgtcaggtctatgccgagaaccgaaatcggatccgatcgcggcgcacgccggtcggctggcacgattttgcttcgctcgaagagatcactccaggcgcggcgctcgtactcgcggccgaatatgaccgggttcgcatgctctacggagcagcccagatgtatgcgatcaacgtcgacgactggcaggcccagccgcgcgatctcctgcgaagcctcgggttcttcgatttgctcggcatcgaagcgcctcccgtgcggcctgacgagatgcgcacgatcgtccggtttaggtctgacaccaacgtcaacatggccgtcgcatcccgcacgctgattgaggtcatcgaactcgcggcttcagccgcaatcatcggggtaggccaggacccgttgaaggaattcaggaccttcctgcaagcgattggcgaggcactgaacaacacgagcgaccacgcctatccggacaacctatcgaccgaatttccgaacgtgggccgctggtggatcacgggggcggtcgatctcgatgcgcggcgtctgacgttcgccgtctatgaccagggggtaacgattccgcgtgcgatcccttacggacgtcggttcgaacgcgtgcgacggatcgtgcagacattgacgaggcgcggatacgatcccgatgacagatcgttggatgggcacgcgatcgctgcggcggttcgatccggcgtttccggtaccggcctggatcatcgcggacgtggcttgggcttgatgcgcgactacatcaggaatgagcgaagcggccgtttacgaattgtaagcaggaacggggaatttgtggcatgtacgggacggaaggacgagtaccggacgcggagcgtgcccctgcatggcaccttcgtggagtggatcgtcgacctgtaa

SEQ ID NO: 8994 - DNA, 321 bp, Methylobacterium sp.
gtgcccctgcccgaccatccaggcgttcaggtcctccgcatcggcacggcagacggcgacgactcggccgtatcggtcgatctcgcgcggatcacatgttacgaggcgtttgccgatgtgatcagccagagccagtgcggccgcctgtccgcagcgatagtccttgccggctgcgtccttgcagatctgcgcgctttccggcgcgtcgataccgtgcaggcgaacgcgcgctccacgaacgtcgagcgtatcgccatcgataacggaggctcggccaacgaacggttcagcctgggctggcgcggcgagaagcaggactag

SEQ ID NO: 8995 - DNA, 186 bp, Methylobacterium sp.
atgctttgcgtgactattttcgtgatattggtcgtatggttcttgctgccgagggtcgcaaggctaatgattcacacgccgactgctatcagtatttttgtgtgcctgagtatggtacagctaatggccgtcttcatttccatgcggtgcactttatgcggacacttcctacaggtagcgttgacc

SEQ ID NO: 8996 - DNA, 435 bp, Methylobacterium sp.
atggccgaacgtctcgaagtgaccgtaccccgctctgcttccaagctcgtagaactcggcgccagccgcgccacgagcgtcgcgctggactactcccaggccagcctgacgaccctggaagagatggcagaggaggccgctcgctgggccgcgacgctcacgcccgggcagatcggcgcgctcgtgcagcaggccggctgttacctgctggaggtcgcgcagagggagttcggcggtgagtaccgctggcacgaggagcgggaccagcccgtcctcgtcgtgggcgagccagactttcacgtcgccctgatgacctgggataaggtgaggagccgcttggccggggaccgcgccgacgacctccgcttcttctacgacggtttcgcggagcgggtccgtcaagctggcccggggacgcgtgcgctctacgtctga

SEQ ID NO: 8997 - DNA, 102 bp, Methylobacterium sp.
ggcgcctgtctcggagagagcaccggaggccagtccagctaccgcgccgtgcacgctatggatgagcttcggaagttcagcgaccggaactgggttgtttga

SEQ ID NO: 8998 - DNA, 597 bp, Methylobacterium sp.
atgatcgcactcgtcgaatcaggccagaaatcacaaccggtgaccgcttcctccctcgcaggccggacgatccgcggtgcgcttctcggcctcttcggcctcctgtgcttggtcggtctcggcatcggtgcaatcttgatctactgggcaagcagcctcggcagtcagtctattagacccgacctagccttccatgtggcctgcgatgacccggactctacaaacatcgacaagcaggccgaagcatttctgcgtcaacgcggattcgtagttctcgataaggtcgaggcagcccgaaaactgggccagccaactctcctattgcgcgacattctcgctgtcgatgcgcagagccgcgaagtgacgctgatacagatcccgtttgacaatcgcttgatgtctatggggctacgaacccctccgccgacccggcacgacgtggagttggaagaggcgctgctctcattcgcagagtccgtacccggctgccacgcgcatcaggtgacacgcaacgataacggaccggaactgcgttccttccacgatgcgttgatcaagatggatgcgcgcctcttacggaaattcggggggcaataa

SEQ ID NO: 8999 - DNA, 690 bp, Methylobacterium sp.
gtgaacgagggccggcaggctcggacggccgacatccaggcggcgcagcgcgggaccgcggcggagacggggcgtgcttggccgcacgagggcgtgggactcgccgcaccggcttcgcccggattcgcgtcagcggccgagacgggcggccttgcttcgctcgcgatgcaaccggttggcggcgggccgaggcgaggcgaggcgccggtgccgaacgcggcgcctgcccaggccgtctccgccgctccactccaggccggtgtcacggcggcgcctcaggccggaacggcggctccgctcgtctccgcggcacctgtcgcccggaccaccgagaatccgccggctcccgccgcagccggagcgggactcgacgcgagcggggcgagcggtgtcggagccgggctgtcgctgggcccggggagcgggatcgcgctggccggcggcgggggtgtcggcggcgttccgctgccgctgttcaatcccttcctggcccggcggtcgcagcgcgatgtccgtcggcaggccggtctgcccgagcgtaccagcgggctgtgggcgattctgagggtgcttggttggcgtcgcaggcgccgcggacaggatggggtcgagccggggccggcggaggacgaggcggccgcggccctgcgcgctcggcgcgccgctctcgggcggcgggcgggggcatga

SEQ ID NO: 9000 - DNA, 123 bp, Methylobacterium sp.
atgtctcgcaaccccgctcgtcgcttgctcatccattttgagcgccgcgccgaaaactacgaggccttcagcttccctcgcctcagcctcattaccctgcaccagatcgaaaggttctgttag

SEQ ID NO: 9001 - DNA, 138 bp, Methylobacterium sp.
atgaccgacaccacggacacggtaggcgtcgcaggtgagcggatccgctccatcatcgaacgcgtcgagcggatcgaggaagagatcaaggatctgatggaaaccaaaaaggagatcttcgccgaggcaacgggctaa

SEQ ID NO: 9002 - DNA, 171 bp, Methylobacterium sp.
gtgaaggtgctcaaggagatcctgaagctccgcaagcaggataaggacgagcgcgacgagcaggagagccttctggaggtctacctgtgcgccatggatgctcctgcgcccgtcgcccaggccgccaaacgcttgcatgtgggtggcagcactttcgctgctacctgctga

SEQ ID NO: 9003 - DNA, 102 bp, Methylobacterium sp.
atggcgtcccgccgggttgacccgaaggacaggggcgccacggtgatcctgcgggcggccgcgatccggctcgggccgttcgcccggctctcgtcgcggtga

SEQ ID NO: 9004 - DNA, 651 bp, Methylobacterium sp.
atggaagagcatcgtctgcccgtccttaagacgttgaagtttgccctgaaggatgtggcaggcatcatcatgaagatgcccgtcctgtgcatgacggtgatgttggtatttctgattataaaaatttacaagccatctcgcgatatattcagaacagaaggtttcacaatatggaacatttcggaggtctatttctattttgccttgatagttgctgtcagagcaattttcgcgttgccggcttatcgattcttgatcgacggcgaagataggatgcagaggaattttcgagaaagcatcgaagcagccctcgcctattgcgctgcgtatgtaatttttaagatcttgcctctttttgctttgggtattctggtttccccaatgttgataacaaacagtttggctttcctttttttctacgtggttgttatgattattgttgtgcctttttgtgtattttggtacataagatggagcctgatcttgccggcaatcgcagtcgattggcaggtagtgagtctgagttggacgaattggctcactaaaggggccgcgtggcgcatttatctatcaaacttattgctcttcgccatcttttccgtctgtttcaaagtgcctgcgttgatggcctggggtttcgggtttgagtag

SEQ ID NO: 9005 - DNA, 159 bp, Methylobacterium sp.
atgtcccccgagatcacgctcccgattgccatccgcctgaacgcgcgcgggcggcccgtctccgctgagacggatcgcaccgtgcctgggatgccgcgtcgggggcgcccgccgctcctgtccggccttggcctcaacatcccgggcgtgaaccggtga

SEQ ID NO: 9006 - DNA, 99 bp, Methylobacterium sp.
atgcctgccggcttcatcagggatcccgcggacctgacggaaaaaatgccggtgccggacgattgccgcatgcttcccacgaccgagatctccccgtag

SEQ ID NO: 9007 - DNA, 279 bp, Methylobacterium sp.
gtggagggtgtctccgcgcaggcgctcgatttcgtccttaaggtgcagtttcttacgcttgagttcggcgatgcggagatcgtcactggcgagggattgcatcgcgtggtgaagctcgcgctccagggcttcgtgcttggcggcgagctggctcaaatgcgtctgcaaggacatgaggtgtcgctcctgtcactgtttcggacgggggtagactggcacaggatggcgggcgtgtcgaagccattcggcggcaaaatggatgagtccgtaacaaggtga

SEQ ID NO: 9008 - DNA, 372 bp, Methylobacterium sp.
atgcttatgacgatgcccgtggccatgctcgtgatcatggctgtgatcgtgcccgcagctgccgtggtcgtggctatgaccgtggtcatggtcggacccatgcttgtgcccctgctcctgtccatgatcgtgatgcgcgtgggcttcgtggtcgtggtgatggtggccatggtggtcatggtcatggtggtcgtgaccgcactggctgtggtcgtgggctgccttttccggcttgaagggccggttcaccgggctggccgtgcagcccgcgccgcggaccagttcggcggccctggccgggacgtagagaacatccgcaccgacctcggcgggaacgtgctcgcccccgagttgccaggcaaggcgcagtag

SEQ ID NO: 9009 - DNA, 108 bp, Methylobacterium sp.
ttggccatcgtccagagggcgtgcggcaacgtctcgatgaggaaggcgaagctgcctgccttcaactcggcacccttcgtcctgtcgatcttcgcgccttgctggtga

SEQ ID NO: 9010 - DNA, 180 bp, Methylobacterium sp.
atgctctacgaaatcgtcgtcgcggatgggctgaacatcgagcccctcgatcacggcgagtatgtcacccggatcggatcggcgaagatcgtcgtccgtatccgagacaacagggtgaccgccctggagagcgaccagaaattcttcgcggcggacgaggcggcacggacacggctgtga

SEQ ID NO: 9011 - DNA, 255 bp, Methylobacterium sp.
atgtttttcgagagggacgtttcactctgcgccctggtctcgacgcacttcggctgcggacggatcggggagtccggaggcccaaactctcgcaatgatggccccctgacgaggcatcctcgactgttcttcccgaggttcttacttccgctcgatccagctaagttctacggatgtacggatgacgccatctcggccggcttcgtctacgtgtcgtttgaaatcgacgtcgtcgcctgcaggatgatcggctga

SEQ ID NO: 9012 - DNA, 234 bp, Methylobacterium sp.
atgctcgagcgcttccatcaggctggccacgggcctgctgctcagtcctgggtgaaccacgggcctaaccaagagatcgcgccgcatcacctggagcaggccatcgggtcggacgtgctggcggccctgaccctgcgcaccgggctgtcccgggacgagctgttgtccaggctttccaggaacctgccccacgcggtcgatcagtacacgccggagggacgcatcccggcctag

SEQ ID NO: 9013 - DNA, 252 bp, Methylobacterium sp.
gtgcagcttgcggtgtcgctgccactgatcctcgatctgatcccgctggcctcggtccggccggtggcgacgggcaacggctctgcccctgtggttgcccgcgcgccagcggagcgccggccgtttccgctgagggccggcgtgctgatcctcggcggcgcagtgaccactgtcggctatgtcgtcgaggcattcaccagcggaaatcgttcgccggagatgagaagcgggcgcagggggcttgatccatga

SEQ ID NO: 9014 - DNA, 429 bp, Methylobacterium sp.
atgcggacgctcatcgcggttgtactggctttcgcggccttgccgctcgtgcccgttccggccgatgcggtcggcaccatggccgaatggaacgatgtcgcgtcccggctcgtcaggtgcaacatccagtatccgcgcgatccgcgcgcgcgcgacatacccgcaggcggcgtcgtggtcgtcgtgaagttcgatgtcggtgccgacggttatgtcgggccgatctcagccgttcggagctcgggaatagctgtcttcgacgaggcggcgctcgtggcggtcaagttgtcgagccccctgccgccccctccggtaccggacaatcgcacggtgtccgtgcaggtgcccatccgcttcatgcctccgccggttccattcctcgcatcgccgatccctcgatcgccgtgccggctccgctttcgccgctag

SEQ ID NO: 9015 - DNA, 555 bp, Methylobacterium sp.
atggcgggcgcgctgatgatgatcccggcaaccgccgacgcccgtccgggcttcggcggcttccacgggggtggcttcggtggcggtttccgaggcggcggcttcggcggtggtttccgaggcggtggtttcgggggtggcttccgcggcggtgggttcggcggtccgcgcttcggcgggggctttggcggattccggggcggcggcttcggcggtccgcggttcggcggcgggtttgccggccggggcgggttctatcgcggggccggcttcggcggctggcgcggcggttacggcggctggcgcggtggcggctggggttaccggcgcggcatcggctggggtggtgtcggggtcgggctgggactcggcctcgcggcgggcaccctctacggcgcctacggttatccctacggctacggcggatggggtggtccctacggctacacgaccgtcggctacgatccctactacagcgcgggctgctacaccgttccgcggctgacctggacaccctacggctaccgccgcgtcctggtcgagcgctgctactga

SEQ ID NO: 9016 - DNA, 492 bp, Methylobacterium sp.
atgaagtgcttcgcccccgccgccacagctctttccgccctcgtcctcgctcccgcaacggccgaggcccgcgatttcggcggtcatggcggctatgtcggcggcggccgttcccatggcggctacggccatcacggctacggcgcacgcttcggtcatgccggccgagtcggcggctatcgcggcgggttcgccggataccgtcacggtttcgcgcatcgcggcttcggcgatcggggcggttacggataccgtggctacgccgcgcgcggcttctacggccgcggatacggctacggccgaggtgtcggggtcggcctcgcgggggccgggctcggtctgggcctgggtctcgccgggggcgcgctaacgggcagctacggcggctacgcggcgccggcctacggctacagctatggctacgcgcccgtcaccaccggctacgctccgctctacaacacaggctacggcttgaactgcgtctgcgactga

SEQ ID NO: 9017 - DNA, 216 bp, Methylobacterium sp.
atgcggcgaggacagaagacgagcgcggagcaggtggtgctcaagctgcgccagatcgaggtgcagaccacccagggcaggagcttggcgttggcgtgcaaggaggcggagatttccgagcagttgcgcgacgagtgcctgcgccaagagatcttttactcgctcaagtggacagaaaagcagggacatcgcgccgcatccgtgacatcgaggtag

SEQ ID NO: 9018 - DNA, 102 bp, Methylobacterium sp.
atggtgcggatgctggggatctcgggcaggaggtcgcggggggatgacggagaggatgccgggccgcacgttgcggcacaagcgatcgtcgacatgtgttaa

SEQ ID NO: 9019 - DNA, 1302 bp, Methylobacterium sp.
gtgctgggcctcgcgctgttcgcggtcgccgccccggcgttgcccgacgcccaggagggcgtgccggtcgaagtgctgaccgagcagcaattctcggagatgacccgcggcgagcgcaatgcggagaagccggagaagaatccgaaccgggccgaccgtgtctccgaaaagatggaggagcgcgagcccgagaacgcgaaaacggatgcgccggccgcgcccacccgcaccgccgagaccaagctcgcggccgtcgatgcgatgccgctgcgcgccgacaccgccgacccggtgaaggaagaggccgaagccgccgccgccaaggcggaagctgcgaaagccgaggcggagaaggccgctgcggcgaaagcggccgaggcaaaggccaaggccgaagccaaggcgaaagcggattccgcggccaaggccgaggcagcgaaggcagctgaagccagggccgccgccgcgaaggcggaggccgagaagcgcgaggaactgcagaagctggtcgagcgtgagcaggcggaggccgaggccgccgccaaggctgcggagaaggccgccgaggcgaaggccaaggcgcgcgcggaggctaaggcgaaagcggacgccaaggccaaggcggaggccaaagcggaggcagaggcgcaggccaaggcggaagccgaagcgaaggctgaagcggcggcgaaagccgcggcggaggccgagcatcgcaagcaggtcgccgaggccaaggccaaggcggaagccgaggcgaaggctaaggccgaggccgccgcgaaagccaaggcgaaggcgatggctgaggccaaagcgaaggcggatgccgaggccaaggcgcgccagcaggccgaactcgcaaacaggaccagccccggcgacagccgcgagacccatacccgcacggcctcgcaatcgaccggctccaccggccgcgaagtgcagcgtacggcctcgctcggcacgtcgaccggcaccgcgcagaagctttcgccctcgttgcgcgacgccctggtcggcatgctgcagcagcagatcgagcggtgctactcggcgccgccgggcgcgacgcagggcgtggtgctgccgatgctcgacatccgcctcaacccggacggttcgctcacggccgagccgcgggtgatgcgcgccggaaacaactcggtcgatcagtcgatcgcccaggcggccctccgggcggtgcggcgttgcgccccctacaagatcccgacccagtacgcgccgtattacaacgactggaaggccatcaacgccgagttcgagttctcgcccgtgtga

SEQ ID NO: 9020 - DNA, 225 bp, Methylobacterium sp.
gtgaggggccacgccgaaggcatcgagaatccgatcgagtgcctgctctacggcttccgtgccttcctcgtgcgtcttcagccgcgtctcgagtcggcggatctgcggctcgaatttttctggcacggcagacggctcgtcgccgagaaagcggggttcgggagccgtctcggtcagcacgccgcgcagctcgtggccgaggtgatcgcgaacggattccggtag

SEQ ID NO: 9021 - DNA, 645 bp, Methylobacterium sp.
atgacctcaactgacgccctgatccacggcctgtcggccgatcttgttcccgtgcggcggcgcagcgtgcgccgcgagattgctgcgctcgtcggcctcgccgccgctgagctggccctcatcctgatggctggcgccatgcgtccggacatgggcagtgtgatcctgtctcccttcatggcctggaagatcggcggcctcgcccttctcgccggcgtgagcggcgcggtcgcgatccggtcgttcgcaccgccggcggcctcacgccgcgacctcatgttcgccttcgctttggccgtcctcatgatggccgcaggcgtcttcgtgacgagtgccgccgagagcggcgaaccgctgcttgagcgcttgtctccggcacgcggcctacgctgcgcgatcgcgatcatcgttctgtcgctgccgttgatgagcctgctcgcactgctgatgcgccgcgcggcaccggtccatcccaagcgcagcgcgctggcgacgggccttgccgcagcgacgtgcggcgctctggtcttcaccgtctgctgcccggcgaacgacccgctctacatcgtggtctggtactcggcggggatcgccgccgtcgccgccacggcgcgatggctcctgccgcgccgcttccggctctag

SEQ ID NO: 9022 - DNA, 117 bp, Methylobacterium sp.
atgttccggtctgcggggcggtaccggcaccttgagcacggcagccgatttctcgacttgatccctgctgccgccatcctcctcagcctgagcatcaggttggaacaccagatttga

SEQ ID NO: 9023 - DNA, 120 bp, Methylobacterium sp.
atgccgacgggcgagtttgacaaccgcagccgcttggccaatcctcaggctgtcatgccgttcgacgcgaccctcaaccgcgacctgctccgggcaggcaacttgatcgcgggcaagtag

SEQ ID NO: 9024 - DNA, 354 bp, Methylobacterium sp.
gtgcccgcccaggtcgtcggcgggcttttgggggggcgctccgacttcgacctcgacgtggcgggggtggacctcgacggttcggggatcttcggcgagtgcaagtggacggcgcaacccatcggcatgggaatcctcggcaagctgcggcgtcgcgtcgaggaggttcgatacggtggcgacggccccgggcgtcatctcctcctgttcgggagatcgggcatggacacggaggtcgccgcggaggcggccagcgacccccgtctccacgtcgtgagcctgggcgacctgctgcgccctcgcacgcatgaattgaccgatgacgaggacgctacggcggcgccgaggatctga

SEQ ID NO: 9025 - DNA, 114 bp, Methylobacterium sp.
atgcgtacctggtgcgcggccatcgcggtgaccgccctgtacgcgctcgcgctccaggcggtactcggaggcacgagcctcgcgctgtttcccgacccggctcatgttctctga

SEQ ID NO: 9026 - DNA, 327 bp, Methylobacterium sp.
atgcacgtcatcagggacgacgaccacctgatctcaggccctctggcggtgccgaccttcctcgtgctcgtgacgcacgtcgtccggccggcggtgcccaaggaagatgtgcttcagaagctcttcgccatgacgggtgccgaggcgcgggtcgcccgcagcattgcagccggtgagaagctcgaagagattgccgtcaagaccggcgttaccgtcggtaccgttcggtttcatcttaaaggcgtgttcgcaaagaccggactggaccggcaggccgatctcgtcggtttgctcagtggactgtcggtgtcgcgcggccagaaatag

SEQ ID NO: 9027 - DNA, 1884 bp, Methylobacterium sp.
atgctcgccctcctgtcatccttctcggcacccgctctgtccggcgaaccgcacgcacagccctcggcaccgtccggcctccaagccgacgtcgaggccctgctgaagccggtgcaagcctacgctcaggccaccctcgacggcctcgcaggcctcgcgggcacgaccctggccgacgtccactccgccttcgccgcagacccgctcctcgggacgaagctggcggccgtggcaggcctcgttctcctcggggcgggctgctgggcctttgcccgccacgcctccggctcctcgtcgcgcaagacccggattggcggctttgccgtgtttctcctggctctcgtcaccggtatggccgttgccgccgggctgttcggcgcgggagcgaatccgtcttcgccggtccttcgcgatgcggcgcagctcccatcggccgcaggcttgcgtgaggcgtggatcgatccgcccctcgcgcttctacgcgagaccggcctcgatcccgcgatcggcctcgtgctgctgctgggcgcctgcgccctcgccctcctcctgagggccaaggccggcaaaggcgacggcgctcaggacgatgcggaggccctgtcccagtacgtgcaggcaccccggcggctcggctgggccacgatcctgctcgtgttcggctgcggcacgacgctcgcggccgccatccccctggcgggggcggccgtcgctcccggcttcgtcagcccggatgggcaccgcaagacggtgcagcacttcgagggcggcatcgtccggcgcatccatgtgcgcgagggggatctggtgcgcgcgggcgaccggctcgtcaccatcgaggacacgctcgcgcgggccaatatggccgaactgagcgagcgcctcgtgcacttcctggccatagaggcgcgcctgctggcggagcaggccggcgcatccgccattgccccccaggacgcgccgatgatccatcaggccgccctggcgaacgccctgcgcggtcaggagaccctcttcatcagccgtcgcgagacccgggccgggcgcgagcgcatcctgggacagcgcatcctgcagctgcacgaggagagcgaggggctgcgccaagtcatcgcctcccagaacgagcaggaggcgctgatcaagaaggagatcgcgacggtggagaccctactgcgccagggcctcgagcgcctcccccggctcctgtcgctgcaacgggtgcaggccgagctcggcggcgcgcgcgccagcaacttcgcccgcatcgccaagaacaagcaggcagtcggcgaggccgagatggaactcctcaccatgcgccagcaggaccgcgagaaggtcaacgaggagctcaacacggtccgcgctgaactcgcctcgctgcgcagcaagctgccggcgcgcacggacgtcctcgaccgcaccctcgtgaccgcgccgatcgacggcgtcgtcatgaacgtgcgggtgacgacggaatccggcgtcgtgcggccgggcgaggcgctcctggaaatcgtcccccagaaggcgagcctcatcgtcgatgcgcgggtgaggccgatcgacgtcgatgtcgtccggcccggcatgggggccaaggtcgtcttctcggccttcgcgcagcgcaacctgccgcagatcgacggccgcctgcgctcgatctcggccgaccgcatgaccgatgaacggaccggcgagagctacttcatcgccaaggtcgaggtcgacgcggccaagatccgcgaactcaattcgagcctcgaactcgtggccggcatgccggccgaggtgttcatcctgaccggggaacggacggccctcgactacctcgtgcggcccttcctcgaatccatcaacaagagcttccgcgagacctga

SEQ ID NO: 9028 - DNA, 17448 bp, Methylobacterium sp.
atggcgcgcaacaagtttggcaagggcacgtcgggcagcaagtccggcagcaagacggaagcggtcctggcgctggcctccggagcgatggtgctcgctctcgacgagggcaagaacgccatcgggcagacgtccgccgccgtgcccccggccgcgccgccgaaggccccccctacccagggaagcccggtctccctcgaggtcgaggatctcccctcggcaccgctggcctcctcgaccaccccgccgagccggagcacccattccgcgcgggaactcgcgagcgaggacacggggccggtcatgacggcctcggtggaagcccccgcgctcaaggtcggctccagcaccctggtcgagagttcgggccgcgtgccggcgcccgcccccgcgatggccgaggacagcttcgaggccgcgccgggaggcttcatccctggcccgatcagttcggggagaggcggcagcggcagcacggcgcggacagcgaacagcaataccctcctgtccgagcaggacgcgctggccgcgccccaggccgacgcggtgccaccggtgatccagaccctgcgccttcaggcggaggcgacgacgggtgtgacgcgcgggagtgtcagcggcggcacgacgacgaccacgcccgtcgtggtgacggcgacgagcgcgagcgccaccgacaagccgaacgccgaggcggccgacgggggcgcctacgtcgatttcggagggttgaacggcaacttcaacgccggatcgggtgagtctctgcagtggacgttcgcggtgcctgcagggggtatctacgacctcgccttcggctacgcgttctcctccacgggcgcgtcgaaccggccgatgcgcctcgaagtgaacggcaagatctgggaccgtctgttcgacttccagaacacgggcaacaacgcgacctacagcgaggcggtcacccgcgtctatctcgatgccggtacgcagacggtccgcctgacggcgaccggcttcagcggtccgaacctcgactatctcgaaatccgcagcgccgacccgcaccggatcgtcatccaggccgaggatctgctgtcctccgcgacgaccgacatgacatcgttggcggtcaaccggccgatcacgctgccgttcctgaacggcaagacgcagccggaaaccttccgcgtcggcgcggagggcgatgcctatctcgactggggctcggccgccaacaccctcgacattcccgtcaccgcgaccgtggccggcacctacagcatcaccatcacctacgccaacggcggcaccacgggccggccgctcgcgctctcttatcaggacggaactgcgatcggcacgtttgccctcgcgcccacgaccgctccggcggcttacccggccttctatgaggatctcgctggggcggtacgacccgctgacggtaacgatacgggcaatgtgcccgaccagaccgggtgggaaggttggacgaagtccaccctcaccgtgaatgtgacgctgaacgccggcacgacggtgcttcgcctctccggcgcgaatggccccaacatcgacaagttcgagttcgtgctggtcgaggcgttcaagcccgagccggtcgccccgtccgacatcacgctcgccaatctctcggtggccgagaacctgaccggcgccgtgatcggccgtgtcaccgtcaccgacgccgattccgccgcgcacacgatccaggtcttcgagggtgcgaccctcagcgcccgcttcgaggtcgtgaacggtgatctcaagctccgggccggtcagagcctcgatttcgagaccggcgccagcctcccgatccgtctcgtcgccacggatgcaggcggtctgtccgccacacgatccttcacgatcgccatcaccaacgacacgacggacgatcccctcccgccccagccgaacgtcacgccgacggccaggaacggcagcacacggaccaacgaagataccgccgtcaccttcgatgtcgcgccgctgatcgccgatgccgatgccgacgcgggcgatgtccttaccgtcacggccacggtccccgccgctcagggcaccgtctcggtcaacggcacgctcatcaccttcaccccggccgcgaacttctccggccaagctgacatcacctacgtcatcaccgacagcggctcgcccgtccgctcggccaccgcctcgctgaccgtcgccgtcacgccggtggacgatgctgcgaccgcgctgagcgtgaccgccgtgccggtcgccgagaatgtggccggtgcggtcgtggcgacgatcgcgatcaccgacgtcgacacgctctacgggccggatgacgtcaagctctcgggcgcggatgcggccaagttccgcgtcatcgacagcgggggcgcattgcacctcgccctgcgcgagggcgtgtcgttggacttcgagagcgcgcgccccgaggtctcggtgacggtcggcaacctgagccaatccgtgacgctctccgtcaccgacgacccagcggacaacgttcctggaacccagccgaacactgcgccgacggccctgaacggcaccgctcagaccagcgaggacaccgccgtcaccatcgacgtcaaggacctgatcgcggacgtcgacacgggcggcaccctctccgtcaccgccacggtcccggccgcgcagggcaccgtctcggtcgacggcacccgcgtcaccttcaccccggccgcgaacttctccggccaagccaacatcgcctacatcgtcaccgacaacggctcgccccccctctcggcctctgcctccgtcacggtcgaaatcgcgccggtggacgatgccgcgaccgcgctgagcgtgaccgccgtgccggtcgccgagaacctgcccggcgcgatcgtggccacgatcgcgatcacggatatcgacagcagctacggccccggggacgtcgtgctctccggcgcggatgccggccggttcgaggtcgtcggcaccgcgggcgcgctgcaactcgcgctgcgccagggccaaaccctgaacttcgaggacgcccggcctgaggtctcggtgagggtcggtgacctgacccaatccgtgacgctcaccgtcacaaacgtgaacgaggcgccgactctgacgggcaccctggcgccggccagcgtgccggcgagcggcgggtcggtgtcgctggcgggcctcgtggcggccgatccggacggcaccacgcccgcgctcgggctgcgtctggccggcggaggggatctgccctccggcatcagcctcaccggcggggcggtgaccgtcgcggccggcgtcgcgcccggcgcctacgcggtcgaggtctacgcgaccgacggccaactgacctccaccgctgtccccttcaccctcacgatccaggctcctcccatgcccgagcccttcaaccagatcctgatccaagccgaggccgggcgtctgacgatcgtggacaccgacacgaacacgaacgacaccttcgtccgcaatccctggaacaaggagacgtcgggcgcggccggcctcgtcgacggattgcggccgggcttcaccggcagcggctatctcgacttcggcgacacgcccggcgacaccgcgagctacagcttcacagtcgcggaagccggcagctacgatatccacgtccgctatgcctccgccggcaatcgcccgctagccttccggctcgacggcgcggcgttgcccaacctggccaacctgcccttcctctcgacggatccggatggaaccggcgcagcggacggcttcaacaactggtccgtgcagaaggtgacggtgacgctcaccgccggcacgcacacgattgccttcgcgatcccggggggcgcgacttcgggccccaacctcgacgcgatcgcggtcacgcgccagggcgcgaccgcgaccttcaatgccccgaacgcgcttcccgtcgtgacggaggccggcttcacggtcgccgagggaacggtgacggtcggaacggtgacggcgagcgacctcgacggcgaccgggtcgacttcgcgctgaccgcgaacgcggcgaccgacaacgccctgttcgccatcgacgcccggacgggggcgctgagcttcaagaccgcacccgacttcgagggtgcgcgcggcgccggtccttacacggtggaggtcgaagcgttcgacggcaccgggcgggccgtgaagacgctcgcggtcgcggttaccaacgtcaacgaggcgccggtgatcactacgaccgcgctctcggccgcggagaaccagacggcggtcggcctcgtggcggcgaccgacgtggacggcaacgcgctgacctacgcgctcaccgcgaacgcagcgaccgacaacgggctgttctccatcgacgcccagtcgggcgcgctgcgcttcacgaccgcgcccgactacgaggcgctgccggcgggcaagaccttcagcgtcgaggtcgcggtgagcgacggcagcctgacgacctccaagaccatcaccatctccgtcaccgacgtcgccgagggcgggccggtgccggtcgtcttcggggcgatcacgccctactcgtcccaggatcggccgcaggacggcggtacggtcaccgccacccccgattcactgacgctcgacggcaatttctggaagcgcgtgagcatcggcagctacacggtcacagaggcgaccaagctcgagttcgacctgcgcgtgggcacgggcggcgaactccccgagatcgtggcgatcggcttcgacgtcgatgaagatcccttcgacgcggatgccagcatctaccagctcggcggaagccagacccagggcgggttcatcgatctgcgcggctcgggcaccccgaacggggacggaacggtccgcttcgtcatcgatctcggcgcccatgccggcaagaccctgacgtcgctggtggtcgtcaacgacgacgacagccgtccgaatctgggctcctcgacctacaccaatgtgcggttcgtcgaggcggccgacgccaatgccgcgccggtcgtggtcggcggcggcatcgccgaccgcacgatcccggagaccggctcgctcgagatcgacttgccgttcctcgatccggacggcgacgcgctgagctacacgctcgaggtgaagaatgcggccggtgcggtcgtcccgaacggcggcctgacgatcaccgacggcgttctctccggcagtctcgcggccctcggcgacggcgtcttcacggtgacggtgcgggcaagcgacgggacggcttttgccgaggacggcttctcgctgacggtcacgcacgtcaacaaggctccggtggccgaggatgtggcgctggagccgtatttcggacgcgtcggcacggccttcgccggcttcgacatcaacgggctgtcgtcgttcttcagcgatcccgagagcgaggcgctgaccttcacgatcgaggacctgccgccgggcctgagcgtgaacgcggagggctatgtcagcggcaccccgatcgcgtcgggcaccttcacggtgagggtccgggcgagcgatccggccggcctgtccgacacgctcaccctgaccttcgtcgtcgaggcgtcggccgcgggcaacgtcgtctcggtcgaggccgaggccctcacggggctcgcgactgccgacggcttcttcgcctccggcgccaccggcgcgtccggcaaccggctgatcctgctcaatcagggcgatgctgggtcggtctcgaccaacctcgcggccaatggcctcgccgacggctattaccaagtcaccgcctacgtcttcgacgagacggacggcgccagcaccttctcgctgtcggtcgatggcacccaactccggatcggcggaacctcgagcgtcgtcctcaacgacgcgggtccgggcagcttcgtcaatccgctggcaccgcgcggcacggccgcgaacgcgggcaacctcaaggcgatcaccttcgacacgatcgtccgtgttgaggccgggagcgtcatgacgctcaatggccaggcgatcgggggcgagtccctgcgcttcgaccgcttcaccttcgagcgcgtcgaggcgccgaacgccgcgcccaccggcatcgccctcacaggcgcggtggccgagaatgccgcgggcgccctcgtcggcctgctctcggccacagatgcggagggcgatgccgtcagcttcacggtgtcggatccgcgcttcgtcgtggtccgcaacaccgagaccggccagaccgagctgcgtctggccgccggcgcggcgctcaaccacgagacggatcacgggaccaccatcagcgtcgtggcaaccgatgcccgcggcgcggcgacgaccgcgcaggtcacgctctcggtcacggatgtgaacgaggcgccgacgctgtccggcaccatcgcggcccaggtcttccagagcgacgccggcggcgagatcaacctcgcggtgctcacggccgccgaccccgatgcgggcgatgccgcgacgctgtccgtccgtctcgcgggcggcggcgccctgccgaccggaatcgtcctcgacggcagcgtcctgcgggtcgccccgaacgtggcgcccggcgcctacgcgatcgaggtcctcgccagcgacggcgagctcgcctcggcccccgtggccttcacggtcacggttcaagagcccggcacgccgcagccgttcgagcccatcgtgatccagggcgaggcggccaccgtcagcctgacgcagtcgcccgacgcgaattcgacgctgctgcgcacgaccacggccaatccggaagcccccggcgccaccaaggttctcgaccagttcgggctgcgggcgggctataccgggaccggctatctcgacttcggcaacgatgccggtgaccgggccagcttcctggtaaccgtggcacaggccggcacctacgagcttgccatccgctacgcctccggcgacgcccgagccctcgacctcgcggtcggcaccggacctgcgacccttgtcgaattcgcaaacaccggagcgccggcgagcggcacgacgcctgcggtcgacggcttcaacgtctgggccaccaagactgtgacggttaccctcgcggcgggggcgaacaccctctcgctcgcgatccccgccgggcgcgtcaacggccccaacatcgacagcctgacgatcagcaagccgcaggcaccggccgacgtctcggccgacgccgacgacatcccgctcttcctctccggcccggtcggcgagctgaccggggcggccaaggagtcgatcaacttcaagatcgcgggcgtcgacgcggatatcgtcaagaccgagatcagcttcgacaacggcgtgacccggacgctcgtccggccggacgcggacggcgacttcgtcgccgacggttccggcctggcggcgggctcctacacggcgcgggtctacgtcaccgacggcgccggcaacgtcgccttctcctcaatgtcgatcgtgatcgggggcaccgtgacggtggcgcccttcacgatccaggccgaggacgccacgcgggtcacggtgcaggataccggtgtgcccaccaacgctgacttcacccgtgtggtggacgcggcccatccggatgcgaccggcaattaccgggtcggcgcggtcggcggcgcctatttggatttcggcgccaatgcgggcgacgccatcacggtgaacgtcgatgcgcccgcggccgggacctacctcgtcaccttccgctacgccaacggcggcgcggccaaccggccgctcgacctacggctcaacggtggtacggcgctctcggtcgacttcgtgcccggtccagtcatcggcgccggcacgaccgcgtccggatgggagtcctgggttgagaagacggtcgaactgaccctgaaggcgggcgcgaacacgatcgcgctggcgatcccggccggagccctggccgggccgaacatcgatgagatccgcttcgtccatcagggaagcggaccgagccagccgcagccgttccagctcacgatcgaggccgagaccttcacaccgatcgacacgaccggaaccggcaacgcgatcacccaggcccgcacgctcgccaacaaggagccggcccttccgctcctgcgcgacaccaacggcgacggattatgggacggcttcaccggtaccggctacctcgatatgggggcgcagatcggtgacgcggcctcgttcaacctgacgaccccgcaggccggcacctacaccttcgcgttccgctactcgaacggcggcaacccgcagggcgaccgggcgatgacggttgcggtgaacggcgtcaccaagacgctctcgttccccggcaccgacgtgaacggctgggacaactggaagatcgccactgtcgaactcgatctcgcggccggcgccaacacggtcacgatcgccaacacggtcgctaacggccccaacatcgacagcgtcacgatcagccgcgacggtgccccggtcgatccgcgcggccgcgaactgttccaggaggtcgtcaagatcaacttcgagccggctccgggccagaccacgcagggcctgcccgccggctacgtcacgcccaccggctacctcgccgacacgggcgccgcctacggcgatcgcggcaacggcttcagctacggctgggtgacggaggcgagcgtcgccgacggcacggccaacggcaccattgcggccgcgcagcccgccaacgcccactggtacaagaacacggtcacgggcgcgtccagtctccagaagacctacgcgcatttcgagtttccgggtgccggtgcggccggcgcgcgggcctgggagatggcgctcgcaaacgggacctaccaagtcaagctctcgatcggcgacaccgcgggtgcgttcgacagcacctatgcgatcaatgttgagggcaagcgcttcatgccctcctgggtgccggtcaacccgatcgatgggtcgcagaacggcggcggcttccgctcgacgctggtcaccggcatcgtgcaggtgaccgacgggcggctgacggtcgactccatcggcggcaccaacaccgagatccagtatctcgagatcgaccgcctgcccgacctgacgccgaccgacgcacggacggcggacctcgactactcgaccttcgccgcgccgcgtgccgcctacctcaatgaccaggtctcgatcgcgctcggtgagaacgggcaactgccgaccggcatcaacccgctgtcgagcttcgtcgtcggcgtcaacgtgcaggcgccgaaccaccgcggcccgaacatcgcccatgtcgagggcgtcaagctggtcgagacgctgaccggccaggaggtcgcgatcaacgtgcagatctccggtggggcggactcgctgacgatccgtccgctgcaagcgctgaaggcgaataccagctacacgctcaaggtcgaagacgtgctcgacctcggcagcatcacggatgccgcggcggccatccgccagatgcaggacctgacgacgaccttcgtgacgggcgtggcgccgacggaggtggcacgcgaggtcgcgttcacgacctcgacgctcctcgacggcttcgccgacggggccggcggcttcaccacggtcgagttcggtcccgacggaaagctctacgtcgccaccatcatgggcgagatctaccgctggggcgtcaattcggacggctcgatcaacaaggcctccaaggaaacgctctccctcgactacctgcaatcgggcgaggatcggcgcggcatcatcgggttcaccttcgatccgaccgacccgaacacgatctggatcagcgacaactacccgatcccgcgggagaacaaggcgttcagcacgccggaattctccggccgggtgagcaaggtcacgctcgggcagaacggctccttcaccggcgccaccgccgagacctacatcaccgggctgccgcgctcgggcggtgaccacgtcaccaacagcctggagttccgcgccaaccccgatgcggggcaacccggcgagccggcctaccttctctacctgtcccagggctcgaactcggccgcgggcgcgcccgacggcgcctggggcaaccggcccgagcggctgctcaacgcggccgtcctcgagatcgatccgacccgcaacgcgccgaccggcggcttcgacgtgcgcaccgagccggtgacggctccgaccacgcagaacccgctaacaagcttcaacagcgacggcacctatccgggcttctacaacccgttcgcggcggatgccgtcctcaagatcttcgcaaccggcgtccgcaacgcctacgacctcgtctggcactccaacggccacctctacatgccgaccaacggcacggcgtcgggcggcaagactttcgacgatccgacgcaacccggcagtcaggtcatcgtcaactcgccgacccaggacgactacttcttcaccgtcgagcagggaaaatattacggccaccccaacatcctgcgcgacgagtacatcctcaacggcggcaacccgacgtccggggtcgacaagaacgaggtgaccgaccgtaaggacggcaacccgaacaccgacggctacgatcccggcgtcaggcccgacctgaactacgatctcgacggcgcctacagtctcggccgcaaccagtctcccaacggcgcgatcgagtacaagggcggcgccttcggcacgaacctcaagggcgcggtgctgttcgcgcagttctcgaccggcgacaacgtccgcgcgatccgtgtcgatgcgagcggcaagatcatcggcgacgacgtgctgcggcggcccgacgggtcggtgatcaacaactacatcgatccgctcgacatcatcgagaatccggtcaccggccagctctacctgatgacgctgaaccgcggcacgggggcgagccagctcatcctcctgaccccagcgcccggcggtgtgacgcaggatctcacggcggacgagggcggcaacctcgcgctcgtcgccgtcgatgtcagcaacccggccgcgtccatcttccagctcaacggtctcgacagcgacatcaccgcggtgcgcgtgtcgttcaacggcggttcgagtcagaccgtcacactcaacgcgcagaaccgcttcaccgccgatctcggaaccttgacgggcccggtgatcgccacggtcgaggtcacggacgacgcgctcaaccgcgcctccacgaccacgaccttcacccccggccagaatccgggctcgaccgacctcgtctccctggtgacgatccaggcggaggacaccacgccgggcgacggcaccgccgtcacggtggcgacgggcgcgaccgcgcagatccagatccgcagtgccgccaaccccgaacccaacgcgaccggcacgggctacgtgaatggccttcgtccaggcgcggtgggcctcgacggaaacaccagcaacaccgatggcgtgccgggtggttacgccgatttcggcgccagcaacgcggacttcgtcaccttcagcttctcggtgccgagcacgcaggccggggccggcgtcatcaaggtgcgctacgccaacggcgccaccgcggaccggccgctggaggccgtgctgaacggggtgagcctcggcaatgtcagcttcgtcccgcccgccggcgtgacgggtgacctagcctggacggtctggcagacggtcgacgtgcccgccaacttggtggctggcctgaacaccatcacgttcaagtcggtcgcggcgacgggtcccaacatcgatcagatcgaggtgctggtgcccgaggcacaagtgccgagcgatccctacaccttctacgaggcggagacggcgcagatcgtcggcgccaaggtcgtcacggagaaccgcaatcaggtcggcaccggattcgtcgatttcgacgggaccggcgaccagtcgatcacctggacggtgaacgcggcgagcgccggctcgttcgagatcggcttccgctacgcgctggccgcctcgaaggcggaccggccgctctccctcaccgtcaacggcgtcaatctcggccccgtcaacttcgagggcttcggaccggatgcggagaacacgtggcagttcgaaacggcggtcgtgaacctccggcagggcgccaacaccgtcacggtcacggccccgaacgccgtcggcccgaacatcgatcagcttcgcgtcgccaccggcaccgcggcgccgcccttcgagccggattacgtgtccgtcaccacggagtcccggatcgagctcgaacagaccgccgacagctcgacgcgcatcctcaacagccaagccgtggagttctacttcaaggtcgcgtccagcggcctctacgccctcgacctcgcggccaatgcgggtgcgaccaatggcgggacgctgcgtctcttcctcaacggcaccgccaccgaggaaatcgccttccccggaaccggagcggcgggcgagcgcaccgtctacgtcaacctcgaagccggcacctcctacgcgctgcgcgtgctctcgtcggcgccgggtgcgaacgcgctcgactatctcgacgtgcggcgggcacccggcaacccgaacgccgacatcgcggtccagagcctcgatccggcctatctcgataaccggctgcacttcagctacctggaggatccggactcggtcgcgcccgacgcggcggatcgcgacttcaaggattccggtacggtgcggatcaccaataccggcaccgagacgctgtccctcaccgactacgacctcaccggtccgttcgtcctcgcgaatccgacccagctcgacgggctgagcatcgcggcgggccaatcggccgatgtgacggtgctgttcaaccgggccgcctacacgccgccgaccagcaacatcgatgcgacctcgacggtcttcaccggcgcgctgaagctcatcaccaacgatgccgacacgccggtcaccacgatcgacctcgcgggcttctggcaggcgcgggacgagggcgggcaggagccgaacgtcaacgaaatctggaagatcttcggcttcggcaacgtcatcgaaggcctgacgctacgcggcggcggcgagaactcggtgctgagcaccaacgacgtcttcgccaagaccgacgataccgaggttctgtcgccctattggcgcatcgccgacggggtcacgcaggccaaggtcacgcagatcgccgccttccacggcaccggcggcgcgacgctgcacatccacaaccccggcaacaagggagcgaatgtccggttctgggatcacgagggaacggacaaccagcgcctgctgccgaatgccaacaacgacacggacttcgcgacccgcaccttcgaccgggtctccatcccggacaactgggccggcaacgacatcttcggcatctcggtcgccggattgtcgaccgatccgcggctcaatccgcgcggcaacgtcgaagtgcccggcgcacagcagggccacacggtgaagatgttccaggcgctcgacgcgcaggagaaggtgatcccgaacgtctatctcggggtcatggactacaccggaatcaactacgactataacgacaacctgttcgtcatcgagggtgtgacgccggtcggcttcggccagcacatggtggtgagcgggctcgacgacgcggcggccggggaccgcctcgtcttcaccaacatcgactcgccggccaacgcctcgcaggccttccgcaacgaggcgacgttcaccatccggaacgacggctccgcggcgctcaccatcgacagcgtgacgaccggcagcgcggcgttccagatcgtcggcacgccgcccgccacgatcgcggccggtgcgagcgcgaacgtcacggtccgcttcgtcggcacgcatgacggcacctccgccggtgcggatctcgccgagtcgaccctgacgatccggtcgaacgacttcgtccagggcgagaaggtgatcgcgctcgccggcctcgctcaggagttctcggagaacaactcggagccgacggtcgcgcagatcgtcaaggcgctgggctacagcacggacatggcccagggcgaactcgcgaatggcggccgggtcgagaccgtcggcaacgaggtgctgatgccctatctggagcggctcgacgcgacgaaggcggtcgaggtcatccaggtcgcggccttcctcaaccagggcaacgtggcgcggctcggcttccacggcctcgcctcgtcgcaggtcaccaacctgttcgccaacgacgatcagcagggccagaccgtgctgcccgaccagttggtgaccggcgcgggcgcgggcgcgagcgtggcgcgcgggaccatcaaccagagcacgccgttcggcctctacatctccgtcgatggccggccgacctactcgtcctggaccgatccggtcgccaaccgcatcgatccccagttcggtcagctcgtcggcgacgatcagggccacctgatccgcttcttcgaggcacgcgacgccaagggagccgtgatcgcggggacgtatatcggcatccaagactatccgggtgccggaaactacgactacaacgaccacatgttcgtcatcaagaacgtcaagccgcatgtcttgacgagcacgaacgatgcgaatggcgaccgtatcaacgacgccctgcagcgcgacacggatggtgacggtctcgtcaacttcttcgacacgacgaacaccgcccagacgccgttcggcggtaccgcaccgcagatcggggccgcccccgttgtgatcgacgccacgcgcttcgatctcggcggacagggtgtggcctacaacgacacgacggcgaacgacgagggtggcaccgcgggccgcaacgagggcgtcgacatcgtcggcaacaacgtggccgtgggctacatcgcggccggcgagtggatcgagtacacggtcaacgtagcacgggccggcgtccatacgctgaccttcgccgccgcctcgcccgatccgggacgcactatcaccgcctcgttcgagcagaacggctcgacctacgtgacggcggcctcggccaatgtggtagacaccaacaactacacctcgttcgccgccaccgcgcccgtccaggtcaacctggtggcgggtgtccagacggtccgcctcacgttcggcggcggcgccttcgatctcgacaccttcacgatcgatcgcgccaatgtggcgccgaccgtggcgcagacgctctcgggcgccagcgccacgcagggccagttcttcagctacaccattccggcgggcacgttcgtggacgtggatggcgatccgctcgcctacaccgtcaccggactgccggcgggcctgagcttcaatgcggcgacacgggtcatcagcggcacgccgctgtccgccggttcgctgaccctgcaggtcacggcctcggacggtgcggcgagcgtgtccacaccgctggcggtcgcggtggcggcgctgccgggcggccttcagcagcccttcggcgggacagcgccgaccttcacgaacggcgtgctaataatggacgcgtcgaacttcgacaccggcggccagggcatcgcctacagcgacaatgccggacgcgatggcggcaccaccttccgggccggcgaggcggtcgagttcgtcaacgtccagaacgacatcggctacatccggccgggcgagtgggtggagtacaccgtcaacgcgccgaccggtggcacctacgatctgagcttcctggccaagaccccgctggccaacgccagcatcgcggtctcgctcaacggcacgacgctgctcggcacggcggcgcttcaggatggcggcaccagcttcgacgcggcaccgttccaggcctcggccccgatcggggtcaacctggcggcgggggtgcagaccctgcggctgaccttcaacggcacgccgcaggccggctcaccctatgtgctggatctgcgctccttcaccctcgacctgcgcgagacgccgctcactcaaacgcctttcggcggcacggcggcggggttcacgaacgggttgctgacggtcgacgcctccaactacgacaatgggggacagggcgtcgcctacaacgatgcggcgggcctccaggggggcacgaatggcggccgggccggcagcgcggtcgagcagaccggcgcgggcgacatcggctggatcgatccgggcgactggaccgagtacacgatcgcggttccgaccgccggaacctacgatcttgacctgcttctctcgaacggaggcgagaccggccgctcggcaacggtcgacttctacaagccgggcgccgcgacgccctacgcgacgagcgggacgatctcgaatcctagcacgggcagctacaacaccttcgtcgctcgggaggtcgacgacatcgcgctcgatgcggggacgcagatcgtccgggtgacgttcgcgggcggaagccaagacttccggtcgttcacgctgacggcgccgagcaacccgcagagccccttcggtgggacagccccggccttcgtgaacggcctgctgacggtggacgcgtcgagcttcgacaccggcggccagggcatcgcctacggcgacaatgccggacgcgatggcggcactaccttccgggccggcgaggcggtcgagttcgtcagcagccagaacgacatcggctatatccggccgggcgagtgggtggagtacaccgtcaacgcgccgaccggcggcacctacgatctgagcttcctggccaagaccccgctggcgaacgccagcatcgcggtgtcgctgaacggcggggcggcgctcggcacggcggcgcttcaggatggcggcaccagcttcgacgcggcaccgttccagtcctcggccccgatcggggtcaccctggcggagggcgtgcagaccctgcggctgaccttcaacggcacgcctcaggccggctcaccctacctcctggatctgcgctccttcaccctcgacctgcgcgagcccggcccgaatgctttgtctgcgctgacggccaattcggagaccggccccggcgagccggcatcggacagcaccgtcttcagcctgatgcagagcggcgcggtcgagaaattcgtctggtatcccgacagcgccgtctccgacgacgtctacgcgacgctgacctcagcgatgtccgagctgtatggccccgaagcggtctcgcaggcggctggtggcggtacggcggatccacacctgcctcttgcgggcgatccgggacttggagcgacgatgttcacggacgcgccaagcggcatcacagtccccaaggcgctgttcagcacgccgacgccaacgcatttcaacttcggggtgcgattcgccatgcctgcggcgcctgacccggtcagccatcatccgctgcccctggaacaggagacaagcgatcagcctttcgccccgctctcaccggtcctgggtgagttcgagactttgatgcatatcgcctga

SEQ ID NO: 9029 - DNA, 96 bp, Methylobacterium sp.
atggcggacaggagagatctgggccagcgggccggcgccgacctgaccgacgttgcggaaaccgacttcactttttggtcgcatgccagaagctga

SEQ ID NO: 9030 - DNA, 279 bp, Methylobacterium sp.
ttggcctttgtcggtcgcaccgggacccttttggatagacaaatccagattctgggagatcggtccaatgcgaccgtgcccgacatcaatctcggcgcggggctcgcgttcaagctcgcggagacgctgaaggactcggacctccctttcatcctctccacgggagacgaaggggcggtcattcccgcaggggtcgacgccgccgcgcggttgcagacgccgctcgaattccggcagaccgtcgccgccgtgttgaagttgccgcccaccgccgtgtag

SEQ ID NO: 9031 - DNA, 159 bp, Methylobacterium sp.
atggctgagaccgcacccctcatcgccatggtggcggcagcgctcgtctgggctgccatcgcagctgtcatgctcaccttcgcgatccgccaggcgcgcaaatacctgcgccgccgtccggcgctcaaccgagaggaggccgaccgtcatggcgcctga

SEQ ID NO: 9032 - DNA, 483 bp, Methylobacterium sp.
atgccgtcgctccgtccgcttcaatccggagacctcatctccatcgaggccgaggcgcgttgggcgggctacgtggcacagaacacccaacccgtctttctcggtcgtgcgccggacatctacaaggcgctgttccaccgccagcaggaagcgattgaacgctgctacgaggcgctgcggcctggtgcgactgtcggggagatatcggacatggtcgccgccatgagcgacgagcgcttccggtgcagcctcatcatgcacggccggggcctcggtgacgatgcccccatcaacatccacgaaccgcgggacgcgaccatgcgagactggcggatcgaggccaatgcgacgttcatcgtcaagccgatgatccagacgcatgatggggcgcagcgcttgtattggggcgataccgtcgtcgtgggggagaacggcgccgaacggcttggaaaacgggcggcggaactcatcgagatatcgtag

SEQ ID NO: 9033 - DNA, 219 bp, Methylobacterium sp.
atgagcgttccgatccgggccgatgctcagaacctgtcggccgaagttgataggcggcgccttgcccgcgagcgggccctgcttgcacaggcgcgtgagtcggtcgcccatggaaacgtcgtgccggactgcgaggtcgaggcctggctcgaccgaatgatcgagagcgacgaaccgcttccgatcccgacggctcgcccgacgagcgatcgctcctaa

SEQ ID NO: 9034 - DNA, 321 bp, Methylobacterium sp.
gtgcctttgccccgcaggttgatcctgtcgcgtgaagcggcactcgacatcgaggccgcgcggcgatggctgaggcagccgggtgccggcagaagggccgtagagcggttgaggcagatccgtgcggtgatcctcgagcttcgcacggctccgctgcgctggccgttcggcgaacacgatggcgttcgggaagccggcgcaggcggctatcgtatcctctaccaagtcgagccggagagcgacatctcggagggcgacgtggtcgtcctgcgggtcttcggtcccaggcaggatcgttcggatctcctgcgggggagttga

SEQ ID NO: 9035 - DNA, 270 bp, Methylobacterium sp.
ttgagagtcttggtttacggcgtcattcgggtcgtcggggccatgcgcgaccccgtgacccggcggctccaggccattggttcggtcgaggcgctcgccctgcgggatggcaggtttttcgggcgccgagacaagcggtcggcgatgcggtcgggaaagccgttccgcagccgccgcgacagggaaccggaaggacccgactcgacgctgcggccgcggatctcgatcggctccccctcccccaagggtgggacatcgaccaaggcatga

SEQ ID NO: 9036 - DNA, 330 bp, Methylobacterium sp.
gtgccggtgacgcaggtggtgccggaggggttcgcagcggcggcgaggtcggcggcacccgcggaggtgagaccggcggcgcggcaggcgccccgggacgcggcggtgagccgggaggggccggcacgcgcggcggtcgagacggcgacccggcccgcgccggagagccgggcgagcgcggcaatcgtgaaacgggccgcgacggcagcggcgagcgcgacggccggggtggccgtgatgcggccggagagcgaggtgcccgcgacggggccggcgagcggagcggccgcggggctgccacggaagcccgcggcgcctccaaaagcctga

SEQ ID NO: 9037 - DNA, 189 bp, Methylobacterium sp.
atgggccccctcaacgcggcagctccggcctttcccggtgccgcggtcgcgctccagcccctgcgcacggctgccgaggcgcaaggctcgggcgatttctcaccgctctggtcgggccaggctgtcgggctttcgcgggaacggccggcagccgaactgacccgcctgttggcgaccggcgtgccgagc

SEQ ID NO: 9038 - DNA, 240 bp, Methylobacterium sp.
atggaagcgctcgagcatctcgcccaggctgctgttcagaaagccgccgggaccacccgcgccgagttgattgcccagcaatccgccgaggaggccgccgaggcctccattcaaggcgccacccaggtcgccttggccaacttggttgccgggcgcggttccggatggtgcgggagtgccttggcctccgacaagcaattccgcgagattatcccggttctggtagcccgccagcgctaa

SEQ ID NO: 9039 - DNA, 276 bp, Methylobacterium sp.
ttggaagccgccgctgcgcgggcccacgcgcaactgcgcaccctgagcgagatcggcggcctcgtccctctggtcgctgaggcacaagaggcgctcgcctcgggccgtccggcggacctcgaccgggcggcgcacgctctgatcggcgaggcgaagcgccacgaccgcgcgatccgcctgcagctcgcccgcgccgtgaccgacctcgcgaccgcttcgcgcgttatgcggcggcacggacgcttcttccgccgcctcttcgttctcaattcctga

SEQ ID NO: 9040 - DNA, 81 bp, Methylobacterium sp.
gtgcctacggaagcgatcggcacggtcgttttctatcaggaagcggagcgcggctggattgcttcgctccgctcgctctga

SEQ ID NO: 9041 - DNA, 90 bp, Methylobacterium sp.
atggctttcgcggcgatccgcatgaaagtcttgcttccgaagccggaccggcaagaaacctccgcgcgcgccttgaaagccggaggctaa

SEQ ID NO: 9042 - DNA, 144 bp, Methylobacterium sp.
gtgcaggccacgaccagcgtcgacgccatggctcggccgcgcatcacggatggattccgggttccgccgcgcggtcccggaatgacgacgcggattgcgggcggccggcgccgcggccgcgtcgatcagtatgcaggcttctga

SEQ ID NO: 9043 - DNA, 321 bp, Methylobacterium sp.
gtggaagtcggcgctaagacggcccaacgtgacgtcacccagacgcgagagcagcagagcctcggcgtcgcggaaggcgtccgcgagggctgcgttgaccgcctgctcgaagaggcaagtcggcccattgctccggtgccccatcgcgaacacctccggcgagccaagcgcgacgtagacgtcgtgcagggttccggacgccgaggcgccgaggctgtccgtacctcggacctcgtcctcgccgtcgcgggcgtcgccacgctcggcggcttctgcctcctgctcgccgccgacatcctgggcaatctagcgggcatctga

SEQ ID NO: 9044 - DNA, 336 bp, Methylobacterium sp.
atggacgtaagcgacttgtccgtcctcgtcgcgcacaggcatgaggatggcatcggacacatctgcgttcgcctgaccctcacagcacatactgagtgcctggctgtggagctgtatcacctcacctgcgaaggcacgctggtagaacggctcggccgccgcccagccagccgggaaggtatgaggcagtgtttggccgagagctgcgggatggtgctcgccaagaaaggtagcagccgcatcgttgtagatgaggaggcgttctggcccgcatacgaggctggcggcaacagggttggccagcgtcatctcgacagcaagcttcaggcgtggtga

SEQ ID NO: 9045 - DNA, 174 bp, Methylobacterium sp.
atgatggctagcgtacctgaggaggggcgggccgcactgatcgcgccaatcccactgggccgcatggcgcgtcccgaggaggtggcggcggccacgctgttcctcctaagcgacgaggcgagcttcgtcgcaggtgccgaactgtgcgtcgatggcgggatgcgacaggtatag

SEQ ID NO: 9046 - DNA, 246 bp, Methylobacterium sp.
atgcgctccttccccgcccgcctcctctcgggccttctctccgtggccgccggcttggccgcctgccaaacgcagacggcaccgatggcaccgccggtcgaggcggtcgccgaactgcccgccgttccgcccctgccgccgagaccggagcggggcgcggcctggatgaagcacgcgccgcaggcgcctctcgatcccaccctatggtcaaaactcaatcagcttgaccgcacagaaggctgctga

SEQ ID NO: 9047 - DNA, 138 bp, Methylobacterium sp.
atgctccaggtcccgcgcggttcctggaacactcttcgaggcctcctctgcgctccggcgccccaggatgagggcgaggcgagcatcgccgtgatccgtgccttgccccgcatgttcctcagtttagaagcccgctaa

SEQ ID NO: 9048 - DNA, 219 bp, Methylobacterium sp.
atgttctcgccgatcacccgcgcgctcattcgaggcgaacatcaacgccttatggccccgctcagaccctggagcgagatcgttgcggccggatcgtcggcctgcgatctgccggcaatgcgaatgatcccgccgtcgttcgataagatcaccgatttcgtcggcacggtctggctctgtcgcgccgtgcagcatcatcaccaaggcacgcagtggtga

SEQ ID NO: 9049 - DNA, 417 bp, Methylobacterium sp.
atgcccctcacgtcacgccagatgttcgctgctggggtggcgttggtggtggccgggtgcggggaagacaagcctgcggagtacgtttcgcaaacgggtttccagccattcatccacaagcgagagggcgaccggatcacctacacgatgctcgacgtgatctcagaagacggtccgctcgtacggtacgtgacgaagcagcaggttgcccccggcggcccggtcggtgggatggtcaactacgcttcgcggcgcggtgactgccaccggctgctctaccaaacgctcggcgagggcgacacggcagcgaagatggagcgcgaccgtcccgaaaatcagtgggtcgagcttgtgaacggttcgagcgctacggcggctttggtgacggcatgtcaggtggcgaagaagttgaagtag

SEQ ID NO: 9050 - DNA, 114 bp, Methylobacterium sp.
atgagcacggccaaggcgacggaagcggcgaccatgagggtcacgcgcacggtcacgcacatcaccctcacggtcatgacggggccggctgcggtgaggggcatggggacgtga

SEQ ID NO: 9051 - DNA, 189 bp, Methylobacterium sp.
atgacggagagccgtccggccgggggcggcatgcgcgcggcctcggtgggcccctcgtgcggaccatggcccgcgcaggctctcggcgggacgccgcatccggccggcggagccgcgcaggtcgcgagggcgcacgcgatcctgccggggctgatcggtgaccgtttcggacgcgagcgcgtgatctga

SEQ ID NO: 9052 - DNA, 126 bp, Methylobacterium sp.
ttgtggccggagcggatcggtctcatcgccggcttggcgctcggcgtcgccctgctcgaagagagggacgacccgaccggcattgggcgggtcgacgacctctgcgccgtcccgccctcggcttga

SEQ ID NO: 9053 - DNA, 357 bp, Methylobacterium sp.
atgttggaacaacgtgttgccgctctagagaagggccaagagctcatcatcagcaagctcgacggcatcgccaagggcatcactgacggtcggttggagagcgagaagcggtttggcgcgatcgagggccgcctgacggggcttgaagccaagttggacaccaaggccagcggcgaggctctgacaaaggtaggtggagaactcgggggccggcttcagggcgttgagggcaaggtctcgaacatccccgatgttcgggcgacgatcaccctgacgttgacaacgatcgccctctgtttgggcggcgtgtcggtgattgccttaaccctcttcaagctcttcgggaacaccccttaa

SEQ ID NO: 9054 - DNA, 102 bp, Methylobacterium sp.
atgaaggatctggaacgcgagaacgcccggcagtggcggctcgtggccgagctgtttttggaaacgtgggttctggcgcacgtcgcctcgagaaatctgtag

SEQ ID NO: 9055 - DNA, 216 bp, Methylobacterium sp.
atgccggagaccggctggccgggcctccggcctgaggtcgagccggattcggccccagccccatccggggttccggcatcgcgcgtccgtacggcttccgaggtcgagaccttcgggttcgccctgccgtcggcccgcatcgtgtcgtcgatcgcggtggcctgcggatcggccgggaaagccgccggtcggtcgcctcaatccggtccgccgtga

SEQ ID NO: 9056 - DNA, 267 bp, Methylobacterium sp.
gtgaaaatcccccaggttgccgaccgcctccgcgagatcgccgccgaggctggcctgtcggagctctcccggctcgccgacgaactccgccggcgcccggccggccgcaaggcgcgcccctcgtcgcggcccatgacggacgaactcgccagcgagatccgagcctaccgccgggccaacccgcacctttctcaggtcgagatcagccgccggttcaacgtcaatcagggccgcgtgtccgaggtgctgaagggcgtgcggacatga

SEQ ID NO: 9057 - DNA, 768 bp, Methylobacterium sp.
atggtcgcccacgctgatctgatgcacggcacgtcactctccgctgttgcggacgaggccgcgcgcgcgctgatcaaggtgcgccgcggccccggcttggatgcgcgcgttacgcttcctgtcctgtacccgtctggcgcctgtgttggccttcgcatcggcggaggcgaaaagggcttcatggtcacggacgatggcggcgcttgcgccgaggcggacatggccggcgcgggcgaattcttccatcgcgcggctaaggagacggccgagcgttgcggcgtgcgctttgacggccatgagatgttcgagatcgaggctccgccggatgccttgcccggttttatggcgatcgtcgccgatgcgtctcgccgggctgcgcagcttgtcgctgagcgccacgccgagcggctggaccgccgcatgcgcacgggtctgacagacagactgatccgggtattcggcgaagagagagttgagatccgcccgcaagtatttggcgcctcaactcacgcctggccctttgatgctgcagcccgcttcgggcagcgcacggttctgtttgctgcggtgacaccttcggccgtctctgtgtcgtccgcatacctcaagctcgacgatgttcggcgcctcccggaagcgccgggcacggtggccgtgctttcgcgcgagtcgcttttccggcaggatcagcgactaatcctcggccgcgcggcccgcatccttgaggcctcgtcgtccgacgatgagtttcgtcgcgctgccgcctga

SEQ ID NO: 9058 - DNA, 255 bp, Methylobacterium sp.
gtggggtcacggtacgggaaggcgaacaccgacctcgcagacctcgcccacatctccgtcacctgtgaggactgcggccgtcagaattggtggacgcgggcgcaattggatgaggccgaacagggcggcgttcagtcgctcggtgccctcgggcgcaagctgcggtgcacgtactgcgtggagcgtggcggcagtgggcgaaacctggggctacgcgcgaccctacgagaggaggcggaccatgtcagggaatga

SEQ ID NO: 9059 - DNA, 210 bp, Methylobacterium sp.
gtgagcgacgacagcgtcacctgcccgcactgccagcacgagatctcgatgacggacggcgagcgcctacagggccacgtctcctattggggtcaggacaaggtcacgagcctcgactgcccgcagtgcgagcgcgaggtcttcctgcaggaatacgtgaagcgctggtggaccgccggccgcactccgcaggaggcgtgcgagctatga

SEQ ID NO: 9060 - DNA, 408 bp, Methylobacterium sp.
atgccggagatcgccgtcggaggtcgttccatgagcgtcgcgcagatgagccgggaccgcgtgcgtacgatcaacgtagcgtccgatttcacccgtacgccgggcggccgaactaagcgcaacggtccgttcaacggcgtccagtttcgcaccgaggtgctcgagccggctttgcgccagatgccgggcgagtacacgaagctcgtcgtgaacctcgatggcgtggacacctatatcggttccttcttggaagaatcgtttggtggcctactgcgcggtctctacgacacgttcgaggaagcagccgagcgcctggaaattcgtgcaaccggtgagtttgaggtcttccgggatctcgcctaccagtacatgcgcgatcaggataagcggaacgcaaaggggcgctga

SEQ ID NO: 9061 - DNA, 555 bp, Methylobacterium sp.
atgccggaccaggcccaaggccttacgctggccggcactgcatggtcgttcgctgccgggctcggcggcgcggccattccgctgggcgtgatgtggttgaagctgcggctcgatcagctttccgcgcgctgcgacactttcgtggaattcatcgaggaggttgccgagctcgggctcgactactggctcctcggtgaagccgatccagattcgccgctcccagccgatggttccgatgatgcgaaagagcatgtcgccgccatccttaagcacgagatccagctgcggggagcgcaaacgatcctgcagcttgatcttgcgcgcatggcgcgcgacttgcccgcagcgaggcgcgatccactccgcttggagttcgcggcactcatcagcgctctgaccggcggcaagtttggagatcgcaccggctatgccgagccgcacaaggcgcaggctgtcgtatcggcagctgcgcggattattcgcatcgttcgtgagggcagagacgacgtgtcgaggctgccgaatatgctccgcttcgcgatcgggcgcctctga

SEQ ID NO: 9062 - DNA, 276 bp, Methylobacterium sp.
ttgacaatccccgtccaggtcgacagcatcccggcattgcgtgccttcgtggcggcggcggaggcacggagcttcaagctcgccggcgaggcgctgggggtgtcgtcctcggccatcggcaagagcatcgcgcgcctggaggcgcagctcgccgccgcactgttccaccgcacgacccgcacggtcacgctgaccgatgagggcgcactctacctcgaccgagctagagcggcatccgagcgcgctgaaacggctgggcaggtgatgaggttggtc

SEQ ID NO: 9063 - DNA, 1125 bp, Methylobacterium sp.
atgtccgagctgttctccagcttcgacctcgccggccggacgctccgcaaccggctcgtcatggctcccatgacccgcgcacgcgcgcccgacgacgcggccgacgagcgcatcgccctctactacgcccagcgggccaccgcgggactgatcgtcagcgagggcacgcccatctcccgcgagggccagggctacctcttcaaccccggcatcttcacgcccgggcaggtggcgggctggcggctgaccacgcaatccgtccatgcggtgggcggaaccatcttcgcccaactctggcacgtgggccgggtctcgcatccctccatccaggaaggtggccgcacgccggtgagcgccacctcgaaagtcgccgtcggcgccaccgcgttcggctacgacgagagcggcaagccgggcttcgtcgcgccccccgcgccgcggccgctcgccaccgaggaggtcggacgcgtcgtcgccgacttcgcacaggccgccgccaacgcggtggaggcgggcttcgacggcgtcgagatccacggcgcgaacggctacctgttcgagcagttcctcaacccgctcgtgaatgaccgcaccgaccgctacggcgccggcacgatgggaaaccgcctccgcttcgccctggaggtcgtggacgcggtgtgcgagcgcatcggccccgcccgggtcggcatccgcctctcgccctatggccaaatcttcgacatgccgcactacgccgacatggacgagacctacacggccttggccgccgaactgggccgacgcgccatcgcctacgtccacctcatggaccagtcgggctacgtcatgaacgacatcgtcatcgacaccttcgtcgagcggctccaccgccttctacgagaattccggcaaaacctgccccggacggccatcgtcctggccgggggcatgacccgcgagcgggccgagggcctgatcggcgacgggaccatcgacctggccgccttcgggcagcccttcatcgccaacccggacctcgtcgagcgcctgcgcaacggctggccgctgacccagccggacaaggcgacttactacggcggcggtgcgaaggggttcatcgactatccgccccatgcggcctga

SEQ ID NO: 9064 - DNA, 324 bp, Methylobacterium sp.
ttgagcgacctgcgggaacacgaccgcatcgacgcggagctgacgcgcacggacgcgagctccgacccgttcgccgccggcgccctgcgccggcaggcccagggtctggtcgaggcgggactggcgcgcggcgacgccgacgtggaggcttacgcgcgcgaggtcgacgccctgcaccaggagccgggccggcgcgacctcgcttggcgcctgggcctggacgagcaggtcaccgacgctcgcctgaggctggccgagatgcgcaacttcgtcggggcgctcgaccgcctcggtcgggaagggtggcaagctgtgggtaactga

SEQ ID NO: 9065 - DNA, 126 bp, Methylobacterium sp.
gtgatcctggaggcggtgcgccgccgcgatgtcgagcgtctgaagctggaagtcgtttgcgacatctacactggccgggacctcatcggtggcaacatggcggccgcggcgcatcgggccggttag

SEQ ID NO: 9066 - DNA, 285 bp, Methylobacterium sp.
atgaagaccatcattctggccagcgtcgccgccctgatcagcacctccgcttttgcccagactgcgggtgaattccttggccaggacctgcgtgaccgtggtgccgcctatgtcgcgaccgatcgcgctcgcgagaacttcggcattgctcgtgagcgggccgccgagggcaactatgtcggtgccgccatcgcccaagagcgtggcgagatcgaacgcggccgcgctgatcacgacgtcatcgcggccgatcgcgatcgcgccctctaccgcctgacccgctga

SEQ ID NO: 9067 - DNA, 339 bp, Methylobacterium sp.
atgcttttttttgagcaggcggttctccaagacgaggtcggccacgacctccttcagcgcgctcgccccaaggcgcaggtccttgacctcgtcggcggtggcggcacgggccgtatcgccggccagccgcttcttcccggcgtccaggaactcgttggaccagccgtagtacatcgagctggcgatgccttcgcgccggcacaggtcggcgatgctgtcctcgccgcgcaggccttccagcacgatgcggatcttctcctcagacgagaactgccgacgcttcgcgcggcggatgtccttgatcacggcctccgccggcttccgtaccagcccggatga

SEQ ID NO: 9068 - DNA, 111 bp, Methylobacterium sp.
atggcgttgaggatggtgatcagcttccgagcggtggcaatcagggcgacgagcttgggcttaccgactgcgatgagccagtcacggaaggttttcagcgcggcgttgtga

SEQ ID NO: 9069 - DNA, 267 bp, Methylobacterium sp.
gtggatgatctccgaaccgatcttgatccgttcgacgatggcctgaagctacgccttccggaattgtatctcaccgctcgtcaagttctcgcgcatcagccgaccaaagcgcgcgatcagttcgggcgcgagttccgccggcgcccgctcagcgacatggatgcgctccagcgtcgcgcgagcgtggattcgatccgctttcaacatggccaactctgccgtgaggatttcgtcgggatccggcagcccaccctgaccaagcaatag

SEQ ID NO: 9070 - DNA, 420 bp, Methylobacterium sp.
gtgggcatcgaagaccatctcctgcgtctcgcgcggataggcccgcagcaggaagagccggctgtggcagagccggatatgggcgaccttgacctgcgtggtgacgccggtgagccgaacggtctcgtggctccagtcgaactggtaggcctcacccggggcgaaggcgagcggcacgaacacgcccgcggcggtggcggcatgctccgcgaaccagcgttgcgcgtagcggcgcaccgcgtcgtagccgccggcatagccctccgcccgcagcccctcgaacaggcgcgtgagactgaggcgctcgcgtttgggcttggtcaactcctcagccagcaggacgtcgaggcgcgcgatgtgcccgtcgagttgcggccggggctggtgctgacgcttgtaggcgaaggcggtcttgtctga

SEQ ID NO: 9071 - DNA, 159 bp, Methylobacterium sp.
atgagtcggccgggccagatcatgacgacccgcgacatgaacatcgaatgccgcggcaacggatgggtcggacgcagcgcgagagactgctacagcggccgctgccggatcttgaaatcgaagcgatgcaaatgcatcggcaacaagccgtcgttctga

SEQ ID NO: 9072 - DNA, 237 bp, Methylobacterium sp.
atgcaattcgacgcggacgcccgccggtccctgatcgaccaaggcgatctccagcgctgcatgatcgacacgctgctgtcgggcgcatttgagaccatcagcgacgcgcgagacgaaacgagccgccttgctggctgggatgcacagcgacggttcggttgctcggagctaagcttgctgccgagccttgtccggggtacgcgaccggggtactttccgcagatggtgggccgctaa

SEQ ID NO: 9073 - DNA, 120 bp, Methylobacterium sp.
ctccagccccctgcccaaaccccttcccgcgcctcgaacgactgggtgcggatgatgctcgactacgagaacgagcgcgcgctcggcgggcgctccggtcgcgaagcgggcacggcgtga

SEQ ID NO: 9074 - DNA, 549 bp, Methylobacterium sp.
gccggcaccatcaccggcggaaccggcggcggctggaacttcactggccagaccccaccgacggcgctcggcgcggccggcgagggcggcgcgggattctccggaccggccggcgcgagcctgtccaatgccggcaccatcaccggcggtaccggcggcggcggcgcggccgggacaaccggcttcgccgagattacgggaccgtcgggcgcgccgatcgctacgggcggcacgggtggaactggcggcatcggcggccgcggcgggaccggtgcgcagctcaccggcgcggagggcttcagcaacaccggcatcctggccggcggggccggcggcatcggcgggacgggtggtgacgctgacagcatcggcgagagaccgatcccacccgatgcctccggcgggacgggtgggatcggcgggacgggcggcaccggactgcggatcagcggcggaaccgccctcggcaatgccgggaccgttcgcggcggcgacggcggacggggcggcgacggcggacgggccggcttaccagcggagagccggggc

SEQ ID NO: 9075 - DNA, 738 bp, Methylobacterium sp.
atgaccgagatccggcgcgtgtatgaggcgaacttctgcgtctacggcgtgcgcaggatctggcggccgctcgaccgtgaggggatcacggcggctcgttgcgccgtcgcacggctgatgcgagcgatgggtctgcaaggcgtcgtgcggggcaagacagtccgaacgacgatccctgatccggctgcggcttgcccactcgaccgggtcaaccagcagttcgaggcggagtgcccgaactggctgtggggtgcggattttaccgacgtcgctacccggggcggcttcgtccatccggctttcgtggtcgatgtcttcgctcgccggatcgtgggctggcccgtgtcgcgctcggcgcgggcggacttcgtccttgatgccttggagcaggctctgcatgagcgccgccccttcacaggcagcgctctcgtctgtccctccgaccgcggatcgcaatacgtgagcatccgatacaccgagcgccttgctgaagcgggcatcggaccctccgtcggcagcgtcggtgactcgtacgatgatgctctcgccgagaccgtgatcggactgttcaaggcggaggtcatccatcggcgtgacccgtggcagtcgttcgaagccgtcgagttcgcctctctcgaatgggtggatggtttcaatcgccgtcggttgctcgaaccgatcggcaacatgcctcccgccgaagcggaagcacgctcctatcatcaggccgaggcctaa

SEQ ID NO: 9076 - DNA, 225 bp, Methylobacterium sp.
atggtgttggagcatcagggcgatcacgcctcccggtacggagcgatccgctcgattgccgccaagatcgactgctcgggcgagacgctgcggaatcgggtccgccgggcagagcgggagcaaggtcagcgggctggtccgacgacggacgagcgcgagcagatcgaggcgctggagcgggagaaccgtgagctccggcaagccaacgagatcctgagaaaagca

SEQ ID NO: 9077 - DNA, 273 bp, Methylobacterium sp.
atgagcctccgcctacagcccgtgcgtgttgctacgggcagccatgacacggaaagccagctcgtcttctcagacggctttctcgtcgcgatcttggtgcagctctccgacgatcacgaggacatggccggcatgtgggtcctggaggccggcttcggctccgtcgagcatccttgcccgcctaccttcgcaaaccttgatgcggcgcaggtctggatcgcgcagcagctctcgtcgtctgccagaagcgacacacctaggcacgctccctaa

SEQ ID NO: 9078 - DNA, 543 bp, Methylobacterium sp.
atgacagctgccgcccgcgagatcgtccagaccttcgagacgatcgaccgcgacgccctcgccgccctctccgagaaggcacgggcggaccccaccgccgtgcgcaccgtccgcgcccgcacggtcgccgaggggcggcgcttccgccacctcaactacgtgcgcgacctcgccgcgcacgtggtcgacgagccgccgggcctgctcggcgacgacaccgccccgaacccgaccgaggcgctgctcgccgcgctcggcacctgcgtggcggtgggcctccaggccaacgcggtggcgcgcggctggaccgtgcgcgccatcacgatcgagagcgagggcgacatcaacatcacctcggtctggggcaccggcgacctctcgccgaaggccgtggggctgaccgccgtgcggctcagggcccatctcgacatcgcgggcgcgagccccgaggagctcgacgacctcgtcgcccacgcggcggagtggtcgccggtgctcaacaccgtgaagaacccggtccccgtcaccctggcgcgggcctga

SEQ ID NO: 9079 - DNA, 273 bp, Methylobacterium sp.
atgacacgcgccatcgtcgccacgctggtgctcgggacccccgcctatgccgccgagggcagtcccgcgacgggctccgggcagacccgttcgggtaccatggacagcaccggcgcgaacgacgcggggtccgggtcgtcaccgggcgccgccggaagcggcccctcgaccggcggcctgagccggtccggcacggccaacggcaccggcgcgaacgatgcgggctcgggcgcgacgccgggcgcgaagggcggttcgagcggcggccgctga

SEQ ID NO: 9080 - DNA, 255 bp, Methylobacterium sp.
atgcccgagagccgtatcgcctggaccgcttccgatatcgccggtgtgccgctgcgccgcctcgtcggcaggctcggccggatcgaggtcggcatctgcgagtacgacgggtcgaaccggctctggacgtggtggagccccctcgccgaggacgtctggggccatgcgccgagcgcggaggccgcgcagcagcactgcgaggtctggctgcgggaatggctggagaacttccggccgttcttcgagcgggactga

SEQ ID NO: 9081 - DNA, 1080 bp, Methylobacterium sp.
atgagcgccgcagccccgtcgatcgcccccgacccgcaccccgacatcccggagatcgtgcggacgcagctgcgcccgcaggtcgcggcgatcgatgccggcgcctatccggaggcgaccctgcgggcgctcggtgcggccggagcctaccggcaccacgcggacggaacggcagcgggcctggagcgggcgatcgacgccatgagcgaggtcgccgacgcctgcctctcgacggccttctgcacgtggtgccaggacgcgctcgtctggtacctcgcccgtagcgcggagcccagcgccgcgggccagctccaagccgtggcggccggggaccagctcggcggcaccggcctgtcgaacccgatgaaggccttctcggggatcgagccgctggcgctctccggcacgcgggtgcccggcggctaccaggtgcggggacgcttgccctgggtctcgaacctcgcggccggccaccgcttcgccgcgatcttcgccctggaggacggcacccgggtcatggccgtcctcaccgccggcacggaatcggtggggcttgccgcgaacacccgcttcgtcgcgctcgaaggcaccggcacggtcacggtgctgctgcgcgacgccttcgtgccggacgcggacgtgatcgcccccgacgcggcggccttcgtgccgcgcatccgcaacggcttcgtgctgctccagaccgggatgggcctcggcctcgctcgcggggtcgccgcgctgatgcgggcggacggccgcgggcgtcggcaggccgcccacctgccgctgggaccggacgcgatcgtggatcgggcgggaaccctgcgcgagcggatcgcggcggtagcggagcgccaggccgacccggcccgcgcggcgttcctcgacaccctgcgcctgcgcctggacgtctcctggctggcgctggaggcggcgcaatccgcgatgctccagttcggcgcccggggctatcaggagggggccgaggctttccggcgcctgcgcgaagcgcagttcgtggcgatcgtcacgccctcggtcaagcacatcaccgccgagcttgcccgctcgacctga

SEQ ID NO: 9082 - DNA, 729 bp, Methylobacterium sp.
gtgcccccgccacggatcgcgctcgacgacatcggtttccggcacggcccgcatcagatcctgcagggcgtgtcgctgcgcgtcacggatggggaatgcgtcggcattctcggggcgtccggcgtcggcaagtcgaccctcctccagatcatggccggcctcgcgacacccgccgccggtaccgtgcggatctcggacgttcccgtcgcgggccccgtcccgggcgccaccgtgatgttccagcggcccgccctgctgccctgggcgagcgtgctcgacaacgttctcctgcccgcgcgcctgtccggacgtctccggcgggaccgggccgcgagccgggccgaggcgctgcgcatcctcggcgaggtcggtctcacggaccggatcgacgcgaagccgcaccagctctccggcggccagcagcagcgggcggcgctcgcccgcgcgctggcgagcgcgccgcgcatccttctcctcgacgagcccttctccgccctcgaccccgagatgcggggcgcgctgcgcgaggatgtccgccgtctcgcccgcgcgcgcggcctgaccctcgtgatcgtcacgcacgacctcgccgacgtcgcggtgctcgccgaccgcgcgatcctgctgggcggccggcccgcccgggtcgtgcaggacttcgccctcgggcccgatgcggagggcgaactcagggcgcgcttcggcacccccgaccgccgcgccgcctga

SEQ ID NO: 9083 - DNA, 1068 bp, Methylobacterium sp.
atgagcaccttcgaacgctacctgaccctctgggtcgcgctgtgcatcctggccggcatcgcgctcggccacgtcatgccgggcgtcttccaggccatcggcgccgccgaggtcgccagggtgaacctgccggttgccgtcctgatctggctcatggtcatccccatgctgctcaagatcgacttcgcctcgctgcgccacgtcggccggcactggcgcggcatcggggtgacgctgttcatcaactgggccgtgaagccgttctcgatggcgctgctgggctggctgttcatcggctacctgttccggccctacctgcccgccgaccagatcgacagctacgtcgccgggctcatcatcctggcggcggcgccctgcaccgccatggtgttcgtgtggtcgaacctgacccgcggcgagccgcacttcaccctgagccaggtggcgctcaacgacaccatcatggtggcggcgttcgcccccatcgtcggccttctgctcggcctctcggccatcacggtgccctggggcacgctggttctgtcggtggtgctctacatcgtcatcccggtcgtgctcgcgcaggtgttgcgccgcagcctgctcgcttcgggcggccagaccgccctcgaccggctcctcgccagactcgggcccgtctcactcgtggcactactcgccaccctggtgctgctgttcggcttccagggcgagcagatcctggcccagccggcggtgatcagcctgctcgtggtgcccatcctcatccaagtctacctcaacgcggggctggcctacctcctgaaccgggttgcgggtgagcggcactgcgtcgcgggtccctccgcgctgatcggcgcctcgaacttcttcgagctcgcggtggccgccgccatcagcctgttcggcttcaactcgggcgcagccctcgcgaccgtggtcggcgtgctcatcgaggtgccggtgatgctctcggtcgtgtggatcgtgaaccggagccgaggctggtacgagcgcggcgccgcgggcaagggagcggcgctcaagcccgcctcccgtgaggcttga

SEQ ID NO: 9084 - DNA, 1746 bp, Methylobacterium sp.
atggacgacgatatcctccacctgatctcggatgaggcggaggaggtgcccccccgcgccggctcctggaccatcgccgtcgtcgacgacgatcgcgccgtgcatgacgggacccgctacgcgctggccggctacgagctcgacggccgcggtctcgagatcctctcggcgcattccgccgccgaggcacgcgcgctcctgctggagcggcgcgacgtcgccgtcgtactgctcgacgtcgtcatggaaacggatgatgccggcctgcgcctcgtcgagttcatccgccgtgatctgggggacgagacagcccggatcattctccgcaccggtcagccgggccaggcgccggaacgccgggtgatcgtcgattacgacatcaacgactacaaggcgaagaccgagctcacagccgacaagctcttcaccagcctgaccgcggccctgcgagcctaccagcagctcaagcgcctcgacgacacccggcgtggcctcgagatcatcatcgatgccgccccgatgctgctcgaccacaaatcgctgcagcgtctgtcggagggcgtgctcacgcaggtcgcctccctcctcaacgccgcctgcgcggggatcctcgtccttcgcgagaacgatgcgtccgcgcagcgcttctccgtgctcgccggctcgggcctctacggcgaccacgtcgatcgagacccgccctggcccctcgatccgaagattcagccgatcgtcgaggtcgccttccaggaccggcgcaacagcttcggcgaccactggtcgacgctctacgtgcagacggcgagcggcagcgagatcgtcgcgctgatcgataccgaccgaccgctctcggacaccgaccgggcgctcatcgccctgctgaccagccgcctctcgatcgccttcgacaacgtcatcctgtacgagcaattgcagcgggcgaacgtcaccctggagcaacgggtggtggagcgcaccgcggagctgatcagggccaaccggcgcctcgccgcgcagcgttcggacctgcgccgcgccaacagcctcaagaccgagatcctcggaaccgtggcgcacgatctcaagaatccgctctcggtcatcctcgggcgctccgagatgctcacggatctgatcgcgctcgagcgcgcgccgaaggatcagctcgccacccagatcggccacatccgcacctcggccacccgcctcatcggcatgatcgacagcctgatggccgacgcgatgaccgacgcactggacatcaccctgcgtcgggagccggtcgacctcgccgccctcgctcgggaggtttgcgaggcgaacaggccgctggccgagtcgaagagccagatcctgacgctcgatctgcccgaggaggcgtatctctgcggcgatgccgagcgcctgcgcgaggcggtcgacaacttggtctcgaacgccatcaagtacagcttcgtcggcggaaccatcacgatccgcgtccgctacgaggcgggggacatcgtgtgcgcggtgaccgaccacggacccggactctcccccgaggacgcccaacgcctgttcgggcgcttccagcgcctctcggccaagccgacggggggggagggatcgaccggtctcggcctgtcgatcgtgaagcggatcgccgagctccaccgcgggcgggtcgaggccgcgagcgatgggccggggcgtggcgctaccttcacgatccggtttccccacgaagccgtcgcgctgctctga

SEQ ID NO: 9085 - DNA, 735 bp, Methylobacterium sp.
atgggtaccggcgcatcccagatcttcatcgtcgacgacgaggccgacgcccgcgcgatggtcggcgactacctcaggatgcacggcttcgaggtcaccctatgcgatggtgggcgcgccctgcgggccgcgatcgcgcagcgcgcgccggacctcgtggtgctcgacctcaacatgccggaggaggatgggctctcgatcgtgcgcgacctcaaggcccgctcggcgatcccgatcatcatgctgaccgccacagcgagtgccatcgaccgcgtggtcggcctggagcttggcgccgacgactacctgccgaagccgtgcgagctgcgcgaactcgtcgcccgcgtgcgctcggtgctgcggcgggcgcagagccccgccgcgggtgcccccgccgagcaggcgcccctcccggagatcatgcggaggatacgcttcggcacgaagtggctcgaactcgatgccctgcgactgcgcgacgatcacggcgaggagcaggctctcacgcgctccgagttcgatcttctcaaggccttcgccgaccatccgaagcgggccctgtcccgggagcgcctgctcgacctcgcggatgcgcgcgatcccgacgcgttcgaccgcgcgatcgacgtgcggatcaaccggatccgcaagaagatcgagccggatccggccaatccccgcttcatccgcaccgttcggggattgggatatgtctttcggccggagggcgactga

SEQ ID NO: 9086 - DNA, 1473 bp, Methylobacterium sp.
ttgtctgcattcgggctctggttctccgagcccgacgtcgaggacatgttcgccgcgagcttcgtgaccggaaacttccggcagacgcgcctctacatggtggcggcggcggcgatctattttctcttcgcgttctgggacctgctcataggcacgtcgtcgtggccggccacggtggcgatccggtcgctcatcgccctcggctggatgctgcccctgaccgcgatcaccctcgtgcccggcgtccggcgccgggccgaggcggtcctgctcctgttcaccatcgtccccgtctggtcgctctcgctgatctacagctacctggaagacggcttcacgcacggcactgccgggacgatcctcctgatcctctacgtcgcgacgctgctgccgatgcgggtgccgtacttcgccgccttcagcggcgcgacctggatcggcttcatgctcggcgagacgttctgggcccggcagccggccgggcacgcgatcgtcaacaacatctcggtcgggaccgcgctcgcactgtcgctctacgcggtcgccgcccgcgaattctcggcgcgacggcagttccgcaccgcggccgaactgcggatcgccaaggcggcctccgacgtcgcgctcgaggatctgaagcgcatgcaggcccagctggttcaggccgagaagctcgcctccctcggccagctcgtggccggcgtcgcccacgagatcaacaccccgatcggcgtggcgatcacgaccgtgacgacggtcgaggccgagatcggcgcgctcgtccacagcctggaaggagggcggatgcggcggtccgacctgacgaacggtctcgaccggttgggggagggcgcgcgcatcatcttcgccaacctcgatcgcgcgggcgatctcgtgcacggcttcaaacaggtcgcggtggaccgcgcgacggaggagcggcgcagcttcgtggtcgggacatggctgcacgatctgctcaccagcctgaagccgctgatccggcggcacggtcacagcatcgaggcgcggtgccccgagaacctcaggctcgccacctatcccggcgcgctcgcgcaggtgatcagcaacctgacgatgaacgcggtgacgcacgccttcgcggaggggcgtgccggtcggatgacgatcgaggtcgtccggatcggcgagggcggggtgaggctcctgttccgcgacgacgggatcggcattccgcccgagaatcgggaccgggtattcgacccgttcttcaccacgcggcgcaaccaaggcagcaccgggctcggccttcagatcgtgcacaacctcgtgaccggcgtgctggagggtcacatcgccctgtggagcgaggtcgggcgcggcacccagttccgcatcgacctgccgggcccggtcgcagatggtcaggccgctcggcagacggggggaacaaacccggccccgcgctacccgcatccgcccgaaacttga

SEQ ID NO: 9087 - DNA, 843 bp, Methylobacterium sp.
gtgagcgcggcgcccgtacaggccgtcctggcggccgcgcccgcggctccggccgcgtcgcctgcccggcctcccggggcggggccggcccggctgctcgcgccgctggccgggctcgccctcctcggcgcgctctggttcggcgcggggctgatcctcgcgagcgacccgcgctacggcgccttcacgggcttcgcgcccggaccggcgctcgccgccttcgccgatctcctgcgctcgggcgaggcttggcgggcggccgcgcccagcctcgcccgcgtcggccagggcctcctctacgccttcctcgccggcgcgcccctcggcctcctcgtcggcagcctgccgctggtcgagcgcgccctgcagccgcctttccaactgctccgcatgatctcgccgctcgcctggatgccggtggcggtgctgagcttcccgagctgggacggcgccatcgtcttcctgatcgcggcagctgcgatctggccgatcctgttcgcgaccgccgccggggtgaagcgggtcgatccggtctgggtgacgctcgcgcgcaatctcggcgccgggccgctcggggccctgcgcgccgtggtgatcccggcggtcacgcaagacatcctgaccggcctgcggctcgccctcggtgtcgcctggatcgtgctggtgccggccgagtatctcggcgtcacgagcgggctcggctacgcgatcaacgacgcccgcgacaccctctcctacgaccggctcgccgccctcgtcctgttgatcgggctgatcggctacgccctcgacagtctgctcggccgcctcgcggcccgcgcccgctggatccccgcgacctga

SEQ ID NO: 9088 - DNA, 1056 bp, Methylobacterium sp.
gtgcgcatcggctacctgccgatcaccgacgcgacggcgctgctcgtcgcccacgccaggggctatttcgaggaggccggcctcaaggtcgccgagccggtgccggtgcgctcgtggtcggcgctggtcgagggcttcgcggcgggcaagttcaacctcgtccacctcctcaagcccatcccggtctggatgcgctacaacaacaagttccccgtgaaggtgctggcctgggcccatacgaacggctccggcatcgtcgtgggcggcaagagcgggatcgccgatttcaaggatctcgcgggcaagcgcgtcgcggtgccgtactggtactcgatgcacaacgtcgtgctgcaatatgcgctccgggaatcgggcgtgaccccggtgatccgcggcgatgccggggccggcgagtgtgccctgcagatcctgccgccgcccgagatgccggccgccctcgcggcgggcaagatcgacggctacatcgtggccgagcccttcaacgcgctgggcgagatcaaggccggcgcccggatgctgcgcttcacgggtgacatctggaagaaccatccctgctgcgtcgtggccgcccacgagcgcaccacggtcgagcggccggactggacgggcaaggtcgtcgacgcggtggtgcgggcgcagattttcgcccgggccaacaaggaggcggtcgcgcggctgatctcgaaggacggccgcggctacctgccgatgccgggcgacgtggtggtgaaggccgtcagcgattacggcccggcctacgccgagagcggcgcgatccgccatcccgaatgggcggccaaccgcatcgacttccagccctggccctacccctcggcgacgaagctcatcgtcgaggcgatgggccggaccgtggtcgagggcgacgccaccttcctgaagggcctggaccccgatgtcgtcgcccgcgacctcgtggacgaccgcttcgtggccgcctccctgaagcgctacccggagggtctgccggccgggggcgccgacccctacgcgcggaccgaggtcctgtcgctgtga

SEQ ID NO: 9089 - DNA, 1461 bp, Methylobacterium sp.
atgacgccagtgccctcgcagctcgaagcgaagcttctgctcaagagtcttcgagccttccgcagaggggacttctcggcccgcttgccgctcgacctgaccgggatcgatggtgagatcgccgaggctttcaacgacatcgtcgagctgaaccaggggcttgccaaggaactcgaccgcgtggcgcgtgccgtcggcaaggacggccggatcggcgagcgcggcaagcttcccgcagcgacgggtggttgggtcgagtgcgtggactcggtcaactcgatgatcggagacctcgtccagccgaccaccgaggtcgcccgggtcatcggtgccgtcgccaagggcgatctcggccagaccatgcaactcgagatcgagggccgcccactcaggggcgagttcctgcggatcggcaaggtcgtgaacacgatggtcgatcagctcaactccttcgcctccgaggtgacccgcgtcgcccgcgaggtcgggtcggaaggcaagctcggcggtcaggcccaggtcaagggcgtgggcggcacctggaaggacctcaccgacaacgtgaacctgatggcggccaacctcacggggcaggtgcgcaacatcgccgaggtcaccacggctgtggccaacggcgacctgtccaagaagatcaccgtcgacgtgaagggcgagatcctggagctgaagaacaccatcaacacgatggtggaccagctcaactccttcgcctccgaggtgacccgcgtcgccaaggaggtcggcacggagggcaagctcggggggcaggcccaggtgaagggcgtcggcggcgtctggaaggacctcaccgacaacgtgaacatgatggccgagaacctcacgggtcaggtgcgcaacatcgccgaggtcaccacggcggtcgcgcgcggcgacctgtccaagaagatcacggtcgacgtgaagggcgagatcctcgccctcaagctcaccatcaacacgatggtggaccagctgaactccttcgcgagtgaggtgacgcgcgtcgcccgcgaggtgggcacggagggcaagctcggcggccaggcccaggtcgagggcgtcggcgggacctggaaggacctgaccgacaacgtgaacatgatggccgagaacctcacgggtcaggtgcgcaacatcgccgaggtcaccacggcggtcgcgcgcggcgacctgtccaagaagatcacggtcgacgtgaagggcgagatcctcgccctcaagctcaccatcaacacgatggtggaccagctgaactccttcgcgagtgaggtgacgcgcgtcgcccgcgaggtgggcacggagggcaagctcggcggccaggcccaggtcgagggcgtcggcgggacctggaaggacctgaccgacaacgtgaacatgatggccgagaacctcacgggtcaggtgcgcaacatcgcggacgtgacgaccgcggtggccaac

SEQ ID NO: 9090 - DNA, 3477 bp, Methylobacterium sp.
ctggagctgaaatccacgatcaacacgatggtggaccagctgaactccttcgcgtcggaagtgacgcgcgtcgcccgcgaggtgggcacggagggcaagctcggcggccaggcccaggtgaagggcgtcggcgggacctggaaggatctcaccgacaacgtgaacatgatggcggccaacctgacgggccaggtgcgcggcatcgccagcgtggtgacggcggtggcgcagggcgacctgaagcgcaagctctcggtcgatgccaagggcgagatcgccgcgctcgccaacaccgtcaacgagatgatcgagacgctcgcgaccttcgccgatcaggtgacgaacgtcgcccgcgaggtgggcgtcgagggcaagctcggcggccaggcccgggtgccgggcgcggccggcctctggcgcgacctcaccgacaacgtgaaccagctcgccgcgaacctcacgacccaggtgcgcgccatcgcggaggtcgcgaccgcggtgaccaagggcgacctcgcgcgctcgatcgcggtcgaggcctcgggcgaggtcgcggcgctgaaggacaccatcaacgagatgatccgcaacctgcgggacacgacgctgaagaacgccgagcaggactggctgaagaccaacctcgccaagttcacccgcatgctgcagggcgagcgcgacctcgccaccgtctcgaacatgatcctgtcggagatcgcgccgctcgtgagcgcgcagcgcggcgtgttctacatggtcgaggacgatgcgggcgagccggtgctcgacctcgttgcgagctacgccttcaccgagcgcaagaacatctcgaaccgctaccggatgcgccaggggctcgtggggcaatgcgcctacgagaagaagcgcatcctgctcaccaacgtgccgggcgactacatcaccatcgggtcggcgctcggccaggcggcgccgctcaacatcatcgtgctgccggtcctgttcgagcaggaggtgcgcgcggtgatcgagctcgcctcgttcaaccggttcagcgagacgcaccagtccttcctcgaccagctcaccgagtcgatcggcatcgtgctcaacacgatcgcggcgaacatgcggaccgagggcctcctcaagcagtcgcagttgctgacgggcgagctgcagagccgccaggaggaactcaagaagaccaacgaccggctggagctccaggcggcctcgctccagcaatccgaggacctgctcaagaaccagcgcgagcgcctgcagcagaccaacgaggagctggaggagaaggcgcgcctgctcgagatccagaagcgcgaggtcgagggcaagaaccgcgaggtctccgtcgccaagacggcgctcgaggagaaggccgagcaactgagcctgacctcgcgctacaagtcccagttcctcgccaatatgagccacgagctgcgcacgccgctcaacagcctgctgatcctctcgaagctcctctccgagaaccgcgacggcaacctgaccgacaagcagcgggaattcgccaagaccatcaacgcggccggaagcgacctcctgtcgctgatcaacgacatcctcgacctctcgaagatcgagtccggcaccgtgtcgctcgagatcggcgacgtcgcgctgcaggatctcgtggagaacctcaacaggaccttccggcagctcgccgaggagcggcatctcgccttcgagatcgcggtcgagccgggcctgccgcggtcggtgcgcaccgatgcgaagcgtctgcagcaggtcctgcgcaacctgctctccaacgccttcaagttcaccgagacgggcagcgtctcgctcaggatcggctcggccgagggctcgctgctgcgggccggaagccagtggatggccctgtcggtcaccgataccgggatcggcatcgccgaggacaagcagcgcatcatcttcgaggcgttccagcaggccgacgggaccacgagccgcaagtacggcggcacgggcctcggcctcgcgatcagccgcgagatcgcccgcctgctgggcggcgagatcgtggtggagagccgtgtcggcgcgggcagcaccttcacgctgttcctgcccgtcgtgccgccggcccataccggcacggctcgcgcgccggaggcctccgacgggaacggcaccgccgcgttgatcgggcgccagcccaacgccgcgatggcgctctcggcctcggcggacgaccgccacgccatccatgcgggcgaccacatcgttctcatcgtcgaggacgacgcgatgttcgcctccgtcctcctggaactcgcgcgcgagcgcgggttcaagggcctgatcgcgcaggacggtgcgggtgcgctgagcctcgcccaccggttcaacccgcatgccatcaccctcgatatcggcctgcccgacatggacggctgggccctcctcgacctcctgaagaacgatccccgcacccggcacatcccgatccacgtcatctcggtcaacgacgagaagaagcgcggcctgcgcgcgggagcgttcggcttcctcgagaagccggtcgagcgcgagggcctgctgcgggctctcgagcgctcgaaggagttcatcacacggccggtgcggaacctcctgctcgtcgaggacgacgagaaccagcgcgccagcatcacggcgctcctcggcgaggagaacgtgaagatcttcgcggtcggcaccgcgtcggccgccctggaagccctgacgggcgggcggttcgattgcgcgatcgtcgatctcggcctgcccgatctcggcggttccgagctgatcgagcggatccgcgcctcgcaggatggggaggagctgcccatcatcgtctatacgggacgagagctgacgggggccgaggagcagcacctcaggcagaccgcctcgaccgtcatcctgaaggacacgcgttcgtccgagcggctcctcgacgagaccgccctgttcctgcaccgggccatcagccgcgtccccgtcgatgatcagatcctgatcgagcgcgcggaatcggcgtccctgcagggatgccgggtcattctcgtggacgacgacctgcgcaacatcttctcgctgacgagcgcgctggagcagcacggactcgcggtgctgttcgcggagaacgggcgcgacggcatcgcgctcttggaggcgaacccgaacatcgacgcgatgttgatcgatatcatgatgccgggaatggacggctacgagatgattcgggagatccgggccaaggccgccttccggagcctgccgctcatcgcggtcaccgcaaaggcgatgaagggcgaccgcgagaaatgtctcgaggcgggcgcctccgattacgtctcgaagccgatcgacatggaccagctgctcgcggtgctccgggtccagctggaacggcgcaacgggccccgggccggcgcggcagccagggagggcgcgcaggagccggcgcgcacggcccagtga

SEQ ID NO: 9091 - DNA, 1128 bp, Methylobacterium sp.
gtgctcgtcgtcggaggcgggggcgccttcggcagccgcctctgcgccgggctcgccgcgacgctcgcgtgcgagatcgtgctggccggccgcgaccgcgcccgcgccgagcgggcctgcgcggcgctgcgccggcatgatcccggtgccgccgtcgcggcggtcgcgctcgacgggtcccgggcctcggccggcacgatcgccgaactcggcgttgcggcggctgtcgatgcggccggtccctaccgccccggcgcctacggcttcgcccgggcctgcatcggggcaggcgtcccctacatcgacctcgcggatggccgcgccttcgtggccggcttctccgacgcgctcgatgccgaggcgcggcgggcgggcgttccggccctgtgcggggccagctcgacgccggccctgtcgaacgcggccctcgacgcgatcacccgggactggcaggcggtgacggcggtcgaggtcgcgatctcgccgggcaaccgggcgccgcgcggtctctcggtcttcgaatcgatcctcgcctatgtgggccggccggtgcgggtccggcggaacggcgcctggacggaggcgccgggctggggcctcacgcaaacccggccgatggccgggctcgggcgacgccgcctgtcgctctgcgagacccccgacctcgacatcctgccggcgcgccggccggagctgcgcacggccctgttccgggccgggctcgaattgcggatcctgcacgacggcctgcgcctcgccgccctgccggtccgcaccggcctgctgccctcgctgcgccccttcgccccggccttccggcaggccgcggcctggttcgagcgcctgggttcggaccggggcggcatggaggtcgtggcggaggggcgggacgcgacgggccggccgacccgggcgacgtggttcctcgtggccgaggcgggggacggccccttcgtgccgaccctgccggcgctcgccctcgtccgccggatcctcacgggcgcgccgccggccccgggagcccgcccctgcgtcggcgaactgacgctcgccgagatcgaggccgagatgcgccgcctgcgcatccggaccggcatcctgacggagccggccgcgccccggccgtga

SEQ ID NO: 9092 - DNA, 1185 bp, Methylobacterium sp.
gtggccctcgatttcggcacgcttcagatcgcgagcatcgtgagccggatcgccttcacctccgtcttcctggtcacgctgctgcggcatccgcgcgagatctacttcgcggtctgggcgagtgccctcgtcagctcgctcacggcctcgttcctgatgctgggggatccgccggggattgcgctggcggcggccaaaggcgcggtcgtctacgtcctgtacggggcgagcctcgcggtttcctgggtcggcctgcggctcttccatgagcggcccctccatctcccggaggccgtcacgctggtcctggggcccggcctcctctacggcggcctgatgtggctcggcgtctcggtggaatggtgcttcacggccctgttcggaagcctcgccgtcagcacgggcctgtgcgccgtcgagatcgtgcggacgccggtcaaggagcgtctctggacgcagtacgccgttctctcgggcttcgtcggctacaccgcgatcttcctcgtctcgatcctcgccatccacttcgcgagcgagcgcatctccacgccggagagtggggtctacgccctgctgttcgaccagtggtgcggcgtcttcatccaggtcggatacctcgcgatggtgagcgagcgcgcgcaggtgaggatcagccgcctggccgacacggacccgctcaccggtctgccgaaccggcgcggccttgccgcggcgctcggccggagagccgccacggggagccgcgggctggccggcgccgtcctgctgatcgacatcgaccacttcaaggccatcaacgacacgtacgggcacgaggccggcgaccgggtcctggccgacgtggccgagcgcctgcagggtgtcatgcgggcggccgacatcgtcgcgcgctggggcggggaggagttcctcgcggttctcgagggcgccgacggtgccgtgtccctcatggtcgccgagcgcctgcgcgaggccgtgtccggccgcaccttcgcgctggacggggggcccatcgccgtcacggtgagcatcggcgcctccctggtggcggccggcgagacgaagatcgacgccgccgtcgcccgggccgacacggccctctacgcggccaagagggacggccggaaccgggccgtcctgaacctgcccgagcccgcccggcaggacggcgggcgcgtcgcatga

SEQ ID NO: 9093 - DNA, 1428 bp, Methylobacterium sp.
atgagacgcacgccccgcttcagggatgtcctgccggccctgctgccgaccctgctgctgagcctgggttcgatgtcgcagccggcgcgcgcgcaggaggccggggcggacgcccccgccctcccctacgcctcgtcgccggacctgcgcgccgccacggtcgcccgcgaggtgcgggccctgcgcgcggcgaacccggtcgccgcggccgagaccgcgcgggagatggccaagcacgattacgacacgatcttccgcagcctcgtcgccggcacgccgctccgtgcggaggatgcgggcgacgtgctcgccgccttcatcgtcctgcaatggatggtcgccaacgacgcgaccgccgagccgagcccggccgccctgcgggcgatccggagccggttcgtcgcgccgatggccgggcgcccgcccctgtccgagcccggcacccgcgcggccttcgccgagcaggtgaagctgcgggcggtgctccaccatgcgggctggaaggcggcgaagcagctcggcgtgatgccgcgcttcctcgccggcctgtcgggcgagttcatccccgcggccaagctgcaagcgctcgctctgaccgatgccgggctggttccgaaggggcagacggaccggcaagcggagcgtcccgcgcgcatccccgtcgaggggccgccgcgggtggccgatgcccgcccggcgccagctcccgccccggcggcgccggacgcctccgctccgccgcgccacgccgccaactgggacgcggtcgagggcgtgtatttccgctccaccaccggtttcggcgtcggcggcctgatgatcgtcgacttcgagccgctgatcgtcctgcgggacgggacctactacgagatcggcgacacggccctggaggatgtcgacctcgcggcggaacgggcggcgcggccgacccgcttcggccgctgggcgcgcaagggggcgggcaagggggcggaaacgggcttcgtgctgacggattccaagggccgcgcgaacgactacgcgctcggcgacggcagcttcttccgggccttcccggcgaccgccgacgagcgggtgggccgcgcctaccggcgcctgtcgggcggcggcaacagcgcgatgggcggcgacgtggcggtcgcggtggagagccgctacgatttccgccccgacggcagctacgggcgcggcggctcggtcggcgcggtcaattccggggcgagcaccggcgtcggcacggcgatcggccgccgccgtgccccggagggcgggcgctacgccctggatcgccacaccctcaccctgaccggtgcggacgggcgcagccgccgcctgttcttcgcctacggctcgcggaacgatccgccggagatcgaccgggagatgatcttcgtgggcgacgacgtcttcacgccggcggaccgctga

SEQ ID NO: 9094 - DNA, 96 bp, Methylobacterium sp.
atcgtgccggtcgccatggaggagaagctgcgcttcgccatccgcgagggcggccgcaccgtcggcgccggcgtcgtcgccgccatcaccgagtaa

SEQ ID NO: 9095 - DNA, 96 bp, Methylobacterium sp.
atcgtgccggtcgccatggaggagaagctgcgcttcgccatccgcgagggcggtcgcaccgtcggcgccggcgtcgtcgccgccatcaccgagtag

SEQ ID NO: 9096 - DNA, 717 bp, Methylobacterium sp.
atgtccctgatcgtcagcccgagctcccgcccggcgccccccgccgcgtccccgaaccgggcgcgcgtcgccgccgccgcggtcgcgctctgcacgctcggcctcgccgtgccgggccgggcggcggagcccgcgccggagccggatctcgatcgcctgggcgcgggcagcatcctggtccgcggccgggtcgtcgggtccataccggtcaaccagcattcccgggtggagccgatcggcggccgcgtcgtcacccccgcacgggctctgccggacctggacgcgacctacttcctcaccgaccatttcgccctcgcgggccaggccggcatcgtctcgacgcggacctccatccgcgggtcctttgtcggcaacctgccgatcggcgacacgtggagcgccagcctgacggccgcggcccagttccacatcccgctcgagggcggcttcaagccctatctgggtgcgggcatcggctacacgatcccgttcgcctacgagccggcgaagccgttcgtcacggtgatgaaggccgacccccagctggggccgatgctccaggccggcatcgactaccatctgggcgggcgctggtacgcgaacctggagttcaagcagatcttcctgccgcccctggtgtcccgcatcgggcccggcagcgcgacggtgaagctcgacatgatgatcatcggggccggcctcggctaccgcttctga

SEQ ID NO: 9097 - DNA, 1368 bp, Methylobacterium sp.
atgccggccgtgcggatcgaagagccgacgacgctgccggtcacgaagcaccgcctcccggcccagcggtctcccgccccgcgcgcgatccactggcggcgccacgccctggcgggctacgcgctcatcgccgcgaccttcggcgtcggcggcctctgggccgccctcgcgcgcctcgaccgcgccgtcatcggtccgggcatcgtcgtcgtggagggccatcgcaaggtggtccagcacctggagggcggcatcgtccaggaggtcttggtccgcgacgggcagagcgtccggacgggcgacgtcctcttgcgggtcgatcccctgcagtcgcgcgcgagcgcggacctgttgcggggccagctcgacgccgccctgatcctggaggcgcgcctgcgggccgagcaggaccagaccgccgatctcgaactcccgcccgagatcgccgcgcgccgcagcgaggacgcggtcgcgcgcatgatcggcgaccaggccagccagctgtcggagcggcgggcctccttcggggctcagctcgccctcatcgagggcagggtcacacagttcaggaccgagatctcggggctcgcggtcgagaagtcctcggtcgagcggcaggtcgcactgatcaacgaggaactggcgggcctgcggaccctgcgcgagaagaacctcatcccgctcacgcgtgtgcttctcatggagcgcgagcgcacacgcctcgaaggcgtgatcgggcgatccgtggccgagaccgcgaaggcgcagaacggcatcggcgaggcccggatgcaggccacgcagctccggcagaagcttcaggagacgctgacggcccagttgctggagacccggcagaaggtgaccgagctgcgcgagaagctggtcgtcgcgcaggacgtgctgcgccgacacgcggtgcgggctccccacgagggcgtcgtccagggcctgaaggtctacacgatcggccaggtcatccgatcgggggagccgttgatggagatcgtcccgacgaacgacaggctggtgatcagcgtccagttcgccccgaacgatctcgaagccatcaaggccggcatgcgggccgagatcaggttcccggcctttcagacccggcggatgccgccgatcttcggaacgctcgcgacggtctcgcgcgatcgcctgatcgatgaagggaccaggcagccctacttcgccgggaccgtcgagatcgacgagcgccagctgccggaggcggtgcggccgcgcctgcacgccggcctgccggccgagatcgtcgtctcggccggcgagcgcacggccctcgactatcttgtcgcgccgttcttcgacgcgctggggcgcggcttccatgagcggtag

SEQ ID NO: 9098 - DNA, 309 bp, Methylobacterium sp.
gtgctggagctgcgccgtgagggcggccggtacctgaaggaactcagggaggcccgcggcctgtcgcagagacagctcgcacaactggtcggcgcggaatactacacgttcatctcccagctggagacggggcgtggccggataccgcccgaccgctaccgcgcctgggcggatgccctgggcatgccggccaaggacctggtccggaacgtgatgcgcttctacgatccgctcacctacgagatcctgttcgacgccgagcccgcctcacggccaccgccgaaccccgccggcacgcaccgggcctga

SEQ ID NO: 9099 - DNA, 1749 bp, Methylobacterium sp.
atgcaggcggcgctgaacgacgggctccgcgcgatgcggccggtcctcgtgaccgccgtggtgttcgggttcttcatcaacctcctgctcttcgtcagcccgctctacatgctgcagatctacgaccgggtcctgcccagtcgcaacgagacgacgctgatcggcctcaccctgatcgcggctttcggcctcgcggtctacgcggtgctggagatgctgcgcgcgcggttgctggtgcgcggcggcatgatcttcgaccaggagatcgcggacccgatcttcgatgccgcccatcgcgggacgctgctcaggcccagcgcgcagcacgagacggcgctgcgggacgtggacgtcctgcgcgagttcctgacgggcagcggcaccctggccttctgcgacctgccctggacgccgatcttcctcgtcgcctgcttcgtgctccacccctggttcgggtggatggcgctcctgggcggcggcgcgatcctcggcctgaccctcctcaacgagatcgccacccgcgggctgctcgacgcggccaaccgcgcctcccgggaggccggccagcaagccgcggcgaccttccggaacggtgaggtcctgcaggccatggggatgctcgcggacctccgcgggctctggcggcggcgccacgacgatgtgctggttcggcaggccggtgccagcgaccgggccggcctcatcgtggccgcgacgaagttcgtccggatgcttctccagacgctggttctcggggcgggcgcctatctggcgatccaccgggagatctccgccggatcgatgatcgcggcctcgatcatcatcggccggacgctcgcgccgatcgaggccgtcgtgggcaactggaaggggttctgcgccgcccgcgtgagctatcggcgcctgcgcgacctcgtcgccctcgccgggccggagatccgtcgcgtgacgctgccgcgtccgcgcggcctcatcgaggccgagaacgtctcggtcgcggcgcccggctcggcgcgcccgatcctgaccgatgtcagcttccgcctggagcccggcagcgtcgtgggcatcatcggtccgagcgcggctggcaagtcgacgctggttcgcgccatgacggggatctggcccctcgtcgagggcgggatgcgcatcgacggatccgacctgcgccactgggatccgcaaggtctggggcgccacgtcggctacctgccgcaggacgtggagctgttcgacggtacggtggcgcagaacatcgcccgcttcgccgacgcggaggatgcggacgtgatcgcggtggcgcagcgcgcgggctgccacgaactgatccaggccctgcccgacggctacaacacagtgatcgggaagtccggaatcggcttgtcgggcggccagcgtcagcgcatcgcgctcgcccgggcgctgttcggcgatccgagcctgatcgtcctcgacgagccgaacgcgagcctcgatcagccgggcgaggcagccctgatgcgggctgtggcggatctgaagcggtcgggaacgacggtcgtgatcgtgacgcacaagctcggtctcctggccgaggccgaccgtatcctggtgctgggcggcggcggcctgcagacgtgcgggagcgcggagcacgtcctcgggcagatgctcggcccgcgtccgaacccgaccctgctcccgaccggcatccgcgcggcgcaggccggccatcagggcgccgacgcgcagcggaacgcggggtaa

SEQ ID NO: 9100 - DNA, 996 bp, Methylobacterium sp.
atgcaatccgaagtcgcagaaactgacttctcacaaatagaagacgatgccgcgcggcgggaggcgtggatacgcgcgatctccccgatctacgtcgcggagatcgacaaggccgtcccggtcccacgcaccgtccgcttccgctcatggcggctgggcaccgtcctcttcaacgagatgtgcgcctcggcccaggcggtcgagcgcacgccctcgcagatcgcgatgcagggcgtggatcacgtcgtcctgcgcctctacacctccggtcggacaggtatcgacaccgctgccggcgaggcggaaatcccaacgggcgggctcgtgctcttcgacctctcgcagcgcgcccgctccgtcacgcacgagatgaccggcctcaacctggcaatcccgcggcggctcttcgacagccgcgtcggcgaactctcggacctgcatctcggcgttttccggaaggaggccccgttgatccgcctgttgggcaaccacatgcaccaggttcggaacagcatcgacggcctggacgagcggcagcgaagcctcatctcctcggcaacggtcgcgctatgcaatgccgccctcacgcccgcctcggacagcgcccacaaccgcccggcggtcgcggccatcgagatccgccagttcatcgaggcgaacctcgcccgagccgacctcggcatcgagacgctctgcgcccgcttcgggctgtcccgcacgccgatctacgccttgttcgagcccgatggcggggttgcgacctacatccgcaaccggcgcctcgcccgggccatgcggatgctttcgggcgtggaagcagggccgccccgcatctccggtgtggcctatgcctgcgggtacgagaacctgaaatccttcagcaaggccttccacgcccgctacggcgtgaatccgcgcggtgttggtgcgggccatcggaccgatgcccactgggaaagcggcacgacgctactgtcctggatcaaggagctataa

SEQ ID NO: 9101 - DNA, 966 bp, Methylobacterium sp.
ttggaggatgagcggcagcgtcgggaggcctggatccaggcgatctcgccggtcttcatgccgacgctggatcgggacacgccggtcccgcgagaggcgggcttccgctgctggaacctcggccggattctgctgagcgcgatccaggcctcgccgcagacgatcgagcggacgccgtcccagatcgcgacgcagggcgtcgatcacgttatcctgcggctctacacctccggtcgttccagccttgacacggccgcgggcgacgcgacgatcgccccgggctcgttcgtgctgttcgacctgtcgcagcgcgctcgctcgatctcggccggcatgaccggcatcaacctctgcattccgcgccgcctgttcgacgggcgcgtgggcgaggtctcggaccttcaccgcggcctgttcgagcagcgtgggcagccgctgctccggctcctctccgaccacatgcgcaacacccgacactgcctcgacacatcggacacggcgcagaaggcgctgctggcctccgccacggtcgcgctgtgcaacgcggcgttcgcgccgccctccgacagcgcacacaaccttcccgctgtcgcggcgatcgagatccggcagttcatcgaggcgaacctcgggcgcgtcgatctcggcctagagatgctctgcgcccggttcgggctgtcgcggacgcccatctacgcgctgttcgaggcggacgggggcgtgatgacctacatccgcaaccgcaggctcgccctggcgatgcgcctcctctccggggtcgaggagggtggcccgcagcggatctccggcgtggcctacgcctgcggctacgagaacctgaagagcttcagcaaggccttccacgcccgctacggcgtgaacccgcgcgacgtcgacgccgcgttccggatcgaggcgcgccgggagaccggggcgaccctgctgtcatggatcaaggagctgtag

SEQ ID NO: 9102 - DNA, 936 bp, Methylobacterium sp.
atgtcgtcctacttcttccggcagcgtgagagcgcgtcggccgatgcgctcggtcccgaacccgatctcgccgtgctgcaacgggaggtccggcgcctgcgggagatgctcgatctcaactccgactggatctgggaggtcgacgcggccggccgctacacctacgtctcgctccactgcctgccgctgctcggctacacgccggaggagatgctggggcgcacgcccttcgacttcatgccgaccgacgaggccgcccgcgtgggcgcggccttcgcggcgatcgtcgcggagaagcgcggcttctcgcatctcctcaaccgcaccatccggcgcgacggccggatcgtggtgctggagaccagcggcgtgccgctgctgaacccggacgggagcctgcgcggctatcgcggcatcgaccgggacatcaccgagcgcgaggccgcggccgagcatctgcgccacctcgcgcggcacgattccctgaccgagctgccgaaccggctctacctgcgcgaacatcttggcgcgaagctcggcggggaagcggcgggatgctccgtcctggccatcgacctcgaccacttcaagccggtcaacgaccggctcgggcacgaagccggggacgtggtgctcaaggagatcggccgccggctggcggagctggcggcggcgcgcgccgtcttcgccgcgcggcccggaggcgacgagttcgtcgtggtggccgatgccctgccgtgcgacgcggccgacgacttggcggccgatctgcgggcggtgatcggccgaccgatccggctcggcgacgcgacggtccgggtcggcgcgagcgtcggtaccgcccgggcgcgggcgggcgacacggtcgacaccctgctggccgcagcggaccgggcgctctaccgtgccaagtccgggcccggcgggggagcctga

SEQ ID NO: 9103 - DNA, 783 bp, Methylobacterium sp.
gtgggccgcagcgccgaggtcttcgcggacgcgccgggccgcgtcctcaagctctacgtcgcgggatccgatccggaggcgatcgcggcggagttcagcgcctcgcggctcgcccacgcgcagggcctgccctcggtgcgcgcgcacgcggtggtcgcgcgtggcgagcgcaccggcatcctgttcgaccgggtcgagggccgcaccctgctgcggcactgcggcgtgagcccggtccgcgtcatgccgggcttccgcgccctcgcgcttctgcatcggcgcatccatgcacgctcgggcgccggcctgcccgaccagcacgcgatcctgcgggagagcgtcgcgcgggcgcgcatctcggacggcgcgcgtatggccgcgctcgcccggttggagcgcctgccgcggggtgaagccctctgccacggcgacctgcatcccgagaacgtgctggtgacccgcgacggctggcgcgtggtggattggcagaaggccgtggcggggcacccggccgccgacgtggcacgcaccgccatgctcatccgcttcggtcgcgtggtgggcgggcccggccgggcggccgcgatggcgcgcctgcgcgacctcgtcgcgttctggtacacgctctgctaccggcaggggccgggtccgcggatcgggctcgccgatatccgggcctgggcgctcccgatcgccgccgcgcggctcgccggccgcgtcgccgagaacgaggatctcctgcgcgcggaggtcgagcgcctcgccgccgcgaagcagggctga

SEQ ID NO: 9104 - DNA, 507 bp, Methylobacterium sp.
atgcacgacacatcgccgaagcctgagcgcccggatcccggctactcgcaagaggactgggacgaggtgtccgacaacccggagctgaccgatgccgagctggccgagatgcgcccggcccacgaggtgcccgaggtctacaacctgctccccaagcgcgggcgtgggcggccgaagctcgccgacgccaaggtgaacctgacgctccgcatcgatccggccttactcgacgcctacagggcgaccggcgcgggctggcaggtgctgatgcacgaggctctggccgcgggccgcccggagatggacgaggccgaggcgatcgaccaagccgcgcgtcggaccgccaagcagaaggccgcggatgccagggccacccgcagcgggtcctatgaggtggtcgggccgaggagtggcaccgtcgcctccgggaagagcagcacgcgggccggcgccctctcctcgtccagcacggcacccggcaagcggccgggcaagaagtcggcctag

SEQ ID NO: 9105 - DNA, 318 bp, Methylobacterium sp.
atgccgaagcctgagcacgcccccggctacgtgccgaacgctgcctacacgcaggcggattgggatgcggtgtcggacaatcccgctttgaccgacgccgaactcggccaagcccgccggggcaccgacgggatgccgcccgcgattgcggcagccttccggcgcgggggacgcccgagatccgaacagcgcaaggtgccggtcacgatccggctcgatgccgagatcgtggaggccttcaaggcgacgggccccggctggcagacgcggatgaacgacgcgctccgccgggccgcgtgcgacctggacgcggcctga

SEQ ID NO: 9106 - DNA, 249 bp, Methylobacterium sp.
ttgaacgccaagatcgtgctcctggtcgtcggcctcctggccggcggcctggtcggctacctgacgcgtcccgaggcggccgagatcaagctcggccccttgagcgtcgagattcagggcgaccggccggccggggcgcagggcggcacgctgaccttgggtcagctccagcatgtcggcatcttcgccggactcggggctctgatcgggttcggcatcggcttcgtcgtcgacgggcgtcggcgctaa

SEQ ID NO: 9107 - DNA, 813 bp, Methylobacterium sp.
atggtgcccggcggtaccgagggccgcggcctcgggcgcccggaccggcaagccacgcgggtcgtgtacgatgctccgggagagccagcccatcgggagatctacgatgccatgcgcgagcggcgcgtgctggagcgcgtggcggcggccttcgacctgttcaagctgccccggcgcctgacctatcggctcacggggtgctccggagagcccaacgcctggtacgatccgcgcacccgcacgatcaccacatgctacgcgttgatcgagagcatcggtcggatcgccccgtcggaaacgtcgcccgccggcgtgtcgcgccaagatgcgatccgcggacccgtgctgcagatcctgttccacgagagcagccatgccctgttccatatgctgggggtgccgatcctcggccgggaggaggatgcggccgatcaagtggcggccctggtcctgctccacctcggccgcgcggatgcacgcgcggtggtgaacggcagcggctacttcttcgcggccttgggcaagcgcgagccgctcgaccggagcgccttcgcggatgcgcatggcctgtcctggcagcgcttctacaatctcgcctgcctcgcctacggttcggatcggcgccgctacggcgacatcgtcgagaagggattcctgccgaccgagcgcgcgagcgcgtgcgaggaggagtacggccaaatcgcccgcgccttcctggccctgctcggaccgcacctgcggatgccgccgcggcaggggcaggcgttgcggcgcgccctcgcgagggcgccgtcggcatccccgcgccattga

SEQ ID NO: 9108 - DNA, 561 bp, Methylobacterium sp.
atgcttattggctacgcccgcacctcgaccctcgaacaggacaccggccttgaagctcaggtccgtgatctgacggccctggggtgccagcggctgttccaagagaaggtgtcgagcgtcgcccctcgcaaggagctagagaccgcgctggacttcgcgcggtccggcgacacgctggtcgtgacgaagctggatcgtctggctcgtagcgtcagtcatctcggccggatcatcgagcgcctggaagcgaagggggtggccctccgcatcctcaacctcggggtagacacctcgacgcctaccggcaagctaatgctcaacgtgctcggtggcgtcgcccagttcgagcgcgagatgatgttggagcgccagcgcgagggcatcgcgaaggcgaaggccgccggcctttaccggggtcgcaagcctactgcccgggccaaggcggaggagatccgggtcctcgcccgcgacggcatgagcatgggtagcatcgcgaccaagctgggcatcggcaaaagctcggtccaccgtgccctctcggcgagggagcctgggaagtga

SEQ ID NO: 9109 - DNA, 564 bp, Methylobacterium sp.
atgctcgtcggatatgcccgcacctcaaccctggaacaagccgccggcctggaggcgcaggtccgcgacctccaggcgctgggctgcgagcgcctgttccgggaacaggtgtcctcagtcggggatcggccgcagctcgacgccgccctcgcctacgtgcgggacggcgacaccctcgtggtgtcgaagctcgaccggctggcccgctccgtcacccatctcggccagatcctcgacgcactaacggcccggggcgtggctctgcggatcgtcagcttgggcgtcgataccgccacccctacgggcaagctgatgctcaacgtgctcggcggcgtggcgcagttcgagcgggagatgatgctggagcgccagcgcgagggcatcgccaaggccaaggccgcgggcctctacaagggccggaaaccgaccgcccgggccaaggccgccgagatcgcggccctgtcagccgagggtctgagcatggccgccatcgccgcccggctcaacatcggcaagggatccgtccaccgcgtcatcggcaagacccgcacgcccaccgcctga

SEQ ID NO: 9110 - DNA, 1203 bp, Methylobacterium sp.
atgaccaccttctcggtgtcctggacggacgcggccggggctggcgccaacgcgaacgccgtgctgcagaccctgcaggccgcggccgattcttgggggcgctggctccagggctacggcaacatcgagatcggggtccgggtgagcgaagcctcgggcaacaccatcgcgaccggcggctcgagctattactggaccggcagcgcctacgaggccgtgccgatgatcgagatccgcacgggcagcgatccgaacggggacagcccggacatcaacgtcacggtcagcgccgcctatatcgaccggctgttctacgatcccacgggccggcaggccgtgccttccacccagctcgacgcgctctcggtgctcacgcacgaggtcgggcacgggctcggcatcctctacctcgacaccagcacctacgcggcccatgtccggctcggcgacgcctcgaccttcgtcggcggcaacgcggtgcgggtcaacgggggaccggtgccgctcgattcgagcgagggccacgtctccgtcgcgggcgacctgatgaaccccacgatctcggccggctcgcgccgctccatcagcgatctcgacctcgcgatcctgcaggatatcggcgcgccgatcgcgaccgggcgcgccgacgccgtcacgctcggggcgcgcaacgacatcttctcggccttcgccggcaacgacacggtgacggggggcgagggcgccgacgtgatctacggcaaccagggcagcgacgtcctctacggcaatccgggggccgaccggctgttcggcggcctggacaacgacagcctgttcggcggcctggacgcggacatggtctacggcaaccagggcgccgacgcggtctacggcaatttcggcgacgacaccctgttcggcggccagggcgacgacacgctctacggcggccagggcgacgacgtgctcaacggcaatctcggcaacgacgtgctgatcggcggtctgggcgcagaccgtttcgtcttcggcgcgaattcgggcgccgacctgatccgcggcttcagccagcagcagggcgaccggctggcgttctcgggccagagctatgggctcggctcggccggcaacggcgacgcgctgctcaccctctcgggcggcggcacggtccagatcgagggcgtcaccgcggcgcagttcggcgcgggctatctggtctga

SEQ ID NO: 9111 - DNA, 240 bp, Methylobacterium sp.
atgcgcatccttctctccgcgacgatcctggcctgcgccgtctccgccctctgcctcgccgcgccaccggcgcgggcgcagggcgtgccgccgaaccccttcgcgtcgaactatccctccgcgccgcccccgccgcacatcgtggaacagcgtgagcgccggatggcacgggcgcggcgccagcgcggcgcgttccctgcggagccaggattgctgccgcccgcccgcgtcccgtactga

SEQ ID NO: 9112 - DNA, 861 bp, Methylobacterium sp.
atgcggatccaggatgcgtctcgggagggtgccgttcaccgcccggcggacgggcagggcgcgccgcgccgcgccgcgcaggctcggctcggccgctcgggcctcgtgctggccgcaggcctcgccctcaccctcgccgcgccggcccgcgccaacccgctgaccgaggtgccgggcgcgcgggccgcccccgaggaagcccccccgccgcgcgacgccgaggccgcgcgggcggaggccgaggaggcgcgcgccgcgaaccccagcgccaacgcgatcatccgggcgctcgcgcccttcgcggacggcaatccgggcgcgcctgccagaccgctggcggtcgcccccgacgacggcggtccgaccgtgcgggtcgatcccgcccgctcggtcgatctcacggtgttcttcgcctacgacagtgcccgcctgaccccggaggcgcgcatccagctggagccgctgggcgaggccctgcgtgccagggacctggccggccacggcttcctcatcgccggccacaccgacgcgtcgggcggcctcgcccacaaccggcgcctgtcgctggcccgcgcgcgggccgtgaaggcgcatctcgtcgagacctacggcctcgcgccggagcgcctgcgcgtccatggctggggccccgcgcggccgaagaacccggccgcgcccctgtcgcgggtcaaccgccgggtcgaggtcagcctgatcgcgcccgcccgcagcggcgacctccgcttcgtcctgccggtcgccgggcaggcctgcgccggtctcgccgacccgcgcgcccgcgtcgcgctcgacctcgacgatttcgacgcgggcccgacgccgcgaccctgcgccgaatga

SEQ ID NO: 9113 - DNA, 474 bp, Methylobacterium sp.
ttgggggccgacctgcgtctgtcgctctacacggacttctccctgcggctgctgctgtatctcggcgcggtgaaggcggatggctgggccacgacgccggacatcgcccggaccttcggcatctcggcgcaccacctgcacaaggcggtccagggcttggtgcgggcgggcttcgtcgtggcgaagcagggccggaccggtggcgtgcgcctcgcgcgcgagccggccacgatccgcctcggcgccgtcgtggcggaactggagggcaccggctgcctgatcgattgcgggcggggaccctgcccgctcgccgcgcattgcctgatcaagcaagcgctcgacgccgccgagcgcggcttcatccgggaactcgaccgcttcaccctggccgacgtgctggccgaccggaccggggcgaccctgggcggcctgatcgcggccgaccgggcgcggcaggagacgccctcggcctga

SEQ ID NO: 9114 - DNA, 423 bp, Methylobacterium sp.
atgttcgccggtgaactcgctctcgccgccgcggcggccttcacgggcgcggccttctacgtcagcgcggtcgagcacccggctcgcctccccctggcgcccggacccctcctccagcactggcgcccgagctacgcccgcgccacgcggatgcagggcggactggcgctcgccgcgacggcgctcggcctcctcgcctggggcacgagcggcgatccgcgctggctcctcggcgcgctcctggccttcgcgaactggccctacaccctcgcggcgatcatgccgaccaaccgtgtcctcggcacgatagcgcccgaggacccgcgcctgcgcccgctgatgctgcgctgggggcggctgcacgcggtgcgcaacctgctcggtgcagcggcgacagtggccttcctgtgggcgctgcactga

SEQ ID NO: 9115 - DNA, 1257 bp, Methylobacterium sp.
gtgccgacggccggcttcattcatctcaaagtcgcccaggagatccgtccggtcatcgtcgaactcggcgccgatccctgcgccctcgttgccgaggccggcctcgatccgggactcttcggcggcgagcgccgcttcgtctcgttcaccgccctcggacgcctcatggcgctcgcggccgctcggacccgctgcccccatatcgggctgctcgtcgggcagcggacggccttgtcggcgctgggactgctgggcgtcctgctgcgcaactcgcagaccgtcggcgatgcgctgcgcgccctcgaggcgcatctgagcgtgcgggaccagggggcggtcatcggcctgggcgtccacgatgacgtcgccgtgctcagctacgcgccctacgagcccgaggccgagggtgcggctctccactcggagagggcgctggccaaggcgatcaacatcctgcgcgcgctgtgcggacccgaatgggcccccacggaagtgctgctgccgcgctcgaccccgcaccagaccgagccttacggggcgttcttccgcgcgcccgtccggttcgatcacgagatggccgccctcgtgttcccggcggccctcctgcagaagcggatcgccggcgccgacccgtgcctccgcaggcgggcggaggagcgcgtccgtcggctcgaggcggtggagcccggtacgctcacggaccagatccgccgataccttcggaccgcggtcacccggcagcgctgcagagcggcgcgcgtggcacgccaaaggatggtgcatcgtcgcaccctgagccgccgcctgaaggccgagggtacgagcttccggcaactggccggcgaggcgcagttccgggtcgcgcgacaattgctgggcgataccgggatgagtatggcgcagatcgcggccgttctggacttctccgagccctccgccttcacgcatgccttccggcgctggtcgggcgtgacgcccaccgcctggagacggctgaaccgtgcggagccgatgggcgacgaggtccgcacggcgcggcacatctgcggcgcgaggggcgatgtggcagcgcgcgccagtccgcgcgcgggcgactcgctccggcaaggcgaactccggcaaggcgagttccggcaaggcgaactccggcaaggcgagcgttcaggatgcgcgggccaccgtcccccggacccctatcccatcggtccggacctcggcccggcgccgcagcgacaaagggtcgattgcccgacatga

SEQ ID NO: 9116 - DNA, 1077 bp, Methylobacterium sp.
atgccgaagccggtcgacgacctgcgggcgggcgcttgcgaattctctccctccccgcgcgggacggaggacggggatcccatggatctcgtccacggcgccgccgtccgggcgatccgcgacgtcctgctcgccctcgatgtcgagccggatgagttcctgcatcgcgccggcgtcctctcacggggcggcgccgtcccggatgccggctcgttcgccgcgctcggccgtctgacggcgctgtgcgccgagcggacgcgctgcccccatttcgggctcatggtcggccagcgcacgaccctggcatcgctgggcctgctcggcgtgctgatgcggcactccgggacgatcggcgacgcgctccgggctctcgaggcgcatcacggcctgctcaaccgcggcgccgtgatcagcctgtcgacgaacggtgccctggccatgctgtcctacgcgccctacgagcccgacatcgaggggatcgggctgcattgcgagcgcgcgatcgcggccctcacgcaggtcacgcgggccctgggcggggcgcgttggacgcccgatgaagtcctgctgccgcgcctccagccgaccgaccgccaaccctacaccgccttcttccaggcgccggtccgcttcgatcaggagatcgcagcgctcgtgtttcccgcgagcctgctgcggcaagcgattcgcgatgccgacccgcggacgcgccagagcgtcgagcggcgtatccggcagatcgaagcctccatcctggcggacgtgaccgatgatctgcgccgtcgtctgcgcgtgacgatggccgagcggcacctgagcgccgagcaggtcgcccggaccatggccatccaccggcgtaccctgggccggcgcctgagggcggagggcacctccttccggctggtggcgagcgagacccgccttgccgtggccacgcagctgttgatcgataccgacctgagcctcgcgcagatctccgcaacgctcgagttctccgaaccctccgccttcacccacgccttccggcggtggacaggcacggcgccgagcgtgtggcggaaggaaagacggggctag

SEQ ID NO: 9117 - DNA, 1338 bp, Methylobacterium sp.
gtggcggaggcgctcgccctcccgtccgtgctcgccacgatgctgcgcagcctgatcgaggcgtggccggagcaggtctacgcgcagccgctggtgaccgcgcgcttcctcggccagcgcacgacctatgtctgcgatcccctgcacatccgcggcctgctggtcgatcaggccgatgccctcgcgcgcgagcccttcatgatgcgcgccctcgtgccggccctcggcaccgggatcctgacggcggacgggccgcactggcgcgagcagcgcaggaccgcggccccgatgttccggcccgagcggatccgcggcttcgtgccggccatggccgcggcggcgcgcgccacgcgggcgcgctggctccggggcggcccagccgacgggatccgcgacatcctgccggagatgatgcgcaccaccttcgacgtcatcttcgccacgatggtctccggcgacgacgcgctggaagtcgagcccttcgggcgcgcgatcgacgcctaccttgcccagacgagctggaagatcgcgctcacgatgctgaaggcgccggcctggacaccgcatcccggttggcgggccggcgcgcgggcggcgcgctacgtgcggggcgaggtcgcccgcacggtcgcgcggcggcgcgcgcgcggcgagccgggtgccgatcttctcggtctcctgctgcaggcggtggatccggagacgggggagggtctctccgacgcgagcctcgtcgacaacctgctgaccttcgtcgcggccggccacgagaccaccgcgctcgctctgacatggaccctgcgcgtgctcgccgatcatccggagatcgagcgccgggtgctcgcggagatcgccggcctcggggccgacctcgccgacgacccccgggccgtcgatcggctcgccttcacccgccaggtcgtgctcgaggtgatgcgcctgtacccgccggccccgctgatcgtccggcgcgcggcggccgatatccgcctgggcgacacggtcgtgccggccgggcaggcggtgcacgtgcctgtctacgccctgcaccggcaccgcctgctctgggacaggcccgatgtcttcgaccccgaccgcttcgcgccggggccgtcggccgcgcgcgaccgttacgcctacctgccgttcggggcagggccgcgcgtctgcatcggcatgggcctcgccctgacggaatgtctggtcatcctcgccacgctgctgccggccttccgcttcgtgccggagaggcccggcatgccggccgctcagttccgcgtcacgctgcggcccaggaacggcatgccgatgaaggtggtcgtgcgccatgacagttga

SEQ ID NO: 9118 - DNA, 678 bp, Methylobacterium sp.
atggttctccacggctcagagggggcgtggtcggggtacagctacctgacggctgccatcttggcggctcatggatttctggccgtcccgtttggctattcggtcggcggtgacgtgtggaacgcgggcgacatccgagaggtcgccgtggaccggaccgccgaggccttggccatgcttcacaatctgccgctgtcgagcaaggtcggcctctacggtgtctcccgcggagccgaacacgccttgctcgttacctctttgatggtgcgggacggcgttcccggcctgcctgatgccgtggccgtgcacgccgcgccggacgtgatctgcggtgccttcatcgctgcgagttatcgggacagcggagatcccgggtggcggtcttgggacccggcggagcgggcttggacgtggcgcggttcgtcagacgctctgctgccgacgatgccgatcgagatcgaacggtatgccggccctctgttcctcagtcacggcacgctggatgcgatgtggtcggtggcgatgacgcaacggctcgaagcacgcctgctgcgggcagcgcgaacccccgaagtgcatctgctggcgggtcaggaccataacccgcatggcgaggatgagaacgagcaccaccgcaggctcattacgttcctgcggcaagcgctgggcgccgcttag

SEQ ID NO: 9119 - DNA, 2733 bp, Methylobacterium sp.
atggcctataccctgcagatcctgcacgcctccgactgggagggtgggttgctcgcgacgcgccgcgcggcgaacttcgcggcgatcgtcgacaagctggaagatgccacgccgaactcgatcacgctctcgaccggcgacggctggatcccgagcccgttcttcatcgcgggcggcgacccgcagatggccgcgacctacaacggcgtctacaaccagctctacgggctgaacgccgccaccggctaccgggcgctcaccgcctcgccgggccgggccgacatcacgatccagaacatcatcggcgtgcaggccgcggtcgtcggcaaccacgagttcgatgcgggtccggccgaggtcggcaacatcatcgggtcgagcctcggcagcgccgcgggtccggccgacgacacctgggtcggtgcgcagttcccgtacctgtcggtcaacctgaactatgcccgcgaagccgccctctccggccgcgtcgcgccggacgggctgaacgcgaccttcgcccagaccggtccgaccgcgacgcagaccggcaccggctccgacaagctcgcccgctccgccatcatcaccgagaacggcgagcgcatcctgttcgtgggcgccaccacccagctcgaggcgcagctcacctcgctcggcaacgtcaccctcgacggcgtctcgggccgcgacgacatgcgggcgctggccgaccagatcaacgccgaggtcgaccgccagctcgcggccaatcccggtctcaacaaggtcatcgtcggcacccacctgcagcagctcgccaacgagcaggcgctggccccgcttctgcgcaacgtcgacatcctgatcggcggcggctcgcacacgctcctgtcggatgccaacgaccggctgctgccgggcgacgtctcgggcggcgcctacccgcagttcttcaccaacgcgagcggccagaccctcgcgctggtcaacacggcctccgagtacgcctatgtcggacggctgaccgcgaccttcgacgaccggggcaacctgatccgcgacgcgatcgaccctgcgacctccggggcggtggcggtggacgacacgaccgtggcgcagctctacggcgcgaccgctgcggccttcacgccgggctcgaagggctacctcgtgcgcgaggtgatcgagggtctcgacgccgacaatgacggcgtgcaggagacggcgggcatcgccgacatcatccgtcagcaggacggcaacatcctgggccgctcctcggtctacctggagggccgtcgcggcgaggtgcgcaccgagcagaccaatctcggtgatctgtcgagcgacgccgccctctggtacgcccagcaattcgacggcggcaccgtggtggccctgcgcaacggcggcggcatccgcgactcgatcggctcgttctcggcgacgggcggcggcgcggcggaactgccgccggccgccaatcccgaggcgggcaagcgggcgggcgacgtctcccagctcgacgttcagaacgccctgcgcttcaacaacaacctctccctcgtcaccgtgtcggcgggcgagctggagcggatcctggagcacgccgtcgccggaaccgcacccggggccaccccgggccagttcgcgcaggtctccggcatcgcctacgccttcgacgcgacccggcaggcgcaggttctcaacggcacgaccggcacggtcgccaccgagggccagcgcatccgctccgccgcgatcacggaccgcgacgggcgcatcgtcgatgtgctggtgcgcgatggccaggtcgtgggcgacccggatcgccagatccggatggtcaccctcgacttcctggccaacccgtcctcgaccgcccccgcgcttgggggcgacagctatcccttcccggccttcggcgagaaccgggtgaacctgcacgatgccgtcgccgcgagcctgccgaacgccgcgaccttcgcggcccagggatccgagcaggacgccctcgccgagtacctccgggccttctacggtgtcacgccctacggcgcggccgacaccgcgccggccggcgacacccggatccagaatcttgcggcgcgcgccgacgcggtgctcgcccgcggcagcgtgatccagggtaccgtcggcgacgagcgcctgcagggcaccgccctcgacgacgccctgcgggggctcgcgggcagcgacctcatctacggcaaccaggggccggacctcgtctacggcaaccagggcaccgacacgctctacggcggccaggggtcggacagcctctacggtggccaggacgacgaccggctcttcggcaatcgcggcgacgaccgcctctggggcaaccgcggcgcggacacaatcgagggcaatgacggcgccgacatcgtctacggcaacgcgggcctcgacatcctgttcggcggcgcgggtgccgacacgctctacggcggccgggatacggacgtgctcatcggcggggccggcgacgacgtgctggtcggcggtctcgctggcgacctctacgtcttcgaggtggggtcgggccgcgacctcatcctcggcttcgacctgtccgcgggtgaccagctcggtctggcgggccaggccttcacgctcggttcggcccggaacggggacgccgtgctcaccctctccggcggcggcacggtcgagctggcgggcgtcgcggcggcttccttcggcaacggtgccggctatctcgcctga

SEQ ID NO: 9120 - DNA, 300 bp, Methylobacterium sp.
atgttcgctctcgctttcgacctcgtggtcgcggatgtgcaggcacaccatccgaaaggcatctcgcaggcctacagcgatatccgtacgaccctcgcccatcacggcttcgagtgggtgcagggaggaagcctctacgtcaacgcaagcgaagatctcgccgtgctgttcgccgcgatcatggccctcaaggcgttgccccggtttgctccatccgtccggaacatccgggcattccgcgtcgaacagtggtccgacttcaccgcgctcgtcaaagggccgcccctcaccgcgccatag

SEQ ID NO: 9121 - DNA, 2139 bp, Methylobacterium sp.
atgccgagacaggccccggtccccattccgtggcgcgccgcccgcgcggccgcgcgcctcctcggggccgcccgcctcgctctcgtcctgccgatcctggccattccgatcctggccctgccgatcctggcgggaccggcccgcgccgcgccggaggccgcgcccttcgccgacaacgccgactcggtcgcggtcgtgatcggcaaccgcagctacaagcagacggtgccggtcgattacgcccacaacgatgccgaggcgatccgcgcctacctcgtcgaacgcctgggctatcgcgagagcaacgtcttcgtcctgaaggacgcgacgctcaacgagttcaaccaagtgttcggcacggagcgcaacccgcaatcgggccggctctggcggagcgtgcgcgagggccgctcgaacgtcttcgtctactattcgggccacggcgtgccggatctcgccacgaggcagcccttcctgctgcccgaggacggcaacccgaaccagggcgagagcggctattctctcgagaccctctaccgcaacctcgacctcgtgaagcgccgcatcggccccgagcgccagctcgtggtgatggtcgatgcctgcttcaccggcgagaccggccgcaagggcgagagcctgctcgccgtctccgcccccggcttcgcgccagcccggccgaaagccgagagcggcatcgtgcgcgtggtggccacctccggcgcgacgcccgccaactgggacgagccgaacaagctcggcctcctcaccagccgcttcctgatgggcgtctcggggctcgccgacgcccgggaccagcagggcgacggcgacgggcaggtctcctgggcggagctgaagcgctacctcgcccgcgaggtcgaggaggcggcccgccgggcgtccggccgcgcgcaggtgccggaggtggacgacgcgccgatcgtgctgaaggcctcgctccccgtcgaggcggtgtccaagggtgtggcctcggtccgcgacgaggcggcgtggcggcgcgccgagacgctcggcacccgcgaggcgatcgaggcctatatcgggggctgcggcgagacctgcgcctaccggccccaggcgatggaccggctgctcgccggacggcgccgtgacgcggcggcgatcgaccaggaaaactgggccaagttcggccatacccggcagtaccaggcctatctggattcctgcggtgaggtctgcgcctaccgcggcctcgcggagggctatctcggcgggcagaacccgagcgccgacccgcgcgtgaaacgctgcgacgaactcgccgccggcaccgacgaccccgaccggccgaacggcgtcacgggggtgaggctcgggcggatcgaggcttcggccgcgatcgaggcctgccgcggcgcgtcggccgcctatccgcagctgcgccggctcgcctaccagctcggccgcgcctacgaccgggccgaccgctccaaggaggcgttcgccgcctacgacagggccgccaaggccggcagcgtctcggcgatgaacaacctcgccacgctctacgagaacggccagggcgtgaagcgccagcaggcggaggccctgcggctctaccggcaggccggcgagggcggcaacgtggtggcgctcgccaacgccgcccggatgctggaatacggcaacggcgtcccgaaggacgaggccgccgcggtggcgctctaccggcgcgcggtcgcgggcggcgacgtcgcctcgatctcgaagctggtgccgcactacgccaccggcgcccacggcttcccgaaggacctgcgccagggcttcgacctgttccggcaggcggccgacaagggggaccccgtcgccatggccacggtggcgacgctcatcgacaacggcttcggccgctacttcccgggcgtgcgcgccgccgacatggtgctgcgggccctgaagcggggcgagctcggcgcggcctcggtctcggccaccgacaccgcggcccagaagctgaagccggacaccatccgcaccgtgcagcgcgccgtgaaggaggcggattactatacgggcgcgctcgacggccgcttcaacccggtcttcgtgcgggcgctggaccagtacgcccgggcgaacgaggtggaatga

SEQ ID NO: 9122 - DNA, 309 bp, Methylobacterium sp.
gtgagccccggcgctctcgcggcgccggcgcgcgcggggcggcgcgcgctccgcgtcctggccctgctcgtctggctgccggccctgctcttcgcgtccggcttcgcgctcgcccacctgaccggctgccgggtctccgaggcgaccacctatccctgtgaggtcggcgggctcgacatcggcggcctgctctacgcgctgctgatgatgggctggctcctcatcccgctcctgcccttcatggggctgacgctgatcctcgtcctccggctggggctgcgggcgctctaccgggcgtggcgggcgtga

SEQ ID NO: 9123 - DNA, 306 bp, Methylobacterium sp.
atggatccgaagacgcggcccgacgcggccgagccgcacgattcgctgcgcagcttcgacgcctatgccgaccgcaacggccaggacctcggccaggacgaggcgcgggacgtcgcccgcccggagcggctgcagcacgagatggcggagaaccccgactggcaggccgagacggcccgcatcgcctccggcttcccgcgccgcgacgcgacggagggcggcagcatcgcctccgtcgaggcgacggaggccgagaccccgcccgagaacctcgaccgtatcagcaaccccggcacccggcgctga

SEQ ID NO: 9124 - DNA, 444 bp, Methylobacterium sp.
atgggcagccagcccctcatgatcccgcacggcgcctacgttgtcgtctgcgacggccacaaggccctggtgctccgtaacgatgggcccccgctgaacccggatctccgggtacagcaagtgttcgaggcgccaccgaacccgccaacccgcgagcagggcgccgacaagccgccgcgggtcaggctcggcaaccgccgcagccccatcgagcagacggattggcacgacctcgcggaacatcgcttcgccgacgaggtcgccgaggcgctgggcaccatcgatccgctcccggccgtggtcgtcgttgcccctccgcggacgctcgcggagctgcgacgggccttgcccgaacgcctgcggcgggccgtggtcgccgaggtcgacaaggatctgaccaaacacccgatcgaagagatcggacgctgcctcgtcgatgcctga

SEQ ID NO: 9125 - DNA, 651 bp, Methylobacterium sp.
atgacccgcctggatcgccagcagcatgtgctggatctcctcgtgccgcaactggaggaggacggatactccgtcttcatccagccgccccgctcgctactcccgaagttcatggcggagtatcgtcccgacgcggttgcgatgggcaagccgaagaacctcgccatcgagatcgtgcagggggaggccccggccgcgcggctcggcagcctgagcgagcgtttcgccgggcggccggactgggaattgcgggtctactactaccagccggaccgggacgacgaggccctgccgcctcccgggcgcgaggcgatcgaggcggcggccgcgacggtggagggcttggtcgccgcaggtcagccggaggccgggctgctgatcggctggtccgcgctggaagcgctcggacgcttcctgctgccccagaagctcaggcggccgcagacggcgggccgcctgctggaatcgatcgcgcaggcgggtgtcgtgacgcccgacgaagccgagcggctgcgcgcgctgcaggccatccggacccgggtcgcccacggggatctcggggccagcgtgcggccggagcaggtcgcggatctcgtcgcgatcctgcgcgcggccctggcggaagcggggcccgtcgaagccgcgccgtga

SEQ ID NO: 9126 - DNA, 294 bp, Methylobacterium sp.
atgtcctggcaagccaagagggctgcggccaagcttcgctggaaggagcatgtccgcgaagcgagttcggtgggcttgccggacggccatttcgcgaccgagggccggctcgccgtgaccctgttctacttcccggccgcgcgcgagggcggcgacgtggacaacatcgtcaagctggtcctcgacgcgctggtcggccacatctacctcgatgacgcgcaggtcgagcgtatcgtcgtgcagaagttcgcgccggacctgccctccccttcgtcgcgccggatggcatcctga

SEQ ID NO: 9127 - DNA, 1686 bp, Methylobacterium sp.
atggacatgatcagccctggtctcatcaacctcctggtgatcgccggcatcctcgtcgtcgcgctgctcggcatcggcttcgtgttcggccggctctaccggcgcaccacccgcgacaccgccttcgtgcgcaccggcctcggcggccgcaaggtggtggtcgacggcggcacggtgctgctgccggtcttccactccatcgccctggtgaatctcaacaccctgcggctggaggtgaagcggtccggcaacgagtcgttgatcaccaaggaccggctgcgggccgacatcacggtggagttctacgtgcgcgtggagccgcgcgaggaatcgatcgcgctcgccgcccagacgctcggcgaccgcactaacgacgccaacctgctgcgcgagctgatcgaggcgaagttcgtcgacgcgctccgcgcggtggcggccggcatgagcctgccggacctgcaggagcagcgcgccgccttcgtgaagggcgtgcaggaggcggtctcgggcgacctgcgccacaacgggttggaactcgaatccgcctcgctgacccgcctcgaccagaccccgatcgagcatttcaacccggacaactccttcgacgcggaaggcctcgcccgcctcaaggagatcaccgagcagcgccgcaaggagcgcaacgccaccgagcgcgacgccgaggtggcggtggccgagaaggaccgcgaggcggcgctccgccagctcgagatccggcgcgccacccgcgaggccgagctcgcccaggagcgcgacatcgccaacaagaccgccgagacccgggccgagaccgcacaggccgagcagcgcgcccagcagagcgaggagaccgcccggatcgagcgcgagcaggcggtgcgccagcgcgaggccgaggcgcgccagaactcggagagcgcccgcatcgcggccgacctcgccatcgcccagcgcaacgccgaggccgagcgcgagcgccagctcgtgctgcaggacaacgccatccggatcgccgagcgctcgcagaagcagtccgaggcgctggccgccgccaaggccgccgaggcgctcgcggtcgcggccgaggagcgggtcgccaccgccaaggccaaggagatcgccgagcgcgagcgcgaggtcacggtgatcgccgccaagcgcgaggcggaacgcgaggccaccggcatcaccgtcacggcggaggccgagcgccgcgcggcggaggaccgggccgacgccatcaccaccctcgccgaggccgaggcgattgccgccgcctcgaaggccgaggccatcgcgacgctcggccgggccgaggccgagcgcgagcgggtgatgaacgaggcccgcaacgccctctcgccggaggcgcgcgcctacgagaccggcctgaaacggctcggcatcatcccggacgccctgcgcgagagcatgcgggcggtggagaagatcgactcgatccgcatcttcgacgcgggcggcatgatgggggccggcacaggtgcggcctcggcgagcttcggcgacggcctctcgggccacctgctgcgctaccagtacaacagcccgatcctcggggcgatcctcgacgaggcgggcttctcgggggatgccggcagcctcaatgcgctggtgggcggcctgcgcgacggcaaggtgccgaccgcatcggccgccgcgccctga

SEQ ID NO: 9128 - DNA, 1464 bp, Methylobacterium sp.
atgcacaagctgctgctcaaattcggcctgcgctacgatgatcctctcgaagagagacgattcgtccaacggttcacgctcgatgatctggggcgcacccaggccgcgatggtgctcggcgctttcgtctactgctccttctcggccatggactggatcctcagcccggacgcctgggcggtcgcgaccacgattcgtctcggtgtcgccggcctcgtcctgctgccggcgaccctgcttctgacccgcccggccgcccacccctgggcggagcagatctacctcgtctactgcgtcgtgccgggctgcatgctcagcgtgatctacgtcttcctgcggccgagcttcgaccacggcgcggcgggcatgatcgtggtgatcctgttcgtgtcgacgctgctgcccctgcgggtgccctcgttcgcgctgttcgccgtgctgacctggacgtgcttcgcggttttcgagacgatcgcgatccatgacaatcccggcttcgttctggtgaacaatgccgagatcggagcggccttcgcgctctcgctctacggggtcggcgcccgggagttccgtgcacgacgccagttccgaaccacgcaggctctgcagatcgagacggagcgctcggaggcgatgctcgccgatctgcgtgccgcgcaggcgcatctggtgcaggccgagaagctcggcgcgctcggacagctggtcgcgggcgtagcccacgagatcaatacgccgatcggtctcgcgatcacgaccgcgaccgccttcgacaacaacctcatgcagctgcgccgaacggtgaattcgggacaggtgcgccgttccgaattgaatcggggcatcgatcggttggatgaggggtcggcgctcatcttctccaacctcatgcgggccgccgacctgatccataatttcaagcaggtcgcgaccgaccaagcggcagaggaccggcgccgcttcgacgtgcgcgattggctcgtcgagttgatgagcacgctcggcccccttctgcggcgcaagggtcaccaggtccggctcacctgcgccgaaggcatcgtcctcgactcctatccgggcgccctggcgcaagtcgtcagcaatctcgctctgaatgccgtcgtccatgcctttcccgatggccgcgcgggcacgctcgcgatcgacgtggtccggctcggcaccgcgcagatccggctcgtcttccgcgatgacggtacgggcattccgcaggagaacctgcagcgcatcttcgatccgttcttcacgacacggcgcgacaagggcagcaccggcctcggcctgcacatcgtgtacaatctcgtcacctcgaccctgcaaggacgggtggagctcgagagtcacgagacgatcggaaccgtcttcacgatcgatctacccgcagcgttgtctcccgccctgcatacaggaccgggtgtcggcctggagcaggaacacggctga

SEQ ID NO: 9129 - DNA, 267 bp, Methylobacterium sp.
atgaccacgacgaccaaggcggtgatcctcatgctcgtcggcgcgggcctcctcggcgccgcgcaccccgtccgcgcggaggaggccgcgccgcgcggcaaccaggagttcgtcggcgtcgatctcgatacgggcggcgtctactacaacggccgcaactcgggccggtactgcctctaccgcacggtcgacgtgttcaaccgctacaccggctatgtcgaggcacggcgggtgcgccgctgcggccgcggcctctacctgccgtga

SEQ ID NO: 9130 - DNA, 285 bp, Methylobacterium sp.
gtgagcgacgaggcccggctgctggccgagatccacgccgcccgcgcgctgatgcgggccggagcgcgggcggaggccgctgcccggccgggacatgccgcgctctgggcgcacgcgacgcgggctcccggtgcgccgatcgacctcgccgtggcgcgcgcgctccggagcgatgccgataccgcgcggcgctaccgcctgatgctgggggcgcaggccctcgcgcacgcgccgctcgcggcggcggcctcggacggtgccctggcgcggcgccgggtcgggccg

SEQ ID NO: 9131 - DNA, 1212 bp, Methylobacterium sp.
atgaccctgcgcacgatcctcatcgtcgtcccgaccaccgccgggccgctgcgcctgcggagcctcgcgccgcgccccggcctgccggccccggccgccttcgcggacggggattaccgccccctgccctggtcgggcgattacgcccggctctgtgcggcgggcggccccctctcccggctgatgacggagggcgccctgccgccgcacgagctgcgcctcaccggctccttcgatgccgggcgctcctgggaggtgccggtctgcctcgcgcacgggctcgtcgcgcgggggtaccgcctcgccgcggagccggcccgggccgacctgatcctctgggcgaccggtgcggtcgatctcgatctcgcggtgctgcccggcgactacgcgctcatcgacaagatcgagcgctcccgcaccctgctggcggaagcgccggacgcagccctgatggtgctgcttccggaggggccggagcggtcgcgagccgaggcggcgttccgcgccctcgggcgggtgccgcacgtgctgcccgcggagaccgtgccggcagccctggcggcggccctggcgagcctggcgcggccggcggcggcgagtccgtcggtcgcatcgatgctgcggcgccggcctcgcctcgccctgtcggcgggcgccgtcgtggggctcggcctcgcggccgtcgtcgcactcggcgcccggcatgcccccgtttccggcccggccgggcccccggcgggggaaccgcgtccgtccgacgccgcggagcccccgccgccgccgagaccctcggagcccgcacgcgcggcggcggcggccgccccgcccggcaccgatccggccgggccgcccgggatccgcgtcgaggagttgcgcgcgacctccggctcctcctgccgccgcgtcgccttcggcgccgacccgcccgagcgccgtcccgtgccggtggaggccggagagcgcctcgttccgacccggctggctccggatctgtgcgggctcgcggtgcgcgccacggggatgcgggtgacggtggggccggagctgcgcgccgccgccctgcctccggtgcggctggcggacggagcggacgcgtacttcctgcgcgagggcgcgcggcagaacctcgtctacgccgtccaggccctgccggaggcgggtgcggacgccggaacgcccggttcccgcctcgtccacgcgctgacgcgctga

SEQ ID NO: 9132 - DNA, 993 bp, Methylobacterium sp.
atgaccccgattcgcccgagagcccccaatgccgcggtcgcggccggcctgctcgtcgcgctcgccgcggccggtccggcccgcgcgcagagcgtcggcttcgatcccgccgattacggccgggcgcaactcccctcgcgccagaccacgggcgacgcggcggcctatgtcgaccagaacaagggcgcgttcgagccgatcgccgagctcgacccgaaggacgggctcgccgcgctggcccgcccgatcggccgcgtcgacatcgtgctgaagaacgcccgcaccggccagcaggtcggcgcctcctgcaccggggctctgctgcccggcgactacgtgctgaccaaccaccactgcctgccgcaaggcggcgacctcacgcccgtgaaggcgtcgatcctgatggattacctgacgctcgacggcaaaggctcgcgccgcttcgcgatcgacccgaagcccgtcgagcacgacgcccgcctcgattacgcgctggcccgcgtcgccgggaacccggccgccacctacggcaccgcccggctctcgggcgaggccgtgccgggcaaccgctcgatgctggtgatccaccaccccctcgggcgcccgaaggtgatgagccgcttccgctgcttcgccctgaaggagcaggccgagggcgtcgacctgcgccatcgctgcgacacgctcggcggctcctccggctcgctgatgttcgacgcctcggtggccggcatcgccctccacaaggagggcggtctcgatccgaaggacccgacgagcttcaacagcgccacccggctctcggccatcctgggccggagcccgatcctggcccggatcgcggcggctcagggacggcctgtcgcggccgcggaccccgcgccgcagccggggccacggccgggacagccgccggggccgcctcccgccgcccagcccgcggacgggccgctcgatccgggtcggatgaacgcgatcctgcgcgggcgctga

SEQ ID NO: 9133 - DNA, 978 bp, Methylobacterium sp.
atgccgctcgtccgtgccccggccttccgcgccgcgatcctcgccgctctgctctcggccggcctcgcctgcctcgccggagcatcgcccgtccaggcgcaggcccgaggttcggcaaagcccaacatcgtggtgatgggcgaggatgccgacgaggattcggtgccgcgcggcaaccgcatcttccagcgggtgatcaccgaactcgccgagacgatgaacctgcgcggctacaacgtctacgacgagaccgcggtggcgatgggcttcacccaggccaaccgcgtgcggcggcgcgacgccgagctgatcgaggtggcccgcgcggtgcagaacccgcccctcgacgtggtggcggtgttccagatctacgccgccgcgtcgaaatcggcctattcggacatcgtgcggccggaggtgcgcatccccggccggctcctcaacgtccgcaccggacagtcgctcggcgccttcgaggttgcgggcgtgcaactgccgcccctgccgcaggggtgcgaccgcgagtgcctgctggagcgggtcggcacggaggcgaagaccgttgcgggcgacgtggcggcggcgctctcggccaagctcgacggggtgatcgcgcctcggcgcgccgatgccggcgcgccgccccccgacacggcagcacccacgcctgcccccggcgcagtcgcggcgcccggagagggctgcggcggcctgccgagcgcctacgtggtgcggctcaacggcttctcggcccaggaagtccaggcggccgaggagtacatggcggccttccgctgctacgagcaccaccgcccggtgcggtcgagcggggccggcgccgagtactggtacgagacccgctccgactccgcccgcctcggccgcaacctgcgcctgatgctggagcacatgagtgcgccggggcaggtccagttctccggcaacaccttcgtgatcagccgcgtggcgacccgctag

SEQ ID NO: 9134 - DNA, 1116 bp, Methylobacterium sp.
atggccttcggactgctcctcgccgcggggcaggccgggcaagcgcaggaaggcgcggcacagaagcgcgcagctcaggactcggcgaccgaggcggcgctcagcgagacgctgaacgccaacaccgtctcggtggtcaccggcacgcccggcggaacctatttccgcaccggcgccgacctcgccttcgtcctagacgacggcgacaggctgcgtatcctccccatcctcggcaggggggctggcgccaacgcctacgacctgcgattcctgaaaggggtcgatctcggcttcgtgcgcaccgacacgctcgatcagctgcgccaggacaagcgcctcaaggagatcgagaagcggatccactacatcgccaagctcttcaacgacgagctccacgtgatcgccccgaaggaggtcggcacgatcggcgatctcacgggcaagcgcgtcagcttcgacgtgaagggcagcggcacggattacagcggccgcgccatgttccgcgagctcggcatcgcggtcgaggcggtcaacgtagaccagccgaccgccctcgagatgctgcgccggggcgagctggaggcggtcgtctccgtggccgccaggcccgtcgcgatcatcgccggcttcgagcctgacggccggttccacctcgtcacggtgccctacagcgaccgggtcggcgaggcctacgtgcccgccacgctgaccggtgccgactacccgaagctcgtcgacggccccagccccgtcgagacgctcgcggtcggcacgatcctcggcgtctacaaccacccgaagggctcggagcgctacaggaagctcgagcgcttcacgaccgccttcttcgaccggttcgagcggttcctggcgccccagcaccatccgaaatggcgggaggtgaacctcgcggcctccgtcccgggctggacccggttccggccggcacaggactggctcgacagccacagtggggaaacgccgtcccagggtgaggtcgagcgcttcctcagcgagcaaccgcagggcgcggccgccgacaaggaggcggtctatcaggcttatctgcgctggcgccgcgcgcagcggcccgaatacgggatggcgcgccggtga

SEQ ID NO: 9135 - DNA, 1170 bp, Methylobacterium sp.
atgacccggtcgcaggccctgccctcttgcctgacctaccggctgctgccgcagccggcggatctcgacgcggtccgggctctgctggccgcctaccggcacatgctggtcatcctgggcgagatccgccgcacccacggcctcggcgccgacgtcgtcgcgctgatcgcgcacggctaccagcgcgtgcgcgacgagaccggcctgcccgcccgcctcgtgacgctgggcatccgcgacttcgcccggcagcccgcggatttcgaccccgagcaggtcagcgcgctgcccctcgacgggaagctgttcagcctcaagggcgccgccgagatcgccctgaccacgctctgcggccggcgcagcatgccctaccgcgtcgagggctacgacggcccctggcgtgcgctctccgccgcccgcctcacgatcgcgggggacgacctcacgatcgcggtgggcgtccccgtcatgcccccgcatccggccccgagcccgaaggagacccgcaccatgcccgagaccatcctgacccgcgtcggccgcatcatcggcggcctctccaacgcggccctggaggcggtcgaggaccgcaacggcctcgcggtggccgagcaggccctgcgcgagatcgacgccgtgatccacgaggcccggctcgacctcggccggatcaaggcggaggagcaccggctgacggcccggcgcggccagctcgacggggaactgaccgcgctccccgagaagctggcgctcgccctggcgagcgggcgcgaggatctggcccgcgccgggatcagtcggcagctcgatctggagagccagatcgaggcgatcgattcgagcctcggtgacgtcgccgagcgccacgcggcggccgccaaggccctgcaggcggccggcgccgcccggcgcgacgccgagcaccggatcgccctgctgcgcaggccccccgccaggggaggcgacccgaaggcggccgatacgctcgccggctacggcgaggagacgggccgcgcggagcgcctcgcccggtcgctgcgcgccatcgaccgggcgaccggcaccgccggcgctgccgccgacccctcggtcgaggagctcgaccgcctgcaccgggacgacgccatcgagcggcggctcgccgcgctgaagggcgggctgcccgcgtga

SEQ ID NO: 9136 - DNA, 201 bp, Methylobacterium sp.
atggcaggcgagcgcggcgatccggaaacgacggtgcccgaggaggccgactccgagaagaccggtggagataccgagagcggcatggcgcgccccagcctctggaaacgcctcaagccgcttcatgacaggatcgcggcgcggccatcgagcggtctccttgccgacaaggccttctacgacagcctgaacgacgagtag

SEQ ID NO: 9137 - DNA, 1278 bp, Methylobacterium sp.
cgcgccaccgccgccctcacccccttcctcgacgcggtcgccgcctgcgccgggcggcccgacctgacgctcgccgtggtcggcgtcgagccggggcagacggcgctctcgcgcgagcaggccgaggaggtgcgcctcgccgtcgagagccggctccaggcgacgggccgggtgaagctcgcggcggccgccgacgtggtgcggatcaaggcgctcagcgagggcaccaccggcctctcgggggcggaggcggaggcgcagatccgtgcggccttctcgggggatgccagcgtcttcctggtggaggcgcgccgggccggcgagaccgccgcgctccggctccaggcgctcacgcggagcgcctcctgcaaggcgacgagcgagccggtgatcgtgccgatccgcgtcggggccggcgtcgccgacgtggacgcggtgatggagggcgccgtggaggccttcgggcaggccgcgccgggcgcgggcgccgtcgaggtctgccccttcgtggccgagggcggacactcgacctgcgcgggcgcgctcaccgaccgcctcctcatcgccctcgacgccgaggcgcgctcggccaaccgcgtcctgaagggcgcccgcctcgacgtgcgccgcagcccccccggcaccgcctgcaccggccccgtcaccgcgcgcggccgcttcctcaccgaccgggaccgccgatcctggatggaggtggagttccagcgcgacggcgcggtgatcgctccgaccggacgccgccgcatcggcatcgaggggctcggctgcgacccgaccccccgccccttcctcgaccatctcgcggcgacggcccgcacggatgcgggccgcctcgcggtggcggccgccgccacgcccttcgcgcccggccagcggctggacctgcgcatcgagtcgcgcgcccggcagagcctctattgctgggtggtcgcgccggacgagaccgccttcgtggccctgccggtgcgcgggaatggtgcctcgctcgcgcccctgaagcccggcgaggcgaagcgctacccgcgcggctacggcctcgacgagatcgtggcgggcgagcccttcgagaacctcttcgcctgtttcggcgtcgagggcggcctgccgccggaactggccgcgcgctggctcgccgcggcgccgggcgcggacggggaggccaggctcctccagccgcccgacgtgctcgacctcctcgagcggatccgggcgacgcccggcgtgaccgaggccaccgcccggatcgtggtgcggtga

SEQ ID NO: 9138 - DNA, 1389 bp, Methylobacterium sp.
atgagcgggggatacgacgagcgctgcgcggccgacctcgcgggtgtcggcgagggccgcgacctctcccgcgccgatcgggcctggctcgcccgcgtggtcgccggggccgtgcgcccgaaccgcgacaagccgctctgggatctcgcccacgcgctggccggcctggcccgggcgacgggcgcccgcgacgggcgcggcctcgtcaccctggcgctcgacccgaacctcgccacggccggcgcggtcgaggcgcgctttgccgggagcgacgccgccgacgcgcgcggcctcgtcctcgacggcggctggcgtaccggctgggccgggctcgcgcggctgctggcgctcgccgagttcgtgctgacggcggaggatctggcgcagttcgcggccgtgaccggctggctcgacgagctcgccgccgcgcccgatccggagggcgccgccttcctggccaagcgcctcgcccggcacctcgccgcctaccgcaacgcccacctgccgctggcgccgctggaacggcgcttccgcgcgctcctctggttcctcggcgggcgccgcgccttcgcggacgacgacatcctggccttctggcgcgccgagatggcggcgggcgagcggccgggcttccgcaccgtggccgagcatttcgtgaccttcgaggccggcgcgcagctcctcggcggcctggatggcctcgccgcccccgcctccctcgacgcgcatgcgggctgggaggagcgcctggatgccgcgctcgccgatctcgtggcggccgagcccgccgagacgctggccggcctgctcgccgactggccggagggtccgaagatcctcacgggcgccgagcgcgaggacctcgccgacttcctgcgcctggacccgttccaccggacgcggccgctgacgacgctgcgcgccgcgagcttcgggcgggtgcagtccggcatcgccaaccgcctgcggcgcggcgggggcggcgccgacatcgccgagcgggcgacctgcgcggaggccgagagctacgcggcgctggcagcccgggccggggcgctcgccgtccatctcggccggatgctgcggatcgcggcggccctgcgggtctcggagcgcgacggcctcggcccggaggcgcgggccgtgctcgatgcggcggaggcggacctgcgccgggtgcgccgtgccgggttcgaggatcgggtcgcactcgccgcgggcttcgccgccgcggaagccgcgctcctgcgcgtcgcggcggaggcggagcggctggatcgtgcgctcggcgtgctcggacggcagcgcccgctcgacgcggccttcgcggcggaccgcgcggtcttcgccgaatccctcgcggcggcctatgcgggggaggcggcgtga

SEQ ID NO: 9139 - DNA, 666 bp, Methylobacterium sp.
gtgagcgcgctcgccgggccggcgctcttccccttcagcctcgccgccgcggtgatgaccggcctcgtgctggtcgaggtcctgtcccttctggtcgggcactccgcctcggccctggtcgacggcgcattcgggcaggatgcgggcctgggcacgggcctggacggtgcggccgtcccggccgacgcgcacgggccgctctcgcccgccgcgctgctgtcctggctcaatgtcggccgggtgcccttcctgatcctgctgatcctggggctcgccgccttcgcgctcgccggcttcgccctgcaggggctggccgccgcgctcgtcgcgcccctgccggcgcccctcgccgtgccggcggcgggcgccgccgccctgccggtgctcagggtctcgacgcgcgtgctggcccgtctgatcccgcgcgacgagagctacgcggtctccgccgccgacctcgtgggcgcgaccgccgaggtcacgctcgggcccctcgaccagggcctgcccgggcaggtccgggcgctcgaccggcacggcaacccgcatctcctgcgcgcccgcgccgctcccgacgccctccccatgccggccggcgcccgcgtgctgctggtcgatcgggcggacggcgtcttcgtcgcgatcccggccgcgccggacctctga

SEQ ID NO: 9140 - DNA, 159 bp, Methylobacterium sp.
atggacgatacgcgagagggcacgaagcccgaggatcaaacgcccgaccgcccgcgcctgaccccgcagggccatgcgagcggcacggagacgggcgaggacagcaccgacccggccggcggcgccaaggagggccagggcgacaaggccgagggctga

SEQ ID NO: 9141 - DNA, 786 bp, Methylobacterium sp.
atgaggcgcctcgtcgatctgctgccgccggccgcgaccttcctggcgatctgggccgcgtggagctacgcgaccggccccggcggcctgccctcctacctgttgccgcccccgggcgcggtggcgcgcgcgctctggagcgggctcgccgacggtgcgttctggccgcatatccggttcaccctgacggcgacgctgacggggtacctgctgggatcgctcgccgcggtgatcaccgggatcctggtcgccgagagccggctcttcgagcgcttcgtgttcccctacatcgtggcggtccaggcgatgccgaaggtggcgctcgcgcccctgatcctggtctggttcggcttcgggctcgcctcgaaggtggtgctcgtcggcctgatctgcttcttcccgctcttggtgaacacgatcgggggcatccggcgggccgatcccgacctgatcgcgatggcgcgggccttctcgcggccgggctggtggatcttcctgcacatcaagctgccggcggccgcgagcgcgatcttcgcgggcctcgagatcggcatcgtgctcgccctgatcggggcggtggtcggcgagttcgtcgcctcggaacgcggcgtcggctacctgatcggatcggccaccgtgaacatgaacgtcgccgtgatgttcgcgggcgtcgtcatcctggcggccttcggcgtgctgggcagcagcctcatccgcgccctccagcggcgcgtcgtgttctgggaaggcgcgcgcaacgacctgccgcccgccgggcgcacctga

SEQ ID NO: 9142 - DNA, 1065 bp, Methylobacterium sp.
atgtcgatcatgatgtccatcgttccgcgtcgccggtatgcacgcaggactggcctcccgatcgctctgatcgcccttcaggcctgcgtgttggccgtcccggccgtatgcgccgaggcgcccctccgagtggacgaagccgggccgggtcttaccgagccgcgcgtcttcgcacgtgatgtgaccggcgagcagggcgcgaccattccccttttgatcgaggtgcggcatcggcccggccagcccggcgggagcacgtacatcctgggcgtgccgaagggcgcgcagctcagcgatgcgaaccatgcggtcaccgccaccgaggaacgatccatgatcgaggtgacggactggaagctcgcggacctcgccgtcacgctgcagccggagcagaccggtgcattcacgctggcggtggcggccctgtcgctcacggagactgggcgcccgctaccgatcgcgcggtcggtcttcacgctgcgggtccagccgcggcaggcacgtgctgcgcctttgcccatgcctgtacccgcgaccgccatccgaccggcagccgccatcgtgagcgccgaagcggcgaatcccacaccggccgggcgcagcgacgcggccgcgatccctctgccggaggccccacccctccggcctctcccgcgtcaggcgcacgagaccgggtccctcgcgcgggcgcgggaaacgggccccgacaatcccgcggtcgaacccgcagccgatcgcgcgccgggcctgggcggaccactctcggaatccccgcaggcggcagctcgatccccggggcctcagcgcgcggctctgctggaacgggccgagcggctcatccgatccggcgacatcagcggcgccaggctcgtgctcgaacatttggtcgagcgcggcgacgcgcgcgcgaccttcctccttgctcagacctgcgatccgcggatgctgcgcgcttggcgcgtccacggattgcgacccgatccggagcgcgcgagcgcgctctatgcccgggcggccgagttcggtctgcgcgatccgaggaaccgcgccgaagcagcgcgctga

SEQ ID NO: 9143 - DNA, 1842 bp, Methylobacterium sp.
atggccggcggcctcggcgcgctcttcgggctcaagcagacgccgagctaccgcgccagcgtcgagatcctgatcgacccgcaggccctccagatcgtggggcgcggcctcgcccggaccgatacgccggcgcagctcgacttcgccaacctcgagagccagtcgctgatcctgctgtcggccaaggtgctggatcgcgtggtcgcgcggctggacctcgccgaggacccggtcctcgtgcgcggggccaagcccggcatcgaccgggccggcctggcgctcgaggccctgcgcaagcgtctcatcgtgcgccgggtcgagacctcgctgatcttccagctcagcgcgtcctatcccgagccgcgccgcgccgccgagatcgccaacacggtggcggccgtctatttcgaggtcgcggcgagcgaccgcctcgccgcggtccggcgcgccaacgacacgctgctgacgcagctcaacgacctgcgcgggcagctcgaccgggccgatctcgccgtcgagcgctaccgggccgacaaggggctgatcggctcgggcgagtcgggcctcctcgtctctcagcagctgcgcgacctctacgggcagatcaccacggcggaagccgagctcgcccggctctccggccggcgcgagaaggcccgggcctgggccgccgccgacgggccgcccgcgacgccggaggcgggcgcctccgcggtgatgatctcgctgcgcgcccagcacgcccagagcacgcaggagatcgcccagctctcgcgcagcctcggccagaaccacccgcagatgatcgcgctcgcggcccagcgcgccgcgaccgtgcggctgatcgcggcggaggccgaccgcatccgccgcaccatcgacgaggacgtgcgccgcggcgaggaaggcctgaagctcctgcgccgacgcgcggaggcgctggtctcgtcgcagaccagcagcaacgaggaggggatccgcctgcgccagctcgagagcgaggccgaagcgatccggcggacctacaacctcgtgctcagccgctccaaggaccttgagcagcaggaggtgatcaaccccagcaactcgcagatcgtctcccgggccgcgccgccgctgaaaccctccgacacgccgatgccgatcatcgccgcggccggcgccctgctcggcgcggtgctgggcctcgccgccggcttcctgttcgacctctggcgcgggaccttcgcctcggccgccgccttgagcgcctccggcctgccggtctgggcacgactgcccgcccagcgccgcgccgggcgcaatgatccggatgccgagcaggcgctcgtcgcggtggcccgggcgctgcgcgaccgcctcgccgcccggccgggcgccacgatcacggtggcctccgaggggctcggggcggagcgcctgcgcacggcccacatcctcaccgaactcctgatccggctcggcgagccggcgcagctcgtgccgggcacgctgcgcccgcaacgggccctcgcggaggccgccggcgcgcgcgacggcaacgcccgccgccgaccgccgccgcaggccccggcagcgcccgggctggtggtgaccgagcgggatttcacggacggcgagagctggctcgcgatccccgagacctcggacgcgatcgtcctggtgatcgctccggggcggaccacgcgcggccgcctcgaccgggtgatcgagatcctggacgggagcggccgcttccggcgcgcgagcctgatcgggatcgtcgcggcccagccggcccgggcgcggctcgcccgccgccccgtgccgcgggccgccgccgtggcggtgaggcccgcgtga

SEQ ID NO: 9144 - DNA, 177 bp, Methylobacterium sp.
gtgcagatctggctgacctccgcgctgagcctctgggcggcctactgggccgcgatcttcgcgcagctcgcgcatctgcgccggctcgaggacggcgtcggggcctcggcctgcgcgcggatcgctggcgctctgctcgccgccgggctcgccctgcacctgctcgcatggatctga

SEQ ID NO: 9145 - DNA, 450 bp, Methylobacterium sp.
atgacgacgctgctcgatcgggccgtggcgcgggcacggcagttgcccgcggcccagcaggacgagatcgcccggatgatgctcgcccattcgggcctcaccgcagagacgtcaggtcgggtagatcctcagacgcggcgcgcggtggacgcgttcctgcgccatctcgacggccgctacccgatccgtgaggtgatcctgttcggcagccgcgcccgccagacccacacgcacgagagcgatgccgatctggcgctggtgctggactgggagcagggcgaccgaatgaaggtcggcctccacatggccgacgtagcgttcgatgttctgatggagaccgaggttctgattcagccgctcccgctctgggcgacggagtacgagagccccgagacgttcaacaaccccgcgctgatcgaggcgatccgccgcgacggcctgcggatgtga

SEQ ID NO: 9146 - DNA, 294 bp, Methylobacterium sp.
gtgagccgctacgtcctcacgccgaaggcgcgcgaggatctcgatgccatctggcgctactccgccgagcgctgggatcccgaccaggcggaacgctacctgcgccggatcggacaggccttcacgggcctcgccgagggtacggcaagaggcaagagcgcgcaggatgttcggccgggatacttccggctcatcgtcgcttcgcacgtcatctattaccggaacggcacggatggctgcgtcgagatcgtccgcatcctgcacggccgcatggatgtggaacgacatttgtag

SEQ ID NO: 9147 - DNA, 372 bp, Methylobacterium sp.
atgccttgcgccgtggccaagctcctgccgctcctcggatacgcggcctgcctgctcaccctcgcggcgatgacggggatcaacctctatgcgggcccgcggatcgcgacggcgcaggtgccgatgcagtggtcgctgtcgggcgagccgacttggttcgccggcaagatcgtcgggttgtggtttcccgtcctgatcgccctggtggtcggcgcgagcctcctcctgaaggcgcgccagggcggggcgccgtccggcggctgggccgacggcgcggactggctcgtcctcctgggcgcctgcagcctcttgctctgcgtccacgcttggcacgtctcggccgtcatggcctgggcggcgaagcagtcctag

SEQ ID NO: 9148 - DNA, 921 bp, Methylobacterium sp.
atgccggttgcggcgacgctctccaggcgcttcctctccgatgtcgatcatcgcacgaccggggaggtcctcgatcatcccggcttcgcgcaaatgcgacagccctacatcaccgctacgatggcgagctacaagacggcgagcttcccgggcgggtgccagagcacggcctaccgggtcgcgaccatcggcgtgatcgtctgtctctacgccgcctacgacgtcgaggaccgcgcgacgtggccgacgctcgcgcggctgaagcagaccgtcacggccttcgggctctccagcgcgcgccaagtcgatgacttcgtcgcgcgcctcgtgcggacggacaacctcgtgctggagcgcgccccagccgacgggcgcctgcgcctgctcaagccgaccgacaagctcctggcctgggaccgccacgtgctggccccctactacgatgccctccagagcctctatcccgagccaggctacgtccctacccgcgaccctggattccatctggcgctgcgcagggcgtcggtgcggtaccttgggcccgtggcgggcttcatgcgggagaacacggatctgctcccgttccatatcatgtaccagggcgtgcatatgctgatgaccctggtcaacctgagtgtggccgagggcgcacgcgcgccgcacgagccggaccttggcgccttccaagaggccttcggcatctcgcggacccatatccgcaacacgctgctcgcggcgcagcaagccggccttctcacttggagcggtcgggtcgagaagatcatcgccctgacgccacgcggcctggccgccatcgaccgcttcatcgccgacaccctcgcttcccacgatctcggctaccggctcgccctcggggatcttgggcaccccgtgacgcccccgaaacgccgcgccccctga

SEQ ID NO: 9149 - DNA, 2382 bp, Methylobacterium sp.
atgcccgccccgagccccggccgcacgctgttcttcttcgagaagccctcggcgatgcgcgagctgaagcgcttcttccgctcgcccaacaccgtctgcgtcgccgcggagggccacctgctcacggccgaggagcccggcgacgtgcggccggactggaagccctggcgcttcgacgcgctgccgatcgtgctcgacacgatccccgtcgcctgcgggcagaaccgctccggccagtcgcatgcgggcaagctcgcggccatccgcgaggcgctgagcggcgtcgaccgggtgatcatcgcgaccgatcccgggcgcgagggctcgatgatcgcctgggaggtcttggagcatctcggctggcgcggccgcgtcgaccggctgaagctcggcgcgctcgacgacgtctcgatccggcgcgccttcgcggggctggccgccgagcccgattccggcgagcgcgactacgcggcctatctggaggcgctctgccgccagtacgaggactaccatctcggcctcaacggcacgcgcgccatctcgctgcgcctgcgcccggcggccttccgcgagccctggcggttcggcggtgtgcagacgccgacgctcgcgatcctggccgacctggaggagcgcatccgggccttcgtgccgcaggacttcttcaaggtggcgctgcatctcggcaccgcggagggacacgcgctcaccctctggcacgcgccgaaggagcgcatcctcgatcccgaggtggccgagacgatccgggcggccgccgccggctggtcgggaccggtcgcggtcgagcagaaggacgtgcggcgcgcgcccccgcgcctgttctcgaaggacacgctcgcgaggcgctgcgccaagcgcttcggctgggacccgcaacacaccgccaagctcgcccaggacctctacgaccagggctatctgagctacccgcgcaccgagtccgagctgctgcccgaggggcagatcggcgacgcgcccgcgatcatcgccgccgtgacaggggtgctctccgacctgcgcccgctcttccccccggaggcgaagccggtgatccggcgcggcaagagcggcccctacgtcaaggatccgggcgagcaccacgccatcgtgccgctgcgcaaggtgcccgagcgcgggcggctcacgggcgatcaggtccggctctgggacctcgtcgccaaggcgtatctcgccgcccacctgccggacgggatcgacgcgcgcacgggcatcaccgccgaggtggccacgcccttagggtcgaagcgcttcgcggtctcggggaccgtggtgcgggtgccgggctggcgcgcggtctacggggccgaggccgagacggaggccgaacacgtccccggcaaggcgcggcgcgaggaggaggcgagcgcggcccgcctgccgccggtgcgcgacggcgaggcggcttccgccacgggtgccgagatcgcgaccgccgtgaccgagccgccgcgccgcatcacccgcggcgagctgccggtggtgatgggccggctcgtcgatcaggtcgaggatccggcggtgaagcgcgccctggagaaccccgccaacccgaacgagccgaagggcctcggcacggccgcgacccgcgacacgatcctgcccaagctcctgaagagccgctacgtgacgctgggcaccggcaaggacccggcggtctcggtgaccgaggtggggctcgccttcatcggggcggtgcgggcggtgttcccggcctacggcgatccggtgggccgggcggtgttcgaggcggaactcgccgagatcggccgggccgcgacccgcgcggaggccctgcgccgggccgaggatttccggcagcgcacccgcgcgcggctcgacgcgctgatcggggcgatcgcgggcgccccgacgatcgacctcgacccgagcctgatcccgccgggtggtggaccctcgggcgctgccggccggggcggcgaccgggcgccgacgcccgccatggtggccttcgcggtctcgctggccgagcgcaagggcgtggcgctgccgcgcggctgcaagagcagcatgcgggtctgccgggccttcctcgacgcgcaggccgggccgcggcccgagggcgggagggaggagcgcgggccggacggcgtgcgcgcgccgagcgaggcgatgctgcgctacgcccgcagcctcgcggaggcccggggcatggcctgcccgcccgaggtggaggcgcgcttcgacgcctgccgcagcttcctcgacgcgcacgcggcgcgaaccgatacggcgcgcccggcccgcaagagcgccgcgccgtcccgcggccggtcacccgcgccgcgcgggaagccggtgcgggcccgtcgccaggcttga

SEQ ID NO: 9150 - DNA, 873 bp, Methylobacterium sp.
atggatctcgacatcggcgaattcgaggaggtctgccgcgacctctacgtccgggccctgaagatcctgccgcccgacatcaaggcgggattctcggaactgcagaagagcgagaccagcgcgaccggccgcgccatcctcgacacgatggtggagaacgtcgcggtcgccgagcgcacgaagaacatcctctgccaggacaccggcatcccgatctacaacatccgcatcggccgcgacgtcgccttcgacggggtcgagctgaaggccgcgatccggcggggctgcgagcgggccacgaaggagttctcgctgcgctcctcggtggtccatccgatcacccgcacgaacgagcagacctcctgcggcatccgcgtgccgatcatccacgtcgacttcgacgacagccctgagaccgtcgcggtcgagatgatcccgaagggctcgggctcggagaacggctccttcctgcagatgctgctgccgtccgacgggatcggggccgccaagcgcttcgtgatcgaccgggtgatcgagctcggcggccgggtctgcccgccgaccatcgtgggcgtggggctggggggtacctcggacctctgcatgcatctggccaaggtcgcggcgacgcggccgctgcgctcggtctgcccggacccggagggcgcccggatcgaggcggagctgtcgcgggcggtcaacgagctcggcatcggcccccagggcctcggcggacgctcgacgagcttcgcggtgcatgtggagctcgccgccacgcacatcacccagaacccggtcgcggtgaacatccagtgccactcggcccgccgcgcccgcgcgacgatcacgccgggcggcatcgcgttcgcgtga

SEQ ID NO: 9151 - DNA, 1503 bp, Methylobacterium sp.
atgggcgacgacatcggcatctggaacatcggcgcctatcaccgcggcatgatggccggacgcacgccccatctcgatcggatcgccgccgagggcatgctgtttaccgactactacgcggaggcgagctgcacagcgggacgcgcggccttcatcaccggcgagctgccgatccgcaccggcatgaccacggtcggccaggccggagcccccatcggcattcctgcggaggccgtgaccatcgccaccgcgctgaagggcatgggctacgccacaggccagttcggcaagaaccatctgggtgacaagaacgagttcctgccaacggtgcacggcttcgacgagttctttggctatctctaccacctcgacgcgatggaggatccggcccatcccgcctatccgcaagagctgctgaacagggtcggcccgcgcaacatggttcattcgtgggcgacgaacgtcgacgatcccacgatagacccgcgttggggcaaggtcggaaagcagcgcatcgaggatgccggtacgctatacccgaagcggatggagacggtggacgaggaaattcgcgacctggcacttggattcatcgacaaggccaaggctgacggtaagccattcttcgtctggctcaacccgactcgcatgcacgtcaccacgcacctgtcgccgaagtaccaaggcatgcgcaactctcagaatggctggagcatccaggaagccggcatggcgcagctcgacgatgtcgtcggcgcaatgatgaagaagctgacggacttagggatcgacaacaacaccatcgtggtcttcacgacagacaacggtacggaggtgttcacttggccagacggtgggcagacgccgtttgcgcagtccaagggcacggtcatggaaggcggtttccgcgcgccggcgatgatccgctggcctggcaaggtgccagccggtaaggtcgagaacggcgtcatgtccggcctcgactggttcgcgacgcttgtggcagcggcgggaaacccggacatcaccgaggagctgaagaagggcaagcagatcggcgaccaaacctacaaggtgcatctggacggttacaaccagatggacatgatcaccggcaaaggcccgtcaaagcgcaacgaggtctggtatttcggggagagtgagctgggggcagttcggatcggcgactacaagtaccgcttcattgatcagccgagcgggtggctcggcgacaagacgaagcctgacgtgccctacatcaccaacctgcggctcgaccccttcgagcggactggctggcccgacaacgggaccaaagccggggcgcagaactacatgagttggttcctgtacgagttctggcgcttcgtctttgttcagcaggaggtagagaagctcgccatgactgccgttgagttcccgccgatgcagaagggcgcgagcttcaacctcgaggcggtcaaggagaagattcaggcagccaggaccgcgatggcgaaataa

SEQ ID NO: 9152 - DNA, 231 bp, Methylobacterium sp.
atgctgctctccgaatggatgcgccgcgagggcctgagcgacgccgatgtcgccgccgctgtgggtctgtccgccgaggccatcagaaagctccggttccgagcgcgcggcacgtcactgcgggttgccgcgcggatcgaggccctgtccgccgggcaggtccgggcgcacgatctccagccgcgccaggacaagcaccaggccgccccgcagccggaggccgtgccgtga

SEQ ID NO: 9153 - DNA, 2070 bp, Methylobacterium sp.
atggtcgcgcacgctgaaggcggaccggaggccgctcccccggagccgcctccggtccgggcgaagatcctgatcgtcgacgacgaccggcgcaacctgctcgccgcctccgagatcctctccgacccggcgatcgatctcgtgctggcggactcgccggaggaggccttgcgccggaccctgcgggaggatttcgccctgatcctgctcgacgtccagatgccgcgcatcgatggctacgaggtcgccgccctgatccgcagccgttcgcgcagctcccgcgtgcccatcctgttcctgacggcgcacaacaaggaagacatgcacgtcttccgcggctactccgcgggcgcggtcgactacgtcttcaagccgatccagcccctcgtcctcaagtcgaaggtcgatgtcttcgtcgacctgtaccgcaagaccgaggagatcaagcacaaggcggcggccgagaagcagcttctgctcgagaacctgcgcgtgcgcggcgagaagctggaagccgagcaggccctgcgcaggcgcgaggaacaccaggccgcggtgctgcgcagtctgccgatcgcgctctacaccgccccgctcggcgaggcggaccgacggcttcacttcaccaacgacagcatcgagcgcatcaccgggttcccgcgcgaagccttcgcggccgcgaacctctgggaatcccgcctcgaccccgaggacacggaccgcgtgttcgcggatctgcgcaccgtacaggacaccggcgcggtggcgctggaatatcgctggcgcaacgccgacggagcggagcggcacatcctcgatcaggtcgtgctccatcgcggcgcgggggacacggccgccgaactcttcggcatgtggttcgacgtcaccgagcggaaggagctcgagctcagcctgcagcacgcctcgaagctcgaggccgtcggtcgcctgaccggggggatcgcgcacgacttcaacaacatgctgagcatcgtgatcggcaacctcgacctcgtgaagggatcgctgcagggcgacgaaaaggtcctccgccgtgtcgagagcgcgattgcgggggcgcatcgctgcgctgagctcaccagccgtctgctcgccttctcgcggcgctctcctctgcagcccagggccctggagttcgtcagcttcatgccgggcctgatcaagctgctcgagcgcacgctcggcgagcggatcacgatcgccacggacttggcggcggaactcccggatgtctgcgtcgatcacgcccagttcgaggcggccatcatcaacctcgccgtcaacgcgcgggacgcgatgccgaacggcgggaggctgggcatcagcatccggcgccgcgacaccgctgaccaggacgggtccgagagcgcaagcgtcgtggagatcgcgatcgtcgacacggggatgggcatgccgcccgccgtcctcgcccgcgtgttcgagcccttcttcacgacgaaggaggccggcaaaggcaccggtctcggcctcagcatggtctacggcttcgtgcagcagagcgaggggaccatcacggtcgacagcagtcccggccagggcacccgcttcgtcatccgcttgcccgcgctcgccaagcggagtctcgccccggaggcggacgcccacgccacgggccccgaagcgggctgtgccgttgacggcgcaggccgggccgttctcgtcgtcgaggacgatgccgacgtccgccatacggtcacctcgaccttcgaggcgctggccttcaaggtcctcagcgcgcatgacggcagcgaggccctgcgcatccttgagaacgagcccgacatcgccctcgtcttcagcgacgtgaacatgccgggcgcgatgaccggcatcgacctggggcacatcattcgccggcaatggccgcaggtgcccattctgctggcttccggctatctgcaggaggatcaggacacgaacggcttcgcgttgctgcagaaaccctaccgcgccgccgacctgatcgagatgttgcgcggattgctgagcgacaccgagcagggccgtgcccgccacgacgcaccctga

SEQ ID NO: 9154 - DNA, 297 bp, Methylobacterium sp.
ttgagttcggacgcacacgtcatcaaccgggctgccagcgtcggcgcgagcgaccgcttcgtgcgctggctcggctggatcgcgaccgtcaccggcgtcctgatgttcgtctcctatctcgaccagatccagctgaacctcgccggacagaagggctcggtcattcagccgctcgccacggtggtgaattgcgggctgtggacgacctacggcgccctgcgccgggactggccggtctccttcgccaacgcccccggaatcgtcctcggagccgtcgccctgatcaccgcgctctga

SEQ ID NO: 9155 - DNA, 234 bp, Methylobacterium sp.
atgactgatataaccggctttgaaattcggatcacgaccagtgaaaccgggagcatcctgcgcgcaccgacggagcgtgaggtggccgcgaaggccgagcctctgctccgtagggtgcatgcgcgcggcgagctgatcggcttcagcatcatcgggccgagcgcgtccggcatcggccgcctcaaagcctaccttgaggatgtgctcatagaagtgtcgcgcctgggtctctga

SEQ ID NO: 9156 - DNA, 231 bp, Methylobacterium sp.
gtgagcgcgacgcgcaacgagcagacgaagctcctggcgaccgccatcaacaacgtggcggtcgccttcgcggtgctgggcttcgtgacgccggtcgtcgccgtgagcttcggcgcggcgagcgcgcccatcctgcgcaccgacagcgcgctgttcatgctcgtctggctttgcgccggtttcaccttacattgggtggcgagacgcaccttgcggagcctcgaaccgtga

SEQ ID NO: 9157 - DNA, 180 bp, Methylobacterium sp.
atggacctacaggccacgatcagggatgccatctggaccgaacttctgcgtcagtccgaggcgaccgacgccgcaccgacggtcagcatcgcggaagacggcgccgccgacatccacggacgcatcgatatcgacgcgctgatcatggtgatcacgggagccctcgcgggcgggccgtga

SEQ ID NO: 9158 - DNA, 894 bp, Methylobacterium sp.
atgggctcggatcagcattatcccgaggaagctccggttcatcgggtggcggtggatgggttctggatggacgagagcctggtcacaaaccggcagttcaagcggttcgttcaatccacgggctaccgcactctcgccgagatcccgccagacccaaagaactatcccggcgcgctgccgcacatgctcttcgccgggtcgatggtgttcgtgcccccgcgcgggccggtcgacctgcgtcactacggccagtggtggacgctcctgaaaggggcggactggcgccacccctacggcccgggcagctcgctcaagggactcgacgaccatcccgtcgtgcacgtcgcgttccaggacgctgaagcctacgccaaatgggccgggagggcgctgccgagcgaggccgagtgggagttcgccgcccgcggtgggctcgacggggctgagttcgcctggggtgacgtattcgcgccgggcggccgcctgatggcgaacacctggcaaggcgagttcccgtacctgaacaccgccgacggctcgtttcggcggacgacgccggtgggcagcttcccgccgaacggctacggcctcgtcgacatgatcggcaacgtctgggagtggacggctgactggttcgcgccgcgtcacacagccgacgcagcgaaggcctgctgcatccctgagaatccgcgcggcgggcgtgagatggacagcctcgatccgcgcagcccgcattccccgatctcgcgcaaggtggtgaagggcggctcacatctctgcgcgccgaactactgccgacgttaccggcccgccgcccgccacccccagccgatcgacacctccatgagccatgtggggttccggaccatcatcagggagaggatgcagccatga

SEQ ID NO: 9159 - DNA, 351 bp, Methylobacterium sp.
atgacccggctcgggcgcgccgcggggcgcgcattcctcgtgacgctgatcccggcctgcgcgtcggcgcagcccgtccgctcgacgctcgccgaccccgtcgactcgcggatgcagatgagcgccgcctcgctcatgccgacgctgcgcggacgcgggctctacgccgacgacggcagcctcgtcgggtgggtgcgggacgtgcgggtctcggaggccggcaacaccctcgtggccatcgtcgcgcggcggcgctggctcggcggcggcgaggtcgcgatccccgtcccgaccctccgccagcagggcgccagcctgacggtcgcggggacgacccgaacgatccgcgcc

SEQ ID NO: 9160 - DNA, 1131 bp, Methylobacterium sp.
atgccgaccggtatcaggcgctgcaccgagatcgagggcgcctgcgcgatccacgaggcgccgccggacatccgggtccataccgacctgctctacgtccccgtggagtgcggtgccctctgggggctctacgcggacggggtccggatcgaccgcgaggccccgctcgacgccgacgccgcgcggcaggtcgccgagctccgcgtctcggccccgcggatcgacgggcgcttctactatctgggcgacgtggtcgagcatttcggccacttcgtcgtcggcagcctctcgcggctctgggcgctgcctgcgggtgccgacacgcccctgctctaccacggcgcgcaggacatcgagcggctccgcggcctcggcttcctggagccgatgctcggttccctcggcctcggcctggaggcgctccggcacttccgcgtcccggtccggctcgccgaggtcacggtggcggcgcgcgccttccgggagaaccgttcggcgagccgggcctacgacggactctgcaaggcgatcgggcggccctggctggcgggggtggctgccgacggcgatgcgcggccggcctatctctcgaagctcaagctgcccccgggcagccttcacaagctggagaacgaggccgaactcgtgcgggagcttgagcgccggggcgtcgacatcgtcttccccgaagagctcgacatccgcgctcaggtccggctcttcgccgagcggcggcacatcctcggcctcaccggctcggccctgcacgtctcgctcttcgccgcgcccgagcgccggatcctcggcctcaactggtgccgccgcctcaacgcgaacctcccgctcttcgacgccctgaaccggaacagggcgcactactatttcgccgacggggtgacctgggtccggaacgacgcctacgccgccgagggcgacttcttcctgcgctggtcgctgccggacccggcctccgtcgctgccgccctggtcgagcgcgccgcggatttcgacgggatcgccgagcgggacgcacgggaggatgccgcgcgggcgggcgggcccttcgcccgctccgtggccgccgccgggcgccgggcgcgcgccgggctgcggcggatcctgagcccctga

SEQ ID NO: 9161 - DNA, 1542 bp, Methylobacterium sp.
gtggctcggggcgctcgcggcactcagcgtgccgctgctccggaggctgaagccctgagcgccgcccgcttctcccacctgctcgccgccgagctgcgcctcgtcctgcgcgagcgcctgacctgggcgatcctggccgcgctcctcgcggccttgtgcctcgcggcccgaacgggcgccgagcgcaccgaggcggcgcgcgccgcggtcgcgcaggcgaccgaggacggggcccgcaccgtgcgcgacgcccgggccgcgcacgcgcgctatgcccggccgagcccgatcaccgtgaactactggcaggacccgaccgacgccttcggctacatgacctacttcatggccgcccacgcggtgaaaccgccgacgccgctcggcctgctggccgccggccagtccgacgtgcagcccgccgtgatgcggatcagcttcggattcagcacggtgttcgacgacaccgcctacgagctcggcagcgccgcccggctcaggctcggcgccttcgatctcgccttcgtgctggtctacctcgtgcccctcgccgtgatcgcgctcgcgggcacgcggctctctgccgagcaggatgccgggatcctgcgcctgatcgcggcccagccgatcggcccgcgccgggtcgccgccgcgaagttcggggcggtcgggctcgtcgcggtcgcgggcgtgctcggggggacggcgctggcgctcctcatggcgggcgggaccggcccgctcgcgggctggggcggcgtgctggccctactcggcgcaagccttgccgcctacaccctgttctgggtcgcggcctgcgcgctcgccgcgagcctgtggcgcggggcggtggcggcgctcgccgtgctcgtcctggcctgggccggcctgaccgtcgccctgcccaccgcgctcggcctcgcggtggacctgctcgcgccgcgcccctcccgcatcgcggcgatcgacgcgagccgtcaggcgcaggcggcgttctacgcgggcgagacgggcacgcgggtcgcgagcgcgtggctcgccgcgcgcgtccccgatgccgccgctcggccgggcctatccgagaaacccgagatcaagcggctcgcccgcgacgccttctacgacacggcgctccgcgagacccgggcggcgctcgccgcgcatgcccgcgaactggcggcctggagcggacgcctcgccctgctcgcgcccgcgagcgcgctggcgctggcgctcgagaccgccgcgggcacggacgccgcccggcacgccgccttcctggcggcggccaccgggtatcgcgggagcctgcgcgccttcttcgagccgcggatcgtcgcccaggcgctcgatccggtccccgtctgcgccggctgcccgggccggctcgacttcgacgcctacgacgccgtgccggccttcgcgcccgccccggctctggcggcggcccggcttcaggcgtggctcagcctcgcggcgctcctcgccggcacgctcgcgctggccgtgctcgcccatcgccggctgcgcgcctggccggcctga

SEQ ID NO: 9162 - DNA, 1395 bp, Methylobacterium sp.
gtgaggcgggtcgcggccgagctcgccctgatcctccgcgacgcgcgcctgcgctggatcggcgcggtgctcgtcctgctgctcgctctggccggccttgccgcgtggcgggaggccgccgcctacggggccgagatccagcgcgtcaccgcggccgagcgcgcgcgctggctcgggcaggacgccaagaacccgcactcggccgaccattacggtctctgggtgttccgcccctctgcgccgctcgcggtgctcgatcccggcaccgagccctttacgggccggatggtgcgggtggaggcgcacctgttcaacgacgcggtctaccgcgccgtgcaggatgccgggccgctggcgcgcgccggcctcggcagcgtcgccgacatcgtgcagctcgtggtgccgctcgccgcgatcctgctcggcttctccgccttcgcggccgaccgggagcgtgggacgctccgcctcgcactcggcaacggcgtgccgccgggccggctcttcgccgggcggctcgcggcgctcgtgctggcgctggcgctcgtcgtcgggctgccgctcctcgggctcggggcgctcgccgccgatagtttgggagccgagggctggcaggtctggccgcgcctcctcgcctgggtcgccgcacagctcgcctatgcgggtgcgttcctgctcgtcgccatgctggcctcgctggtcgcccgcacggcgcgcggcgcactcgcggcctcgctcgccgcctgggtcctgctctgcgtcgccgccccgcggctcgcgggcgcgggcgtcgagctgctgcagccggccctgtcctaccgcgaggtgcgcgcccgcatcgatgcgggcttccgtgcccaccgcacggcggaggccaacgacgtccgggtgcgcgaggtgctggcccgctacggcgcgagcgacccggacgagctgccggtcgacctgcgcggcctgatgatgtccgagaacgagagccacaacttcgcggtctacgaccgggagctcggcgccttcttcgcgagcctgagcgcgcaggagcgcgccacggcctgggccggtatcgtctccccgcgcgtcgccctccaggccctgtcgcagacgctggccggcaccgatttcgccgcgcacgcccatttcgtctgggcggcggagcgctaccgccgcacgatctcggagcggatgaacgccgagatccgcgaccatccgcagggcggcggccgagtgctcgtctccgggccggagctctggcaggagatcccgcccttccggcacgcgccgctgccgctcgcccgcgcgctggcggatgcgggcgttccggccctgatcctcgccctgtggctcggggcgctcgcggcactcagcgtgccgctgctccggaggctgaagccctga

SEQ ID NO: 9163 - DNA, 729 bp, Methylobacterium sp.
atggcgaacgacgggcccgtgctggcgctggacggcgtcgtcaagcgcttcggccagcgcaccgcgctcgcgggcctcgaccttatcttacgttcgggcgaggtcttcgccctgctcgggccgaacggggccggcaagaccacgacgatcaacctgatcctcggcttcctgcgggcggatgcgggcacggtgcgggtgcggggcgtcgatgccagtgccgacccggtcggggcgcgggcgcacgtggcctacatccccgagcaggtcgcgctctatcccaccctctcggggctcgagaacctgcgctacttcgcgacgctcgcggggctcgacctcggcaaggcggaggcgcgcgcgctgctggccgaggcgggcctcggcggcgacgcccacgaccgggcggccggcgcctactcgaagggcatgcgccagaaggtcggcatcgcgatcgcgctcgcccgccgggcggggctcctcctcctcgacgagcccacctccgggctcgaccccggcgcctcggccgagttctcccgcacggtgcgggcggcggcggagcgcggcagcgcggtgctgatggcgacccacgatctctaccgggtgcgcgagatggcggaccgggtcggcgtgctcggcggcggccgcatcgtcgaggagatcgacccgcggagcctcgaccacgtcgcgctggagcggctctacatcgagcggctctcggagagcgcggcgtga

SEQ ID NO: 9164 - DNA, 1377 bp, Methylobacterium sp.
atgtacggcgccgtgctggcgggcgcctcgtccgatgcggcggcccgggccacgcccggaaacgtgatcctgatccgcggcggctacgtcatgacgatggatgccgtgcggggcgacctgcccggggccgacatcctcgttcgcgacgggcgtatcgccgagatcggacgcggcctgccggctccggagggcgccgacatcgtcgaagcggcgggcgcggtggtcctgccgggcttcgtcgatgcccacacccatggcgcgatcagccagatgcggggtctctacggcaacacgcccgagaccgcgttctttcccgtcaccaaccggctctcggcgcattacagtccggaggacacctatatcggcatgctgctgagcgccgtggagagtctggcctccggcatcaccacgacggccgacttcttcgacgccgtgcgcgaccgcgaacacgcggaggccggtctccgggcgctgcgggacgcgcagatccgggcgcggctgctctacgggatgacgagcaagaccgcggcggccccgatcgatctcgcccatgtcgaggaatggcagcggggctgggcggaccgctcggccggcgggcgcctctctctcggcctcgcttggcgcctgccgcaggatctcgacgacgcgcgggcctgggcgatcaagcagggggaatgggaggcggcccgccggctcggtctgccggtgcaggtccatgtcagcggcacggtaccgggacgggcggaggcgatgttcgacgccctgatcgcccggcggatgcttcggccgggcctgcaggtcatccatgcgaccgacgcccgggacgaccagctcgccgcgctggaggaggccggcgccggcctcgtggtcacgcctctgaccgagcaccgggtcggctacggcctgacccggatcgatcgcttcgccgggatccggcgcctcggcttcggcatcgatggaagtgcgctggccggctccaccgacatgttcgccctcatgcgcctcaccgcgctcacccaggccggcgccgcgcgtgacgagacggccgtctcgccccgccggctcctggaactggcgacggttggcggggcgcgggcgatgggcctcgatgcggagatcggcaccctcgtgccgggccgcgcggccgacctgcagatcgttcggctcgacacctggaacctcgccggtttcaagggcggcgatccgtcggcactcctcgtctactcggcccgaccggaggatgttgcaaccgtcatggtcggaggccgcttggtgaagcacgaccgtcgccttctattcgacgacctcatgctgctcgaccaagcccgcctatccatcctcggaatttgcagacgttccagccaagtcggtccttga

SEQ ID NO: 9165 - DNA, 231 bp, Methylobacterium sp.
atgcgatccgcacccttcaccatcgtcatctccggcaagcggtacgagtgccgcgtggccggcaacaccgagtccgaggcggctgacacggccgagcgcatcctgcaccagctccgacaggaggatcgtgtctggcccgcgcaggtgaacatcgactgcgcggatttcgaagcgggaaagcgcctcgccgcgtatttcgccgccatcacggtcgagcccgacctcgactga

SEQ ID NO: 9166 - DNA, 213 bp, Methylobacterium sp.
atgaacgacgcggcacttccgacacgacttggaccgcaggccctgatcggcacttggcgccggttcgggcctgtcgggccgatctacgaggtcatcggcctggcgccgacccgtccggacggcgaaaccctcgtgcgcgtgcgtgttctcgaaacggctgaagagctggattatcggctgagggaactcctcgacgatccgccggcacggtag

SEQ ID NO: 9167 - DNA, 1098 bp, Methylobacterium sp.
atggcgcccctcctcgaacgcgccttgggcaccctcgtgatggggggcatcctcctcgacgtgttcctcaccgtgctctacgcccgcatcggcaccggtctgatcgccgagcgcgccgcgcggctcgcctggatcgccttccgccgcgctgccgaggcggccggtgcgcgacgcgggacggttctgtccttctgcggaccggcgatcctcctcctctacgtcctgctctgggccttcggcctgacgctcggcgccgggctcatcatacatccgggtctcgggacaggcgtgcaggcgggcgacggtccgacacccgaagacttcctgaccgcgctctacgccggcggcagcagcatggcgatcgtcggcgcgagcgacttcaggcccacgagcgacgcctaccgcgtcgtctacctggtgaactccctgatcgggctgtcggtgacctcgctggtcctgacctacgtcatgcaggtctacggcgccctgcggcagcgcaacgcgctcggtctgcagctccacctcctctcgggtgggacctccgacgcgggcgagctgctggcgcgcctcggaccacgggcacagttcagcgccggctacacgcatctcgccacgctcggcgacgcgatggccgcgatgaaggagacgcaccacttctacccggtcctgttctatttccgttttcggcaaccctactattcggtctcggcgcaggcccagctcgccctcgatacggtctcgctgatccgcagcacgctcgcgggcgaggatacggcgtggttgaaggacgccgcagcggtcgaggcgctctggcgggtggcccagatgctggtcgtcacgctcgaaacggctttcctgccgggcgatccggtggtcgccagaaccatcgatcctcgcgagcggcagcgatggcgcgcgcattgggagcgggcggtggcgcgtcttgccgaggcaggcatcccggtcgcgaagcaggagatggcggcgcaggcctacctcgacttgcgcgcccaatggtggccgcacatcgctcgacttgccccggcgatggcctaccggagcgaggacatcgaggcgcaccgatcggagaactcctaa

SEQ ID NO: 9168 - DNA, 1344 bp, Methylobacterium sp.
gtgacgaccgtgaccttgcgccttcgcaccctcctcgccaccgcggcactctcgctctgcctgcccctcggcctcgtcgcctcggctgaaaccgagccggcacccgtccagaagaaggacgtcgatacgcctcaagcggtggaggccccgaagacggcgcccgatcccgccatcgagcgcgggcgctacatcgccgtggccgccgattgcgtggcctgccacagcaatccgaagagcgggaaaccgttctccggcggttatggcctggaaaccccgttcggcacgcttttgtcgagcaacatcacctccgacccggagacgggcatcggccgctggaccgaggcggagttcacgcgcgccctgcgcgaggggctcggcaaggacgggcagcacctctacccggcgatgccctacacgagctacaccaagatgtccgatcaggacgtccacgacctgtggctctacatgaagacggtgccgccggtccgcaacgccgtcgtcaccaaccagcttccgttcccgttcaacatccgcgccctgctgatgggttggaacctgctgttcttcgaacagaagcggttcgagccgagagccgaccaatccgccgcctggaaccgcggcgcctacctctccgacgccctcggccattgcggcgcctgccacacgccgaagaacgtcctcggcggcgacaagacgagcaaggcctatcacggcgaggttctgcaatcgtggtacgcccccgacatcaccacgagcaagaccggcggtatcggcgactggtcgaagggtgacatcgtccagtatctcaagatcggcagcaaccggatggcggtcgcctcgggtccgatggccgaggcggtgacgaactcgacccagcacctgaccgacgccgacctcgcggcgattgccgactatctccagacgctgccgccgggccccgccaccgaggcgccgcgcaccgccgccaccggagcggtcatggcccagggcaagcgcgtcttcgacgcgcagtgcaaggcgtgccacgcctccgacggaaccgggatccggcacatgacgccgagctttcccggcaacaccgccatccagtcgcacgaggtcgccggcatcgtccggaccgtgctggcgggcgcgcgcggtgcgatcacggccgagaacccgacgggagcggcgatgccgtccttcgcatggaacctgtcggaccagcagatcgctgcggctctcacctacatccgcaatagctggggcaaccgcgccccgcccgtcaccgccgaggcggtcgccggcacgcgcaagagtctcaacctcaacgccgtcgggcgtgcaccccatccggcgcattga

SEQ ID NO: 9169 - DNA, 1056 bp, Methylobacterium sp.
atgtacgatacgccggccgacgcccgcgcccagctcgcccagcaggacttcacccgcccgcagatcgagatgatcgtgggtgcgctcgtgccgacgctgacgttccggccggaggcgggcggagcggcactccggatcggggccacccggatcggcggcacgcccgacctgccgcctggcctcgcatggcccgtccgcgcggcgccgccggacgccgaggccatcgccgggcgcggcaacgtggaggcggccgagggcatgcgccggcacttccgcgcggcgctgccctacgccttcttcgcgcaggtggacctcgccgaggcgcgggggcagggcggcccggccgcggacctccccgaggacgggcggctgctgttcttctacgatcttattgccgggccctgggacaccggcggcggcgccgtccgggtgatctgggacccgagcccgcgtgcggcgctggcggcgcaggccgtgcccgcgccgctcgccgccgccgccgcggcgcaccgggccgagatcgcgcaggtaaacgcggcgttcaagctgccgccgccgaagcccgaggcggcgacaccctacggcgcgcctgggcggccgatgcgtctcgcagcgcgcctgcgcccgccgaacccgcacagcctcgaatgggcgggttcggccaagctcagggccgcctatgcggaggaagaggcggacgattttcgtgaggcctacgacgatctgttcgcgcacgccttcgatccgcattacggggccgccaattccgggcgccgcaaccagctgctgggcagcccgctgcccgagcagggcgacccgcgctacgaggccgaggtggcgagccgcttcggcgtgcagcatctcgatgccgagacccggcgggcgcgctggccggagatcgaggccggcgcgcgcgactggcgcctgctcctgcagatcgacatcgccgacttcatgcaggcgcgggaggaggggaccgtgtacgtcctgatccgcgccgaggatctcgccgcccgccggttcgaccgggccgccgccgtctaccagcagacctga

SEQ ID NO: 9170 - DNA, 684 bp, Methylobacterium sp.
atggcggcccttgccggcaacgcctccaccgcgcaggctgcggaactcagcggcgagatgccctgggagcccggtcaggcgaacgttccgccgctgcccgattccgggtcggagcgcttcgtgttcttcacgcctgcggaagccgaggccgtgggcgccatggccgaccggatcatcccggcggacgacctgagcgtcggcggccgggaggcgggctgcgtccgcttcatcgatcgtgagctcgccggcccctacggccgggcggcgacgcagtaccgcctcggccgcttcgtcaagggaaccgccgagcagggcatccaatcccctctcgccccggccgaccgctaccggctcggcctcgccgccctcgatcgccactgccgcgcggcccacggcaagggctacgcgagcctgcccccggacgagcaggacaaggtcctctcggcgatggaggccggaacgctcgacctcggcgaggtcgatgcgaaggagatgttcgagcggatcctgcagaacgtccgcgaaggcttcctcgccgacccgctctacggcggcaacaaggatctcgtcagctggcggatgctcgggtttcccggagcacagtacgatttccgcgacgtcatcgacttgaagggaaagaagctcgacttcgttccggtcagcatgatcgacaagtccctttga

SEQ ID NO: 9171 - DNA, 876 bp, Methylobacterium sp.
atggacctcgcggacgcgggctcgcccgaggcgctcgtcaaacgcatcctccaggccgagccgaaccttcccgtgcccgtgccgatccaggaactttgcgcgcgtctcggcatcatcgggatcgaggacctcgacagcgacgcattcgagggcggcctcgtgaccgacgcaaagcggtccgaaggcaccatcctcgtcaagcgcgggggcgaaccgcgtcgccgcttcaccatcgcgcacgaactcggccacttcctgatggcgcaccacgtcccggatcagcccggccggttcctgtgcaagggtgcggacatgctccgtctcacggccaatgcgggcgaccagcggcagcgcatggaagtcgaggccaaccgcttcgccgccctcgtgctgctgcccccgcacctgttgcgaggggccatggcggcgtttcgtgagcctgatctgcagcacgttcgcgtgctcgcgcgcgacttcgcggtcggcaaggaggcggcggctcgggcctacgtgcagtaccacccggagcggatcgcggtcgtcgcagcgggcaagggccgggtgcagcggtgttaccgcagcctctccttcccggacatcatctgcgggatcggcagcccgatcccgacaggctcgctctatcacaacggttcgcatcggcccaacagcgcgagcgacattgccgcgtgccctcccgatctctggatcgacgtgaagcgcgacctccgcgcgccagccctctacgagcaggtgtaccttcagccgaacggcttcgcgatgatcctgctgcgtctggcccccgtcccggaagacagcgcggaggagcgcaggctcgaggagggttggcgtcaccgcttccactcggggcgacggtag

SEQ ID NO: 9172 - DNA, 261 bp, Methylobacterium sp.
gtgatcgtcgatgctgccggggcggcgcatcgcgccacccgcgtcgtcggcgccgcggcgcggcggctcgacgcgcaggaccgcctgctgcacgcgatcgtggcggcgctggcgcctccggaagcggagacggagggctcgggattcgaggacctgatcgccgtgctggccgacctgacggaagcggtcgccgacgtgacgcaggccgtgcaagccctgcgctccgacgtctccgcgcgcttccctacggtcagggcctga

SEQ ID NO: 9173 - DNA, 1743 bp, Methylobacterium sp.
gtgatcgtcggtctcggctggtgcggctcgctcatggccgaggagctgacccgggccggcctcaccgtcgtcgccatcgagcgcggcccctgggtcgagacggccgtcgatttcccgccctccgtcgatatggacgaactgcgctgggacacccggcgggcgatgctgctgccgccggcgatcgagaccatcaccttccgcaacgacccgacccagaaggcgctgcccgcgcgggactggaacttcaacgagtggggctacaatgtcggcgggtcgggcacccactgggccggcatggcgtggcgcttcctgccgttcgacttccagccctacagcatgaccgtcgcgcgctacggcgccgagcagctcctcgacggcctgatcgtgcaggattggggcgtcacctacgacgacctcgaaccgttctacgaccggttcgagaagatcgccggcgtgtccggcaaggccggcaacctcaagggcgagaagatccccggcggcaacatcttcgagggggcgcgctcggacgagtatccgctgccccccctcaagacgacccgcctgaccgacctgttcaccgaggcctcggccagcctcggctaccatcccttcatggttccggcgggccagacctcgggggcctacaccaacccgctcggcgtccggatggggccctgcacctattgcggctactgtctgtattacggctgcggcaactggtcgaaatcgacgcccaacaactgcgtcgtcccggcgctgatgcagcgcaagaacttcagcgtcctgaccgaatcgacggtgctgcgcgccaacctcgccccggacgggaccaccgccaccggcgtgacctacgtcgacaaggacaaccggacctgggagcagccggcggacatcgtcgtcttctccgccttccagatgcagaacgtgcggctgatgctgctctcgaagatcggcaagccctacgatcacgcgaccggcgagggcgtcgtcggccgggcctacagcttccagaccgtgtccggcgccaacatcttcttcgagaacgagtacctgaaccagttcatcggcgccggcgccctctcggcccaggtcgatgacttcaacggcgacaacttcgaccatgccgggatgggcttcatcggcggcgccggcatcctcgtcgtctcccgcggcgcccgcccgatcggcaatgccgacttcctcccgcccggaacgccccggtggggcagcgcgtggaagaaggcctacacccacagcttccagaacgggacgttcctgttcggccagggcacgagcttcgcgcacaaggacgcctatctcgacctcgatcccgagtacaaggacatccacggcctcccgctcctgcggctcacctacgactacaacgagaacgaccgccgctcggcgaagctgatcgaggacaagagcgtcgagatcggccggaagatgggggcgaaggtcgtcgtcggcacgaacgcgaccaaccagcacgcctcgccctaccagctcgccagcgaccacaccaatggcggcgcggtgatggggctcgacccgaagaccagcgcgctcaaccgtttccagcagagctgggacgttcacaacgtcttcgtcctcggcgcatcgtcctttcccaacaacgccggctacaacccgaccggaacagtcggcgccctgacgctctggactgcgaaagcgatcatcgagacgtatctcgacaagcgcggtccgctggtggcgaattga

SEQ ID NO: 9174 - DNA, 993 bp, Methylobacterium sp.
ttgtcttccttctgcgccgtgctcgcctgcctcggggcggcgcgggcggaggctcagagctcggacgcgctcaaggagccgtaccggcgcccgagcgcgatcccgttccccgaggcggcgccctacgcgccccagatggcgacgctcggcaagatgctgttcttcgacccgcgcctgagcggcaagcagaacctcagctgcgcgagctgccacaacccctccttcggcttcgaggtgccggtgcccggcgcgatcggggcgaccaacaagccgctgccgcgcaaggcgccgaccgtgctcaacgcggcctggacgccggtcctgttctgggacggccgcgccccggacctcgagacgcaggcggcggggccgatcaccgcggatgccgagatggacggcaagttccccgagatcgtcgcccgcctcaaggccacgcccgaatacgccgcctggttcggcaggctgttcccgcgggacggcgtcacgcagggcaacatcctcacggcgatcgccacctacgagcgcacgatcgtctcgggctgggcccccttcgaccgctggatcgagggggacgccacggcgatctccccggccgcgcagcgcggcttcgcgctgttcaccggcaaggccgcctgcgcgggctgccacagcggctggaacttcaccgacaacaggttccacgacctcggcatcccgacccgcgacatcggccgggccgccttcgagcccgacaatcccctggccaagcacgccttcaagacgccgggcctgcgcaacctgacctaccgggcgcccttcggccatgccggccagttccccgacctcgaagcgatcgtcgcgttctacgagaccggggggctggcgcggccctcgaaatcgccgctgatgaagccgatcagcctgaccggcgaggagcgggccgacctgctggccttcctgcgctcgctcacggccgagcagacccgcaccgcgctgccgaacctcccgaactga

SEQ ID NO: 9175 - DNA, 864 bp, Methylobacterium sp.
atgacctcgtcccccgacgtgggcgccttcgcgcgcctgcgagcggccggcttcgtctgcgccgcgactcgcctcgccgatgttgaccttccgcggcttggctacacgatcggcgtcggcgaggacgagatccatgccgtgctcgacgtcgagacggcgggcggcggcttcgacgcgctgaagcgcccgaagatcctgttcgagccgcacgtcttctaccgcaacctctcgggcgcggcccggacgcaggcagtctcgctcgggctggcctatgcgaagtggaagcctggcgcctacccgcgggacagctacccgcggctgatgcaggcgctctcgatcgacgagaccgccgctctgaaggcttgctcgtgggggctcggccagatcctcggcgagaaccacgtcgcggccggttaccatactccgcaggcgatggtggaggctttctgccagggcggcgagaccgagcacctggcggcgatgatccgcttcatcgtcgcgaacaagctcgacgacgagctgcgccgtcacgactgggccgggttcgcccggggctacaacggcccgcagtacgcggcgaacggctacgaccggaagctcgcagcggccttcgcgaagtggtcgcggatcaaggacacgccttggtcgccgagcgaggtcgagccggttcccgacccgctggcgccgatgggggccggcgctgacccggtcttacaaaaagcagcgcagaatatgccagctcccatgctgaagcccgcccccaccggcggcctttcttctgcgccgagccccgcgccggccgcgccgggcttctggtcccggctcctctccaccatccgcctcaacctcgcgaaaggagcctga

SEQ ID NO: 9176 - DNA, 621 bp, Methylobacterium sp.
atgcgccgtttcgccaagctcctcgccctagtcatggccgccatggccgcctccgcccagcgcgtctgggacggcacgaagtggatcgcccgcgcagccttcggcccgcccgtccccgcgggcgccggcatcgaagaggctttcgacgacgtcgcgcaggccctgcgccccgtgacgccgtcacagcccgccgccgaagccgtgacgccgtccgcccccgcgcccaagcccggcccggccaaggtcgtggagatcgaccccgtcctcgcgcggggccgcgtcgcctacgccttcgcgcacgccatgctgacggccgacgagccctcgaccgccggcctagacgacgccgcgagcgcgtggctgaactccctgaacgcgagcgagctgatgaaaatccaccagtacggcgcgcaccgcgtgggggcccacatggcgggcctccgccccatcgagggcctgcccctgtgccccagcatggcggagtaccgtaatgcgctgtgcgccgccgcgcagatcacgccccagcagcgccgggacgtcgcggagtggcaacagatgctcgaccgggccttcgaagagatggtcgaggaccccgcttacgaactgaagtgcggtatctga

SEQ ID NO: 9177 - DNA, 828 bp, Methylobacterium sp.
atgagcgcggcgcgcgtgaggggttccggccgttccctggagatcatccgccgaagaccggcgcgggcgctcggccggccccggctcctgttcgtccacggcatctcggtcggcgcctggatctggggcgagcacgtgctgccctggttcgccgaggccgggttcgaggcttgcgccctcagcctgcgcggccatggcggcagctggggccacgaccggatcgccgactggcggctcgccgactacaccgccgacatcgatcaggccgcccgcagcctcggcggtccgctcgtggtggtgggccactcgctcggaggcgcggtgatccagaactgggtccgcaccggcgggcggccgctcgggatggcgctgctcgcagcggtgccgccctggggcctcgcggtctcggcgctgcgcatgggtctcctgacgccggccctgttccgcgaggttctggcgatgagcctgcacggggcgcgggcggccgatccggcgatcctgcgcgccggcctgttctcggaggacgtcgcggcggagagcttccgccgcttcgtggcgcggatcggcgaggaatctcgactgatcgggcccgagctccagggctggccgcccttcgcgcccctgccctgggaggcgccccgcaccttcgtgctgggcggggcggacgaccgcttcatcccggccgacgaggtctggcgcacgggcgcctattacggctgccgtccccacatcgtgccgcgcctcgcccacgcgctgatgctggagccgcgctgggaggaggccatggcccccctgcgcgactggctgctcacgctgccgcggacgtaa

SEQ ID NO: 9178 - DNA, 2523 bp, Methylobacterium sp.
atgatcaagacctttattcccaacgatcccctcttcggcgcgcagtggcacctgcagaataccagccagaccatcatgggtctgccgcaggccggcggggcgtaccggaacgacatcgacgtcacgaaggtctggccggactataccggcaagggcgtcatcgtcggcgtgatcgacgacggcgtccagatgaaccatccggacctccaggcgaacctgctgctgggcaagttctacgacctggatgccggcaaggccggtacgcccaacgggaagcacggcacggcctcgatcggcctcatcctcgcgccgcagaacgaccagggcggcgtcggcgtcgccttcggcagcaagggcatcggttacgtggcctcgccgggggtgttcaacctcgtcgcccagcgcatgctgacggacggcgtcgcggtcagcagcaacagctggggcctcgtcgggcccgaggacacgacgccgttcaagtacgcggaggatcaggccgagttcgacgccgtgctgaccaacctcgcgaaggccggccgcaacgggctgggcaccgcgaccctgttcgccggcggcaacgagcgggtggaggggagcaacacgctcttcgacctgaccagcaactcggcctacaccatcgccgtggcggccgccaatgcggacggcaccgtggcgacctactccacgccgggccccaacgtgctggtcgccgcgccgggcagcggcaatggagccggcagtgcagcgcaggtcgccagcatggtcaccaccgacctcctgggcaccgcgggctacaaccaggccgtggacggcaactacaccaacctgtcgaacacgggcttcaacggcacctctgcggcgactcctgtcgcctcgggcgtggtggcgctgatgctggaagccaatccgaacctgggctaccgcgacgtccaggagatcctggcctacagcgctcgcacccccgaaggagtcgcgacctggagcaccaacggcgccaccgactggaacggcggcgggcaccggcacaacgcggatctcggcttcgggctcatcgacgcgcacgcggcggtgcgcctggccgagacctggaacaagcagagcaccttcgcgaacatcgccggggcgacgagcagcttcacaggcacgggcagcgtctcgctcgcggccggccagagccggcagttcacggcctccttcgcgcagccgctgcgcgttcagcacgtcgccgtctcggtggacatgagcatggccggcggcagctccaacctcagcgccgtcacgctgacgctcaccggtccgaacggggcgacgacgaccgccctgatcgacccggcctcctactcggaggaccagaagaccaagatggcgagcacgctgacctacacgttcgactcggtgcagaactggggcgagctgagcaattccggggcgtggaccctcagcgtctccaacgccagcacgggcagccggctggacatgaaggcctccatctcgctgatcggcgatctcgccaccggcgcccagaccttcgtctacaccgacgattacgcgtacctcgccggcagcgagaccgcgcgcgccgccctcgaagcgacggcggccccgaacgtgctgaacgccgccgccgtcaccagcgacacgaccgtgaacctcgcggagcgcaccgcgaccatcgcgggcgtcgccacgcgccttggcgagagcgcgcgcttcgcgagcctgatcggcggcgacggcaacgaccgactcaccggcaacgacgccgcagatgtgctcgtcgcggcccgcggcaacgacgtgctgcagggcggcggcgggacggacacgctcaccggtggccagggcagcgacacgctgatgggcggcgcggacgctgacctgatctacggcaaccaggatgccgacctgatctacggcaatcagggcggcgacaagattttcggcggccagggcgacgaccgggccttcggtggtcagggtgacgaccagctcgtcggcggtgccggtgccgatacgctgctgggcaatgccgggtccgacctcgtctacggcaacctgggcacggacgtgatctacggcaaccagggggcggacacgctgttcggcggccaggattccgatacgctgatgggcggccaggacacggacgtgctcttcggcaacctcggtgccgacgtgatctacggaaacctcgggagcgacgttctgtacggcggccagggggcggacacgctttacggcggacagggcgacgacgtgctggtgggtggcctcggcgacgatgtgctggtgggtggcctcggagcagaccgctacgtgttcgcctcggaccccggcgggcgcgacctgatcgtgggctttcagcaggcgtccggcgatcgcatcgtgctcggcggccagggctacaccctcggcacggcccggaacggcgacgccctgctcacgctgacgggcggcggcgtgatcgacctcgcgggcatccgcgccgatcaggtcaatgcgagcttcttcgcagcggcctga

SEQ ID NO: 9179 - DNA, 1518 bp, Methylobacterium sp.
atgaacgatctggtcatcagtcgcgccaacgccatcggcaaggccgtggcggtgcgcaccgccccggtcaccgggcggatgcgcacctacatctcgggctcctcgctgctctcgggccgttcggacgacaccgagttcctgccggcccatctcgagatcctcgagacgccgcccgcgccccagcggatcgctgcgctctggctgctctgcggcgcgctcgcggcggccctcctctggagctgcttcgccaagctcgacatcttcgccatcgccaccggccgcgtgcaggtggcgggccgctcgaaggtgatccagccgctcgaccccggcgcggtgaagtcgatccgcgtcgagaacggcatacaggtgaaggcgggcgacatcctgctcgaactcgatcccacggtggccaacgccgacaagcaggcctcatcctgggacatctggtccctgcgcgccgagatcccgcggcgccaagccgagatcaaggccttcgagagcggcgccacggccccgcccaaggtcgatttcccagaggatatcggccccgagatccggctgcgcgaggagagcgtgctcgccgccgagttcgcccagtacatgtcggccaaggcgagcctcgagggtcaggtcggcgagaacgacgcgctgaaatccaggctcgccggcagcgtcgcggcccgtacgcggctgatcgatgttctgaaggagcgtctcggcatgaagcaggagctcgtggtgcgtgccgccggcacccgcgccgccctgctcgaatcgcaacaggcgctcgagagtgagcttacgaacctcgcctacgacaagggccagatgatgcaggcggaggccgccggcgtctcgctcgcgaagaagctcgagcagctccagaagcagtcggtggctgagcaggcccagaagctgaccgacgcccagcgcaagctcgaccggttcaaggaagatctcgcaaaggcgagcttccgggtcgaccgcacgacgctgcgcgccccgatcagcggcaccgtgcagcagctcgccgttacgacgatcggtcaggtcgtcaccaccggccaaccgctcatggtcatcgtgccgagcgagggcaacatcgagatcgaggccctggtgcagaacaccgatatcggcttcgtcgaggtcggtcaggaagcgacgatcaaggtcaacgccttcccgttcacccgctacggcactctcgacggccgcgtggtgcgggtctcgcgcgatgcggtcgacgcgaaggacgcctcgcagacctcggacgccgcgaccgcctcgcgggctcagaacagctcaatcttctcgtcgacgcccgccgcgcagaatctcgtcttcccggtggtgatcgcgctcaacaagacgtccctgctggtcgacggcaaggacctgccgctcacccccggcatgaccgcgaccgtcgaggtccagaccggctcgcgccgggtgatcgactacctcttcgcgccgatccgcgagacgacctcgactgcgggccacgagcgctga

SEQ ID NO: 9180 - DNA, 390 bp, Methylobacterium sp.
atggcgctggccgatgacctcatgcggaaagccgagcgggctctcgacacggcccggctcatgaccgaacacggcgccacggagggcgcctgcggtcgcgcctactacgcgatgttccatgcggcccaggctgcgctgctcacggtcggcacgcatcccgacgaggtcatcgtcaagacgcatcgcgggctgatcgcgagctttggcagacacctcgtcctgcccggtcatatcgatccggcattcggccggtccttcagccgggccgagcagcgccgcattgcagccgactacgcgggagacatgccgtctcgcgatgatgccgaggacggtctcgccgacgccgaggcattcctgcaggcgatccggatcgcgttcccgagcctatga

SEQ ID NO: 9181 - DNA, 243 bp, Methylobacterium sp.
atgctcagcatcagggatgaggaagtcagaaccctcgccgaggccgtgatgcggaagtccggcgcccccaacctgacggcggccatcaagcttgccctgcagcgcgagatcaagcgcgccgacgaggccgttcccctgatcgaccgcgtggccgcgatccgtgccgcagcactggcgaaggcggaccggccgcccgctccgcccctcagcgaggacgagcgcgacgccttgtgggcgcgctga

SEQ ID NO: 9182 - DNA, 1449 bp, Methylobacterium sp.
atggatgtcaccagacggatcttcgctgcgggcgcggccacgctgcccttcgttggaccgggcctgccgcgcactcaggctcagagcacggggcaggacgcgccgattatcggcaatcacgcggtggcggatccgctggagctcgcggtcgacgcctacatctacggctacccgcttgtcaccgtggaaatgacccggcgcgtgctcaccaacgtggccgcacccgagggcaagaacgccccgatgggccagttcgccaacctgcgggagtacccggacgcgaaattcagggccgtcactgccccgaacgcggacacgctctactccagtgccttcgtcgatgtcggcaaggagcctcacattctcagcctcccggacgaggacgggcgctattacctgatgccgatgctgagcgcctggacgaacgtcttcgcggtgcccggcaagcgcaccaccgggacggggccgcagacctacttcatcgcaggccccggctggagcggcagcgtgccgcccggcgcccagctgatccaggcgcccaccagcctgatctggatcctcggccggacctactgcacaggcacgcctggggattaccgggccgtgcacgcgctgcaggaccagtatcggctcatcccagcgagcgcggccggccgggcgtacaccccgccgcccggccggatcgacccaagcatcgacatgaagacggccgtgcgcgagcaggtcgaccgcatggacgcgacgacctacttcaacctgctggcctctctgatgaaggacaacccaccggcgctggcggacggtgttccgctcgccaagatggcctcactcggaatcatgcccggtcgctcctttgacccggcaagccagccgcccgccatccgggatgcgatcgggcgggcaccgaaggaggccagcccgcgcatcatggggtatctgaaggcaacgggcaggcacgtgaacggctggaccttcacgactgacggcggcgactacggcaaggactacctacagcgcgccctggtcacggcggtgggccttggctgcaacctgccccaggacgcggtctacccgctgaccacggtcgatgccgccggccgacggctaaacggcgcctcgaaatacgtgatgcgcttcccggccggcgagctgccccctgttgacggcttctggtcgctgacgatgtatgacgccgactacttcttcgtcgacaacccgatcaaccgctactcggtgagcccgcgcgacgatctcaaggccaaccccgacggctcggtcgacctcttcatccagacggagagccccggtgcaatgcgagagtcgaactggctgcctgccccgcgagggccgttcgtgctgatgctgcggacctattggccgaaggacgctctgctgaacggatcgtggtcgccgccgccggtcacccgcagcgcgagcgccaccctctaa

SEQ ID NO: 9183 - DNA, 1479 bp, Methylobacterium sp.
atgagccgggtgctgcgcccgcaccagacccggatcatcgaccggctgcgggaatcgatgatcgccgggcgccgccgcccgatggtccaagcgcccaccggggcgggaaagaccgtggtggcgggtgcgatcgtccggggcgctcgggccaagggcaaacgggtgctgttcgtggtcccggccatcagcctgatcgaccagaccgtgcggtcgttcttcgccgagggcatccacgacgtcggcgtgatccagggtagccacccgatgacggacgccagccgtccggttcaggtcgcttcgatccagaccctgcagcgtcgggccatcccgccgttcgacatcgtggtgatcgacgaggcccatcgctggttcgagatgctgggcacgtggatggccgcgcccgattgggccgcggtgcccttcgtcgggctctccgccacgccatggaccaaggggctgggccggcactacgacgacctgattcaggtcaccaccacggctgagctgatcgcggccggctacctcgccccgttccgggtctacgcgccctcgcaccccgacctcgacggggttcgcaccgtagccggcgactaccacgagggcgatctgggcgaggcgatgaaccggcccgagctcgtcgccgatgtcgtccggacctggcagcagcgcggggagaaccgcccgaccttcgtgttcgcggtcgaccgggcccacgccaagcacctgcagggcgagttcgagcgggcgggtgtggcctgcggctacatcgacgccttcaccaagtccgacgagcgggaggcgctgttccagcgcttcacggccggcgagctgcgggtgatcgccagcgtcggctgcctcaccaccggcgtcgacctcgacgtgcgctgcatcgtgctggcccggccgaccaaatccgagatgctgttcgtgcagatcatcggccggggcctgcgcacggcgccgggcaaggacgattgcctcatcctcgatcatagcgacacgcacctgcggctcggcttcgtcacggacatccaccacgatgctctcgacgacggccgggagcggcagaagcaggaccgcaagcgccggcccgaggccctgccgaaggagtgccctggctgctcgttcctgaagccggccaagagcccgaagtgcccggcctgtgggttcaagcccgagcgtcagtccgagatcgtctgcgaggacggcgacctcgtcgagatgacgccgaagcgcgagcgcgcgaacagcgccgagaaaggcctgatgttcggccagctccggcactacgcccggacccggggctacgcggacggctgggcggccaacaagttccgggagcgctacggggtctggccggaccgctaccacaacgctccgctggtccagcccacgcccaccacgctgtcgtggatcaagtcccgccagatcgcttgggtgaagggcaagggaggcgcccgtgcccacgcttctgcgtga

SEQ ID NO: 9184 - DNA, 300 bp, Methylobacterium sp.
atgagcgccgagctcagcgaggccatcgggcgagccgcccgggatgaggggcttaccgcgggagcctgggtccgccgcctgctgctggaacggctcgacctgaaatccgcggaggacgcccgcagcggtcgtccggttcgcgtgcccgaggggcatcacgccgccctcgcaggcgccctgcgcgagctcgcctccgccggtgccgcggtccggacgggtgacgaagtcgaggcggctcgcgcccttcaggccgcacgggatctgctgatcccgctcgccctgcgccggtcggcgccgtga

SEQ ID NO: 9185 - DNA, 426 bp, Methylobacterium sp.
gtgattgtcgccatcgagacggcgatgcggcgcggtgagttgctgtcgctgcgctggtgcgacgtggacctcgagcagcgcgtcgcgcatctcgccgtgacgaagaacggcgacacgcgctctgtccccctttcgagccgtgccatcagggcgatgctcgacctgcgcaccgagcgcaccgtgccgacagacaagctgttccctctccggcccggcagtctcgagcagacctggatgcgcttacgcgagcgtgccaggatcgagaacctgcacttccacgatctgcgccacgagggcgtctcccgcctgttcgagcgcgggctgggtatcgccgaggtgggcgcgatcagcgggcataaggaggtgcggatgctaacccgctactgccacctccgcgccactgacctcgcagagcgcctgcgctga

SEQ ID NO: 9186 - DNA, 990 bp, Methylobacterium sp.
atgctgccctatcccgtgctcctggcagatatcggcggcacctacgcccgctttgccatcctcgccgcgccggaagcatgccccggcccgatccggaaggtgccgacagccgccttccccgagcccatcgcggccctgcaagcctacctcgacggtccggggacgccgcagccgcgctccgccttcctcgccgccgcggggcgcgtcgacgggcaggccacgcgcatgaccaacgcgccctggctgttcgacctcggcgacatcggcgtcgccctcgggctggaggcggcgcggctggtcaacgactacgtgccgcaggcggccgcgttgcacgtgctcgacgaggcgaacgcggccgacttagcgcggatcgggcccgtcgcggccggaagggggccccgcctcgtccttggcccgggcaccggcctcggcgccgcggccctggtcccggtgggcgaccgcctcctggtccagacgaccgaggccggccacgtcgggttcggcccgtgcgagcgcgacgaactgccgtggcaggccctgatgccggcggaggggaggcttaccgccgaagccctgctgtccggtcccggcctcgccaggctcgcgcgggcgctggcggcgttgcgcggcgtagccgcctggcaatcgccgccggaggtgctcgaagcggccaaggtcggcgatccgctcgcgcaggaggccgtccgtcagttcgcgcgcctgctgggccggttcgccggcgaccttgccctgatgttctcggcgacgggcggcgtctatctcgccggcgggatcgcgccgcgcatcgtcgaggtcctgcagggtgaggcgtacaacgcggccttcgaggacaagcccccgttccgcgaggtgatgcagaccatcccccgcttcgtgatcacgaggcccgagccagccatcgacgggttggcgtcgctcctgcgcgcggcggaccgattcctgttccccggccaggactggcgggcttga

SEQ ID NO: 9187 - DNA, 1437 bp, Methylobacterium sp.
atgacggcctatttcatcacctgccatgcatccgtcgcctacgttcgtgaccagttccggtcgctctatgggccggagcacctgctgctctaccacgtggacgcgaaggcgcccgctgccctgcacgagacggtgcggcgcttggcggagaccttcccgaacgtcgtggttctgccgagtcggcattacgcctgggccggctactcgcaggtcgccacgacgctggcggcgatcgactgcgctctggcatccgggcccgattggtcgcatctcgtggctctcagcgagcagcattgccgtgtgctggacgaggcggagcttgtggcggcgctgacgccgggcgtgtcctacgtcgattccacacctttcagtgccatgaatcccggctttcaagccgacatcgcccatcgcttcagcatggattatcgtgagctgccgggcatcggcagcttcggaatcgcgccggtcgcgcccgacccggacttccttggccgccttcggcacggcagcaactggtacatcctctcgcggcaagcctgcgcctatctcggcacggccgcccgcacggccccggatgccgcgcgcctgcgcgctgcggtccatccggacgagaacatgctccagacgctgctcgcggccgacggcggacgcgcaggcccgatccagcggcgcgagaccaccttcgtggcctggccgcacatctcgggcaatcccgacatgaccttccgggcggaggatttctcggccgctcgcgcgggcgaccggctgttcatccgcaagcgaccggcgcagttgcctgcgccagtcgccgccctgcttgatgactgggcgtctctgagcgaggctgagctctccgagcggatcggtgccccgctggagctcgcgccggaagcccccgaccccgagggaacggcgctggcccgccgcgtggcgagccgggtggtgcggcgcgggcgcggcgtgcaggccgacctgccgaacctccggttcggcctgcgcaacccgcgcttcagcctgcgcttccgcacggcgcggatcccggatggcatcgacgtgcgcatcctctcgcaggatctccggcacttccgcgtcctgcttctggaggccgagcggccggagatcgacttcgcgccgcgccggctccacggccggccggccccgctcctgcggatccgcgtccccgaattcgatttccgacgggagatcctggtgttggaggacccggcgcacggcttctggacccggccggaggatggcagcgtgaccgggctcgtccggctcatcgagctctatctccgcgtggccgaagacctcgcgcagacgcgggcgcccgaaccggcccggggccctgccgcggcgcggcgcgagatgagcgcgcgcgcgcggagtttcgcctggagcctgcgccggctcctcaaacggaaacggccggcctga

SEQ ID NO: 9188 - DNA, 282 bp, Methylobacterium sp.
atgcgtaccgtcctcctcatcggcctcgtcggctgcgtcgcggctgccagcctcggccatgccgtcaccgccgccgagccgcccgccttccgcgccgtcgccctggtgtgcccggccggtatcgagggccccgactgctcgcgcgagaacgccctggacatcgccgtccagccggtcgcgcatgagaccgagtgcgggctggtcgggcaggtcctggcctcgcacctcacgctgcagccgggcgagcggcacaagatcgcctgcgagcggcggaggggctga

SEQ ID NO: 9189 - DNA, 570 bp, Methylobacterium sp.
atggaccgggccgctcccgcgcgcgccgaccgccccggggcctcgcgcctcggacggcgcctgcgcgacgaactcaagcggatggcggcgatcttcgcctatctctggacggtgttcggcatcctcgtcctgcacgagtggatcgtgctgtcccgccacgggatcgaccaccggttctacggcctcgccttcgtgaacgcgtggatcctggcgaaggtcgtgctcgtcacggagcatctcgacgtgctgccgcgctgggccggccggccgccgatctaccggatcgtcacccgctccgtcggtctcgcgctgatcctcgtcgtggcctacgcgctcgaggagaccgcgatcgggctcgtcaggggacgctccctcgccgacagcctgccgacgatcggcggcggcggcgtgcgcggctacctcgcgatcggcgtgatcatggcggtcgccctggtcccgtacttcaccttccgggagctcggccgcgtcctcggccgcgcgcggctgcgggccctgatcctgtccgagccggcgccgtcggcggcgggccacggcggggagcagcgctga

SEQ ID NO: 9190 - DNA, 1248 bp, Methylobacterium sp.
gtgatcagcggcgcgacgcgcggtaccgggcgcggcggggccctcgcgcgccacctgatgaaggacgagaacaaggccgtgctgatcccggcgcgcgccctcggcagcccggacctggcgggacagctgcgggagttggtggcgcaatgtgccggcgggcggaccgaccggcccgtctaccatgtgttctgcagccccgatccggccatcgccgacaacgcggcggcccggtcacgcttctggaacctctttgaacacgagttcggcatgaccgaccagccctactgcggcgtcgagcatgccaaaggcggtcgcctgcatgagcatcgcgcctacggcctggtccatccgacgggcgcggtggtcgacctgtcctgggactatgcccgccgcgagaagtgcgcgcgtatcgtcgagagcgagttcgggctgtccccggtggcgtcgaagcacgcgcgggccgtcgagcgcgcccttcgccgggagggacgctccgacgtggccgactggctcgccgcgtccggggcgaccgtggccgagcggccgatcgcgcggctcaccccacgggagcgcctgatcgaggagcgcacgggcgtgccgctcgacgacctccgacgtcaggtgttggcggcttggcgcgagaccgcggacggccctgccttcgcggcggcactcgcggctcgcggcctcgtcctgcggcggggacgggtcggacccgtcatcgtcgacgcgagcggcacggcgcgcgcggccacgcgcctcgtcggtgcggcggcccggcgcttcgagggcacgcgcatccgggcggcgacggtgaaggagcgcctagccgggctgaggttggaaggagttgacgatggacgatgttcaggtctcgcggcggctggccgcgatggaggcgctgttgcagggcatcctggcggccctggcgccgccgggatcggagtcggaggggtcgggcttcgacgacctggtggaggcgctgtcggacctgacggtggcggtggccgacatggcggacacggtccgggcgctgcgctcgaccggctacgtgccgcctccggcgcccgccgcgccatgatgcgtcgccacctcgcgggcctcgacgtgtccctcgaccgctaccgggccgccgccgagcgcgcccgtgcagccgccgagcgcctcgacgaggttgccgacgcccgccagaggcgagggatggcgctgtggggcgtcaccgacatctggggcctgccccttcaatga

SEQ ID NO: 9191 - DNA, 432 bp, Methylobacterium sp.
atggtcatcccggcccgcggcctcggcagcgcggatctcgtcactcagatccgcgaactcgtcgcgatctcgctgggcgggcgcacggaccggctcgtctaccacgtgcatctcgaccccgacgtggggatcgcgaacgaggctcgcgcaagggcgcggtggtggagtctgttcgaggcggagttctgcctggaagcgcagccgtactggggggtggagcatcgcaagcacggtcgccgccacgagcaccgcgtctacggcctcgtgcgcccctccgggtccgtggtcgacctcgcctgggattacgcccgccgcgagaagtgcggccggatcgtcgagttcgaattcggcatggcgccggtcgcctcgaagcatgcccgcgccatcgcccgccacctccgcgaggagggtcgcgcggaggtggccgactga

SEQ ID NO: 9192 - DNA, 819 bp, Methylobacterium sp.
atgcgccgcggcttccgcacccggctcctcgggatctcgggcaagctcatcgtcgggctgatcctcgccttcatcgtgctgccggccctcgtggtgacgctcgccgccttcaacgaccgggcgatcctgagcttccctccggccaagtactcgacccgctggttcacccgggccctgacctaccgggacttccagaccggcctgtggaacagcctcgtggtcaccgcctgggcctccacgatcgcgctcgtcgtcggcaccggcttcgcgatcgcgctgaagcgctacgccttccgcttcaaggcggcgctcgagggcgtgctgctctcgccgctgatcgtgccgcacttcaccatcggtctcggcctcctggtgctcgccaccggcatcggcgcggcgcggggtttccccgtcgtggtgctcacccacgtcgtggtggtgctgcccttcgtgatccgctcggtctacatctcgctgcagaacatcgacgagcggctggaactcgccgccgccagcctcggcgcccggccgggccgcgtgctcggcaccatcaccctgccgctcctcgcgccgggcctcgtcagcggctggttgttcgccgcgatcctctccttcaacgagttcaccgcctcgctcttcgtgacgggccaggcgacccagaccctgccggtcgccatgtacggctacgtccgcgagttcgcggacccgacgctggcggccgtctcggtcatctacatcgcggtgacggcgctcgccctgaccgtcgccaacacgttcctcgggctcggcaaggtgctgaatgttgagcaaggccgttga

SEQ ID NO: 9193 - DNA, 1419 bp, Methylobacterium sp.
atggcgccggacacggtcgccctcgatctgccggaactcggcaagggtcgtcacaccgcccgcctcagcctgatcggcgtgatcgccaccttcggcgggttgctgttcggctacgacaccggcgtgctgaacggggcgttgtcctacatcgccgactatttcggcctgtcgccgctccaagaggggttcgtcaccttcagcctgctgatcggcgcgaccctcggcgccctggccggcgggcggatctcggaccggatcgggcggcgggtcaccatcacaggcctcggcgccctgttcttcgtcggcgcgctcggctgcgtcctggcgccgacctacgacatcctcatcgtcttccgcgtggtgctcggcctcgcggtcggcggcgcgtcggtcacggtgccggtctacctctccgaggtcgccccggcggagcagcgcggcagcatgatcggccgcaacgacatcatgatcgtgtccggccagttcctggccttcctgttcaacgccgtcatcggcaacgtgctgggcggcaacgagcacgtctggcgcatcatgctcgccgtcgcgctcctgcccgccgtcgtcctgttcctcgggatgcgccggatgcccgagagcccgcgctggctgatggcgcagggccgctcccccgaagccctggacgtgctgcgcacgatccgctccgaggcccgcgcccaggccgagatggaagaggtgcgcgtcctcgcgcggctcgacgcggtcaagcgctcgaccagctggcgcgacctcgtggcggagccctggctggtgcgcctgctcttcgtcggcatggggctggccgcgctcgcgcagctcaccggcatcaactcggtgatgtattacgggacgcaagtcctggagcaggccggcttcacccggaacacagccctgatcttcaacgtgctgaacggtctgatcagcatcgtggcgatgctcgtcggcgtgatggtggtcaaccgcgtcggacgccgctcgatgctgatcctcggcttcggctgcgcgacggcgctgcacgtcttcatcggcgtgatcggcatcgtcgtgccgctcgacaacccggcccggccctacctcctgaccgtcggcatgttcggcttcctcgcgatcgtgcaggggaccatccagctcgtgagctggatcatgatgtcggagatcttcccgctgcgggtgcgcgggctgatgatcggcgcgagcgtcgcggttctgtggctcaccaacgcgctgatctcgctcgccttcctgcctgtcgtgcagaccctcgacttcgcgaccttcttcctgttcggcggctgctgcctgttcggggtggtcttcacggcgcgctggctgccggagacgcgggatcggagcctggaatcgatcgaggcggagctgtccgcgggaggcgcccgtgtctga

SEQ ID NO: 9194 - DNA, 1773 bp, Methylobacterium sp.
atgagccgatcgcaggatcgccgggtcgtggccgaagagctgcgcctcgtgctggacggcgtctctcaatcggtcgccgtgggattcctcgtctcgacgctgatgctggtcgtgctctggacgcccgcgccccgcggcatcctcctgagctggtacgccgcgttcctcatcgagcggatcgcggcggccctctacgcgcgacgcgcgcgccatgtcgtggaccgtcccgaccgcgcgcgccgggtcgagcgcatcgtcttcctgagcaagatcatcgagggctcgatcctgggctcgctgatctggatcgcgctgccgctgcagattcccgcggtcagcatcctgacgatgtccctgctgggggcgacctgcagcaacggcgtctcccttctggcgccgcgccgccatctgtatctcgcgctcgtcatccccgtcgccatgctggccgcgggagcgctgtggtcgctggggggcgctccctaccgggccctggcgatctgctcgatcctgttcgtcgtcgggcagtacggacaggtcgtgctcgccagccgccgcgtccgcgagtcgatcgaattgcgcttcgagaacatggctctcgtcgagcaattgcgcggggagagcgcggccgcccacgcggcgcgtcgagacgccgagcgcgcgaacgcagcgaaatcgcagttcctcgcggcggcaagccacgacctgcgccagcccgtccatgcccttggcttgttcctgcaggccctgagccagacggatctcgtcggcccgcagcgtcggatcctgcagaacgcccaggccgccaacgtcgcctcgacggacatgctcaacacgctcttggatttctcgcgcctggaggccggagtcgtcaccccacggccgagagccttcgaactccaaccgctcctcgacaagatcgagaacgacctcgcccatctggccgatgcgagacgcctgatctaccggaccgtcgaaacggaccgggcgatcgtttccgacgccgcgctcctggaactggtcctgcgcaatctcgtcctcaacgccatccgctacaccgatcgcggcggcatcctcatcggctgccggcgacgcgggaccaacgtctcgatcgacgtctacgacacgggaatcggcatcccggaaggcaagcgggaggacatcttccgcgagttctatcagctcggcaatcccgagcgcgatcgccagaagggcctcggactgggactcgccatcgcgcgggggatcgcgacctcactcggacatgcgctgtccctgtcatcgaaggaggggcacggcagcgtgtttcgcatcctcgtccctggaacggatgagaccgtgcccgacgtcgatgtcctggccgacatcccgaatcccagcgggctcgccggcgcgcgcgttctggtcgtcgatgacgacgccatcgtgcgcgacgcgatgacggcgctcctgaccggctggggatgccggtgctgggtcttcgaaggtccggacgacgtcgggcggcaccccgcgtccgaaccggctccggatgcgctgatatgcgacttccgcctgcgcgaggggcgaacgggcaccgaggccatcgcgctgctgaggcggcattgggggcgcccgatccccgcgatcctcatcaccggcgacacggcaccggcccgcttgcgggaggccttggacagcggaatcccgctcgttcacaagccggttcgccccgacatcctgcagaatgccctgctgtccttgatcgcgccggggcgaccgaccggaagcctctga

SEQ ID NO: 9195 - DNA, 807 bp, Methylobacterium sp.
atggatcaggcccgaaccggaccgccgccgctgctgaagatcaggaagctgcgcaagagctacggcacgaacgaggtcctgaaagggatctccctcgacatccacgagggcgaggtggtgtcgatcatcggcgcgagcggatcgggcaagagcacgttcctgcgctgcctgaacctgatggagacgccgacctccggcttcatggatttcgagcgcttcgccttcgactacgaggagggcgcccgccgccagccgacgccgcagcagctctgcgaattgcgggcgcggatcggcatggtcttccagagctacaatctctggccgcacatgacggtgctggagaacgtcaccgaggcgccgatccgcgtgcgccggatgccgcgcaaggaggccgtggcggaggccgaggccctgctccagcgcatcggcctctacgagaagcggcacgcctatccgtcgaagctctcggggggccagcagcagcgggtcgccatcgtgcgggcgctggcgatggcgccgaaggtgatgctgttcgacgaggtcacctcggcgctcgacccggagctcgtcggcgaggtgctggcgctgatgggttcgctcgcggcggacgggatgacgatgctcctcgtcacccacgagatggccttcgcccgggacgtcgggacccgcaccctgttcttcgacggcggcgtgatcgccgaggacggcccgcccgccgagatcatcggcgcgccgcggagcgagcggctccggcagttcctgcggcgcgtcctgcacgatccggcccggctcggagcgtcggcgtga

SEQ ID NO: 9196 - DNA, 414 bp, Methylobacterium sp.
atgcccgcgctcgacggtgtcctggagacggtcctgtacgtggaggatctcgcccgcgccgacgcgttctaccgcggcgtgatgagcctgtcctgcatccacgaggatttccggatgcgggcctacgacgtggccggccgcggcgtgctgctgctgttcccgcgcgggggctcgctggagccgatcgagatccctggcggcaccatcccgccccacgacggctcggggccgcagcacgtcgccttcgcgatcggggcggacaccctgccggcgtgggagcggcacctcgccgaggccggcatcgccgtcgagggccgcacccgctggccccgcggcgggcagagcctctatttccgcgatcccgacgggcatctcctggagatcgcgacgccgggactctggcggggctactga

SEQ ID NO: 9197 - DNA, 1017 bp, Methylobacterium sp.
gtgtctgagcgtatccgcttcggggtcagccccatcgcctggatcaacgacgacctgcccgaactcggggccgggacaccgctggagcggatgttccacgaggccgccgcgatcggctacgacgggatcgaactcggcggcgccttcccccgcgagcccgcggcactctcggccctcctggctccgtccgggctggccctggccgcgggctggtacgccagcagcctgctcaccgtcgatgccgaggcggagatcgaggcgctccagccgcatcttcggctgctgagggcgatgggatgcgacgtcttcatcgccgccgaatgctccacctccatccacggcctgcgccgcgtgcccctggcccaccggccggtgctggactgggcgggctggcgccgcttcggccgggagctgacgcacctgtccgagtacctggcccgcgagggcttccggctggcctaccaccaccatctcggcaccgcggtccagagcgtgaccgacctgagcgcgatgctcgcccacaccccgagccatgtcggcctcgtgctcgataccggccacgcggtcctgggcgggatcgatccggtcgcgctgatccgcgaacatccggaacggatcgcccatgtccactgcaaggatgtgcgcccaccggccttcgccgccgtcgaggccgcgggaggcagcttcctcgacggcgtcctggcggggatgttcacggtgccgggggacggcagcctcgccttcggccctgtgctccgcgcactcgccgacatcaagtatcgcggctggctgatcgtcgaggcggagcaggatccccagatcgccgatccgcgcatctacggtcggatcgggctggagaccgtgcgtcgggaggcgatcggtgcgggcctgacgacatggacggggtcgctcgcccgcgcagcggtcggagcgccttcgcccggcaacgccccatcgcaatcgcccgcagcgacgctgttcccgctcgcggagctggccctgtccgggctcgcctag

SEQ ID NO: 9198 - DNA, 618 bp, Methylobacterium sp.
atgaagctgttctacgcgcccggcgcctgctcgctctcgccgcacatcgtgctgcgcgagctcgatctgccgttcgctctcgaagccgtcgatctgaagagcaggacgaccgcggccggcacggacttcacggccatcaatccgaaggggtacgtgcctgccctgcagctcgaggacggagaggtgctgacagaaggcgcagcgatcgttcagtacctggccgacagatacgctcccggcaccctcgcccccgtcgccggcacggtcgagcgcgcacggctcaacgggcacctgaacttcatctccgcggaggtgcacaaggcgttcggccccctgttcgacccggcgctcgcatcggaggcgcgcaccgcgtcgatcgcgaaccttggtcgcaagctcgacgtcgtccagggtacgctggccgacggacgccccttcctcaccggtcaggacttcaccgttgccgatgcctatctcttcgtcgtgctgagctgggcgccgcatctcggcgtcgatcttgcccgctggccacgcctcgccgagttcagccatcgcgtctcggcgcgccccgccgtgcaggccgcgatgggggcggaagggttgcggaagccggcctga

SEQ ID NO: 9199 - DNA, 618 bp, Methylobacterium sp.
atgagcggtcacctcccgaacaagcagcacgcgcacgccgagcgcggcaacgacctctacgagacacccggcgccgccgtgcgcgcgctcatcgccaccgagtggctgccccagcggatctgggagccggcctgcggtcccggcgcgatcgtgcgcgagctgcgcgccgccgggcatgacgtcgtggcgtccgacctagtggactacggctgccccggtcaggcggccggggtcgacttcctgaccgtccaggcggcgcccgacggcatcgactgcatcgtcggcaacccgccttacaaggacgccaacgccttcgtggagcgcgccatcgcgctctgcccgcgcgtgatgatgctgctgcgcttctccttctacgagagcatccgccgcggctcgattctcgacaccggcacgctggcccgggtgcactgtttccggaagcgcctgccgatgatgcaccggcatggctgggagggcccgaaggccgcctccgggatggccttcgcgtggttcgtctgggaccgctcgcaccgcggcgccacgctgctcgaccggctgtcctgggaggacttcgccgacgaggccgaatccgctcccgtcctcgcggcggcggagtag

SEQ ID NO: 9200 - DNA, 1572 bp, Methylobacterium sp.
atggcggaggcgtcctgccgcgccgtcactgtggctacgacggcgatcagcctcgtcctgtgctccccggcggcggccgcgccgacgaacgaggagctgtacgcaatgctgcgctcggtccagaccgagcaggcgcagctgaggcgtgagaacgccgaggccaaagccgacctcgccgaggcgcggcggcagttgcgggaagcccttggatccgcgcggctcctgcacaggcgcgatcccgccggcctcgctacggtgagcgttcctgcacctgtgcccgtcgcgcggcggctcgcaccgccgcccgccgtgtcgggagtcgtcggcgcggtcgagggcggagccggcggcttccgggcgggagcgggtggctacgccgcgggatcgctggcttttcccgtcggccggtcgttcggattgcaggcggatctggccatgatggccaacggcggcgatctcggcctgggcgcggccggacgcgccttcctgcgtgattctaacaaagggctgatcggcctttacggatcagtcgattacgccagcgcgatccgaagctacggccttcaggacgtgggtaccacgaccggccgcatcgccgcggagggcgccttgttcttggaccggctcaccctggacgggatcgccggctggcagctaggcgagcgcgcggaccgcttcttcgatcaagtcgacctgtcttggtacgcgagcgacgatctgcgcctcagcatcggccatcgctatgagaacaggatccacgccgtcgcggccggcgcggagtacctgctgccgctcggtagcgcggtcggcgtgtcggtgttcgccgagggccgcgtcgggagcaacgattaccgcgccggcctgggcggcttgcgcgtctacttcggccaggaggacaagtctttgctgcggcgccagcgcgaggacaccctcaaggtccgcctcatcgacgccttcgcgtcgcgcccaaagggcttccgcgtcgttccggctatcggaccgcagggaccggctggcccgcagggtccgaccggagcgacgggtgccaccggcccgcagggcctgaccggagcgacgggtgccaccggcccgcagggtccgaccggaccgcagggaccggctggcccgcagggtccgaccggagcgacgggtgccaccggcccgcagggcctgaccggagcgacgggtgccaccggcccgcagggtccgaccggaccgcagggaccggctggcccgcagggtccgaccggagcgacgggtgccaccggcccgcagggcctgaccggagcgacgggtgccaccggcccgcagggtccgaccggaccgcagggaccggctggcccgcagggtccgaccggagcgacgggtgccaccggcccgcagggtccgaccggatcgcagggtccgaccggggcgacgggtgccaccggcccgcagggttcgaccggatcgcaggggccgacgggtgccaccggcccgcaagggccggctggaccgcaggggccgacgggtgccaccggaccgcaggggccggccggtccggaggggccgccgggcgccaccggaatttag

SEQ ID NO: 9201 - DNA, 624 bp, Methylobacterium sp.
atgatgacgattctcatcggctacgcccgctgctccaccgacaagcaggatctgacggcgcagcgcgccgcgctggaagcgctcggggtcgctccggagcgcatctacaccgaccatggattgagcgggacgaaccgggcgcggcccggcctcgaccaagcgctcgccgccgcccgcgcgggcgacacgctggtcgtgcagaagctcgaccgcttggcccgctccgtcccggatgcccgcgccatcgccgacggcttggtccgtcggggcgtccgtctcgccctcggggcgagcgtctacgacccgcacgatcccatgggccggatgttcttcaacatcctggcgaccttcgccgagttcgaggccgacctcatccgggcccggacgcgagagggcatggcaatcgccagggccaagggcaagctccgtgggaagcagccgaagctctcagccaagcagcaacgagaggtgaggcgcatgcacgacgtcggggaccactccatcggtgatctggcggaactgttctcggtctcccgcccgacgatctatcggaccctcgccagaagtatcagaatgcgtgctggcgagagccctgccgagacggtcaccggaacgctgtcatag

SEQ ID NO: 9202 - DNA, 414 bp, Methylobacterium sp.
atgctcacgccgttccacctcgcctaccacgtcaccgacctcgaggcggcgcgccgcttctacggcggggtgctcggctgccgggaagggcgcagcacggacagctgggtggacttcgatttcttcggccaccagatctcgctccatctcggcgaacccttcgcgacggcccggaccggccaggtcggggatcaccgggtgatgatgccgcatctgggcgtggtgctgccgctcgacgcctgggaggcgctggcggcccgcatcgcggccgcggggatcgccttcgacatcccgccggtggtgcgcttcgccggcgagcccggcgagcagcgcacgatgttcttcttcgatccgagcggcaacccgatcgagatcaaggggtttcgggatctggcaggcgtcttcgcgcactga

SEQ ID NO: 9203 - DNA, 1680 bp, Methylobacterium sp.
atgtcgcaacgacgcctgtcgctcggatccctgtcgatccgctaccagattctgctgccgcttctcggcttcctgctgctggccgggctgatggcggcgatcaccggcctcgtgggcctgcgggtctccgccgacctctcggcgctcgccgagcgcacggtggcggcgaacgaggcgagccaggccgcccgcgaccgcttccgccgggccgacgcggtggtggcccgggtgaccgcgatgacggacctgctcgacatggggcccgtcaccgccgagttccggacggccgccgacgcgctcggggggctgctgggggagctgcgcgcctcggccctctccgagcggatgggcgccgtggcacagacggcggacacggaggcccggcagtggcgcaccgacgccgaggtgctgctcggcctgcgcgcggcccgggagatcccgacgctggagcggatggcccggcacagcgagcgcctgcgccagcgcttcgacgaggcggtcgccctggcgggcgcggatgcacgggcgcagatccgttccaccgaggcggcggcgggccggcagatctggacgatcctcggcctcgcgggtgccgtgatcctggtcggctcgggcacggcgtggtggctcgcccgcagcctgtcccggcccatcgtcgatctgacggacgcgaccacccggctcgccgagggcgataccggcgtggtgctcgcggagggccggcgcgacgagatcggcgcgatgatcgccgccgtgcgggtgttccgggacaccatcctgcgcagccgcaccctggaggccgagacggcccaggcgggcgccgcggccgagcgccgcgcgatggtgaacggcctcgccgacacgttcgagcggcgggtcggcggcatcgtcggcctcgtcggcgcctcggccgggcagctccagacgacggccgagagcatgagcgcgaacgcccaggagacggcggacaagtccggccgcatgaaccgcgccgcgggcgaggcggccgccaacgtcgacaccgtcgcggccgccgccgcgcagctcggcgcctcggtcggcgagatcggccggcaggtccagggttcggcgggcctcgcccggaccgcggccgccgaggccggccggaccgccgaggtggtccaggcgctcaacggggccgccgcccagatcggcgacatggtggcgctcatcacccagatcgcgggccagaccaacctgctggccttgaacgccacgatcgaggcggcccgcgcgggggaagccggccggggcttcgcggtggtggccgccgaggtgaaggagctcgccagccagaccgcgcgcgtcaccgagcagatcaccgcccagatcgcgcgcatccagggggcgaccggcgaggcggtcggcgccatcgacggcatcaccggccggatcggggagatcagcgcggtggcggccgcgatcgcggcggcggtggaggagcagggcgcggcgacccgggcgatcgtgcaaaacgtcgccgaggcggcgtccggcacgcggcaggtctcgggccacatcacgggggtcgcgcaggccgccgggcagaccggtctcgcggccaatcaggttctcgacgccgccgccggcctcgcgcagcaatccgcgcagctgaaggacgaggtcgccgccttcctggtgcgcgtccgcgccgcctga

SEQ ID NO: 9204 - DNA, 366 bp, Methylobacterium sp.
atgttgaaggcgttcgaagaccgcgagcgcgcggcggaatacctgttcgcgcggaccgaggaggcgcgcttcgccgcccattgcggcagcatccgcgcgctcgccatcttcgcgatggccaagctcggcgtcgatggccgtacggccgaggcctatgcgcgggtgctcatcgcggcgatgatcgagggccagcacgacgaggatctgatcgcgcgcgtccaggcggatctgcgcgccaacggcatcgaggttccgcgcagcgagctgcagggggtggtgctgcgcgccgcggcgtcgcaggagatcctctcccgcatgggaccgcccgacgccgcgtccgcgagccggccggcagacccgcgctga

SEQ ID NO: 9205 - DNA, 756 bp, Methylobacterium sp.
gtgacggcgcccgtcgaccacgccgccgtggcggcgggcgcgaccgaggcgctccgggtgcgcgtgcgccgcggagacggcgtgcaggactacgcggtgccgcggcgcgccaaccagacggtgctcgacgtggtcacggagatccagcgcgagcaggacccgacgctcgcctaccgcttcgcctgccgggtcggcatgtgcggctcctgcggcatgacggtgaacgggcgcccgcgctggacctgccgcacccgggtcgccgccgtggcgccggagggggacctgctgctggagccgctgcgcaacctgccggtggtgaaggatctggccgtcgacatggagcccttcttcgagaagtggcgccgcgcccacggcttcttcgagccgggcgagaccccgccggacgacttcgcggcggtgcccccggactcgcccgcgcggcaggaggtcgatgccggcatcgagtgcatcaattgcggcgtctgctacgcggcctgcgatgtcgtcgcctggaaccccgactatctggggcccgccgcgctgaaccgggcctggaccctcgtcaacgacgtgcgcgaccgggggcaggcggcgcggctcgcggcggtggcgggcgatgccggctgccattcctgccacagccacatgagctgcaccgagcactgcccgaaggcgctgcagcccaccttcgccatcgcggggctgaagcgcgagaccggcaaggcggcgctccgccggctctgggggcgcggatga

SEQ ID NO: 9206 - DNA, 330 bp, Methylobacterium sp.
atgagcccgctcctctacctcgcccagcgcggcaccgccgcgatcctggcgctgacggtcgcggtccatctcggcacgatcctgtacgcggtgcggggcgggctgacggcgggcgagatcctggggcgcacgcagggcaatcccgggttcctcgcgttctacgcggtcttcgtgctggcggcggcgatccacgcgccgatcggtctgcgcagcgtcctgcgcgagtggaccggctggcgcgggcgctcgctggacctcgcgatgctcgccctctcggcgctgctcgccgggctcggcctgcgggccgcgctggcggtgtatctcgcatga

SEQ ID NO: 9207 - DNA, 345 bp, Methylobacterium sp.
atgagcgcgctgtccgtccatcgccgcccgggcttcgccgccgcgctgatccaccgcctctccggcatcgcgctggcgctgttcctgccgatgcacttcatcgcgctcggcaccgcgctccggggcgccgaccggctggagagcttcctcggcctgacccataacggcttcgtgcgcgcggccgagtggggcctcgtctgcgcgctcgccgtccacatggcgctcggcctgcgcgtcctggcgatcgagtggctgagctaccgcgagcgcacggccgtcgtcgtctccggctgcctcgcgggcgccttcgcggtcggcctcctcttcctgctcagcggggcctga

SEQ ID NO: 9208 - DNA, 612 bp, Methylobacterium sp.
gtggcccaccacgtcctcgacatgccggccgccgaggccgagatccgggctcttcggatcggcgacaccgtcaccctgcggcgctggctgttcggcatccgcgacgccacgctgatccacatgttcgaccgggaccggcgcacccggctcgacctcgccgggcacgcggtgatccacaccgcgcccaacgtccaccgcgtgcccccctcccccgaggcgccggtcggctacgcgccgttctgcatcggcaccaccacctcgatgcgcatggagcgcttcaccgatgccctgatggagcgggagggcgtgcgcctgatcgtcggcaagggcggcatgggcccggcgacgctcgacgccttcgccgagcggggcggcgcctacctcgccatcgtcgggggggctgcggcgctggagaccacctggatcgagcggatcgaggacgtcgacatggacgacctccaccccgagagcctgtggcgcttcgcgatccgcgatttcgggccgctgctcgtcggcatggacgcgcacggcggctcgctcttcgccgaggtgcagcgggacgtggccgcccgccgcgacgcggtgctggccagcctggaggcggcgcgatga

SEQ ID NO: 9209 - DNA, 1725 bp, Methylobacterium sp.
atgaccctcgaagaggtccggaccgacatcctgatcctgggctcgggcggggccggcctgttcgcggcgcttcacgccaaaaagacggcgcccgacctcgcggtcacgctcgccgtgaaggggctgctcggcaagtgcggctgcacgcgcatggtccagggcggctacaacgtggccctggcgccgggcgactcggtcgagcgccacttcatggacacggtcgagggcggcaagtggctgaacgaccaggggctggcctggacgctcgtcaccgaggcgcaggtgcgcatccgcgagctggagaccgagctcggctgcttcttcgaccgcaacccggacggcagcgtccaccagaaggcgtttgccggccagaccttcgaccgcacggtgcacaagggggatctgaccggcatcgagatcatcaaccggctctccgagcaggtctggcgccgcgacgtcaatcgcctggaggaccaccgggcgctggagctgatccccgcccgcgacggctcggggctcagcggtgtcctgatgctcgacatgcgcaccggcgagccgaagctcgtccgggccaaggcggtgctgctcgccacgggcggcgggccgaccatgtacaagtaccacacgccgtcgggcgacaagtcctgcgacgggctcgccatggctctgcgcgccgggctccccttgcgcgacatggagatggtgcagttccaccccacggggctgctcgcgggcgccggcacccgcatgaccggcacggtgctggaagagggcctgcgcggggcgggcggctggctcctcgattcgacgggcgcgcgcttcatggaggcctacgacccgcggggcgagcgggcgacgcgcgacatcgtcagccgctcgatcgtccggcgcatccgggacgggttcgccacaccgagcgggggcgtccacatccggatgagccatctgggcccggacgatgtgcgccgccgcttcaagggcatggtcgagcgctgcgccgattgcggcttcgacctcgcggagggcctcgtcgaggtgatcccgaccgcccactacatgatgggcgggatccagttcgcggcggactgcaccacggcgctgccgcgcctctacgcggcgggcgaggacacgggcggcgtccacggggcgaaccggctcggcggcaacggcgtggcgaactcgaccgtgttcggcgggctcgccggccagtccatggcccgcgcggttctcggcggcggcagcctcgccgatcccgatccggcggcgatcgaggccgggctcgcccgcgccttcgggccgctcggccggccggcggacgcactgcctgcgatccgcgaggcgctctacgagacgatgtggaacgatgtcggcatcctgcgcgacgcggccggcctgacccgcgcgctcggtgccctcgacggcctcgccgaggccgtcgcccgggcgggcgcgccggacggcgaccgccgctacgcgctgacctggatggaccggctgaacctcgagaacctcgtgctggtctcgcaggcgatcgcgcgggccgcgctcgcccgcaccgacagccgcggggcgcatttccgcgaggaccatcccgagacctcggacctcgccacctccgcctacacggtggtgcggcggcaggacgaggccttcgcgatcgcgatggagccggtcgccttcacgcatgtgcggccgggcggctcgctcctcgacgcggcggcctga

SEQ ID NO: 9210 - DNA, 300 bp, Methylobacterium sp.
atgccctacttcctgctccgcctcgagccgccgcgtccgagcttcccgttcgacgcgacggaggccgagaaggccctgttctccgagcacgcggcctactggatcgaccgcgcggagcgggggcaggccgtcgcggtgggccccgtcttcgacgcggccggcacctggggcctcgccctggtggaggccgccgacgacgcggccgcccgtatgctcggggccgacgatcccgtcatccgggcgggagccggcttcgtctacaccctctcggccgtaccgaacctgattctgcggcgttga

SEQ ID NO: 9211 - DNA, 1275 bp, Methylobacterium sp.
gtggtcctgcgggcggccgcggccctcctcgccctcgcgggcctgaccgccgcttccttctatgccgggctcgtccacgcggacctgcgcatcgccaccgggccgcccggcagcgcgatccagcgcctcatcgccaccttcgcggcggcgaacgcccggctgcacccgcgcgtgcgcctcctgcccgtggcggaggacagcctcgcggcgagcgcgcgggcactcgacgcggggcgggtggacctcgcgatcatccgcagcgatctgccgccgcccgcgaacgggctgacggtggcggtcctgcgccgcgacgtgatcgccatcgtcgtgccgccgcacagcccgatcaccgcgctcgcccacctcgccgggcacgccgtcgcgatccagccgggcccggtcgccgcggacgatgcccgggtcctcgacgcgctgctggactatgtcggcgtccccggctcccgcgtggagcggctcgtcctggatcccgcgggcctgcgggcagccctgcaggatcggcgggcggcggcggtcttcgcgatcggcccggtcggcgcgggcgcggcggtcgacgcggtcgcggccgtggcgcgggcgagcggcggcacgccggccctcctggcgatcgacgagggcgaggcgatccaccggcggcacccgggtctggagcccgtcgaggtgccggtcggcgccttccggggccggcccgccgtgccggccgcgaccgtgagcagcctcgcggtgacctaccggctcgtggcggcgcgcggcatgctcgacatcgtcgcgggcgccgtcgcgcgatcggtcttcacggcccgcacgatgctgaccgaggcgacgccgttcgccggccagatcgaggcacccgacctcgacgacaagacgcccctggtcccggtccacccgggcgtcgcggcctacctcaccaacggcgaccagagcttcttcgacacctcgcagaacgtcctctacctgggcggcatcgcgctgagcctcgtcggatcgggcctggcgctcgccgtgagcgtcgggcgccgccgccgcgcggcgcaggagcgtggcctgatcgccggcctcgtcgcgatcgcggaccgggcccgcgacgcggacgcggccgagctcgaggccttgtcgcaggagctgcaccgcctcgtcggagcggcgctggtgcggcaagcccacggggatgggctgccatcgctgatcggaccggcgatcgcgcatgcgcgcacggcgatccggaccaggcaggcgagactggccgccgactga

SEQ ID NO: 9212 - DNA, 804 bp, Methylobacterium sp.
atgaagatcgcggtgatcacaccgtcccggctgaagctgtcgacgctcgccggcgagaccgattccggcctctacttcctcgaacacgcggtccggagcgcgcaggcgcagcagctcgaccggccggtcgagctgcgcttcttcgtcggcgtcgatcccggtaccgagatcccggcgcggctggccgagcagccgaacctcaccttcgtgcacagcgaccgcaaggcgcaggtggcggccctgaacgccgccctcctggcggtggacgagagctgggacctcgtcggcttcctcgaggacgacgatgcttggctgccgcactacctctcggtcgcgatccgggcgctggagcagttcgacttcgtctcctcgacgcagctggaggtggacgaggccggcgaggccgtgcggatcaacgatttcccgacgccctccggctggctgatgcgccgcagcaccttcgatcgggtcggcgagatcagcatgtggtcgaagtggcactacgacaacgagtggctcggccgcctcgccgagacgggcctgcgccgggcccacctcgtcgaggcgaccgcccccgcgaccctgcaggacgccgcgcaggtccggccctggctcgccaacgtgctgcgcttcggcgggccgaacagccatctcctgcgccacggctccgtcctgcccctggtgcggcgcctcgtccatccgggctccggcacctcccagatcggcggcggcgccgtcgccaagcaggagagcgaggccgagtatcgcggcctcgcggaacggttcgggcgaattccgtggtga

SEQ ID NO: 9213 - DNA, 1515 bp, Methylobacterium sp.
atgttgcgtcttgccgccgcctgcctcgcatccgggctcgcgctcaccgcccccctcgccgcccagacttcaggtccgaccgcgggcccgaccctgcgctacggcctgatggaggatcccgacgccctcgacccgacgctcgcccgcaccttcgcgagccgcatggtcttcgccgcgctctgcgacaagctcgtcgatatcggccccgacctgaagccggtgccgcagctcgccaccaagtgggagctctcggcggacgagaagacactgaccatgacgctccgcccgggggtgagattccacgacggcgagcccgtgaacgcggcggcggccaagttctcgatcgagcgccacctgaagctgccgggctcccagcgccgcggcgagatcgcgccgatcgactccgtcgacgtggtcgacgacctgaccttccggatcaacctgaagcagcccttcgcgccgctgatggcccagttcaccgaccgggccggcatgctggtctcgccgaaggccgccgagcggctcggcgacaagttcgcgagcgggcccgtctgcgccggcccgttcaaattcgtcgagcgggtgccgcaggaccgcatcgtggtcgagcgcttccccgattactggaacaaggaccagatccacatccagcggatcgagttccggccgatccccgacaccacggtgcggctgacgaacctgcgcgccggccagctcgacttgctcgagcgcctcgccccgaccgacgcgccgcaggtggcgcgcgatgccaagctcaagctcgcctcgacctacgagctcggcttccagtccgtcctgttcaacacggccaaggccggatccgcgatcgcggacccgcgcgttcgcgccgccttcgagctcgccatcgaccgcgcggcgatcagccaggtcgtgttcaacggcgagttcctgcccggcaaccagtgggtctcgccgaagcacccggactacgtgaaggattacccgatcccgaagcgcgacgtggccaaggccaaggcgctgctcgccgaggcgggccagcccaagccccagatcaccctgatggtctacgccaacagcgaggccccgcaggtcggccaggtgatccaggcgatgacccgcgaggcgggcttcgacgtgaagctccaggccaccgacttcaccactgccctcgatctcgccgacaagggcaactacgaggcctacctctacaactggagcggccggccggacccggacggcaacaccttcagcttcctctcctgcaaggcgcccctgaactacccgcgctactgcagcgagggcgccgacgccgctctccaggccgagcgcggctcggtcgatccggagaagcggaaggccgcctggaaggcgctcgccgacaaggtcctgaccgaccggccgggcgtctacctgatgcaccgcaagctgctctgggcctacggcccgaagctcaccggcttcgtgccctatccggacgggctcgcccgcttcaccgggctgaagctgaactga

SEQ ID NO: 9214 - DNA, 915 bp, Methylobacterium sp.
atgagcaccggcacccctctcgccgaggcgcccggaatcgccgcgcccgccggccaagccgcgctcgtgcgcgagcccggcaccctcgcggccttctggcggcgcctgcgcgcgcggccgagcgccgtgctcggcctcgccatcgtggtcctgctcgtgggcgtggcggcgttcgccgacatcgtcgccccctacgacccgaccgccaccgactggggcgcggtgcgggccgcgccgagcctcgcccacccgttcggcggcgacgaggtcggccgcgacgtgctctcgcgcatcatccacggggcgcgcgcctcgctcggggcgggcctcgtctcggtcgcgctcgccgtcgccctcgggctgccgatcgggctcctggcgggctacgcgggcggctggatcgacgccctggtcatgcggctcaccgacgccctgctggcgatccccttcctgatcctggcgatcgcgctggccgccttcctgggcccgagcctcaccaacgccatgctggctatcgggctgtcggccacctcgaccttcgtgcgcctcacccgcgcccaggtgcgggcggtggcagccgaggagttcgtggaggccgcccgctccgtcggcaacccgccctggcggatcgccctggtgcacatcctgcccaacatcgtgccggcgatcctcgtccaggcgacgctgaccatcgcggcggcgatcatcgccgaggccagcctctccttcctgggcctcggccagcagccgcccgagccttcctggggcgccatgctcaccgtcgccaagaacttcatggaccaggcgccctggatggcgatctggccgggcctgtcgatcttcctcgcggtgctggccttcaacctgctgggcgacggcctgcgcgacgccctcgacccgaggcagcggacatga

SEQ ID NO: 9215 - DNA, 690 bp, Methylobacterium sp.
atgagcgcggacatgagcacggatatcgccgaggctccgggcgcccccctcctcgacgtgcgcgacctgcgcgtggtcttcgacgcggagggcggagctgtccacgccgtcaacggcgtctcctacacgctccgcgagggcgagacgctcggcatcgtcggcgagtcgggctccggcaagagcgtgcacgtgctcgccatgctggggctgatcccgcgcccgccgggccggatcgcgggcgggcaggtgctgttcgagggcgaggacctgctcgccctgcccgagcggcgcctgcgccggatccgcggcggccggatcggcttcgtcttccaggacccgatgagctcgctcaatcccggcatgacggtggcccagcagatcgtcgagcccctgcgcatccatctgggcctctccgcccgcgcggcgcgcctccgggcgcgcgagctcctcgacctcgtgcgcatcccgaacgccgccgcccgcctcgaccagtacccgcacgagttctccggcggccagcgccagcgcgtgatgatcgcgatcggcctcgcctgccggccgaagctcctgatcgccgacgaggcgaccacggcgctcgacgtgacggtgcaggccgagatcgtcgcgctcgtccaggagctgaagtgcgagctcggcatggcgatcatctggatcacccacgatctcggc

SEQ ID NO: 9216 - DNA, 921 bp, Methylobacterium sp.
gcccataccgctgcccccgccccctatcccgtcctctcggtccgcaacctctcgaagcactatccgctgcgcgcgtggtggggcggcaaggcgtccgtcttccgcgcggtcgaggatgtcagcttcgagattcgccccggcgagaccctcgggctcgtcggcgagtcgggttccggcaagtcgaccatcggccgggccgtgaccatgctgaacccgccgacctccggcacggtcgccttcgagggcacggatctcgccgggctcggcgcccgcgagatgcgccggatgcgcgcgcgcatccagaccgtgttccaggacccctacgccgccctgaacccgcgcatgagcgcgggcgactacgtcgcggaggtcttccggctgcaccggcccgggatggggcggggggagcgccgcgcggcggtggccggcctgttcgagcgggtcgggctcgatccgcgcttcatgggccgctacccgcatcagttctccggcggccagcgccagcgcatctgcatcgcccgggcgatcgccctcaggccgagcttcatcgtggccgacgagccgatcgcggcgctcgacgtctcgatccaggcgcaggtggtcaacctgctgcaggacctgcaggaggagctcggcctctcctacctgttcatctcccacgacctgcgcatggtgcgctatctctgccaccgggtcgcggtgctctggcgcgggcgcatcgtggagctcgccgacagcgaccgactctacgaggacccgcgccacccctacacgcgccgcctgctctcggccgtccccctgcccgacccggccgccgagcgcgcccgcctcgcgggcgccgtgccggaggccttcggcgcggggcggcccggcgacctcgtggaggtcgcccccggccactgggtcgcggccgacggctga

SEQ ID NO: 9217 - DNA, 810 bp, Methylobacterium sp.
gtggcccttgcgacgaagaggcggacgcccgagccgccgagcctgaacgacgtctacgagggcgagcggcagctcgtcgggatcatcctcgcgcatccggaggtgtattcagcggtcgcccggatcctgcgcggcgaggactggacgcagaacctgcaccggggcgtgttcgaggtcgtgggcaagcttgccgcggccgggcagtcgatcgcgctcgattccgtgctgccccgcgtcggcgatgtcgggccggatggggcccccgcgagcgattatctggcggagttgatcgcggcagctctcgcaccccaccacgcggaggagatcgcccgcatcctggccgaggccgcgcgggtgcagcaccggccctgcatctacgacctcgatctttacgcgtgggccttcgaccagtcccagcgtctccggcgcgggcagttctcggctctcgacgcactgaacctcgccgaggagatcgaggatttgggcaatgagatctacaacaagctcgagagcgcgctccgcatcacgctgatgcatctgctgaaatgggaccaccagcccggcaggcgcacgcgcagctggaccctgtccatccgcaacgggcgactggacgccgcgaaggtcttggagaagaacccgagcctcaaagcccggcttcccttcgcgatcgatgaagcctatcgccgcgcccggatcgacgccgcgggcgagaccggcctcgacgaggatgccttcccggccgcctgcccctacgatctcgacgcgatcatgaaccggccgatcccctggccgccgagcgaggacgcctga

SEQ ID NO: 9218 - DNA, 861 bp, Methylobacterium sp.
atggtcggcgcgcacgagccggaagggagcctgaccatggcgagccccactcctgcgagcggcctgcgcgagggcctgagctacgcgccgccgcaccgtccgtcggaccggctcgcgggcgagacggccgtgatcaccggcgccggcagcggcgtcggggcggagacggcccgcatcctccacgccgagggtgcccacgtcgtcctgaacggcctcaccgccggccgcctcgaagcgctcgccgccgaactcggcccccgcaccaccgtcctgcccggggacgtcaccgacctcgcctatctggagcgcctcgccgaggaggcgcaggccgtcggcgggggccgcgtcggcgtcctcgtcaacaatgccggcgccacgatccgcggctctctggcggagaccacccccgacaacttcatgtcgacggtggaactcaacctgaacggggcggtgcagctcacccgcctcctggcgccggccatgtgcgaggcgcggcagggatcgatcgtcaacatggcgtcgatcacctcgctgaaggggttgggcggtgccgtcgcctacaccgcctcgaaagcgggcatgacgggggtcacgcgggcgctggccgtggagctggccccgttcaacgtccgcgtcaacgcggtctgtcccggcgtgatcgatacgccgatgacctgggagcacgccgaggcgcagcccgatccggccgcccactacgcgatgctccgggcccgccagccgatgaaccggctcgcctccgcccgcgactgcgccctggcggtgctgttcctggcgagcccggactcggccttcatcaccggagccgcgctcccggtggatggcgggcgccacgctgcctga

SEQ ID NO: 9219 - DNA, 246 bp, Methylobacterium sp.
atgcacaagctgctcttcgccggcatcgccctctcggctctggccggcctatcgaatgccgcgatggccgaagagaccacggtcgttcgccgcgactccgctcccagcgtctccgtcgagcgccgcgagggcgtggtcgagcgccgcgacatcaccacgggcagcgtcgattgcggctcgaagaccgttcacaaggaggacggcgcgggcaactcgaagaccgtccacaaggaaggctgcaactga

SEQ ID NO: 9220 - DNA, 882 bp, Methylobacterium sp.
atgcagtccgacgagaagctcaagtatagcgccccggccgccgcctgcgccgccgacctcctgctcgccctcgcgcgggcggacggcccgatgacgctggcggcgctgatcgagcggacgacctattcgcgctcgctgctctaccgcaccctcaagaccctcggcacccgcggcttcgtcgtcgaggaggctgcgcccgggatttcggggagcctgcactaccgtctcggctcggccgcggcggagatcggcggcgcctaccagagcaacgtcccgttcgaggagagcatccgctccgccttgcgcgccctggcgcagcggaccggcgagagcgcgagcgtggcgacgatcgagggcgaggacgtgctctacgtgatgcgcgaggaggggcgctactccgtgctcgcggtctcgcgggtcggcaagcggctgcccgcccacgccaccgccatgggcaaggccctgctcgcccggttcgacgacggggagatccgcgccctctacgggcggggcgaactccggcgcttcaccgggaacacgatcaccgattccggcgccctcctgcgcaacctcgccgaggtccgcctgcgcggctacgcggtcgagcattccgaactggtccagggccgctgctgcattgccttcacgctccaggccggccccggtccgggcgacctcctggggatcagcctctccaccacggaggcgcggttcgaggtcgagcatgacgcgctgatcctggaggttctctccacgcgcgacgcgctgctggcggacctgagccggcgccgggtgccgggagaccggaaggtcgcgcgcgacctcaccgcctccctcggcgccatctcgcgccggtcggtgccggcggcggccggcacctga

SEQ ID NO: 9221 - DNA, 360 bp, Methylobacterium sp.
atgcgctccgctctccgcatcgcggccgtcaccctcgccctcgcttcgcccgcgctcgcggccggcccgaacggcggccagaccacggtcttcgacggccatcccatcgagttcgtcgcctcggacagcgccgtcacgttctacctgagcgacgaggacgggaagccggtcgacaccgccggcctctcggccaaggccttcgtccaggccgggggcaggacggacacactcgttctgaagccggccgccccgaacaggctcgtcgccgacctgaaggccccgctggcggccggcgcgaaggtcgtgctctccgcgaaactgcacggccacgccatccaggcccgcttcgagaagcgctga

SEQ ID NO: 9222 - DNA, 432 bp, Methylobacterium sp.
atgatccgcgtcacgcgcctgcatcacacggcgatcgccgcccacgacctcgacgcgatgcgacgcttctataccgaggtgatcggcctcgacgcgcatccgaccaagaccaactggctgcgggccgggaacggcttcgtcgtgcacctgatgccgtcgcccgacgcgcccgcctcgggccggatcgagcagcacttcgcgctggaggtcgagagcctgcgcgagaccgcggcggcgctgctgcgccagggcgtgacgccgtacatggcaagcctcgaatacgagacccacgccgtgaccgatgccggcgacccgctcgatttcgggatcggcacgctcttcgtggccgatccggagggcaacacgatcgagttcgtcgagccggatacgggcatcttcgccgaagtcccgctcgaagcgcaggatacgtag

SEQ ID NO: 9223 - DNA, 1134 bp, Methylobacterium sp.
atgacaccggagcatctgtgcgaacgggacgttgaggccgtcgtcgcgacgacgcccgagagcgtgtttctgctctcgggccatctcacgtggctgggcgagcggatgcgcggctggatgggcggccccgcgggcgacgccgccttccaggccggatacgccgtcctcacccgggacggccgcgtcgggctggcggcgcgtgcggtcacccggatggcggccgaggcggcggcgccggacagcctcgtgctgtacggccgggcctgcccggccgccgacgccgacgccgcgctgtccctgctgctggccgagatgggcctcgccggccgcaccatcggtgtggaatgggacggggccggccgcggcctcgcccgaagcctggagccggtggcgacccgggacgcctcgctctggctgcgcagcctgcgcgcggtgaagaccgaagcggcgctccggacgatgcgggaggccgcgaccgccaccgaggcggcgatggaagccgtcttcgccgcctggaccgccgacgccgatccgcgggcgctgcggaccgtgttccgcgtcgccctggcggagcgggactgcgacttcgaccacctggtcttcggagcgcccggcggcggcgtgtgcgacgccgcgaggccgccggaacccgtcacggccctcttcttcgatgccggtgcccgctgtggccgctactactcggataccggcacgacgctgacgcgggccggcttcacggccgccgaccgcgagcgtcacgccggcgcgctcgccgcgctggcggcggccgagcgcgccctgcagccgggccggcccgcttcctcggcctgggcggcgatgcaggacgaggcgcggcggatcccgggcctcgtcgcgcaggggcacggcctcggcctcggcatccgcgaatggccgctgctcgggccgccgagcgacgccgtgctgagcgacggcctcggcacctacccggtcgatgccgtgctcgcccccggcatggtggtgaacctcgaagccggcgggcacttcgccgacggcacctccgtgcaggtcgagaagagcttcgtcgtcggcgccgacgccgccgtcccgctggccgcgcagccgcgcgacgccccgatccgcctcccggcctga

SEQ ID NO: 9224 - DNA, 1875 bp, Methylobacterium sp.
atgacccgacagaagaccatccggctgacgaccgcccaggcgatcctgcgctacttcgcggcccagcaaacccggcgcgacggacgcgaacggccgctcatcggcggcgtgttcggcatcttcggccacggcaacgccagcggcttcggccacgccctcgcgaccggcgcgggcgggctgacctaccaccagggcaagagcgagcaggcgatggtccatgcggcgatcggctatgcccgcgcccacaacctcgcctcgaccctggcggtgacggcctcgatcgggccggccgccaccaacctcgtcaccggcgccggcaccgccacgctcaaccgcgtgcccgtgctgctcctgccgggcgacgtcttcgccagccgccgtcagggcccgatcctgcaggggctggagatggcgggcagctacgacatgaccgtcaacgacaccctgcgcccggtcagccgcttcttcgaccggatcacgcggcccgagcagatcatccattccctgccgcacgccaccgccgcgctgctcgaccacggccaggccggcgccgtgaccgtggccgtctgccaggacgtcgagggcgaggcgttcgacttccccctggcgctgttcgagcggcgcgtccacgacctcgagcggctcgcgccctccgagaccgccctggcggccgccgccgaacgggtgcgggccgcgcgcaagcccctcatcatcgcgggcggcggcgtccgctattccgaggcggaggcgagcctcgccgccctgtccgatgcctgcggcatcccggtggtcgagagcttcgcgggccgcggcgccggccgggaggcgcgcctcaacgcgggcggcgtcggcttcatcggaacgccggccgccaacgaactcgcgaccgaggccgacctcgtgctcgccgtcggcacccgcctgtcggacacgctcaccggctcgcacacgctgttccagaaccccgatgtgaacttcgtgacgctgaacctcgccgagcgcgacctgcgcaagatgggcgcgctggcgctgcgggccgatgcaagggccgggctcgacgggctcgcggcggccctggagggccataccgccccggccgaatggcgcgaccgcgccgaccgggcgatcctgcgccacgtcgcgcgggtcggcgagatcgtcgggaccgagaatccccgcatgaccggctacgaggcggtcgccgagatcaaggacgccgcccgccgcgaagaccgcgtggtgttctcctcctcgacggcgatcgggcaggcccacaccatctgggacagccgcagcgatgccccggtcgacatggaatacggcttcagctgcatgggctacgagatcccggccgccctcggcgcggcgatggccggcacggtgaagggccgcatcctcgcgctcatcggcgacggcaccttcctgatgggcaacaccaccgagatcgtcacggcgatccaggagggcctcgccttcacgatcgtggtggtggtcaaccggggctggcagtgcatccgcggccaccagctcggctcctacggcgaggagttcggcacgcagttccgccgccgcgagggggacgcccgcaacctgaccggcgagacgctcgcgatcgactacgtcgccaacgcccgctcgctgggcgccgacggcctcgacgtgcacagccgcgccgaattgcgggacgccctggagcaggcacgccgctccgaccggcccttcctgatcgcggcgcatgtcgaggacgcaccgctgccgatcgagaacggcgcgtggtgggagttcggcattccgcgggcggatgcgcccgagggcctgcgcgagacccgcgccgccttcgaggcggccgccgcgaagcaccgctggttcgtctga

SEQ ID NO: 9225 - DNA, 354 bp, Methylobacterium sp.
atgatcgatgatcgcgatgccgtcccgctggacgatgttctggcctcgctgccggccgagcggcaggcccggatccgcgcgcgcggcgccgaactgatcgccgaggaactggccctgcgcgacctgcggcaggccgagcgcatgacacaggcgcaagttgccgaacggcttggcgggcggcaggtctacgtttcccgcctggagcggcgtgccgacatgaaactctcgacgctccgcgcctatgtcgaggcgctcggcggcgagcttcagttgatggtcaccttccccgaaggccgcaccgtgcgtctggccgacctcgcagacgagcctccggtcaagcgcacatccgcctga

SEQ ID NO: 9226 - DNA, 333 bp, Methylobacterium sp.
atgctctcaagaaccgcacttcccgtccttgcggcgctcggctccacactcggcgcctgcaccgacgagccctctgaagccgccctgcggcaggccgtcgagcggaaactgacgccgtccttcgacagggaggtggaacaggcgaggaagcttggcgtgcagtcgcccgcgaggccctcgatcaccgccttcacgaagctcggatgcaagccggcggaggccgccccgggctacgcctgcaccttcgacggcgccatagacgggcagaaccagggcccggggacccgccgcttcttcagggcggcggacggcacattgacgatggccgagtga

SEQ ID NO: 9227 - DNA, 825 bp, Methylobacterium sp.
gtgagcgttccccggcagacccgcgacagcgtcctcttcgtcacgctggattcctgccgctacgacaccttcgcggctgcccgcgcccccgccctgaaggcggtcggcccgctgcacaaggcgcaggcgccgagctactacacctacggctcgcacgcggcgatgttcgtgggcttcacccccggcctcgcgcatctccggcagccggtgctgaacccgaaattcggcaagctgttcaagctcgtcggcggcggccacccgggcaagggcacggagggctacgcgctccgcggccgcaacatcgtcgagggttttgcccgcgaggggttccggaccttcggcaccggctcggtcggctggttcgatcccgccacccccacgggccgccacctcaccgagcccttcggcgccttcttctatcccggcgacacctggagcctcgaccggcagctcgcgtggctggagccccggctgcgccatcccggcaacgtcttctgcttcctcaatgtcggcgagacccacgtgccctactggcacgcgggcgccccctgggaccgggccgacaacccctgcgagcccttccagagcgccgaccgggcggaggattgccgcgcccgccagcgcgcctgcctcgaattcgtggacgggcgcctcgcccccctgctggaggcgttttcggacgcgacgatcctgctctgcggcgaccacggcgattgctggggcgaggacggcctctgggagcacggcatcagccacccggcgaccctgaccgtgccgctgctcgcccgggtgcgcggtatggtagtggacgaaaaagccgcctga

SEQ ID NO: 9228 - DNA, 885 bp, Methylobacterium sp.
atgaagaagatcctgcttgcctccacggtccttgccggcctgaccgctgccgcttcggccgccgaccttccgcgtcgcgccgctccgccgccggtgttcacccctgttccggtcttcacctggacgggcttctacgccggtttcaacgccggttatggcttcggcaccagcgacagcaaccgcggcaccctggtggccgtgcccggctcgtacggcctgaccacggccgccggccccaacctgatcgccttccagggcgagcgctcggccgacggcttcgttggcggtggccagatcggctacaactggcagctgacccccggctcgggcgtggtcatcggtatcgaggccgacgcgcagtacgtggacttcggccgtgatcgcaaccgcttcgccatcgccccggtcggcgccgtgcaggctccgggcgcgctgatcttcaacccgaacagcctgaccggtctcgactacttcggcaccgtgcgcggccgcctcggctacgccttcgaccgcaccctcgtgtacgccaccggcggcttcgcctacggctcgggcggcggtcgcgacttcggtctgcccaacgcctcgcgcgatgagttccagaccggctacgcggtcggcggcggcatcgagtacgccctccccaccgactcgttcctgaacttcttccgcgcctcggccgtgacgctgaaggtcgaaggcctctacgtgaacctcgaccagggcaaccgcaacaacggcctgttcggcgtcaacgccgccggcctgccggtcggcctgtccagcccgggcgtgcagctcgtctccggcgtcaccaacaaccgccgcgacaccgagttcgccgtcgtccgcgccggcgtcaactacaagttcggctcgtactaa

SEQ ID NO: 9229 - DNA, 1578 bp, Methylobacterium sp.
atgcaggagacgatgcaagcgggcgccctcgggcgcgccgcagaggatattcgcgtcgcgctgatgaccgcggctgcggtcatccccgaggtcgagcggaagcggggcccggccccgatggagccccacctcgtcgagcggcggtccaaggggaaggcgagagagggtggcggtgtcacgctgtacatccgcgacggcaagcgggagatttcgacccgcctcggtcccgaccgccgaggggacgcgaacaccctcctcgacctgtacaagctgcagaagggggccaaggcccgggggatcatagcgccgaggatggtgccggtggtcgcggccctcgcccacctgctggaggccgaccggcccgtcgaggttccgcaggccgacggcaagcgcaggccggtcaagggcgcccgccacatctacctcatgcggagcacccgcttggccaccctgaccaagttcttcggcgacctcgccttcaaggacgtcacgacggcgaagtgcaaggcgtacatcgagtggcgggtgaccctgccggacgcccgctacaagccgggggaccccgacgcaccgctggcgaaagaggccagcgcccgcgaagacctctacgagctcaagaaggccatcgacctgtacgccgacgagcatacgttggcctggcacccccaggtctacctgcccaaggcgggccccggccgcacgcgctggctccgcccaaccgagatcgaccgcatctactgggcaatccgcggccggatatgggaccctgcgaccaacggctggaaaacggagaccgtggcggacgaggacggtaacgtcgtcacccgccgcgtgctgcgtggagccgagaccatccaggcacggcgggtgctccgccggttcgtcttcgtcggcctgaccaccggcacgcggaacacggcgatgcgcgagctgcggtggcacatcacggacgagggcggctgcttcgacctcgacgccgggctgatccaccggcggggcttcggggtcgatcccaccaagggcaagccacggtacagctcacgcatctcggaccgcacggtcgcgaccctgaggcggtggcgcgaggccgacctggcggccggtatcgatcaggtcatccacaagctggacggcacctcctatgccagcagcccggactgcatctggcgctcgaccatggacgatgccggactcggcgacgacgtggttccccacacgctccggcacacggccgcgaccatgctgcgcgtcgccagcgtcgacgtgcgcaagggggccgacctcctcggcatggcggtccagacgatggtccgcgtctacggccagtggaccctggaggggcaggaggaggccgccgagatcctggcggatacccgaggcctgcggaagtccatgccgctcctcgccctcgttccgatgccgccgcagccggtagttatgacgacgccggccaacgacgacgctgcgcgggccaaggcgacggaccggcgccgcgtggacatcgcggcggcacggagcggccagtccggagccccgatgcccccgcgctcgccagcgcacctcgccagcgtcgcctga

SEQ ID NO: 9230 - DNA, 855 bp, Methylobacterium sp.
gtgacctacctgttccagatcctcaacggcatcggcctggggatgctctacttcctgctcgccgtgggactgagcatcatcttcgggctgctgcagttcgtgaacttcgcccacggcgccttctacatgctgggggcctatctcgcctacacgatggtcgagcgcggggtgagcttctggctcgccctgccgctggccttcctcgccgtcggcgcgctcgccgccctcaccgaggcggtgctgctgcgccggatctacgcccaggcgcacaccttccacatcctcgccaccgtcggactggcgctcgcggtgcaggagatcgtgatcatcgtctgggggccgatcggggggaacctccccccgcccgacagcctctcgggcgtcgtgattctcggcgacttcatctacccggaataccgcctcttcgtgatcgcgctgaccgcgctgctggccggcgggctgtggtggctcttggagggcacgcggctcggcgccatcgtgcgcgccggctcggaagcgcccgagaccatggcgctcctcggctacgacacccggcgcatcaacaccgccgtgttcgggctcggtgcggggctcgcgggccttgccggagcgctcgccgcgccgatccgcggagtcgacccgttcatgagcgtcgaggcgctcagcgtcgccttcgtggtcgtggtggtcggcggcatgggcagctacgcgggcgcgctcgccgcgggcctcgcggtcggcatcgcccagagcctgatggcgacgctctggcccgaaggggcccggctgatgatctatctcggcatggcggcggtcatcgtgacgatgccgcgcgggctgttcggacgcgcctga

SEQ ID NO: 9231 - DNA, 1206 bp, Methylobacterium sp.
atgctcgaccgccgctcctttctgaccacgtcgtcgctcgccctcgcgtccctcgccgcgccgcctcttctgcggagcgcgcgcgccgcgagtgccgacctcgtcgtcggggcaccgctgccgatgtcgggtgccttcgcggcgaacgggaagttcgccgcgctcggcgcggccttcgccgccgaggaggccggcacggtgctcggacgcaaggtggcggcgcgcgacctcgacaccgagggcaagcccgcgaccgcggcccggcgggtccaggaggcgatggccgagggcacccgtctgttcgccggcgggatcctctcctccgaggcgctcgtgatgggcaaggaggtgacgaacggcggcggcgtgttcttcaccacggccggcgccgacgagatcaccggcaaggagtgcaaccgcggcaccttccgctggagcgtacccacccacggggcgatcgcccagaccgtgcgcccactcatcgagcagatgccgaaggccaggcgctggtacacgatcacgccgcaatacgtcttcggcgaagggctgctcggtgccgccaaggcgctcttccaggagaagggcgtcgagcatgtgggcaacagctaccactcgctcgccgagaaggagttcagcggctacctgacgaacgccatcgcggccaagcccgacgtgctgctgatcctgagcttcggcgcgcaatcctccgacaccctgcgccaggcggtgagcttcggcctcaagaagcgcatgaccatcgtgctggcctgggcctcgggcctggagcagttcgaggccctgggccccgacctgtgcgagggcgtctatttcggggcgcagtactggcacggcgtggacacgccgctgaacaaggcgctggtcgcgaaggtgcgcgagacgcgcaagttcagcccgaactactccttcgcgggctcctacctgctcacgaagctcctgctcgacggcgccgccaaggccggctccacggacgggcccgccgtggccaaggcgctggagggcctgacctacgcggggctcaccggcgaggaggagatccgcgccgccgaccatcaggtcatcaagaactactacctgctcaaggggaaacccaaggcgcagatggccgacaaggacgatttcgtcgacatcgtcagctccggcaagtcgttcctctcgcccgaggccgccggctgcaagatggcctga

SEQ ID NO: 9232 - DNA, 1776 bp, Methylobacterium sp.
atgcacgccccgtcgggcgcgccctgccaggacgggagccgtccggcccccaagttctgcttccagctccgccccctggactacgcccgcctcgtgcacccgcgtgcgccgggggccgtactgttcggggcgcacctgccgtccacgaagccccgcaatgccgacggctcgcccaaggtggcgtggcaggaccggcgctggagccccggcgccctcgcgaaccgcgcggtcgacctcgcgcggttcaagttcatgtcgttcgccacctacccctaccaccggccgggtgagcccaagccggctaaggtcgaggcgaacgtcgtcagcatcggcgcctcctggatcgacctcgatttctacaaggcgacggactggaaggagacgccgcccgagaccgtcctggaggccgtccgcaacatctgcgccgagcgcggctggccggcaccgtcctatgccacgcactccgggcgcggcctgcttgtcgtgtggctctaccctgtccaacccgcccagatcgtcatggcccggcacaaggcaatccagcagacgctccacgaggcgttccgggacatgggctcggacccgtcggccaggacgatgacgaagcagttcaggatgccggcgacgtataacgagaattcgggcctgccggtctccatcatctggccggctctcgtgcgcgagatcgagcggacggacttcgacgagctctgccgcacggtcctgccgttcaagcgcctgacgaaggcggagcgcgaggccaaggaggacgccgcgaaggccaagcgcaccgctgcccgcctcgccgcacgcgcgccccgggaagggcactacggagcccgcctcaccgggacgtcctactgggccacgatccgcgccgacctggagcggctcctcgactaccggcatggtaagcagggcgtcgtcgacggcgtgtcccgcaacgagtacggcgccggtcgcaacgcctggctcacgtccctcgtctacgccgcggcctgggacatgaccccggaggagctcgaagcctacgtcatcaagtgtgccgaccgcctcggctacgaacatgccgaggccaaggacaagtgctgcagcatcgtcctgcgggccaagcaggccgccaggggcatgcgcaagacgtacaaggggcgcccggtcgacccccgttacaagctgtccccggcccgattcatagagacgctctccatcaccccgcgggagatgcgccgggccgacctgcgcatcctcgtggacgaggcgcgccgggcagagaacgccgtcgcccgcgtcgtggccagccgccgggccaagggagtgaaggcccgcagcagccaacaggacctccgccgccaggtcggcacgcaggccaccgagatggtcgccgagggcatgaccgtgaaggccatcgccgagctctacggggcgtcgccgcggtgggtagacaacgccctccgggacgcccgggccatcgccggcatcggcaccgtccggaaggagaagccgacggcaacggtcgaatgggaggcctacacggagcagcccgtcgtgaacgtcgcggacgtcgccgacacgctcgatgccgtccccccggtcacgcacgaagtgttacggggtattaggaaggccgttggtagtggtgttgtcgctggcctcggcgtggcctatcctgcgaacgtcacgacgaagggcagcactcttctcagaccgacgcccgctgcgcgccaaccggcccggcgggcgttgtcgtgtccggacttcgtcgcggtgggagcctga

SEQ ID NO: 9233 - DNA, 348 bp, Methylobacterium sp.
atgcgcgcgccgcccccgctcgattcggagcgggtccggaacaccacggaggccgacatccggcgccacgcgctggaggacggcgaggatccggatgccggcaccgagggctacatcgtcgtcccgcggccgcaggatctgcgccgtatcctcgccatgacacaggacgccttcgcggccttcctgcgcgtgccggtcgggaccgtgcgcaactgggagcaggggcggacccttcccgatccggccgcgcgcacgcttctggcgctcgtggccgccgatccggcccacgcgctcggcatcctcgggggtgacgggggcgagccggtcctggatctgcggcgggcctga

SEQ ID NO: 9234 - DNA, 936 bp, Methylobacterium sp.
gtgctgccgtcttggagggaggggccggcgaagcaggcaatcttcgatttcgtccgcgccacgaccgagccgtcgagctcgacctacgtggctccagacgaccggatcgtcgtgttcgaccaggacggtaccctctgggtcgagcagccaatgtacacgcaggtcacctattgcctggaacgcgtcccggccgtggtcgcgaaagagccggagctgcgaaacgtcgagccgttcaagacagtgctgtccggcaaccgcgaggcgatggaaaaacttcccttggaggatcttgagaagatcctcgccgccacgctcacgggcatgacggtggaggagttccagtccgaggtgtcaagatggcttgagaccgcccggcatccacgctggaatcgctcttataccgagctgacctttcagccgatgcaggaggttctgcgatacctgcagagcaacgctttcaagacctacatcgtcaccggcggcggtcaggacttcgtgcgcgtctacgccgccaagacctatggcattccgtctgagcaggtggtcggcaccgcgggcacgacgaagttcggctacggccgggacggcaagccgctcctgaccaaggagccgaagctgctgctcaacgacgacaaggctggcaaggtcgaaggcattcacctcatgattggccgacgtcccttcgccgccttcggcaactccgtcggcgaccgtgagatgctggaatacacgcacgccggccagggcgcccgcctagcgatgctggtgctccacgacgacgcctcgcgggaatatgcctacggtcccgcggccggcctgcccgacagcaagatcggcaccttcaccccggcgctctacgacgaggcgagaaagcagggctggacggtgatcagcatgaagaatgattggaaccgcatcttcgccttcgaggcatga

SEQ ID NO: 9235 - DNA, 1050 bp, Methylobacterium sp.
atgcgcgatgacggtgagccctatgagatcggccggctcaaaggagaatgcgtcctcgccttctggcgcaccgtcgatggacagcggaagcggcaacgttaccgccttggcaccgatgatgaagccgaagcccggcgacgtgctccggcggtatacgcccgcgccatccgcccccaaggccggaaggtaaaggacctctgggacgcctacctgctcgacaagaagggcaggccggtcgcggccgtcatgccgttcgagtggaaggcgctcgaggcgcgcttcggcgaaatggatgccgaggccatcgagatcgcggactgccgggcctacatcgcggaccggcgggcgatgggccggaaggacggcacgatcatcaccgagctcgggcggctgcgcatggtcctgaagtgggccgtgaagcacaagctcgtcgcacacgcgcccgacatcgagcggccggcagcggtgaagcggaaagagcggcacctgaccgcccacgaggtccgccgactcgccgcggcctgcaaggcgccgcacctcgaactgttcgtccacctcgcctatgcgacagcgggcagggcaggggccatcctcggcctgacgtgggagcgctgcgacttcgcccgggagaagatcgacctcgaagaccccgagatcctggtgccgcacaaggggagggcgatcgtgccgatgacgcgcacgctgaagacgcgcctgctcgcggcgaaggccggtgcccgctcaccattcgtgatcgagtggaacgcgcagcgcgtcgggtcggtgaagaaggggctcgcagcggcggccgagaccgcggggctgcagcacacccacccgcacctgctccggcacagcgcggcggtgcgcatggccgagaccggtatcgatatggaggagatccgcagctacctcggccacgagaacgttgcgaccacgcgccggatctacgcgcggttctcgccgaatcatctgcgcggcgcggccgccagcctggaactggacgagggcttggaggaggtcgcacctctggcgacccgtgtcaggtag

SEQ ID NO: 9236 - DNA, 855 bp, Methylobacterium sp.
atgctggaactgacgcagctcctggcgaacgcgctgggccaccaccttgccgagacctacacgcgcatgttcggcagccgggagccgcgctacgccgaggtgatcgacgaatcggctcggctgacgatcgagcgcctcgtcggcagcgacgcgctctatcacgacgcggaccatacggcgctcgtcgcgctggtgatgcaggacatcctgcgcgggcgcttcgtcagccgctcggtcggtcccgaggactggctccacgcgatcctggccgcgctctaccacgatatcggctacgtgcgcggcatctgcgcaggcgacagcctcgggcgctacgtggtggacgcggacggcaccaccgtcggcctgccgcgcggcgcgtccgacgcagcgctcgcgccctggcacgtcgagcgctcgaagatcgccgtgcgcgagcgcttcggcggccacgacctcgtggatgccgagcgcgtggtgcgggcgatcgagctgacgcgcttccccgtcccgaacgacgccgaccacgcggagaccgcgaccgaggcgggcctgctgcgcgccgccgacctgatcgggcagctcggagacccgctctacccgcgcaagctcaacgccctgttccgggaattcgccgaggtcggcctcgacagggaactcggctacgccgacccggccgacctcgcgacgggttatccggccttcttctggtccaaggtcgagccggtgatcggcgagggcatccgcgccctcgatgccaccgtcgagggacggcgctgggtggcgaacctctacgcccacgtcttcgccatggagcacgaccggcgccggatggggcccgacctcggtcggccgtga

SEQ ID NO: 9237 - DNA, 1032 bp, Methylobacterium sp.
gtgttcaccgagccttcctccgccggcctcgcgccgggatcctctccggcgcatctccccggcacctgcctgatcgttcagccgatccacgccgccggactggcgcgcctgcgcgcggccggcctcgcgccaaggtttgccggcagcgtcgcggccacggccctggcgcgggaggccgccgactgcgtcgcggtcgtgacccgcaatgccggcttccccgccgaggcggtggcggccgcgccccgcctccgggtgatcggcgtccacggcacggggaccgacccggtggccgtcgccgaggccacgcgcgcggggatcgcggtggtcaacaccccgggcgccaacgcgcgctcggtggccgagcacgcgatcggactgatcttcgcgctcgccaaggcgatcccgcaggccgaccgcgcggtgcgggcggaggaccacgatttccgcgaccgcgcgcgcctcgtcgagctcgccggcctgacgctcggcctcgtcggcttcggcgccatcgggcaggcgacgggccgcctggcggcggcgctcggcatgcgggtcctggcctacggtccgacgcggccggacgcggacttcgccgccgtcggggcggagcgcgtcacggcgctgcccgagcttctcgcccgggccgacatggtctccctgcacctgccgctgacgccggaaacccgcgggctgatcggacgggatgcgctggccgggatgcggcggggcgcattcttgatcaacacggcccggggcgccctggtcgacgaggacgcgctcgcggcggcgctcgcggccggtaccctcgccggcgcggcgctcgacgtggtctcgggcgatgcgctggcgccggaccatcccctgtatacggagcagcgggcgatcctcaccccgcacatcgccgcctccacggaggccgccctgatccgcgccgccgagcgggtggccgatcaggtcgtcgacgtgctcgcgggccgccgcccgtcgaacctcgtcaacccggatgcctgggcgcggcggcgccgcgcatga

SEQ ID NO: 9238 - DNA, 816 bp, Methylobacterium sp.
atgacgcgcaccttgaaccgcagacgcctcctcgccctctgcacgatcctcgggggcagcctgctggccgcgtcgtccggcacccgggcgcgggcggccgagctcgagctgatccagcccggcaagctcctcgtggccaccgagggcacctacgctcccttcagcatgcgcgcgccgagcggcgaactcgacggattggagatccgggtggccaaggagatcgcccgccgcctcggcctcgcctacacgccggtggtgatcaagttcgattcgctgctgatcgggctgatggccgaccagtacgacatgacgagcgccacgatggacatcacgccggcccggcagaagcaggtcgccttcgcggacggctggctcgaatcgggggcgcggatcatcacccgcaaggggaccggcatccaggcgccggcggacctgaaggggcgcaacgtcggcgccgtcgcggcctcgaccttcggcaagctcgccgaggagcagggcgcgaacctcaagagctacaaggccgtcgcggaggcgatgcaggacctcgtcggcggcaacctcgacgccgtgatcaacgacgcggtggccggcacctacgcgatccgcgaccgcaagctgccgctggtcatgatcgagaccccgctcagcaccgtgcagaagggcatggccatcaagaagggcaagccgaacctgcacgccgccgtcaacaaggcgctggccgagatggtcgcggacggcacctatgccaagctcgtcacgccgctggtcggctacgacccgttcccgaaggagccgatccgcacgccggccatgtga

SEQ ID NO: 9239 - DNA, 681 bp, Methylobacterium sp.
atgaagaccctcgacgcatcgtcctacacgacccgcctcggcgcgcggcgcgagcagagcctcggccagatggcctacgaccggttgctcgacatgctgatgcggcgcgatctcccggccgggacggtgctgcacgagcggcggctcgccgagatgctcgacatctcgcgcacgccgacccgcgaggcgatgtcgcgactggagaccgaggggctgatcgagcggcagcccggcgggatgctcgtggtcaaggagttctccctgcgcgagctgatcgagatcctgcacgtgcgccggctcctggagcgggagagcgtgacgctggcgaccggccgcatccccggcgcggtgctggaggatctccgggcccggatcgaggacctgatggccgccggggatcccgacgcaccgggcaaccgggagctcgaccggcgcttccatgaactgatcgccgacagcagccacaacgcgctcctcgccaagacgatcaaggacctgcgccggaagacgcagatgttcaacctgagccggatgccggagcggttcgaggcggtccatcgcgagcatctcgccgtcctcgcggccctgcgggccggcgacgcgagcggggccgccgacgcgatcgcggcccatctggagaacttcaagcagggcatcatccgccgcctgagcgagctgtag

SEQ ID NO: 9240 - DNA, 1326 bp, Methylobacterium sp.
gtgcctggctggatcgagaataccctctggtggcacgtctatcccctcggcttcgtcggcgccccccgctcggcgccggaacaggccgagccggtgccccggctgcggcacctcgaagcctggctcgactacgccgccgagatgggggcgaccggcctcgctctcggcccgatcttcgccgcctcgacccacggctacgacacgatcgatcatgtccgcatcgatccgcggctcggtgacgacgccgatttcgacgcgctggtggcggcggcccgcgcccgcggcctgcgcctgctgctcgacggcgtgttcaaccatgtcgggcgcgacttcccggccttcgccgaggtgctgcgcctgggcccggatgcgccccgggcccactggttccgcctctcctggccgcgcgggcccggcgcggagccggattacgcctgtttcgaagggcaccggcagctcgtcgccctgaaccacgacgagccggaggtcgcgacctatgtcgagggggtgatgacgcactggctggcgcggggcgccgacggctggcggctcgacgccgcctacgcggtgccgcccgccttctgggcacgggtcctgccgcgggtgcgcgcggcccatccggaagcctatctggtcggcgaggtgatccacggcgactacgcgaggttcgtgaccgagagcggcctcgacgccgtcacccagtacgagctttggaaggcgatctggagcgcgctgaacgaccgcaacctctacgaactggcccacgcgctggagcgccacaacagcgtcctcgaccgtttcgtgccccttaccttcgtgggcaaccacgacgtgagccggatcgccagccgcctccagaacccgcatcacctcggcgcggcgctcgctgttctgttcacctgcggcggcacgccggcgatctacgcgggcgacgagcagggatttgtcggcatcaaggaggagcgcgcgggcggcgacgacgcgatccggccggaattccccgccacgcccgccagcctcccggcggagggctggccgctctatcgcctgcatcgggagctggccgggctgaggcgcgcccatccctggctgcaccgggcgcgcatccggatcgaccatctggccaaccggcagatggtggcccgctcgcacgcggagagtcatacgctcctgctggcgctcaacctcgacgacgcgccggccgctctgccggccccgggcgggcgggccgttgaagcgggtacggggcaggtcatcgatcccggcgcagccggtgcccgcgtcctcgttccgtcccatgcctgggccgtgctctcctgcgcctga

SEQ ID NO: 9241 - DNA, 774 bp, Methylobacterium sp.
atgatcctcgacgaggacgcggaagcgccaccgccgcggcggatcaagctctccgatcagatcgccgaggatctgtgtcggcgcatcgcccgcgaccggatggagccgggacagcgcctgccgaacgagcgcgcgctgatgcagcattacggctgcgcgaaggggacgatccgggaagcgctgaaatccctggaggtgcagggattggtgacgatgcagcccggcccgaacggcggcgccgagatccggccggtctcgatcgatgccgccgccctgcagctgcggcgcttcctgcatttccggcagctcgacttcgcccaggtctacgccgtacggcgcagcctcgaagtcgcgctcggcctcagcatcgtcggccggatcgacgatgacatcctgcagcagctggcgcgcaacatcgatgcctgccaggcggcggccgatgccggcgatctcgcccgcgggcgcgtcctggagctgaagttccacgacatcctgtgcgatgcgagcgacaacgcgctcctcgccttcatgtgccggttcctgaacagccttctgcgcgacctcgtcgaatttcgcagcggcagcgcgacggagcacgaagcgttcggcgcgcacaacatcgacagccatcgccggctcgtctccgccttccgggcggaggatgccgaggcggtcgaggcggtgatgcacgagcacatgtgctgcgccgagcatttcatgcgtcggctcgacgccgccttcaaccgcgatctcctgagcggcgaacgcgcctag

SEQ ID NO: 9242 - DNA, 162 bp, Methylobacterium sp.
atgcagcagaccgagtacggccggaccgcggccaacgcccccgcccaccgcgtgggcgaggacgtcaacgacgtggatcagacctcgagcgtcacgctgctcggtctggccgtggccggagcggtcgtcatgctgctgctggtgcgcctcgtggtcggctga

SEQ ID NO: 9243 - DNA, 375 bp, Methylobacterium sp.
atgggcgaggcggtctgggcttggcagcgcgcgcggcgcctcgtcggacagccaccttggcgagccgcggcaagcctcgccgaggcgggcgagcgtgagagcgccgagacgctgatgctgcaggacatcccgatctgggagggtgccctcaaggccctcgacgccgagaccgcccgggccgttcgctacggcctgcccgtccctctgccgctggcggtgccggccccggtggcggcagccctcgccgcgcatcgtgcttccgtgctggagcgcgcgctccgccgccgcggtcgaagcgacggcgggggcggcgggccggacctcgtgccccccgatccgggagccggccccgcgatacccgggcgcggcatctga

SEQ ID NO: 9244 - DNA, 717 bp, Methylobacterium sp.
atgcgctgggagaccctcaatgcctacgtcgatggggaactcgatccgcaggaccggcgcgcagtcgcggagacgctggcccgcgatccggtcctggccgcgcgggtcgcgaccctgacccggctgaagcagggagtgaaacaggaggtgaaggctgcggccgtgccgccccggcgcgcgccgatcgcccgcgcctccctcggatgggcgtgcgccgcggccctggtcgtcctcgtcggcgccggctggctcgccctgtcgtctcgcccgccggccgaccccgcgcgcgcggccttcacggcatggggtgcggcgggctcacccgcgaacgacgtgcggcccgcgggcggcccgaatggcttccccctcgatctgggggcggcaggcttccgcttggtctacctgtccccggacgacggttcggccggtcggctcgcaggttacgaggggcgtcacggttgccggctcgccatctggagcggaccgtcgcgcgggcaggccggtctggagatcgcgcaaggggacagcggcccgcgtgtggcgcgctgggatagcgaggggcggcgatacgtcctcctgaccgagacggtaccggccgaacggttcgccctgctggccgaggcggccgcgctgctcacgacgccggacaggacggaccgcctgcggcttgccctggaccgggccaccggactctcggcgcgcccctgcaccggctga

SEQ ID NO: 9245 - DNA, 489 bp, Methylobacterium sp.
atgcggtccatcggtcagcacctcgtcgatgcgtggccgcgcctgttccgctacgcgctagccctgacgcgtgagcccgacgccgcacgtgacctgatgcagcagagtgctctcaaggcgctttccacgcgtacgactcccagtgagcctcacgcggcccgcgcctacctgttccagatcgtgcgccacgcctggatcgaccggatccgccggacccgcctccaccacgaggatgagctcctcgattggcccgacgaggggttcgacgaccgcctgatcgaggcgatcgccgtgcgccaagccttcgccgctctcgatatgccctgccgggctgtcgtgacttgcgtggacgtcgaaggcttgagctaccgggagaccgccgaacggctcggcattcccgtcggcacggtcatgagccgtctgcacagggcgaggcggatcatgctgcaccggatcgccgggccgtccgatgggagcgaggggccgtga

SEQ ID NO: 9246 - DNA, 201 bp, Methylobacterium sp.
atggcggcggaagccctgcctgacctgtctctacaggtcgagccgaacccgaaggatccatcgcgctatcgctgggtcatccgcgatcaggatcacatcctgcggcaatgcctctactccttgcccaatgagcaagcggcgcacagtcgaggggaagccgctttcgaggagatgaccgccctgcggcgcgacgctcagtaa

SEQ ID NO: 9247 - DNA, 1425 bp, Methylobacterium sp.
gccagttcctccccgcgcggcttcacggcgctgggcgacggcaagatcctgttcagcgcgattaccgcggcgaacggcaccgagctgtgggtgacggacggcactgccgccggtacccgactcgtcacagacatcaacacggtacccgacagctccaatccaggcggcttcaccctggtcaagcctccccctgctcccccctccggcggaggcggaggcgagccaccgctcgtcagcccgaacaccgggaccggcggcagcagcacgagcctgaccaccacgagcgatcccgccgctgccgccggcgccgcgaaccaggccgtgcagagcctgcccgccggcctcgacaaggccgcggtcggtcaggccgtctccagcttcctcgccggcctgcctgcgggcaccagcgtcaacgtctccaccttcaccccaacgcccggcgccgccaaaatcagcctgaccggccccaccgacggcagccagaccctcgtcatcctcgacgcctccgccctgccgccgggtacccccatcacgctcaacaatgtcggcttcgtcgtgctctccggccccgcctcgctcatcggcggcgacggcgcgcaggtcgtctacggcgatgatgccgcccaatcgatggtgctgggcgccgacgacgacaccctgcggggtggcggcggcaacgacgtcgttggctcgaagggcggcaacgacctgctctacggcgatgccggcaacgacacggtcttcggcggcgcgggcaacgacacgctgtttggcggcacggagcaggatctggtctacggcaaccaggacgccgacctgatctacggcaaccagggccaggacacgctctacggtggccagggcgacgatcgggcctatggcggccagggtgatgaccggatctggggcaatgccggggccgaccgcctgttcggtaatgccggagccgacctcgtctacggcaacctgggcgcggacgtcgtctacggcaaccagggggcggacacgctgtttggcgggcaggaggccgacacgctgttcggcgggcaggacgcggacgtggtctacggcaatctcggagcggacatcgtctacggaaacctgggcaacgacgtgctctacggtgggcaaggcaacgacatcctgtacggcgggcagggtgacgacgtgctcgtaggtgggctcggcgacgacatcctggtgggtggcctgggcgcggatcgctacgtgttcggtgcgaactcgggccgcgacctgatccggggcttcgagcaggcctcgggcgaccgcatcagccagggcggccagacctacacgctgagcacgagccagggcgggaacgcgctgctgctgctctcgggcggcggcaccgtggaactggccggcatcagggccgagcaggtcaacacaggattcttcgcctga

SEQ ID NO: 9248 - DNA, 1071 bp, Methylobacterium sp.
gtggtcgctcaggccgtctcgaccttcctcgccggcctgcctccgggcaccagcatcaatgtctcgacattcacccccacacccggcgcaacaagcatcagcctgaccggccctaccgacggcacccagaccctcgttgtcctcgacgcctccgccctgccgccgggcacgcccatcaccctcaacaacgtcggcttcgtcgtgctcgcaggccccgcctccttggtcggcggcgacggcgcgcaggtcgtctacggcgatgatgccgcccaatcgatggtgctgggcgccgacgacgacaccctgcgcggcgggggcggcaacgacgtggtcggctcgaaggccggcaacgacctgctctacggcgacgcgggcaacgacaccgtcttcggcggcatcggcgccgacacgctgtggggcggcacggatcaggatctggtctacggcaaccaggacgccgacctgatctacggcaaccagggccaggacagcctctacggcggccagggcgaggaccgggcctatggcgggcagggcgacgaccgcatctggggcaatgccggggccgaccgcctgttcggcaatgccggggccgacctcgtctacggcaaccagggcgcggacgtggtctacggcaaccagggggcggacacgctgttcgggggacaggaggccgacacgctgttcggcgggcaggacgcggacgtggtctacggcaatctcggagcggacatcgtctacggcaacctgggcaacgacgtgctctatggcgggcagggcaacgacatcctgtacggcggccagggcgacgacatcctggtgggtggtctcggcgacgacatcctcgtcggcggcctgggcgcggaccgctacgtgttcggcgcccagagcggtcgcgacctgatccggggattcgaccaagcggcgggcgaccgcatcagcctgggtgggcagggctacacggtctccacggcccagaacgacgatgcgctcctggtgctcgcgggcggaggcagcgtggaactggccggcatcagggctacgcaggtgagcgcccgcttcttcgcctga

SEQ ID NO: 9249 - DNA, 1104 bp, Methylobacterium sp.
gtgcagagcctgcccgccggcctcgacaaggccgcgatcggtcaggccgtctcgaccttcctcgccggcctgcctccgggcaccagcgtcaacgtctccaccttcacccccacaccgggcgccgggcccatcagcctcaccggacccacggacggcacccaaagcctcgtcgtcctcgacgcctccgccctgccgccgggcacgcccatcaccctcaacaacgtcggcttcgtcgtgctcgcaggccccgcctcgctcatcggcggcgacggcgcgcaggtcgtctacggcgatgatgtcgcccaatcgatggtgctgggcgccgacgacgacaccctgcgcggcgggggcggcaacgacgtggtcggctcgaaggccggcaacgacctgctctacggcgacgcgggcaacgacaccgtcttcggcggcatcggcgccgacacgctgtggggcggcacggatcaggatctcgtctacggcaaccaggacgccgacctgatctacggcaaccagggccaggacacgctctacggtggccagggcgacgatcgggcctatggcggccagggtgatgaccggatctggggcaatgccggggccgaccgcctgttcggtaatgccggagccgacctcgtctacggcaacctgggcgcggacgtcgtctacggcaaccagggggcggacacgctgtttggcgggcaggaggccgacacgctgttcggcgggcaggacgcggacgtggtctacggcaatctcggagcggacatcgtctacggaaacctgggcaacgacgtgctctacggtgggcaaggcaacgacatcctgtacggcgggcagggcgacgacatcctggtgggtggtctcggcgacgacatcctggtgggtggcctgggcgcggaccgctacgtgttcggtgcgcagggcgggcgcgacctgatccggggcttcgaccagggggcgggcgaccggcttgtgctgggcgggcagggctacacgctgagcacgagccagaacggcgatgcgctgctgctgctcgcgggcggaggcagcgtggaactggccggaatcaggactgcgcaggtgagcgccggcttcttcgcctga

SEQ ID NO: 9250 - DNA, 885 bp, Methylobacterium sp.
atggagcggatcggcgcgcgggggagcggcgggagcctcgcgctcgggctcaccgcacgccgcgcgcccgggctcgtcctgccggcgctccgcggctgggtcggcggctgcctcgccgcggaggccgcgcagcgacggctgttcccctggctcgccgttgccttcggggccggcatcctgctgttcttcgggctggcggacggcacccccgtcctcgccgcgccgctcggcgcggccgccctctgcctcgggctgacgccctggctcggcacccgcccggtgatcctggcgctcgcgctggccctgaccgccgccttcctcggcttcgcggccgcgtcctggcgcgtctcgcgggtcgcgggcccgatcctcgcccgcaccacgatcgggccgctcaccggcctcgtcgagtccctggaggagcgggaggagggcgcccggctcgtggtccgggtcgcccgcttcggtgcgctcagcccggaggagacgccgcggcgggtgcgcgtgtcgttcaagcgggcgccgcccgtgaaacccggcgacgcgatcgaggcgagcgcgcgcctgctgccgcccccggaggccgcccggcccggcggctacgacttcgcccgggacgcgtggttccgcggcatcggcgcggtgggctcgctgacgggcaagatcacggtgcgcgcgcccgccgagccgccgggcctgtcctcgcgcctcgcagccctggtggacgccgcgcgcaacgccctgacccggcgcatcgccgaggcgacgggaggtcaggccggcgcggtcgccgcggcgctggtcaccggcaagcgcgggctgatcgcgcccgccaccagcgagaccctgcgggcggcggggatataccacgtcgtccagggatga

SEQ ID NO: 9251 - DNA, 423 bp, Methylobacterium sp.
atgcgggtccattacctcgctcgcagcggagcgacgcgggatgcgctcggcatctaccgggtggagctcgcacctcgctcgcccggtgccggcctccaccggcatgctcgcctcactgaaaccttcgaggtccatgccggccggctcaccgtgcggatcgagggtcataccctggagctcggccccggcgacttcgtgctgatcccgcccggccagccgcacgccttcgccaaccgcggcgacgaccccgtcagcttcaccctgagcttcaccccggcgctcggtcgcgagggcttcttcgagggactggccgagctcgcggccgcgaatcggctcggggacgaggcggcgatggacgccctgatggcggactacgatcaggaaccgctggaggggttctccggctggagcaggatcgactga

SEQ ID NO: 9252 - DNA, 600 bp, Methylobacterium sp.
atgacgaacatctcaagcctcgcgagcctctcgaacatcacgcgctccgagggcgatccgaaggtcctccggtccggcccgagttcgcgcggcgtaccggacagcctcgccaaggggctcggctggttcagcctcgccctcggtctcaccgaactcttcgccccccaccgcatcacgcgggccctcgggatggagggcaaggaggccctggtgcgcgtctacggagcccgcgagatcggcagcggcatcctctcgctctccgtcgacaagaatctcgggctctggagccgggtcgccggcgacggcctcgacatcgcgaccgtgatgacggcgcttcggccggacaacccgaagcgggacaatgtcgtgatcgccctggcgctcctgctcggcatcacggcggtcgacctgatcgatgcccaagccagcacggcgcggcacagccgcggggtgggtcggaagagatcctaccgggatcgcagcggttttccgcgcggcgtccaggcctcccgcggcgccgcccgggacttcaagacgccacccgacctgcgccacgctccgcccctcgccgcggtctcgcagcgtccgtccgtcgcctga

SEQ ID NO: 9253 - DNA, 864 bp, Methylobacterium sp.
atgagacccgcgatccgccgccggcccttcctgcccctgttcgtgacgccggcggtcttggtcgccgtcgcgatcgtggccgccatggcggcgatcctgcgctacagcctgcacgcctacgtgccgggctccctcgacgtcggcgggctcacgctggagaacttctccgatctcggccgcccgatcgtgctgcgcgctctgcgcgacacggtgctgatctgcttcgagacggcgctgatcaccctggtcgtcggctaccccgtcgcctacgcgctggttcgcacccgctcgctcttcctgaagtccgtcatcctggtcaccgcggtgaccccgctcttcctcggcgaggtggtgcgcacctacgcctggacggtggtgctcggcaattccggcttcgtcaacgcgacgttacgccagctcgggctgatcgagcggccgatccagctcatgttcaccgagctcggggtgatcatcgcgcttgtccacgtgacactgcccgtgatggtcatcatgctggccgccgccctcgcccatatcgaccgcgactacgagcgcgccgcccagagcctcggcgccgggccggtacgcgccttcctcaccgtgacgctgccgctctcgatgcccggcgtggcggcgggcttcaccaccgccttcgcctggaccttcagcgccttcgcgacgcctcaggtgatcggcggcggcaaggtcggggtcgtctcgacgctggtctaccagctcggcttgtcctcgttcaatttcccggtcgcggcctccttgagcctcgccggtctcgtcctagcgctcggtacgatgtggctcgtgcgccgcgccgcccgcccgctcgaagcgctcggaggccactga

SEQ ID NO: 9254 - DNA, 777 bp, Methylobacterium sp.
gtgagcccgcaccgcgcccgctactggatcctggcgatcctctcgccgctcggcctcctggcgctctgggccttcgtgacggcgcgggggctggtgacgcccgtcctcctgcctccgccgctcgcggtcctggcgagcctgaaggacatggtggcgcagggttactcgggcgtcgatctcgcgacccacgttctcgcgagcctgcgccgggtcggcctcgccttcgcgggcggcgccgtgctcgggaccggaatcggcctgttgcgcgggcgcgtggccgagatcgacgcgctcttcctcgtcccctcggaactcctccggccgatcccgccgctcgggctgatcccgctcttcatcctctggttcggcatcggcgaggcctcgaaggtcctgctgatcttcctctccgtcttcctgatcgcgatggtgaacgcgcaggccggcgcacgcgcctgcaccctcgacaccctgcgggccgcccggtgcatgggtgcgagccgctggcagagcttccgccacgtggtgctgccctcggctctgccgcagatcatgacgggcctgcgcgtcgcgatgggcaccgctctgaccatcctggtggcggccgagctgctgggcggcgaccgcggcctcggcttcgtcatcctcgacgcgtcgagcttcttccgcaccacctacgtcttcgccggcatcgtcctcgtcgggctgatcggcctcgtctccgatcgcgcgatcgcagccctcggacgccgcatcgtccactgggagggccggcgctga

SEQ ID NO: 9255 - DNA, 1416 bp, Methylobacterium sp.
atgaccgcacacgtccctctctcctcgcgtcaccccgctcaggactccctcgccgccgtcgtcgccggcctgcgggaccgcttcggcgcgcgcctctcgacggcggaagccctgcgggcgcagcatgcgagcacgctcacctgggcgccgagccagccgccggacgccgtggtcttcccgcacacgaccgaggaggtgcaggcggtcgtgcggctctgcgcggagcaccgtgtaccggtgattccgttcggcacaggctcctcgctggaggggcacgtcaacgcgccctacggcgggatcagcgtcgacctgtcgcgcatggaccggatcctcgcggtccatgcggaggatctcgactgcgtggtcgaggcggggctgacccgcaaggcgctgaacctgagccttcgcgaccagggcctgttcttcccgatcgatccgggggccgacgcctccttcggcggcatggcctcgacgcgggcgtccggtaccaacgcggtccgctacggcacgatgcgcgacgcggtgctcggcctcaccgccgtcctgccgagcggggagatcgtccgcaccggcagccgcgcccggaagtcggcggcgggctacgacctcacccgcctcctcgtcggcgccgagggcacgctcggcatcatcaccgagctgaccctgcgcctcagcggcatcccggaggcgatggccgcggggcactgctccttcccgagcgtgaaggcggcctgcgacgccaccatcctgacgatccagtccggcctgccggtcgcccgcatcgagctgctcgacgccgtgcaggtgcgggccagcaacgcctactcgaagctgagcctccccgagacgccgctgctgctggtcgagttccacggcaccgaggcctcggtgcgcgagcaggccgagcgcttcggcgagatcgcggccggggagggcggcggcgcgttccgttgggcgaccgaggccgaggcgcgcagccgcctctggcaggcgcgccacgacgcctactgggcggcgctcgcgttgcgccccggcgcgcgggcggtggcgaccgatgtctgcgtgccgatctcgcacctcgccgcgtgcgtcgccgagacccagcgcgacatcgccgagagcggactcctcgccccgatcgtcggccatgtcggcgacggaaatttccacgcccagcttctggtcgacccggaggacggcgacgaggtcgcccgcgccacagggttcatcgatcggctcgtcgaccgcgcgctcggcctggacggcacctgcaccggcgagcacggcgtcggccagaagaagatgcgtttccttgaggccgagcatggcgccgatgcgctctccgcgatgcgcgccctgaagcgtgctctcgacccgctcggcatcatgaatcccgggaagatgctgggcgcctga

SEQ ID NO: 9256 - DNA, 783 bp, Methylobacterium sp.
atgggccgccacgagaccttcgacatcaccactgccctgtcgaccacccttactcatctcggcggcattgatcagctcgggaagaaggatccgatctttgccgcgctggacgcctgccgggcgcctgaagccgagagggaggcgtttcacgccgtgcactctgtcggcacgactggtcccggctacacgctcgaacgcgagatagccctggacagtgcggtggaggcggctttcaacgccgtgttagccacgacgccgaccacgcaggacggccgcctcgccctgatcgcgttcatcgcgcgccgcatcgagtggagtgcgtgtccagacggatctccgcaggagggcgaggacactgttttcgctcaggcttaccatgcgctcgcccaagcaatccgggccgaacaggccgagccgatcggattgcccgacctgtctgcgctctcaatcaagcagcttcggaacctctatgatcggtacgtgcagatctccgatatctggaatgacgcgctgaacgccccgtggacgaaccatgccgaaggagccggctttcgggcatcgaacgcagctggcgacgtgatcgaggccgagcagacacgcgtttgcgccctctatgccggtgtggtggctgagatctcgcggcgcacgccttcggggaaggggttcgagccagactggcaactcgagacgctgatccgtcacgagctgatgtgcaacggcgacctgcgcgaggcgccagagctacgcgccaaaattattcggcagtggggagctgcggcatga

SEQ ID NO: 9257 - DNA, 504 bp, Methylobacterium sp.
atgtcgcgctggccagcatccacggccgatctcttcgatgcggaccttgccgcctggaccgaggcgcaggccagcgccctgcgcgaaggacgggtggacgccatcgacgcggcacacctgtcgcagatggtcgaggccctggtcgcggagcgcgcggccgagttgcaggcgcggctcggcgtgatcctgaccggcctcctgcgctgggccgagcaggtcgatctgcgggggcattcctgggcggccaccatcgacatccagcgattccaggtggacgacatcctccgggaaaacccgagcctgcgccggtcggtggcggaactgatcgccgcggcctatcccgaggcgaaggcgcgggccgtgctggagagcgctctcttcgaggaatcgttctcggaatcctgccccttcaccgacgacgaggttctgaccgtgggcttcctgcccgacccttacggcgacgacgcgatccgcggccccggctggtggaagcgctccccatga

SEQ ID NO: 9258 - DNA, 372 bp, Methylobacterium sp.
atgcccacgatccgtcccctctggcgcgcgctgctcacggtcttcctgaccgtgatgctcgtcggcgtctcggtggcgaacgccgggcacgggcatgccggccatgcgccgatcggcccggccgcctcggcacaccacgatggcgtgccggagcaggtcggcgacctgtcgaaccatgcggagcggaccggcgacgacggggccgcgggcccctgcggctgctgctgccatcaggcctcgatcgtgcgctgggattccccggccgttccggtctcgtggcggctcgcacggacgctcgtcggcatccgcgcgatcgcgttcgacagcgtggcgcccgagacccttcccgagcctcccagaaccttcgcctga

SEQ ID NO: 9259 - DNA, 138 bp, Methylobacterium sp.
atgggcaggcggtggatcgtggcggcggcgctcgcggctcttgtcgcggtggcgggctggcggctgcgcgatttcctcgcgcaggatgcctgtctcgacgcgggcggggcgtggaggggcggtatctgccagcactga

SEQ ID NO: 9260 - DNA, 375 bp, Methylobacterium sp.
gtgaggttcgtgatcgacatgaacctgtcgacggattgggcagcctacctgcaggggctcggccacgacgcggtgcactggtcgagcatcggcccgcaggataccgccgatgaggacatcgccgcctgggctcgtgcggaggaccgcacgatcctgaccaacgacctcgatttcgggacgctgctcgtgagcacgggcgccgcgaagccgagtgtcgtgcagcttcggacggacatcaccttgtccgcccatgtcggcccgctcgtcgcgcaggccatcgaccgtatggaagccggactcgtcgccggcgccctcgtcaccatcgagaccggccgcttgcggatccgctctctcgcacccgattcggaagactaa

SEQ ID NO: 9261 - DNA, 246 bp, Methylobacterium sp.
atgacgcgaagcttcaaggacttcccgaggatcacggtcgatcccgcggtgatgggcggcaagccctgcatccgcgggatgcgcgtgaccgtcggcatgatcctgggcaatctcggcagtgggatcagcgtcgaggagttgcttgcgggctatccgtacctcgaacgcgaggacgtcctggaagccatgcggtacgccgcggccctggcacgggtgcgcgaactcgagatcgagcccgccgcgtga

SEQ ID NO: 9262 - DNA, 282 bp, Methylobacterium sp.
gtgcccgacttcccggccagcctgctctgggtcgaccagcttcgctggtgcctcgcggtcatggacgccgacgatcccgacctcgggttcgctgccagtctgctgagccatgccgtcgacaagggcggcctgaccgagaagcagggcaagtacgcctcccgcatcgtccagcgcgtccaggcgctgtggctggccgaggccctggcctgccagcgccggccgtccgcgccggtcccgccgccgcccgccctctcggaaatggccacgaagggggaggcctga

SEQ ID NO: 9263 - DNA, 120 bp, Methylobacterium sp.
atgccgcgggtcgcctcctgcatcagcagcaggtcgggctgctcctgctcgatcagcgcgacgaggtcggccaccgcggcgccggtgcggcgcaggaggttccagctcacgatcttgtag

SEQ ID NO: 9264 - DNA, 156 bp, Methylobacterium sp.
ttggccacggtgaaatcgccgagatccagcacctgcgagacccggtggaacatcgcgccggacggcagcggcaccaccagcggcggccgggtccagggcttcggcgcccacatggcgagcccgtggatgcggtcgggcagctgtgcccaggcgtag

SEQ ID NO: 9265 - DNA, 360 bp, Methylobacterium sp.
atgacgagccccgccccaccgcccaccgcctccgaggtcggacagcccgagtggcgcgccgccgtgctcgccgaggcgatccggcacaccgcgcacctcgccgggccgatcagcccgttcgccctgatggatcacctacgcggctggctcggcctgcccgaggaggcctgcggcggcgatttccaggccgtcctgttcatgctggtccgctgcggcctctacgacggcaacaccatggacctcgcgaagggcgagatctggctgagcgccgagacccggctgaccgccggccggacgctcacggccttcctctacggcgaggcgccggccgagcgcgcggacgacgaggcggagagctga

SEQ ID NO: 9266 - DNA, 126 bp, Methylobacterium sp.
gtggtccgccctgaggtaaggctttcgggccaggacgaggacggacggatgggaacgaagcggcacaagccggaggatgtggtcgccaagctgcggcaggcggacgtgttgatcgcgcagggctag

SEQ ID NO: 9267 - DNA, 333 bp, Methylobacterium sp.
gtgagcgtctgggatcgcgacgacctctgcgagatcgagcccggcgacgaccggctcgacgtgccgccggtcacaatgatcgaccggctgatccgctggcatgagaagcgtgccggcgccgacgggcgcctcgctctgagcctggaggcggaagggctgacgatcgcggccgacaccaaccgacagcgctccctcgcccatcgccagacagcgacctgcctcaaggtgctgcgccagcgctgctgcgagagcgagggcgccccgcagcaggccttccgcggtcacctcaagccgaagccccggccccgcgccgaggtccgcgcaccgccctga

SEQ ID NO: 9268 - DNA, 264 bp, Methylobacterium sp.
atgcacgacaaccgcgccctgagccgcttcgagctgaccgagcaggggctgaccgcctacgcggattaccgccgcggtccgcaggggctcgtcatcgcccacgtctacgcccccccgcccctgcgcggcaccggcgcggccgaccggctgatgcgcgcggtggccgagcaggcacgggcggaaggggtgcggatcgtgccgctctgcggctatgccggggcctggctgcgccgcagccccgctcaccgggacctgatcgcctga

SEQ ID NO: 9269 - DNA, 960 bp, Methylobacterium sp.
gtgaagaccgttttctcgaccgggcacgtacacccgcgcgatcgatttgatttctggcacgacgttgctcggaaggatgtcgccgaccacacctccacgccgaagtgccggaacacgttccaggccgaactccgggccggctcggtcggctccatcgggcttgtcctgttccagaactcggacatgtcggtcacccacgcacgctgtcatatcgacctcacgaacaccgatgagctgttcgtctgccgacagttcggtgggcgcctcgccctcgatcaggacgggcgccaagtcgtgctggagccaggtcacatcacgttgctcgacccccggttgccgtatcagggacggttctcggaagattctcaggtgctcgttctgaagatcccgcggcagcacttggaagctcgcctcgggcagacgcgggaattgacggcgcgcgcgatcgagccgtccacgaccgagaacagtttgctgtcgcagagtctcgcgatgctgccagctcacacgcaggatcttggctcgaccgccgggattcttctcgagacgcacctgctcgatctgatcacgctctcggtcggcctggcgatgggaggggagaaagcccgcacgacgtcggcccgctcacttgtccgggtccggctccgggcggccgtcgaagcgcgcatggcggaccgaaatctcgatgccgccacggtcgcacgcgcagccggggtcagcgtgcgatacgccaatgaggtgctggccgaagacagcacatcgatcgtgcagctcatccaggcgaagcgtctcgctcgctgccgtcaggcgctcgaagacccatcgcagatggggcggagcgtgagcgagatcgcctatgggtggggatttgccgacatgacccatttcggccggcggttcaaagccgcctacggcgtgttgcccagcgagcatcgtcgtcgcgcgaggcacgacagctga

SEQ ID NO: 9270 - DNA, 954 bp, Methylobacterium sp.
atggcatcgacatcgcagacggccaccgcgccgcgcccgccctgccccatcaccggggagcccgcgcggcggctggtgcagtgggtcggctcgcgcttcctcacggatctctggcgctacgccggcggtgtcgatgtcggacacctgctgcggcccgccgggcgcttcggcctctgggaatcgcccaccggcctgatcttcttcgatcccatggtgcccggggacgaggccttctaccgcgcgttctacgcccgcatcggcgcccacgagaagctcgcggggccgcgcacgcagcggctggaattcgtcgccgcggcgcgccacgtgccggacggcgcccgcgtgctcgacgtgggctgcgggcatggcggcttccgcgcctacgtgccgggcgcgcgctacaccgggctcgatccgaacttcgccgcggaggatccgacgggcgcgatcctggccgagagcgtccaggcgcatgccgcgcgcgtcggtccggtctacgacgtggcctgcgccttccaggtgatcgagcacgtcgccgacccgctgggcttcgcgcgcgcgctggcggcctgcctgcggccgggcggcacgctcctgatcggcacgccgctctggccctcgcccaacaccacgatcccgaacttcatcatgaacgcgccgccccaccacctgacatggtggacgcccggggcgctggaggccctcgcccgccggctcggctgcgcgccggtcggggtcgagccgatcggcatggaccggcacgatgcgctgatccactggatggccaggacgacgcccgtccgctgccgcgggccctacttccgcccgcactggagctggtacggcgcgcaggcgctcagctacggcgcggccctcgtcctcgaccggctcctgcccctgcccgcccggacccggccgaacaccctgctgctcgcggcgcgcaagcccggctga

SEQ ID NO: 9271 - DNA, 873 bp, Methylobacterium sp.
atgacgacgcgcgccctgaaatccgccgcgctacccgaggccgagcgcttcgccgcgatccgccgtggcccgggcccgatcgctcgcgcggtcgacaccaccctcggccgcggcctgatccaggccgccgcggtggccgtgttcttcaccgcctgggagatcgcggtcgatgccggctggctcaccgagttcctggtcggtgcaccgtccggcatctggcgcgtcttccgcgcgagcctcatggacggcagcctcgcggtcgacacttggtacacgctgatcgaggccatcctcggcttcgtcatcggcaccctcctcggctcgctggcggggctcgggctctggtactcggtcctcgtcgcgcgagtggtcgagcccttcatcgtggcgatcaactcggtgcccaagatcgcgctcgcgccgatcgtgatcctgtggttcggcaccggcttcgtctcgaaggtggccctcgcggtctcgctcaccgcgctggtcgccttgatcgccgcctatcaggccgcgcgtgacgccgacccggacctgcaggctctgatggcctcgatgggcgccacgaagaaccggatcttccgctcggtcatcgtgccgtccacgctgccggcgatcatcgggatgttccggatcaatgtcggcttcgcgctggtcggcgcggtggtgggcgagttcatctcgtctcagcgcggcctcgggcacctgatctacaccgcctcgtccctctacgacctcaatacggtctgggtcgggctgttcgtgctgatgttcgtaggcttcgttctctaccacgtcatcgacctcgtcgagcgccgcatcctgccctggcgccaggtctcgaccgggggcggcatccaggtatga

SEQ ID NO: 9272 - DNA, 846 bp, Methylobacterium sp.
atggaccccatgccgacacccgacagccccgccgatccgaaggccgctcccgtgcagctcgcgctgcgcggcatccgcaagagcttcccggccaagtccggcccggtcccggtcctcgacggcctgagcttcgacatccacgagcgcgacttcgtcagcatcatcggcccgtcgggctgcggcaagaccacggtgttcaacgtcatcgcggggctgctcgaaccggatgtcggcacgatgctgttccgcgggcggcccgtgccgggcctgcgcggccgggtcggctacatgatgcagaaggatctgctgtttccctggcgcacggtgctccagaacgtaacgctcggcctggagatgaagggcacggacccgcgcgaggccgccgacaccgcccgtcgctacctcgcccagttcggtctcggcggcttcgaaaacgcctatccgaagaccctctcgggcggcatgcgccagcgcgcggcactgatccggacgctcatcctggatccggacatcctgctcctcgacgagccgttttcggcgctcgactaccagacccgcctctaccttgagggcgtgctgctcgacgcggtggagctcttcggcaagaccgtggtgctcgtcacgcacgacatcgacgaggcggtagccctgtcgaagcgcgtcgtggtgctcggcgggcggccctcgcgcgtgaagaacgtgcacacgatcgcgctcggcgaccgctcgccgatcggcgcgcgcagcgacccgcggttctcggaccacttccataccctctgcggcgaactggacatccagacccgcgcgggatccgcctccaccgcccgcgccgaggccgcctga

SEQ ID NO: 9273 - DNA, 963 bp, Methylobacterium sp.
atgaagccgctgcgctccaccctgctcgccgccctgctcgcctgcacgagcccgctccctgcgctcgccgccgacctgaaggccacggtctcgcaggccttccagtcgatgctctacctgccgctctacgtcgccatggacgagggcctgttcgagaaggccggcatcgacgtcacgaaggagacggcgggcgcgccgagcgtcgcgctctccgccgtgatctcgaagagcgcgcaattctcgatccacgggccggaatggaccgcggtggcggcctcgaagggcgcgcccgtcaacgtggtggccaatgtcgtcaacggagccgcggtctggatcgcgaccgcaccggacttcccctggaccgacgtgaagagcctgaagggccagaccatcgtcaccggcctgatgccgaccaccagcacctcgctcttcctgaagctcctgaaggagaacgggatgagcaaggacgacgtgacgctcacgcaggtcgcgctcggcaccgagccgggaccgttcctggccggccaagccagggtggcggtgatgtacgagcccggcctcgaccaggtcgtcgccaagggcatgaaggtggtgctgggcttccccgagaagtacggcccctacgccttctcggcggtgagcgcccgcaaggacgtcgaccctgccgtggcgcaggccttcgtcaacggcatgcaggcggcgatccggctgatgcacgccgagcccgcaaaagccgtggcggttgccaagaagcagttcccgaccctcgaccccgccgttgtcgaggcggcggtgaagcgcatgatgaccgagaaggtctatccggacagcgtggacatcacgaaggaggcgatggcgctcggcctggacacgcagatcgcactcggcaacctcgcggcccagcccgattacgccaccttcgtgcggcgcgacttcataacgaaggcgacggccggcaattga

SEQ ID NO: 9274 - DNA, 1422 bp, Methylobacterium sp.
atgcggccgggtctgcgtgtacctgcctcgtcgcgagaggcggagcccttcatcggcattcccggcggcactctgcccagcggcactctggagggtgatctcgtcgcctcgctgatgcaccggcacgagatcgccgccgagcgcctgatcggatggctgcgtgtggcgatcggagcttgcgtcttcgtgacggtcatcgtcacgggcgcggcgctgcgtcaccagaccggggtgcccttcgacgtgttcgagcgcaatgcttggatcgcctcgctcggcttcgtcgccatcggcgccatcagtatcgtcctcgccgtgccgcagcgctggtgccacgtcttcgcctacctgtttatggcactcgacgtcgggctcgtgctcgccatcgcctgtctggcggtcggggagcgcgcgctccccggcaacgccctgccgtccgcgcccatcgtctgggcggtgcccctcgttctggcggtcggcgccctgcgctacgacgtcaaggtgcagctctcggccatcgcgcttctggcgctcgggctcgtcggcatcgcggtgggattggaacatcggctggtcatggatgcggctggccggaacgcaccgatctggccgcagctgttctcgatgcctgtcaacgtcatgcgcttcaccctgctcttgctggccggtgccgcgacggcgctcggcatcgttcgctcgcgtcggcttctcgcgtccgcggtgaaggatgccgtagggcgggccagcctctcgcgctttcttcctgccgagatcgctccgcgtctcgctgccggcgacctcgacctccgccgcgggcgccgacagcgggccgtcatcgttttcgtcgacatccgcgactcgacgggtatggccgagggcatggatccggagcggctctctcaattcttcaccgcgttccgcacccgcatcctgacctgcgtgcgcagacacagcggcgtggtcgacaagttcatcggagacggtgcgctgatcctgttcggcgtgccggacgagggcagcgacgatgccgcacgcgctctcctcttcgcacgcgatctggccggaagggtcgagacctggaacaccacgcacgagctgccgcatcccgtgaggatcgggatcggcatccatgtgggcgaggtgttctgcggcatcatcggggatgaggagcgcctggagttcacggtgctgggcgatgccgtgaacgtcgcctcccggctcgaacaggcgaccaagcgctacggtgaggtcgttctggcctcgggcgctgtggtggagggctcgttcgagcgccacgcatggctcgagatcggccgggagccgctcgcgggacgcaaggaggcgatcacgatcttcgcgcccgcgcgcgctccgacacggcagatggccagcttcggggatctgagtgccgagccgggctaa

SEQ ID NO: 9275 - DNA, 915 bp, Methylobacterium sp.
atggagaccgcccccgacgacccccgccggcccgagaaccggctcgcctatcgcgccgcggtcgaccggccccggctcaccctgcccggggggcggcgcgtcgcgatgtggccggtggtgaacgtcgagcactggctgatcgacaatcccatgccgcgccagatcctcgtgccgccgacggcggcaggcctgttgccggacctgccgaactgggcatggcacgagtacgggatgcgagtcggcttctggcgcctccttggggccttcgccgcccgcggcctgcgcccgaccctgtcgatcaacggctcggtctgcaccgcctacccgcgggttgcggccgcggcgcgggacgccggctgggagttcatggctcacggcttccatcaggtccccgcacaccgggtcgccgacgagacggagatgatcgcccgctcggtcgggacgattgcagacttcgtgggcgccgccccgcgcggctggctcgggccgggtctgaccgagacgctcgacacgcccgaccacctgcgcgcagccgggctcgaatacgtcggcgacttcgtggtggacgaccggccttgccggatcgccacgcgcacggggccgctcgtggcgctgccctactcggtggagctgaacgacatccccctgctggccatccagcaccaccgcgccgacgagttcgtggagcgggcgctcgccaacctcgaccgtctgagcgcggaggccgcgggcgaggggccgctcggcggcgcgaaggtgatgggcttcgccatccacccctacatcaccggcgtcccccaccggatcggcctgctggagcggctcctcgacgcgctcctggcacggtccgacgtcgcgttcatgcaggggagcgagatcctcgactggtatctcggcaccggtgacgacgcctga

SEQ ID NO: 9276 - DNA, 561 bp, Methylobacterium sp.
atgccgagccatgcagagatcaacttcgcctatgcgcattgggccgagcgcctcgtgcacgaaggctggaccccgtacctgctgaccttcatgttcgagaacttacgcggtccgtctcacgaggtcgcgcgccagatggagcgcgaggtcgagcgagtgtacgctaccctgctgccgcggattgtccgaaatccgactcgacccgcgatgaccggccgattacccgtttggttctgcgcctccgatcggccggttttcaagcgggccaagcagagcctgcgcgatgtcatgatcaacgatggccgccacgttcatgcggttgcgttccttccgccttggtcccggctactagaagacttggcagcgcatgtcgaagcctatcgggcgctctacctccgaccggagttcccgctcgtgcggctcgacgttgttccaattacccagcgggccggttacggcgtcgagtacgctagaaagtatactgggcgaagccttatcggtgaggatgccggcttcgtgctaccccgcgccttgagcgaggttcgggatcaggcggcctga

SEQ ID NO: 9277 - DNA, 609 bp, Methylobacterium sp.
atggcacgcatccgcaccatcaaacccgagttcccgcaatccgagacgatcggcgcgctctcgcgcgatgcccggctgctgttcgtgcagctctggaccatcgtggatgatgccgggagggctcgcgcatcctcgcgagtgctcgcgagcgttctctaccccttcgatgacgatgcgatgcacctcatcgagggctggctgcaagagctcgaagatcagggctgcatccgccgctacaccgtcgagggcaaaccctacctcgatgttcctaagtggttggaacatcagaaaattgacagaccgagcaaatcgaaactgccggaattcgtggaggcctcgcgagggatcgcgagcaatcgcgaaggctcgatgctggaatataggtcaaagaccatggaccatggaactaggaccgtggaccagggaccaaggaccagggaacagaacctagccgcagggtccgagtacggagggggctctcacgcgtatgcacccgcacgcgaggcccgagacccgaccggcgacgacgcgttcggggaccctgatcccgcggcttgggacgaccccggtcagttcggtcgcgacaggtccacgggaggctcccgatga

SEQ ID NO: 9278 - DNA, 102 bp, Methylobacterium sp.
accaaccccggcaagatcccgctcgaactcatcgaggtgcaggtcggatcctataccggcgaggacgacatcatccgcgtcgaggacatctacggacgctga

SEQ ID NO: 9279 - DNA, 102 bp, Methylobacterium sp.
accaaccccggcaagatcccgctcgaacttatcgaggtgcaggtcggatcctacaccggcgaggacgacatcatccgcgtcgaggacatctacggacgctga

SEQ ID NO: 9280 - DNA, 1017 bp, Methylobacterium sp.
atgccgacgaccccgaagcctcgtgcgatcgggctcgccacggctttcctccttatccacgcgggagccgcctccgccgtggaactgccagaggccgttcgggcctggttcgccacggaccggtcgatcgtctgcgtcgatccggacggcaacgaccgccgttgcgccatcgatgccgacacgcatctcgaactccggcggtcgcccgacgcatcgacggcgctcgccttcgtgacctacctgccggatccgacaggcaattcgaccgtgaccacggccgcaaccttccgggcgggcgagacggggtggcggcatgtccggaccctctcggaggtccggggccccctcgcgggcaaggtcacgttcggcgatcggaccgcgaccttcgcggtcgccgtgccgcgacggggtgatagccactgctgcccaacgggccgcaaggcctaccgcgtcgctctccctcgcgagacgcctgcggtggtcggtgggaagaccgacgcctcgccctcgcgacaggccgcgctggatccggctcgggtcatcgcggaacagatgcggctggagaagcgcggcgacatgacgggcctgttctccaagagcttgaaggccgcctacgacgccgtgccgaaggatgagcccaacgtgggcctgacgattctcggcggtgggtacgacgtgccccgcaaggtcttggggacttccgccccgcaatacgacgtggccgacccgaagagggcgtccgtgacggcaacgctgcactacaccaacgaggacgcgccggagccgtcgttcgaccgcagcatcgtggtggtcttcatcgcggaggacggccgctggaggatcgacgatgtccatctgatcgatccgaaagggcgccggacgggtcgcgaggtcgggatgaagcgcgcctttgggcgtctgacggaggaacgcgcgcgcaccatggtcgagcgccatgcccccgcgccccgtgcgggccgcaacgaaatgccggacaatcgccggagcgtaccatga

SEQ ID NO: 9281 - DNA, 360 bp, Methylobacterium sp.
atgaccactgcccaccagatcgcctcagggttcgaccgggctggcctttccctggccggtgtcgcggccggttgcctcgccgacgcccgcgctcgtcaggtcgccgtcgatgaggagcaggcctaccgaaacctgagcgccgcccagcgcaccgtccgggccgccgtccgccagcgtgcagagctccaggccgccgtcgacgagaacgcggccctccgcgccgaggtcgcccgactgcagcgcgcgctcgccgcgtcgcagtcccagaccgccaccgctcaggccgagacgggccgcatgcgccagcgcgccctccacgccgaaggggtcctcctgcggcaggcccgcaccatggcatga

SEQ ID NO: 9282 - DNA, 465 bp, Methylobacterium sp.
atggccacgatggacacgaccctcgacatccgcggccgcctctccgcgatccgcgcgggatggtacgccggcgccccggccgtctccccgcacgggcgccgcatgtactcgggcggcctcgtctaccacatgaccgctcaccaagagatgcggcagccgccgccatcccacgaggcgggacaggcgtacctgcgggccctgctccgggactggaggaccgcccatgccccgctcgcggagtgggacgcggccaacggtggagccctgcgcaggtgcctcgtggccgccggcgtcgccctgcgggaccagacggacgacgggcgcgagcgcgccgatttcctcgtcaggcaggcctgcctgtgcctgagcaccaccacgctcgcgaagctcgacgccaagatcgcgaagctggccaaggttcccgtcgggccgtggcgcatcggcggcgggctcgcgaaggtctga

SEQ ID NO: 9283 - DNA, 774 bp, Methylobacterium sp.
gtgcggctgcgggacgtcgctccgaccatcgatacgctcctggctctaagcaccgaggagttgggcctacgccttctgcccctgctccaccgtgtggcgtctggcggcactcgccccatgagcttgcgcgggttgctgaacgtggttctctacgatgaggtctcgccgacgggtgcgcggtggcgcaacggaccctatccagggcgcgagcgggacgctacgggggccgtcgctgaggcctgggcttggttagaggggcaaggtctcctggtgcctgtcttggacaccgacaacaggagcgatcctgagggccgcaccttaagccgccgtgcggctcagatggtcgccgagccgaaggaagccatcgcctcccggcacctcgggaaggaagctctacacccgcggatcagagaggacgtgtggtcgctctaccaccggggtcgttacgacatcgcggttttcacggcgatgaaggcggtcgaggtgcgggtgcgggaggcgtcgggtttggcggccaccgatctcggcaccgacctgatgcgcaaggccttcaacaaggagaacggtcccctggcggacatggccacgttgccggccgagcgggaagcgcgctcatccctgttcgccggcgccatcggctcctacaagaacccgcagtcgcaccggctcgtggacctcgatgaccccggcgaggccgccgagattatcatgctcgcgaaccacctcctgcggattgtggacgctcggggtacggcgcgcggccactcctcatag

SEQ ID NO: 9284 - DNA, 285 bp, Methylobacterium sp.
ttggccttctgcagcaccgacacggcgctcacggccgccatctggacctacggatcctcccttaccgatccgaagagtgctttcgtgatcaagcaattgccgatcgcttccacccatggcgcggcatggaagctgggcatcctgcccttcctatccggctttccgagtcccattgcctacatgctcctgcttctgccgatcctgctgttcctctacggcatcggatggctgctcgggcttgcctggggccggatgatctcgggctggatcgctccgaccggatag

SEQ ID NO: 9285 - DNA, 381 bp, Methylobacterium sp.
atgccaccgcgggtcgcggcgcgaccccggccagaggagtggaccgatgacgaactgctgaccctgcccgaggccgcggcgctgttctggccggacggcccgatcaccacgaacaccctgcggacggccggtcgtgacggcaccctggcgatcacgaaggtggcggggaagttcttcacgacgccgatggccatccgacggatgggccacgatgagaccggggagccgctcggtcgagaggcggcggtaccggaggcaagttcgccccgaaccctgttcgaggcgaggctcgaagaggcgagaaggcaaggccgcgaccgaaagcgtcggcagagggcggccaagagatccgtcgcgccccaggagggggcaggacggtaa

SEQ ID NO: 9286 - DNA, 432 bp, Methylobacterium sp.
atgggaagccggaccggaagccgcgtcaccgagaccccgcccgccccagccgccgaggcgcaggcccatttctcccgccgcctcgcgctggagaccgactgcgacgacgtccacgccgccctcgaagggggcgcgcccgacttcgtcctcctcgacgcgcgcggcccggccgccttcgcgcggggccatgttccgggcgcgctgaacctgccgcaccgggagatcacgcccgagcgcatggcggcctgggcgcccggcacgctgttcgtggtctactgcgccggcccgcactgcaacggagccgacaaggcggccctgcggctcgcccgctgcggacgcccggtgaagctgatgatcggcggcgtcaccggctggctgcacgagggcttcgccctcgccgagggcctcgctctcgcgagcgggctcgcctga

SEQ ID NO: 9287 - DNA, 1131 bp, Methylobacterium sp.
atggatcacacccgtcacatccccgatcccacctccgatcgagaccggcccctcgaccctgcgaccgttgcctcgctcctcgcctgcatgcgcgacggtctcgtgcgtcggcgttttcgcctgcgcctcgtaggagcgcaggctccggaggacgtcagcgagatcacggatcgacgcgatgttgcgatcgccgatgtcggccggccactccaggacgacacggcgccggcacgttccgaggaggcgcgccgctgtgcggcccgggagaacctgaacgcccggatgcgcccgatcctcctcgcgctcgcgcagaatgccgcccttgaccccgctgtctggagggcgcgcatcgacgctccgatgccgctgaccgatcccgagatcgtacgcgctctgtccgaagtgttcgcgtccgacgccttccgcgacgcccgcgcggcctgccgggacctcaccttgctgccgccggagcagcgggccttcgccgaggcgccgttcgatctcggctttcacagaagcccgccggcgaagatcctcgccgattatccgtgctgggacctcccgttctcgcccgcggcccgagccccggagcgctggaccatctcggatgccgccgactggatgcgggaatggccgcccgagtccggcgagttgaagcatccgatcgatgcatgggacgcgtccacggccgacctctggctgcgccgacacaagctcttcgatggtcaggaggcggacaagacggacccgctcgtcgcatttcgtgaagggcggtcgcggaagagcccgctcacggttctggccgggctcgacgacgacgcgctgctcgtcctcaccgacgcggtgttgtgcgagcgcctgcgccgcgaggtgatgtccgggctgatgcaggatcgcgccgacctcatccatgtcgggatggatatggtggcgtgcggctatctgagcctggatgatgtgcgggcggcagtcgctgcgcatgacgaggcgcgggaggagacattccgagatgcctttgccgataacgacgactggatgggcgagtggatcgttgattggagcaggaggctgatcggtctctacgactggccgctgcgctacgagttccgtgccgtgtccaagggtgagtga

SEQ ID NO: 9288 - DNA, 441 bp, Methylobacterium sp.
atgagcgatcaggcctttgcgctcttcgttcttgccctggtgccgctgggctgggccttctacctgctgccggccatcgtggctttcaggcgccagcaccccaaccgctggctgatcttggcggtgaatgtgatgcttggcgctaccggcatcggctgggcggtagcgctggtctgggcctttcaggcagcacaccgcgctggcgagcccggcggctcgcatggcggcgaatcaggcctgaacctcttcgtgaacgacatcaggaccgtgcgggtattgcacgcagctgacacgcccgttgtcgctccagcgtcaggagccacgcttggcacacctgcgcagaggatcgagcgcctcaatcagttacgggcggccgggcatgtgacggaggccgagttcaccacgctcaaggctgcggtgatccaccatccgaacatatga

SEQ ID NO: 9289 - DNA, 1146 bp, Methylobacterium sp.
atggatgtcggattcatctccgaattcaccgagaacgatcgtgtgttccgcttcaccgacggcgagacgctgcgcagtcccatcgcggtcggcgggtccgacccgctccggcagagcttctgccactacgtggcggccggcctgatgcccgggctgctgcacgatgcccgcgaggatccggtcgcccgcggcctgccggccaccgacgcgctcccggtgggggcgcatctgagcgtcccgctccgctacgccgacggcaccgcctacgggaccctgtgctgcttcagcttcacgcccgaccgcacgctcaccgggcgggacctgaacgtgctgcggctctgcgccgacgtcgtctcggccgtgctccagaaggaccgccgcgccagcctcgacctggaggcgcggcgcgcccgcatcgccggcatcctggaggcgcgggccatcgacatcgtctaccagcccgtctaccgcacgagcgacgggcgcctgatgtcgttcgaggcgctgtcgcgcttccgcgcggcgccggagcgcgccccggacgtctggttcgcggaggccgccgaggtcgggctgctggaggaactggagttcctggcggtcggcctggccctgcgggggctggagcggctcgacccgtcgatcaagatcaccctcaacctctcgccgtcgagcgtgctgagcccggccttcgcccgcgccttcgcgggggtgccgctcggccggatcgtggtcgaactgacggagcacgccgaggtgccctgctacgcggccctgcgcgcggccctggcgcccctgcgggccggcggcctccggctcgccatcgacgatgtcggggccggccacgccaccttccggcacgtgctcgacctctcgccggaactgatcaagctcgaccgcagcctcatcgccgggatcgaccgggattccgcccgccgcgcgctcgccgacgctctgacgatctacggccggcgcatcggcgcggaggtggtggccgagggcgtcgagacctgggccgagtacgcggtgctgaaggagatcggcgtcacccgcctgcagggctacctgctgggcaggccccagccgctcgacgcggcccgcaccctgcccctgaccctggcggcgctgggcgaggccggcggctga

SEQ ID NO: 9290 - DNA, 930 bp, Methylobacterium sp.
atgagcgtgtccgtcatcatgtccacgttcaaccgggagcgctacatcgccgccgcggtcgagagcgtcctggagcagtcccatcgcgcgttcgaactgatcgtcgtcgacgacgcctcgacggacggtacgccggacatcctcgcgcgtctcgccgcgcgcgacgatcggctgcgggtcgtgtgcaacgcggccaaccagggcctgccggccggccggaacctgtgcctgtccctggcgcgccacgacctcgtcgcctgcatggacgacgacgatctcatgctgaccgaccggctggcgcggcaggtggccttcctgcgcgaccatcccgaggtcagcgtcgtgaccgccgcagccaggctgatcgacgatgccgacaacgtcatcggcctgagcgtgccggagatcgacatcgcgcgcggccgggcggaggtccggccggccctgttcctgggcctgatccatccggccgtgatgtacaggaagggggatgtcctgcgggtcgggggataccggcaggtggcgctggaggaccgggatctttggggccggatggtcacggccggctacaccgtcgcggcgcagccggacgtcctgctgctgcatcgccggcacgccagcatcatgcagggcgacctcgacgccctgttcgagcagggcgagtacatcgacttcaacgtcgcccgccgcctgcgcggcctggaggacgtcacgctcgcgggctaccggcgcgcggtggcggccgagcccctgctgcagcggatctcacggcgtcgacggatgtcggccggcatcgccttccggaaggcgaccctgttctacagccggcgggagtggcggccgttcctgatgcacatggcggcggcgatgtccctcgaaccgatccaagtctgccagcgcatcgcgaagaaatacagccccgggcgctga

SEQ ID NO: 9291 - DNA, 9240 bp, Methylobacterium sp.
atggccaggcaaacattcgacgactcgatcggtgcttcgggtaacccgctgaccatcggcggctatgtttacgcgctccgcaccaatgcaggcgccaccacgggtacgctgaacgtgcagcgcgaattgctcggcgacgccgtgctcgacctgaacgcgaccagcggctacctgtcgatcgcgcaggcctccggcaccgccttcaatctcaacagtctcgtgatcgaccgggacatctccgttctcggcaacaccttcttcgtcggataccggaacggtctcccggtcatctcgcaggaggtcggaaacctcctcagcatcggtgaccaggcgatctccttcggcacccagtggcagaacctcaccgaggttcggctcttcgcgcgggacgtcctcgacgtgaatgtcggcgtcggcttcgcgatcgacgacgtggtgaccaccgacgtcacggccccgctcgcgccgaccctgagcgcaggcacgaccgccaccgccgacaacacgccgacgctgaccggcaccgccgagatcggcgcaacggtgacgatcttcaacggcaccacggcactcggtaccacgacggcgggcgcgaacggcgcctacagcttcacgccgaccctgccgctcgccgacggcagctacagcctgacggcgcgggcgacggacctcagcggcaatgtcggtctcgcctcggcagcggtcgccctgcggatcgacgcgacggcgccgggcgcgccggtcttcacggccggcggcggcctgaccaacgacaccacgccgaccgtgacgggacgggccgaggccggctccgccgtcacgatctacaacggcaccgtggcgctcggcacgacgaccgcggcggccgacggaacgttcagctccacccccaccgccgcgctcggccagggcagctacggcctgacggcgaccgcccgggacgccctcggcaacgtcagcccggcctcggccgcgctcgccgtgaccatcgacgcggtggcccccggggcgccgaccgccgcggtcccgggcctcacgaacgatgccaccccgatcgtcaccggcaccgccgaggccggcagcaccgtgacgctgttcaacggtaccacggcgctcggcaccgcggtcgcggcggccgatggcacctacagcgtcacgccgagcgcagacctcgccgccggcacctacagcctcagcgtcaccgccaccgacccggcgggcaatgtgagcgcgcgctcggccgccgccacgacggtgatcgacctcacggccccgctcgcgccgacgctgagcgcgggctcggccgccaccgccgacagcacgccgacgctgaccggcacggccgaggccggcgccaccgtgacgatcttcaacggcgccgcggtgctcggcaccgcgacggcgggcgcgaacggcgcctacagcttcacgccgaccctgccgctcgccgacggcagctacagcctgaccgccgtcgcgcgggacgcggccgggaatctcggcacggcctcggcgccggtcgccctcgccatcgacaccgcggcccccgcggtgccgctcttcacggcgggcggcggcttgaccggcgatccgacgccgacactgaccggcaccgcggagcccggcgccaccgtgacgatcctcaacggcacggcggttctcggcaccgctctcgctggcgcggacggcaccttcagcttcacgcccaccgacgcgctgagccagggcagctacacgctcaccgcgatcgcccgcgacgcgctgggcaacgcctccccggcctcggccaacctcgccctgaccgtcgacctcacggcccccggggcccccgtcctcgcgcctctcggagcgaccaacgacccgacgccgaccatcaccggtacggccgaggccggggccaccgtgacgatcctcgacggcaccgcgatcctcggaaccgccgtcgcgggggcgaacggcgccttcagcttcacgcccgacgcggacctgacgcccggcacgctgaacctgaccgcgacggcacgggatccggccggcaacgtctcggtcccctcggccgcgctggcgctgaccctcgacctcaccgccccgggagcgccggtcctcgcgccgctcggaccgacgaacgatccgacgccgaccatctccggcacggccgaggccggggccacggtcacgatcctcaacggcaccgcgatcctcgggaccgccgtcgccggcatggacggcgccttcagcgtcacgcccgacgcggcccttacggccggcacgctgaacctgaccgcgacggcgcgggacccggccggcaacgtctcgctgccctcggccgcgctcgcgttgacgatcgatacgcaagcacccgccgctccggtcctcgcggccctcggcccgaccaacgacctgacgccgaccatcaccggtacggcggagcccggagccacggtcacgatcctgaacggcgcgacggtgctgggcaccgcgatcgcgggcctggacggtgccttcagcttcacggcgccggccctgccggcgggcaccgccaccctcacggcgaccgcgctcgacgcggccggcaacatctcagacccttccaccctcacgttcacgatcgacacgacagcaccggacgtgccggtcatcacgacactgcccggcacggtcgccgacagcacgcccaccatcgccggcacggccgaggccggcgcggtcgtcacgctcctgaacggcacggcggtgctcggctccgcggtcgccgacgcgaacggcgccttcgcgatcacgcccgctgtgccgctaccggacggccccctcgcgctgaccgcgacggcgcgcgacgcagccggcaacctgtcgccggcctcgctcggtctggcgctcaccatcgacacgagcgtgcccggcgcgccggacctcgcctacgattcgccgacgaacgacgcgaggcccgtcatctccggaacggcggaggccggtgccacgatcaccatcgcggccgggggcaccacgttcggcaccggtacggccgacgcgaacggcaccttcagcgtcccgctcgaccggccgctgagcgagggaaacaatgccctcacggtgacggcgacgagccccggcggcatcacctcgccggccgcgccgctcaacgtgctgctcgatacgctggcgccgcccgcgcccgagatcaccggcgtcccgagcctgacgaacgacccggcgccgaccatcttcggcacggccgaggccggcaccacggtgacgatcctcaacggcatcgctgtcctcggcaccgcgacggcggacgcgaacggcgccttcgccttcacgccgacggcgccgctcgcggatggcaccgcgacgctgaccgcacgggcgggcgacgccgccggcaacctctcgccggcctccgaacccgtcagcatcagggtggacacggccgccccgcccacgccggagatcgaccccctccccgtgctcacgaacgacgcgacgccgaccgtcaccgggagggctgaggccggcagcacggtcacgctcctcagcgatggagcgatcgtcggaaccgcggtcgcggacggcggcggcctctacgcgatcacgccgaccatcgcgctcgccgacggcacggccagcctgacggtgagcgcgcgcgacgcggccggcaacgtctccggcagcacggatccggtcaccgtcgtgatcgacacgctcgcgccggccgctccgaccctggccgatctgcccgatgccgtcgcttccgcaacgcccgtcatcgccggcacggccgacccgaacgccgtcgtcacgatcgccaacggcggcacgttgctcggcatgacgacggcgggcgcggacggcaccttcatcttcaccccgacgagccctctgcccgacggcacggcgacgctgaccgccaccgtgcaggacgcggcgggcaacgtctcgccggcttccgacgccgtcacggtggtgatcgacacgaccgcgccggccgcgcccgtcatcacgacgcagcccggcaccacgaccgacaacaccccggtcatcgccggcaccgccgagcccggcaccagcgtcacggtgctggacgatggggccctgctcggcaccgtcacggcggacgggagcggcaactggtcgctgattcccggagcagcccttggggacggcccgaaccttatcaccgccaccgcggcggacacggtcggcaacatcagcccgctggcggccggcatcaccctgacggtcgataccggtgcgcccgcggccccggccttgaccagcgcgggcggcgccctcgccgacaacacgccgctgatcaccggcacggccgagcccggcgcgacggtcgcgatccgcgacggcgacacggtgatcggcacggtcgtggccgatgtcgacggtgccttcgcgttcacgccggacgcgccgctcggcgacggcagctacagcctgaccgccacggcgacggacgcggccggcctcaccagcacgccctcccagccgctcgagctgacgatcgacacggcggcgcccggcatcccgaccgtcacgggcggaggcggcgcaacgcagagcaccacgccggtcatcacgggcacgggcgaggccggcacaacggtgacgctgctcgacgggacgacgcctgtcgggaccgccacggtaggcacggacggcaccttcacggtcagcccggcgaacccgctcgcggagggtgtgtacgacctcgccgtgcaactcaccgacgcggccggcaatgtcggagcgccctcggcgccggtcgccgtcgtggtcgacacgcagatcgacgccccgcccgcgatcgcgttcacggtggcggcgaccgccgacggcacgatcaacgccgccgaggccgtggcgaccgccttcacggtggcggggctcgatgccggtaccgtggcgacggccaccttcagcgacggcagccgcaccgtgacagtcccggtcggcgccgacggcagctacgcggccaacctcaccggcctcaacggcaccgtgacgacgagccttcagctcgcggatgcggccgggaacgcgctgacgctcacggggccggccctcagcctcgacaccctggccccgaccggcacggcggtcgccgacacggcgggcggtccggaggtcgcgagcttcacctatcaggtgagcttccccgagaccgttgccaatgtcggcgccgacgacttcgtgctgaccggcagcggaggagccaccggaaccgtgacgaacgtgagcggctcagggagcagctacacggtcacggtggcggggattaccggcagcggtgccctgacgctggcgctcagcccggattccgacatcgcggatcttgccggcaatctcgccaccctggcaccggcggtccgggacgtgaccggcgtgccgccggtgcagcccgtgatcacgggctacgccgacgataccggcgtaccgagtgacgggatcacggcggatgccacgcccacgctcaccggcatcggcacgccgggcgcgaccgtgacgctcgccgccgcgaccgggaccggaacggtcacggccaccggcacggtctcggcggacgggacctggagcgtggccctgccgacgctcgcggacggcgcctacagcatcaccgcgagcctcgtgggtgccgacggcagcccgatcggcacctcagcgccgctcgccctgacgatcgacgccacggtggacacgggcgccgcggcggcgctcgccatcgacgcgacggccgacggcgtcatcaacggccaggaggcctccgccgtggccttcacggtgacgggcctcgacgcgggcaccagcggcacagtcaccttcgcggacggcgtgcgcaccgcgagcgtcgcggtgggcgccgacggcgcctacagtgtggatctcacgggcttcaacggcagcgtgacatcgacgctcgccctcggcgacgccgccggcaacacggccacggttcagggggacacgctctcccttgtcaccggccagcccggcacccctgtgatcgcgggcttcgccgacgataccggcacgccgggcgatgcgctcaccagcgacgccacgccgacgctctcgggcgcggccgatcccggcacgacgatccgcctcacggtgggtacgccggacgggccggtctcggtcgagacgcaggccggggcggacggcgcgtggtcggcgaccctgccggcgctgtccgacggcgcctacgcggcgaccgcggtggcgctcgacgccgccggcaatgccagcaccgtgagcctccccttcccgatcagcatcgacgcgaccgcgcccgctggcacggccgccgccgacctctcgggcggcattgccgctcagagcttcaccgtggcgctcgacttccccgaggcggtcgtcaacgtgagtccggaggacttcgtgctctccggcacgaacggcgcgagcggcaccgtcacggaggtcgtcggaaccggcggcagctacacggtgacggtggcgaacgtcaccggcaccggcactctgacgctgggcctcgcggcggacgccgacatcacggatgcggccggcaacctcgcgaacctcgctgcggcctctcggccggtcgcggtcagtccctccgccgcgccgccgacgatcacgggcttcagcgacgattcgggcacggtcggcgacggcatcaccaacgacgccgccccgacgctcaccggcaccggcatcccgggcggcaccgtcacggtccgctacgacggggcgccgggatcggcgccgctcaccggcgacgtcgatgcgcagggcaactggacgctctccgtgccgacgctcgccgacggtacctacgtcttctccgtcacgacgacgagcgcggacggtacgatcgccagcgccacggccgatgccctgaggctgacgatcgacaccgtggcggatgccctgccggcggtggcgctcacggtggacgggacggccgacggcgtgctcacgccgagcgaggccgcggccgcgcagttcaccctctccggcctcgatgccgggtcggcggccgtcgtcaacttcacggacggcacccgcaccgtcacggcgcaggccgcggcggacggggcctacacggccgacctctcgggcctgagcggcagcgtgacctccacggtcgccgtgacggacgcggccggcaacaccgcctcggccgccggcaacgctgtgctcgttggcaccggcacacccggcggcgggaccggcggtgacggcggaggaaacggcggcggcgtcacaccgcccggcggcggcgtcggtgagggcagcacgcccccggcgatcccggtgatcggtggaatccaggacgataccggcacgcccggcgacggaatcaccggcgacagcacgccgacggtggtcggtacgggaacgccgggctccaccgtgacggtctcctacaccgacgcctcgggcccgcagaccgccaccggcaccgtgggtcaggacggcacctggcaggtcgggctcccggcgctcgccgacggcagctacagcctcgtggcgaccgccggcaccgtcgccggcaccggctcggcgccctcgcagcccctgcagatcaccatcgacacctcggcgcccgccgccccggttctcgacggggtgtcagggaccgacgggagcggcccgatcggcgacgcgagcccgaccctcaccggcacggccgaggccggcagcacggtcgaggtccgcttcgacacgccggccgggccggccttcgtcaacggcgtcaccggaccggacggccgctggacggtcgatctcccgacgctcgccgacgggacctacaccgtcaccctcgacgcggtcgacgctgccgggaaccgtggcaccgcctccgccccggtcgcgatcgtggtcgacacgacgcccggtggcggaaccggtggcgatccgggcgacgggacgggcggcggcgtcgtgacgccgcccgtcggcgggatcggcgagggtgacggcaccccgccaggctcggcgcctgccctgacggcggatgcggaccgcacgctcacgcacgcgcccgccatttccggcaatctcttgcttaacgacacgggcagcggcctccatgtcacggccgtccggttcgccgacggcctgacggtgcaggtgccggacgagggcactgcccgggtgatcggagattacgggacgctgacggtcgccgccgacggcagctacagctatcaggcgatcggcgcgaacaacctgccgatcggcttcggttcgcgcgagcactttacctacacggcgaccgacgcggccggccggaccggcgagacgtccctcgacatccaactcgaggggcaggccccgcaggccagtgcgtccttcgatttcgccttcacgcaggcgaaggtcggtctcgcgggcgaggcactggtgctgctcggtcccgacgggatcgtgcgcgacatcagcgggatcgacacgctgcacttcacggacggcgagatccagaacaacgacggcaaccgcgtcgtcgacgacgtctactactatgcccggaacctagatgtctggcaggcccacgtcgacgccgacctgcactacgcagtcttcggctggcacgagggccgcgacccgaacgcctacttccagacgagccgctacctcgcggagaaccccgacgtcgcggcggcgggcgtcaacccgctggagcattacctgacctccggcgagcacgaaggccgcagcccgagcccggacttctcggcggaggcctatctccggagcaacccggacgtggcggagcagggtgccagcgcgctggcgcactacttcgagttcggtcgggcagagggccgctccgtcctcgcgggcgagagcgacggtccgaaccgggccatcggcagcttcgacgccggcttctacctcgcgcagaacccggacgtggcggcgaccgtgccggcaggcgtgacgccggagagctacgcgctgcagcactacctgaactacggtgcggcggagctgcgcgatccgaacgcgctgttcgacacggcctactaccttgcccagaacccggatgtggccgcggcgggcgccaacccgctcctccactatcaggagaccggctggcacgagggccgcaacccgagcgccgcgttcgacaccgacgcctatctggcgcgctaccccgacgtggcgcaggccagcatcgatccgctggcccactacatccagtacggcctgcacgagggccgtctggcgaccgcctga

SEQ ID NO: 9292 - DNA, 918 bp, Methylobacterium sp.
gtgcgcaaaatcatgcccttgaattgggaccacctgcaggtcttcctcgccgtcgcccgcaacggccagatgctcgaggccagccgccgactgggcctcaaccacgccaccgtggcgcgccgcatcgaggcgctggaggctgcgcttcgcacaaccttgtttcaccgcagaccgactggctcggcgctcacggatgccggagagcagttggtcccaaccgccgagcggatcgaggccgagatcctgacggccaccgcccgtatgcgggcgacagaggcggagccgagcgggaccgttcgcatcggggtgccggatgggctcggtaacctgttcctggcgcgcgagctcggccagttcgcgacgcggtacgccaatctcatgatcgaactcgttcctctaccccgctcgttctcgctctcgcgacgggaggccgacctcgcgatcgctctggatcaaccgacacacgggcgtctgatgctctccaagctcacggattacagcctcgggctctacgcggagcgcgcctatctcgatcgcgccggcccgctggttggcgagcacgacctagtgcatcacaccgccgtcatgggcgtggacgactacgcctacgcgtcggcgctcgactacacagcctttctgcagggccggacgcgcggcgtctttcgctgcgccgggacggtaggccaactcgaggccgtgcgggcgggcgcaggtgtcggtattctgcacgacttcgccgcgtccggctgcccagaactcgtccgggtgctcccagccatcgtgtttcggaggacctattggctactctcccaccccgacagccatgaggtccgccggattgccgcctgccgcgactttatcgtgcaacgggtccgcgaggagcgaaaacggtttcttcccagggatgatgaatcctga

SEQ ID NO: 9293 - DNA, 114 bp, Methylobacterium sp.
ttggccccgccctccggcaacccgatcctcagccccgagcggcgcctggacgaccaggaccagagcatccgcccgctgtcgctctccgagttcgtcgggcagagggcggcgcgc

SEQ ID NO: 9294 - DNA, 213 bp, Methylobacterium sp.
atgcgcgccgagacagccgccggctactgcgatgagccgagcgttgaggcgttcctggcgaaggtcgagcgcggcatctactcgcggccgcggcggcagcagggctgcatgccgaagtggcaccgggcaaagctggaccaggacattgcccggcggcacggcctcgcgatcgagggcatgctggtggcggaagacgtgtcggagctgatctga

SEQ ID NO: 9295 - DNA, 1239 bp, Methylobacterium sp.
atgagcattccctcggccaagggcggcaccgacacgtccgcagaccggctcccgttgccgcccgcgcgaccgcacctgatccgcgacgatgccgaggcgctcgcggtcgcccatgacgtcgccgcggtgttcgcggccggcgccggagagcgcgaccgcgagcgccgcctgccctgggacgagatcgaggcgttcacggcaagcggcctcggcggcatcaccgtaccgcgatcgcatggcggggcggacgtgtcccatgccacgcttgccgaaatcttcgcgatcctctccgccgccgacgcttcggcggggcagatcccgcagaaccagttcggcgtgctcgcgctcgtgcgcgcggccgctcgaccggaccagcaggcgcggatctacgccgacgtgctcgccggccaccggatcggcaatgcaggtccggcccgcaacggacgcgccatcacccaggtggagacgcgtctggcgccgggaccggagggcctgcgcctcagcggctcccgcttctactccaccggcgccctcttcgctcattggatcccgacccgggcggtcgatcccgcgggccgccccgtcctggtctgggtgcgccgggacgcgcccggcctgcgggtggtggacgaccggcagggcttcggccagcgcaccaccgcgagcggaacggtcgtcttcgaggatgcgccgatcgaggagaggctgaccctcgatctcgcgccgctcgccgagcgcccaggcctatccgggcccgtgtcccagctggtccaggcggccatcgatgccggcatcgcccgcagcgctgtcgccgccgccctggacgtcctgcgcacccgggcacggccctatccgtacacggccgagagcgtcgccgaggatccccatatcctcggcgaggtcgggcggctcgcggtcgacctgcacgctgccgaggaggtgctggcccgcgccggccgcgcgctcgaccgcatcgccgctgcgccggtgaccgccgagagctcggccgaggcctccgtcgccgtggccaagatcctcaccaccgagatcgccctggaggcctccgagcggatgctggaactcgcgggctcctcggcgacgcgcgaagggtacaatctcggccggttctggcgcgacgcgcgcgtccataccctgcacgatcccgtgcgctggaagtaccacctcgtcggcaactacgccctgaacggtgcgctgccggcccggcaccagtggaactga

SEQ ID NO: 9296 - DNA, 924 bp, Methylobacterium sp.
atgccctcggaggctgagctgacggatctcgtgctgggcgcccacggcttcctcgggcgccgcctcgtgcgacgtctcgaggccgacgggcgccgggtgatcgcaatcgggcgggacgccggcgatctcacggtgccggaggtcgcgcgggccgccctcggccgggcaccggtcgcgcggatcttccacttcgcgacgcgccagcgcaccggccccagccagtacgacatccaggcggagctgctcgcggtcaacgcgcggatgcacctgaacgtcttggaggcctggcgccagctgcagccgcaggcgaagctgatcacgccgggcagctcctgcatctaccccgaatcgcgcgcgccgctgacggaggcgagcttcggcctcgggccgctccatccctccgtcgcgggctacgcgctcgccaagcaggtcctggccacgggctgcgcggcctacgcgcgtcagtacgggctgcgctacctccactgcgtgctggcgaccacctacggtccgggcgatcacacggaggcggaccgcagccacttcgtgggcgcgctcctgcaccgggccgccggggagaagcggcggggcgcgacccgcttcacggtctggggcgatcccgccacggtgcgcgaggtgctccacgccgacgaccagatcgacgcgatcctccgcgcggacgcccagttcacggacacgatcctcaactgcgccgccgacacgcccgtgacggtcggcgcggtcgccgaggccgtgctccgggcgctcgactggcaggtcccgatcgagcgccccgccgaatccttccagggcacgccctacaagatgctcgattccggtcgcttcctggcggcgaccggctggcggcctcggatctccctcgatgacggactgcggcagctcgtccgggaggcgtacgcgtag

SEQ ID NO: 9297 - DNA, 963 bp, Methylobacterium sp.
atgacgggcctccctgacgcgcgggcgcttcccgaggcggtggtgctgttcggagcctcgggcttcgtcgggcgcaacctcgcggcgcggctcgccgggcgcgtgggccggctcgtcgccgtcaacgcgagcgggacgccggtccccggcgccgacacgacgctgccgatcgccgcgctcggcgccgtgcccgcgctgccgcgcgatacggtggcgatccacgtcgcggccccgcgctacgacgccgcccgcttcgccacggcgcaggcggacctgctcgcgggcaatgtcgacctcgccaaccggatctacggcttctgcgccgagcgcgggatcgccgaggtgcggatggcatcgagcgtcgcggtctacccggccgggcgcgacctcctcgacgacgcggtgccggtggatctgcacgcgccgccccacccgggcgaggccttctacgcgtggtcgaagcgctgggccgagatcgcggcgggcctgttccgcgagcgctacgggatcaacaccatcgcgttccggctgagcaacccctacggcccgcacgatgcgctggaggaggccgtggcacacgtgctgcccgccttcgtgatccgggcccttcggccgggcgaggtcttcaccatccggggcgacccgcgggtcgagcgcgacttcatccacgtggacgacgtggtgacggtgttcgagcgctcgctgcaccggcgcggcgagagcctgacggtgaacctctgcagcggcacgacgacctccctgcagacgctcgccgagacggtcctgcgtcttgccggcgtcgcgcgcccgatcgcggcagccgggcagaccggctcggcggtgctggcgcgccgctcgaccaacgcgctggtccggcaggccttcggcgacctgcgcttcacgagcctggaggacgggctgtccccgaccatcgactggtaccgccatgccctcggaggctga

SEQ ID NO: 9298 - DNA, 933 bp, Methylobacterium sp.
atgcgcattctggtgacgggcggggccggctatatcggctcgatcctcgtgccgatcctgctggcgcgcggcgattcggtgacggtgctcgacaccttccgggccggcggcacggagctcgccgcggcctgcgcctacgagggcttccgcccggtgcggggcgatgcgcgcgaccaccgcctgctcgacgagctggtgccccagcacgacgtgctgatcccgctcgccgccctcgtcggcgcgccgctctgccgggaggacgcggtcggcgccaccaccctcaaccgcgacgccgtgcgcgacctcgtcgcccgggccggcggcgaccagatcatcgtctaccccaccacgaattccggctacggcatcggcgagagcggcaagttctgcaccgaggagacgcccctgcggccgatctcgctctacggcgtcacgaagtgcgaggccgaggacgcggtgctcgccagcggccgcggcgtcaccctgcggctcgccacggtcttcggcatggccccgcgcatgcgcctcgacctcctcgtcaacgacttcacccaccgggcggtcaacgacggcgccctcgtggtcttcgaggggcatttcaagcgcaactacatccacatccgcgacgtcgcgaagggatttttgcacgcgatcgaccaattcgccgcgatgcggggccaggcctacaatctcggcctgtcgtcggcgaacctctcgaagctcgaactctgccagcggatcaaggcccacgtgccgcgcttcgtctacatcgaggcgccgatcggcgaggatccggacaagcgcgactacatcgtctcgaacgccaagctcgaggcgaccggctgggcgccggacatcgatctcgacagcggcatccgcgagctggtccgcggctacacgatgctgcgcaacgcccgcttcgccaacgtctga

SEQ ID NO: 9299 - DNA, 135 bp, Methylobacterium sp.
atggcaggtacgacgatgcctttcgtcgaaggcgctgcggcattggtcttaggcacgggcttcttcggcttcttcgtctcgcgattgccgcgcttcttttctgtcgccatggtctcgctcctgggaatgtcgtga

SEQ ID NO: 9300 - DNA, 198 bp, Methylobacterium sp.
atgtgcccggtgatgcagaaaatgatcacactgattgttcatatgtcgcagtttcctggccttctggagcggggacaactcatcgatcaacttacggatcttgaggctgagggcatcgcccaggatgcgccgtggcggacagttgaggcgatccgggcagcccggttgaagctacgcgtcgaaggcctgatggcctga

SEQ ID NO: 9301 - DNA, 363 bp, Methylobacterium sp.
atgcacgacaacgggatgtccgggacgatgcggggatggttcgcggctctggtacttctcgggtgcggggctctcccggcatcggccgcggagccgacggtccggatcgtcgggacggagctgcgcgcgcctccggactcccacgagccgcagagagccctggtctcgctgcacaatgccggcgtacctgcggccgggctcaccctggcctgcacattccaggacgagggcggccggccgctggacacggtggaagcgcctgtccgagacatggccgaaggcgcgagcgccgtcacggaggtgatctactacggctggccccgcgccagccgtgccgcctgccgcctcaccgggcgccggtga

SEQ ID NO: 9302 - DNA, 240 bp, Methylobacterium sp.
atgacggttcagcccacggacacgcttccggccctgcaggcatccctggacggcctcgggaccgggcaggccctgcgcctgacgaacgcggattgcgaccgcctgttcggcgtcgacgacgcgctcctcggccgggtacggaacgtcgcgctgggccacggctgcatcgtggtctgggacgacgaaggtctgtccttctgccggcagcctcatgccaccggctgcaagcccctcggctag

SEQ ID NO: 9303 - DNA, 684 bp, Methylobacterium sp.
atgatcgtccatgtccgcaacgtgctcacccccgaggaggtcgcgctctgccgcgcccgcctggaggcgggcgcctgggtcgacgggcgcgtcaccgccggggcccaggcggcgcgcgccaagaacaacctgcagatcccggaggacgcccccgtcgcgcgcgagctcggcgacctgatcctgcgggccctcgggcgcagcccccagttcaacgcggccgccctgccactgcgggtgctgccgcccctgttcaaccgctacgacgtcggcatgggcttcggcgcccatgtcgacggggcgatccggatggtgccgggcgccggcatccgcatgcgggccgacgtctcgaccacgctcttcctcaccgatcccgccgattacgacggcggcgagctggtgatcgaggacacctacggcgcgcacgcggtgaagctgccggcgggcgacatgatcgtctacccggcgacctcgctgcaccgggtcgagccgatcacccggggttcgcgctggtcggcgttcttctggtcgcagtcgatggtgaagaacgacggcgaccgggcgctgctctacgacctcgaccgcggcatcacgggcgtgcgcgccggcctttcggacgacgacccggcggtgatcgcgctgaccgccagctaccacaacctgctgcggcgctgggcggagctgtga

SEQ ID NO: 9304 - DNA, 2268 bp, Methylobacterium sp.
ttgctgcgcgatgcgggcggcgcgggggcgctcggcctgagcctcgtgacggggctcggcagcttcctgccgatgggagcggtggcgcaggatctcggcgcggatgcggggccgggcatggccgtcaccctgggcgagctcagcgtggctggctggggcggctaccagcccaacacactgaacgccgatacgggcctgtcacggctgccgggccgggtgcaggacaccccccaggcgatcaccgtggtgccgggcgaggtcatccgccagcagcaggccacgacgctggagcaggccctgcgcaacgtgccgggcatcaccgtctcggcgggcgagggcaacggcggcctcaacggcgaccagttccgcatccgcggcttccaggccaagaacgacgtctatctcgacgggctgcgcgatttcggcgtctacgcccgcgacgccttcaacatcggggacgtcgtcgtcatcaaggggccctcgtccgagacgctcggcctcggcacggtggggggcgccgtcaacatcgtctcgaagaaggccctgctcaccgacttcacggcggtcgacgggctcggcggcagcggcccgaccgcccgcggctcgttcgacgtgaaccggcgcatcgacgacaccacggcgatccgcatcacgggcgtcgtccaccagcaggacatccaggaccgccgcggcgtgaagtcggaccgggcgggcgtggccgtctcgctcggcttcgggctgggcaccgacaccacctggcacctgaactacctctaccagcacagcgagcgcacgcccgattacggcgtgccgaccgccctgcgacccggcgaccgctacgcccggccgctcaccgagtacggcctcgaccgcgcgacgacctacgcgcgggccaccgaccgcgacatcgccgacgtgcatctggccacctcgctgatgaagtggacggtgacgccctggctgacggtgaccaacgacacccggctctcgttctacgaccgcagcttctcgaccactgcggcgacctgcacgaacgccgcgggcccgccggtcgccacctgcgcgcgggacttcttcgcgggcggcaacccgttcgtgacctacagcgcgggcggcggccagaccttcgatcaggacgcctggggggcgcagaacgtcaccacggcgctcgccaagttccacaccggcttcctgcgccacgaggtcgtgacgggcttcgacctgttctaccagaacgacgaccgcctgaactacgcggtgatcgggacccgcgccaaccagcgggtgcgcaaccccgaccagtccgccgccggctacgccctggtcaagaacccgctcaaccgccgcgtcggcgacggggccaatctcggctatttcttcagcgaccgggtctggctcaccgagcagttctcgctgctcggcggcgtgcgcgtcgaccgcttcgtgagcacctactcggccaccaacaccgcgaacggcctgttcagcccgaccgtcacggcggcctcgaccggtgtcagcccgaaggcctcggcgatctggcagccgacgccggagcagacctactacgtcacctacgcgcggggcttctcgccccagggccagtacgtggtgaactcgaccggcatcgagatcccgaacgccgctgcgctgaagccggaggagagcgacctctacgagatcggcggcaagatcggcttcctcgacggccgcctcggcgtcgccgctgccctgttccgggtcgacaagagcaacagcttcgacgtcgatccggtcacgggcggcctgatcctgggcgccctcgatgccggcgagaagcggcgcgtcgagggtttcgagatcaccgccaccgggcagatcacggagaactggagcctgctcgccggctacacccatctcgacggcacggtgcgctccggcgcgaatcgtggccgcgccgcgccctacgtgccggagaacgccttcacgctctggaccacctacgatctgagcccggtgatgcgcccgctctggggcctgcccggccggatcacggtcggcggcggggttaccctcgacgacggctacttcccggcgagcgacaacatcacccgcatccccggcaccttctcgctcgatgcgctggtctcgtacgagaccgacacctaccggctcgccgtcaacgcctacaacctgacggacgagctgaactacagcgccgccttctcgacccgcgccgtgccgacctccggccgcaccgtgctggtcagcgccggcctgcgcttctga

SEQ ID NO: 9305 - DNA, 777 bp, Methylobacterium sp.
atgcgggagcaggagaccggccccacgatgagcgcccccttcaaggaccatttctcgtccgccgcccccggctacgccgcccaccgcccgacctacccggcggcgctcgccgaggcgctggctgaactggcgccggggcgcgggctcgctctcgattgcggctgcggcaacgggcagctcgcccggctgctggccgcgcccttcgcgcgggtcgtcgcgacggacgcgagcgcggcgcagatcgccgaggcctcgccgcatccgaggatcgacttccgggtcgcgcccgccgaggcgagcgggctgccggcggcgagcgtggacctgatcacggcggcccaggccgcgcactggttcgacctggcgctcttctacgccgaggcccggcgcatcgcccggccgggcgcggtgctggcgctgatctcgtacggcgtgctccacctcgatggcgaggcggaggcggtgctgcggcatttctacacgcaggtggtcggcccccactggccgcccgagcgcgcccatgtggaggccggctaccgcaccctgccgttccccttcgcggagctgcgcgcgccggatctcgccatcgaggtcgactggagcctcgacgatctcgtcggctacgcgggcacgtggtcggcgctgcgcggggcggaggccgcgctcggcacgagcccgctgccggacttcgcgcgcgacctcgccgccgtctggggaccgccggagacgcgccgtcgcgtgcgctggcccctggccttccgcctcgcgcgtctctga

SEQ ID NO: 9306 - DNA, 84 bp, Methylobacterium sp.
atgagcaagttcttcgaggaagaggttctgtcggttcaccactggaccgacacgctgttctcgttccgcacgacgcgcgatccg

SEQ ID NO: 9307 - DNA, 522 bp, Methylobacterium sp.
gtgagcgcccatctcgcagaggccgtgaacgcctgcgcctatgcccacgcggacggccccttgatctacctcaggaggcgtctggcgaaggcgctcaaggccgcgttcggccagccgatccgccttttggcgtccatcgaggaggacggcgagggaggatacgtccccggcaagtctcgggtcgcgcatctgcacatgaaacctggtctcgatcccgccgaaaagagtactctcgccaaggcgcgcgccgcgatccgtgcggcgtgcggtgagtggacggggccccggcgccggcgccagatcgtgatgaagccgactcgggatgctggttgggcaggctacttcacgaagtactgccgccttgccgcgccgcggatggtcgctttcctcaagatccacggcgctggcccgcgctggctgcctagccacgccgggccggtcctcacgatggaccgcgagaccaaccgcgcggccaaggttctgcacgagaaagcccgccagatcgtttgggaggccccctag

SEQ ID NO: 9308 - DNA, 3411 bp, Methylobacterium sp.
atgaccgcgctgttcgacccgcgcccgctcgtcttgggcacgctgcagaacctctccctggttctggagcgctcgaccgtgctgtcgggtcgtccgggcgtctcggggctcaccgtcggcggcagcgaggccagagccttcggcggcctcgagatgccgatcacccgcaccggcagatcggtgcccgcgaagcttcgctacggggcgatcaccgtcacgccgcgaccgcagggctcggccttcagcggcagcccgggggttcatcctgcgatcgagcgggcctacgacaacccgggcgtgcgcttcggcgatcgggtgcgcggcagcgagcgcccgacttcgtcggccggcgaaacgagttgccacttctcgcagacatcggtgtcgaagacctcgccgatccgcgagatgatcaaggcggcgcgcggcgggcgccgtctcaccggctcgcgcgccgccgcccacgtgctctacgtcgagcgcgtgggcgcgcccgagcagatccagcgcaagggcgagccgcgtctgtccggcgaagccttcggcgccgagatcgagcgccgtggcctcgcccgctccgccgccgcgcagcaggcctacatcgaacgcgccggtgctgctgaaggcatggagcgcaagcccggacggcggatcaccgacgaggcgctcgatgcgctcgacgaggcatcgttcggcacgatcggcgatacgctcgaggagcgcacgcgcttctggctcgccgtcgaggaggccgaggcgacaccgaagggcgaccgcgtcacgatcaagccggccgagaactcgacatggtgggccagggtcgccgagaatctcgatcaggccccacctgccgcgcagaagccgatccgcgacgccctcgcccgcgccgatggcgagcccttcgacgtcaagctgaccacggacaaggccttcgccttgcaccagtgggcggtcgctctcgactccgaggcacctatcgagatctcgcccgggcgcggagggcgtacgcagacgcgcgtgatcgcggaactgccgcacgagatcgatggccgcgagcggctccagatcgtgcgcgacttcacacagaagctcgccgaaaaaggcttcccatactgggccgtgatccacgcgccggacgccaacaacgacgcccggaacttccacgtgcacatcgcttactacgatcgacctgccgcgaagatgcagaaaccgggtggcacgggcgaggtctgggacttcgagatccaggatcatgtgatctacaagagcaagaccgggggagccaagcgtcacctgacgcggccctaccagcagaaccgcgatcgcacgacgcatgaccgggcgtggatcctggaattgcgcaagcactgggagacggtgtcgaaccgcgtcctcgatgaggccgggttctcgaagcgctacaacctcggcagctacgagcgcatgggcatcgacctcaagccgctcaagcacatcaacgcgcgcactttcaacaaggagcgcaagggcgccctgaccgaggaaggtccggtgctcgctcggcggcagtgggacaccgtccacgaccgcctggtcaaggagcacgaggagcgcgcccgcaagcggcaagtgtcgatcacgaacatgtccgaccacgcggcccgcatggttgcgccatttccctacggcgcgcaccgtgtcgccgaagtgaggcgactgaaggatatggggatcaaggcgagcttccagctggccttgctggagctgcatcaggatctgacacggctcgtggcggaccggatcgtctcgcgcccgaagctcatgatgcaagccgccgacgaggaggaccgcaaggccctcaggcagggcgcgtcgccagacgccgccccgcaggaccgcgcggttaccggtgccgagctcttcgggctgaaacgccgcagcgagatcgcgaccttcctgaccacgatctacgacggcgctctccactttgaccgggacaacgagcggcgctctcaggccgcccgcaacaacgtacggttgatcgtggcggagttgaaggcctggatggccgagcccggccgttcgctccatgccgcgcgccgctacgctcccgaggccgtgcagagcctcgacgacccggcacgcacggagcggcgcgagacctccagacgtgcgctgcaggagggcttccgcaaggcggtcgagggtcgaagcgcggagattctgcgggccctgaaagccgaggtctcggaccgttccgcgcctcgggctgcagagacagcgcttgctgccgcgccagcttcttccgcttcccagggacggaagcctgccgcgacagcgtcgccgacaggctcgaaccacgccacggggccctcggatgggcgccccaagccgcgctacacgcccggacggccggacagcccggctcccaagattggccagaccggcttccggccgcgaccggaacacgccgatctgagccgcttcctgcgtcggccgactgtcggcacgggtgcaccgtgtccgccggagccggtgcgagagaccccgcgaatgcgtcaggcttccgcgctgcctcaagccgaaccggcgttcctgcaagcgggggagcgctccagacatgggagctcgacgaccacgctgccgacgaatcaggagacgcttgggcgatcagggcagccgagctccggagtgccgcgaccctcccacgcttcgatcgccgcgcacgaagacggtggtgggccgcccggcctgcttggtgcagatccgggcactcggctcggcactccaggcccgatacacgtcggagccccagtgacggtcggggagcacatcgcaacatcgcccggcgcagcgcacgctgcgaatgagcgcggcgaacaggcggttgaatcgtgcgtcttgaagcccgctaatgtcagacgcgatggtcatcggacttcgccagaggagttggaatcctcacaacgccgagattcgcatccagctcgcggcgagggtccgctcgcaactggccggggtcagcgacgggctgattcggcgatcgcccgcacagatggagcaggcgccagctctgtaccggccagcgtcgccatcggcactgtagccagatcggaagaggagcgccgacagcttggaccggccgccgaaggcccgtcggtctcggcatcgtcggggagcgcagggcctcccgtcggccgccgccgcgggccagtgaacaaagaaggccgccttgaactggtggctccgaacctcgcggtgtcggtggacggtgacgaggcagccgatcgcgtcccgtctgcagagccagacgccgcggcgcacaaatctgacctcacggtagcgtcttctgctgcggataccctgcgaatcgtcggcgcacaacgtccacgcaagaaaatccgcacgcgggacaggggctgggagagatga

SEQ ID NO: 9309 - DNA, 450 bp, Methylobacterium sp.
atgttcttcctgaaggaattgcctacgcagaagatgcttcaaacgtatcaagatcgctttcccgacactgatatccggaacatcgaggatgcactccggctgcttcgacgtggaagtctccttatgcgcgagctcgaagcatattttgcagcgcacgccctgtcgcaaacgcgcttcttggtcatgatggtgatcgatcgcgagccggaacgagagagccttttcccaagcgagattgccgaccggctggatgtctcccggcctgtggtgacggacacgatcagaacgctggaaaaggcgggcctgctgagcatcaagagcgcccaggatggacgaacgaagcaggttctcctcacgccccacggccggaccgtcctcgccaacctccttccgggctacttcgcactgatcaccgagttcatgacgcggggctcgcggcctgtcccgtaa

SEQ ID NO: 9310 - DNA, 1446 bp, Methylobacterium sp.
atggcccagccgcatgccccgggcggcacgctggtgccccggccgcatcaggcggaggccgcccgcgccatcctggcggcgcgcgcggccggccgtcccggcttcctgctcggcgacatgaccgggctcggcaagacgctctcggtctggagcgcgctcgccgcgatgccggaggccgccgtgctcgtcgtctgtcccaagggggcgatgccgcaatggcgccgcacgatccgcgatgcggggctggcaccgaaggacgtgacgctcgtgaactacgagcgcaccaagtcgctgatggcgcccccggaggcgatccgccgccgctcgacccgggcgaggaacaacgcgctcgccaagcacggcagcctcaagcgcgcgtggccgctcgtggtgttcgacgagagccaccggctgcgcaacccctacgcccagcagacgatggtctgccgccagctcgccgacgccgcggccttcacggtctacatgagcgcaaccgcggggcaggccccgcacgagctcggctatctcgggcggctgctcggccacgcggtgggcagcccgaccgagacgctcgccgacttccgcgccctgatgcagcggctgggcatcgggcgcgccaaggggcgctgggtgaactggtcgtggagcgccaacgcccgcgactgcgcggtgatggccgacctgctctacacgggcgcgaacgcgatcggcctgcgccgccgcccggccgacatcgcgggctggccggaggtgcagcgcgacctcgcgccgaccgcgctcaagccggacgagcggcgcctctacgacgcgacctggcgggagttccgccgggaattcggcctggccggcggcagcacccggcggcccgccggctgggccgcggatctgcgcttccgccagaaggcgagcctgctgcgggtcgccggcaccgccgatttcgccgagatcctgctggaggccggcgagcaggtggcgctctcggtggccttcctggagacgggcgcggccctggccgagaccctgcgcggccgcggctggcgggtcgacgcgatcgacggcacgcgcacgggcgaggcgaacgaggcggcccggctcgccttccagacgggcgacctcgacgcgatcgtgttcacggtcaccgagtcgatctcgctgcaccggaacgagctgcccggcggcgaacggacccgggcgctcgtcgtccacgacatgcgccacagcgcgatccagctcgcgcagatcgagggccgctgccaccgcgacggcgaggccgcggtgatccactacgcctacgcggaggatacggtcgaggaagcgatcgccgcgaccgtgctgcgccgcatggcggcgatggacgcgatggcgggcgaggataccggcctgctcgacgcgatcgcggactgcatcgcgcgcccggaccggacgcctgataccgtttccggttga

SEQ ID NO: 9311 - DNA, 1164 bp, Methylobacterium sp.
atgctacgcagagtcgccacggccgcgtcgatcgcgctcgccgccttgtgcgggggtcaggcccgcgccgacgagatcctggtcggcgcccacatgccgctgaccggctcgctcgctcgctcgggtcaggcctacgatgagggcatgcgggtggcgacccagatgttcaacgccagcggcgggaagcacacgatccgcctccaggtgatcgacgacgagagcacgcccgccaaggccgtctcggcggtggagaagctcgtctcggacggcgcggtggcggtgatcggcggctacggctcgaacatcgtcggaccggcttcggacgcggcggagaagctgaagaccacctacatcacggccggcgctgcgagcgacgagctgaatacgcgcgggctgaagaccttcttccgcatcaacaacaacgccggctaccagaacggtatggtcggactggtcacggggctgaagccggcctcgatctcgatcctcgcctcgaccaaggagtcgacggcgctgctggccaagggcctgcagaaggatctcacggccgccggcatcaaggtaacgctgcacgagttcgatccggcgatcaccgacttcaagccgctcatcaacaaggtgaagctgcaggacaaatccgagatcctgatgatgtcggcctacgagaacgactacgtcggcatcatccgcgccgccaaggttctgaagccgccggtcaagctcatcgtcggggcctgggccctcgcggtgccgaagctgtaccaggaattccccgacctgatgaacaacgtcgtcggaacttccttcctgcccttcccggtcgagatcaaggacgaggagggcaagcgcttcgccgaggcctaccggaaagcctacggcaaggacgtcgactatcacgccaccctgagcttcgtggagaccacgatccttgccgaggcgatcgccaaggcggccgaggccggcacgctgaaatccggcggcctaccggagatcgtgcgtgccaccgatcgcgagacggtgctcggccgcgtgcaattcgatggcaccggctacaatccgcgcttcgccgtgtcgatgggccagcaccaggccggcaagatcgtgctggtctccccggccgccacggcgaccggtcagatcgtcttccccggtcttccctggtga

SEQ ID NO: 9312 - DNA, 1164 bp, Methylobacterium sp.
atgcttcgcagagccgtcgcggccgcgtcgatcgccctcgccgccttgtccggtgggcaggcccgcgccgacgagatcctggtgggcgcccacatgccgctcaccggctcgctcgcgcgctcgggccaagccttcgacgagggaatgcgggtggcgatccagatgttcaacgcccgctccgagaagcacaagatccgcctgcaggtgatcgacgacgagagcacgcccgccaaggccgtctcggcggtggagaagctcgtctcggaccgcgcggtggcggtgatcggcggctacggctcgaacatcatcggcccggcctcggacgcgtcggacaagctgaagaccacctacatcacggccggcgcggtgagcgacgagctgacggcgcggggcctgaagaccttcttccgcatcaacaacaatgccggctaccagcgcggcatgggcaccctgctggagagcctgaagccggcctccgtctcgatcctggcctcgaccaaggaggcgccggcgctgctggccaagggcctgcagaaggacctcgccgccaagggcgtgaaggtcacggtgcacgagttcgacccggcgatcaccgacttcaagccgatcatcaacaaggtgaagttgcaggacaaatccgacatcctggtgatgtcggcctacgagaacgactacgtgggcatcatccgggccgccaaggtgctcaagccgccggtcaagctcatcgtcggcgcgtggtcgctcgccaccccgaagatgtacagcgaattccccgacctgatgaacaacgtcgtcgggacctccttcctgcccttcccggtcgagatgaaggacgaggagggcaagcgcttcgcggaagcctacaagaagacctacaacaaggaggtcgagtacctctcgaccttgagcttcgtcgagaccacgatcctggccgaggcgatcgcgcgggcggccgatgccggcacgctcaagaccggcggcctgccggacgccatgcgccagacgcagcgcgagaccctgctgggccccgtccaattcgacgccaccggcgacaacccgcgcttctccgtcgcgatgggccagcaccgcgcgggcaggatcgtgctggtctcgccgcccgcctccgcgaccggcgagatcgtcttccccggcctaccctggtga

SEQ ID NO: 9313 - DNA, 309 bp, Methylobacterium sp.
atggagctcagcgaaggcgaacttggtcgtgcggtcgatggcgacgagcaggtagagccgtccttcggccgtgtggacctcccccagatcgatgtggaagtagccgagcgggtaggccttgaagcgggacctcttgggcttgtcgccgtcgacctctggcaatcggctgatgccgtggcgctgcaggcaacgatgcagcgacgagcgggtcaggtgcgggatcgtcgcctggagcgcgtagaggcagccatcgagtggcaggagcgtgtgacggcgaaaggcgacaacgaccgcctcgtcctcaggtga

SEQ ID NO: 9314 - DNA, 606 bp, Methylobacterium sp.
atgacggccgccgcgctcgtgctcctgctcgccgctgcgcaggtgccggcccgcgccacgccgtccggttcggcgcgggatgcgcccgccatggccgctgctacgaccgcggacatcgaccccgccacgggtttgcgcgtccggaactaccgcgcccccgtgaccatgcccgtgagggggggcacccgcatcgacctcgacgcggtcgaccggctccgtacggagggcgcggcgctgatcgacgtgatgcctcagcgcggcggcttcgatccggcgggcggcgcctggcggatcgtcgaccggcacgcgaccatccccggcgcggtctggctgcccgagaccggccgcggcgcgatcgagccgcggctcgccgcctacctcgcggcctggctcgccaggctgagcggcggcgaccggggccacccgctgatcttcttctgcatggccgattgctggatgtcctggaacgcggtgcggcgggcggccgatctcggctaccgccgcgtctactggtttgccgagggcacggacggctggagcgaggccgaccgcccgctcgtaccggccgagccccccgcggtcccgcccctcaccgccgcgccttga

SEQ ID NO: 9315 - DNA, 984 bp, Methylobacterium sp.
atggcagtgcaaacccgcctgacgcaggcgttcgggatccgtcatcccatcgtcctggccccgatggatccggcctcgggcggcgccctggcagccgcggtgagtgcggcgggcggcctaggcctggtcggcggcggctacggcaaccgcgagatcctggaggcggagttcgccaaagccggcaatcagcgtgtcggctgcggcttcatcacttggtcgatggcacgtgacccggtcctgctggatctggccctcgcgcataagccggcggcgatgatgctgtcgttctccgatccggcccccttcgccgagaaggtccgggcggccggcgtgcctctgatttgtcaggtccacaatctcgagcacgcccgccgcgccctcgacgccggtgcctccgttctcgtggcgcagggcaccgatgcgggtggccatggcatgaccacccgcggcaccatcacccttgtcccgagcgtggttgacctcgtcgcccgcgagcgcccggaggttttggtgctcgccgccggcggcattgccgacggacggggaatcgccgccgcgctgatgctgggcgcggacggtgcgcttcttggcactcggttctgggcgacccaggaagccctaatccatccggcagccaaggcccgcgtcgtggccgccaccggcgacgagacggtccgcacctcggtctacgacatcgtccgcaaccgggcttggcctcccgcatacaccggccggctgatgcgcaaccggttcatcgagacttggcacgggcgcgaggacgaactgcgcaacctcgtgggcgcggagcgcgagcgcgtcgagagtgcagaccggagcggcgactacgacgtctcgaacgtgacggtgggcgaggccatcggtctcgtccgagacctccccgcggccggcgacttggtcgcgcgtctcgcggcggagacggaggcgcgcctcgcgacgctaccccgcgcgctcatcaccgcctga

SEQ ID NO: 9316 - DNA, 1017 bp, Methylobacterium sp.
atgaagaagatcggatttctgtcgttcgggcattggtccccgggcgcccgctcggaagcccgctccgcgggcgacaccctgctgcaatcgatcgatctcgcgatcgccgccgaagagctcggcgcggacggggcatatttccgggttcatcatttcgcccggcaactcgcctcgccgtttccgctgctcgcagcgatcggcgccaggacgaagcgcatcgagatcggcaccggcgtcatcgacatgcgctacgagaacccgttctacatggtggaagacgccgggtcggcagacctgatctcgggcggacgcctccagctcggcatcagccggggctcgcccgagcaggtgatcgatggctggcggcacttcggctacgctccggccgagggcgggagcgatgccgacctcggacgccggcacgccgaggtgtttctcgacctgctgcagggacgcggcttcgccgagcccaatccgcggccgatgtttcccaacccgcccgggctgctgcgcctggagccccactcggaagggctgcgcgagcggatctggtggggatcggcgtccgacgccacggcggtatgggcggcgcggcagggcatgaacctgcagagctcgacgctcaaggccgacgagaccggcgagccattccacgtccagcaggccaggcagatccgccgctaccggcaggcctggaaggaagcggggcacacacgcgagccgcgcgtctccgtctcccggtcgatcttcgccctcgtgagcgatcgcgaccgtgcctatttcgggcgcggcgagagcggcgaccagatcggcatcatcgacagcatgcgggcggtcttcgggcgctcctacgccgcggagccggagcggctggtcgccgagctcgggacggacgaggcgatcgcagaggccgacaccctgcttctgaccgtgccgaaccagctgggggtcgcctacaacgcccacctcatcgaaaccatcctgaagcaggtcgctccggcgctgggttggcggtga

SEQ ID NO: 9317 - DNA, 762 bp, Methylobacterium sp.
atgaacaaccggttcactccgctcttcgaccagatctcggatctccggtcgatcgcgatcgaggcccgggcgcccgcgaatcacctcgcgcttctgacggagcatccggtcgcctacgagagcaacgaccacaaggcgccgtggggcacgaagaacgacaatacccgcagcgcccgcttctgccgcgcgctcgaggcgcatttccggcggccgatcagcgcgatggatctgggctgctcgggcggcggcctcgtcttcgatttcctggtgcgggggcacctcgccatcggtctggaggggagcgactactcgttgaagtcacagcgcgccgagtggcgcgtcatcgacgactatctctacacctgcgacatcaccaagccgttcgatgtcgtggacaagacgagccgggcgacccacgccttcgacgtcatcacgatgtgggaggtcctcgaacacatccacgaggagcatctgccgcagctcttcgcgaacgtgaagaagcacctcgttccggacgggttgttcgtcggctcggcggcgctctacgacgatgtcgtgaacggcgtcagctaccatcccacggtgaagccggagatgtggtggcgcgagacggcccagcgcaacggcctcgaattcgtgccgaaaacgatgttcgacttcgccgatttctgccgcggtacgggcaacggaccgctcgacccgaacttcgcgcaggatcccggcaagggcttccacttcgtcatgcgtcaccgggcagcgtga

SEQ ID NO: 9318 - DNA, 1044 bp, Methylobacterium sp.
atgcccctcaccgtggactggtccgtcagcatcaacgggaccgattacacctcgcgcttcaacccctacgtgatggagatcgaggtcacggacggatccggaagcgacggggacagctgccgcatcacgctcgccgacgacgggcgcctcattatgccgaaaaagggcgtgaccatcgcagtatccatcctcggcgtgaaggtgttcgagggtattctgaagacgccgcgctgtacgacggcgaagggccaaggcggcaagatggtcctgaatgcgacagggcacgacacggaggacgagggcaagcagagtcagcacttcgcgatggaagagaccaccttgggggagtacctgtctggcctcagcaagaaggccgggtatgagatcaaggtcgaccctgaactcgcgaagatcaagcaatcgtggatcggctcggaggggcgctcgtttctggagcacgcccagctgctggccaatcggtacggcgccacgctgaagctctcgggcaagcaggctgtcctggcccggcggggtaagggcaagacgcctggcggcaaggatctccccacggtgcgcgcggtctcgccgggcaacatcatcaacgcggacatcgagccctacgtcgggacggccgccgtgcgcgacgtgcgcttcgacttctttaaccgggacaaggcgcggttcgaggaacagaaggccgacgtgcgtctcggcatcggatcgagcaagactgcgcggagggtgctgcccggcaaggcagcgagcagggaagacgccgaggaccgggcgaagggggccgcggccgactcggagcgcgagcgcggctcgggtaccgtcgagatcgacatcgagccgcaggcccgcgccgagggcacctgcatcgtgtccggcgtccgccagggcatcgatggggagtatcgcatcgagagcgtcacgcatacgctcacggcgggcgacggcggcggctcgaccacgaagctgaccctgaagcagcccggcgacgaggccggctccgacaagcggaaggccggcgagggggattga

SEQ ID NO: 9319 - DNA, 906 bp, Methylobacterium sp.
atgcgctccgacctgaatctctgggatctgcaccatcacagcgtggccgactggcagcggatcctcgccgggcatccgggcctcgccgcccgctggctccgcttcgccgccgagcgcggcttccggtcggcgcagctcgtcctcgggcagatgctgctggaggggcgcggggtcgcgcgggatccggccgccgcccacggctggttcgcccgcgccgccgcgatcggcagcctcgacgcgcgcaacatggtcgggcgctgccacgaatacggctggggcgtgccggtcgatcacgcggcggcgctggcgcagtaccgccgggccgcggccgaggggcatgcctgggcccgctacaatgtcggctgcctgctgctctacggggacgtgccccgcgaccacgccgaggccttccgctgtttcgcggccgccgcgcaggcccccgacgaagcagccgccggcaaggcgctcggcatgctcgggcgctgccacgaggagggctggggaaccccgccggaccacgccgcggcgctccgctgctaccgcgaagcggcggcggccggcgatggctggggcgcgctcaatctcgggctcctcgccctggaggcgggcgacgtctcgggcgcggcgtcggcgatcgagcgggcggcggcgctcgccgccccgaacgggctggcggcgatcgtgcgggcgctggcggggcgggacgaaccggccctggcggccctgcgcgagcgggtgcgcgcgggcctgcgcccggtcggcggcaccgtaccggacacggccccgccgcgccgcatcgccgcccggccgctcgagtggcggctgagcgcggccctcttggccggccatctgctgcgccggggccgggcgccgcgcgccagaaccatccctgccaccaccggttga

SEQ ID NO: 9320 - DNA, 2925 bp, Methylobacterium sp.
gtgggcaatctaacctcatccctgacgctcaagctgattgacgatggcctggccgcaaaggtcaaggctgacgccgatgcaatgcgtaagctcggagcgagcgcccaggacttgaagaagctgggtggcgcatcaagccacgtggcgaaattgaacaaagagctcgacgcccttgcgaaaaagggcggcaagctcgaagccctcaaagtcaatgagcgccagctgagtacgctggccgcctcgtacaagacggcccgccaggaagtcgcggccacggcaaaagcggtcgccgcgctcggcccgggcgtcagcgcgaaggaccagcgcgccgcggaacgcgcgcacaagaccgcgatgcgtcgcatggacgccgcgcgcgacgcggccctggaacaggcccgcctggtgaaggcggcccatgctgaggcgctgggtgggtccggcaagggccggatcggcatggctcgggccgaacagcagctggcggcagccaccaacgcgaccaacgccgctctgcgggagcaggtcggccttgtcgggcgcctggcggccaaggggcgcgccgagcgcgacgtgctcgccgggatgggcctggctggccgcggccagggcgccaagatcgcggccgaccgccgcctggtggacggcatgggcgcgccggcgcgcgcagccgcggccgctgccgcagctgctgccaaggctgccgttgaggccgagggccgacgccgcagcagcgccagcggtgacatgctgcgcggtatgggcggcatcggccgccgcgagcacgagcgcatcgccgctggccgccgcgtggcggaaggcatgagcgcggcgggtcggcgcacgggctcgatggccggcggctccctgcctcaggcgggtgacgcggaaggggccgccatcttcgacaccctcaagggtgttggggccagcgccgcggcccggagggcgttcgatgcgacgacttcaaactgggcaacgatggacgaggccgtacgccggcagcgcgcaattcttgatatcgatgaggataagcaagaacaactcaaagcccaggcgtaccaaatcggcaaagatacccggttctccaacccggatgtcatcaaggggcagacccgtatcggctcaagcctgcccgaccacctgaaaaatcctgcggtgatcgcggccattacggagaacgcgaaggactatgccctggcgatgggcaccaccctggacgaaggttccagcgccgtcctgggccgaatgctcggcatgcgtatggatctgtcaacaaccgggtctgccggggccgcttccctggatgctgcaaacaagttggtccagtgggcgaaggcgtcgggcgccgaccacaacgacgtgatggggtacaccaagttcggtgcggccccgggcaatgtcggtgggttctcgccagagttccaagacgccctgtccgcccagcttcgccgcatcggcttcgagggctcgatgggcggtaacttcgtgcgggccgcggcgaccaagctcgcggtgccgacctcgaagggcctgggcgcgctcgcggccgccggcatcgaccattcggactacgtgcagaagggcaaggagctctcggccgagaacctgaacaagtcgctgaagctcaagtacggcaagggcctgaccgatagccagcaggcgcgcatccacgcgctgatgcaagatgagacggtggtgggcaaccgggatgagttcattcctgcggttgccgaaatcgtgcaggaaacgctggcccggaagaccaagaaagggtcaataaacgcgcaggatgccaagagcattgccaaagctgttggcgagttcctgaacgtttcggcgggtgcggtcgatattgagcgcctgatgcgggatgttatcccgcttctgaaggggtcgcctgcgctgtccaaatacttgttcgggcaggaacatggcggccgcgcccaggcgcttgatgccgccacgctcgaaaaggacacagaaagcttccgcaatacaccgagagatcgcgccaagggtgtaggcaatataacgaatgctgggttccacggcgcgcgagaccgatactatgggtcggttgaaacgttctggacccgcctgggtgaagtcgccaacggcccgctgaccacgttttatgaaacccttggcaactcgattgaccgcgtgtccggcctgcctgacgccctgctgggcgtcgggacagcggcggcctcagccggcgcggccctgctgacgatcaagggcgcagcaggggccggcgcgttgctcggcctgcctggcgccgccgcggtctcggcgggggcgtccgctgccggtggcgttgcgaccgtcgccgccggcggcgcgatggcaacggccatcgccaacgaagccatcaaaaacaaagagttcgcggccccgtacctcgatggcgggatgctgggggcggacccggccggatacggcatcggcgccggcatcatgcacgcccccgaagccctcaagcagatgtccgacgccaacaagcgccggatgggctcgcttccgcctggtatggcgggggtgccggcccagctgccgccgcgcctgcccgggctcgatggcaggccgaaggtggcgccagccccggcggtgcggcccgtgacgctcaacccgggcgacgaactgcccggtgtcgccagcagcctggaacaggtcagcggcaaggcggaccaggcgcgcagcagcctggaacaggtcaatggcgtgaaagtggacccttccatcagcacgggcagcctcgacgccatgctggcgaagatcggtcaggtgatttccggccttcagcagatcaccggcctggcggcatcagccaacagcagcatcgccagcgtgaacagcggggccgccctgaaaggacggtccttcagcgacggcgccacccctgggcgtggcacagactaa

SEQ ID NO: 9321 - DNA, 357 bp, Methylobacterium sp.
atgcgccgcccgatctcgccccgcgaatccgcgatccaatccgccgtgatcgcccactggaaggctctcggcctgcccggcaccttggtcgctgccgtgccgaatgccggcgcgctgggacaggccgggctcaccgcaggcatctccgaccttctcgtcctcggcggtctcgtccgcgtcggcttcatcgaactgaagcgcgaccgcggggtggagagcgcggcgcaggaagccttccgccggcgctgcgaggcgctggccatcccgtgcgtcgtcgccttcggccgagacgagccgatcgcggtgctggagcgctgggagatcgtccgccgccaagccgggagggctgcagcatga

SEQ ID NO: 9322 - DNA, 234 bp, Methylobacterium sp.
atgctccggttcctcggccggcatgcgggcctgctggccttcggggtggtggccgccgtcgtcctcgggcccctcacggtgttctggccgggcgccggggcgctggccgtcgccctcctcggcgcgctcggagcgctcgccgcccatgcccgcgccaccgcgctgcgggcgcgctgcgacgtgctctcccgcgaggtcgacgggctctccaagcgcctgctgcgggcggaatcg

SEQ ID NO: 9323 - DNA, 168 bp, Methylobacterium sp.
cccccgcccgccccgggcacgcagcgctacatcaccgagccgccgcgcgctcccgagacgcccggcccgatgccgagtccggcgcccggccgcggcacgggcgagagcctgtcgcgcgacctcccctcggaagcctaccgcccgccgccggagcgcggcgggcgctga

SEQ ID NO: 9324 - DNA, 198 bp, Methylobacterium sp.
atggcccgtcgtcaaaccgccacgcaagccgcgatttctcgtgccgtgaagggtgcgcaggccgccggtcttaagatcggccgcgtcgagatcgagggcgaccgcatcgtgatccattccagcgccgagcccgtccaggccgccccggcgtcggacttcgacgcatggagggcgaagcgagatgcgcgtccggcttaa

SEQ ID NO: 9325 - DNA, 267 bp, Methylobacterium sp.
atgaccacccgtttcaccaccgccgccgtcgcgattgccctgagtctggccgccccggccgcgttcgctcaggccggcaactggccgcacacggagcgcgcgccggtgagcgcctacgacgacatcaccacgggctccatcggcgtcgcccgcccgcaggtgcgcgacggatggggcgcggtcagctcggccaaggccggcaacgcgaaccagcagaacttcccggtgcagcagtacggccagacctcgggcggtccggcctactga

SEQ ID NO: 9326 - DNA, 297 bp, Methylobacterium sp.
atgtcctgtctctggtccggtatcgcggccctcgcgcttcccgtcgccgcggcgatgccgggggcgggcggccccgttctggtggtcggcgcaccgggtgccggaccggcggcggtcgccgagatcgtcgcacgggccgacggcgcgctcctgcgccccacggtcctgccctggatcgtcctcgcacgctccgatgccggggatttcgatgcgcgcctgaggcgggcgggcgcctggctcgtcctcgacgggaccgccctcgcgggctgtgcgggcggccgcgggagcatccggtag

SEQ ID NO: 9327 - DNA, 978 bp, Methylobacterium sp.
atgccggtgaccgatgccgcggaccctaagccgctcatcctgttgacgaacccgatccacccggaggcggtggcgcggctcacgccccatgcccgcgtcgtgaccgcgccggatacgggcgccgacaccctgcggcgacttgcccgggaggccgccgggatgatcgtgcgggcgcaattgcccgacgacatcctcgatcacgcgcccctcctgcggggcatcgtccggcacggggtcgggctcgatttcgtgccgctggcggccgccaatgccggcgggatacccgtggcaaacctgcccggtagcaacacgcgggcggtcgcggaatacgccttcgcggccctgttcgagttgcgccgccggctcggccatctcgaccggacgctccgccagagcggctggctcgccgccaagacgctggccaacgacctgcccgagatcggcggcaccgcgctcggcgtgctggggctcggcgagatcggccgggcggtggcggggatcggccggcacggcttcggcatgcgggtgctcggcacggcgcgcaatccgcgcggccttgagggcctcgccgagccggtgccgatcgagcggctcttcgcggagagcgacgcggtggtgatcgcctgcccgctgaccccggagacccggggcctcgtgggtgccggcctgatcgggcggatgcggcccgacgcggtgctgatcaacgtcgcccgcggcccgatcgtggaggccgacgcgctcgccgacgcgctggaggccggccggatcggcggcgcggcgctcgacgtcttcgcggtgcagccgctgccggaggaccaccggctacgggggtgcccgaacctcctcctcacgccgcacgtggccggcaccaccgcgaccagcctgcgcacgatggggctgggggcggccgacgccatgctggcgatcctgcgcggcgagcggccggcgacggtggtcaatccggaggtgtacggctga

SEQ ID NO: 9328 - DNA, 237 bp, Methylobacterium sp.
atgatcagcgtgcagccctactggctcgtccacggcgagggccctgccagccgtcggcatgacaccaaggcctcggccgatcgggaggccgatcggttggcccggcttcatcctgggcaggtcttcgtggtgctggaatccgtcgaggccttccgcaagatcgacgtgcaacgggtcagtctgcgcgggcccgaggggcgcgttgctcccggcctgatggacgatatccccttctga

SEQ ID NO: 9329 - DNA, 90 bp, Methylobacterium sp.
aaggcgttctcctacggcatgatcggcgcgttcgtggccggtctcggcctgacgctccggggctccctcggcgttctcgccggcctctga

SEQ ID NO: 9330 - DNA, 90 bp, Methylobacterium sp.
aaggcgttctcctacggcatgatcggcgcgttcgtggccggtctcggcctgacgctccggggctcgctcggcgttctcgccggcctctga

SEQ ID NO: 9331 - DNA, 426 bp, Methylobacterium sp.
atggcaggcggctacgcgccaaacacgttcgcagtgctcctagtcgaggacgtgccggtccagatgatggcggcggccagcgccctgcgggacgccggcctgcgggtcgtcgaggcgccgacggtcgaggcggcgacttcggcgctcgccgctgatcccgagctgcgcgcgatgatcgccgacatcgaccttggcggcgaaccgctcatggggctgaccctagcgaaggccgtcgcggcgcgctggccggatgtcgtgctgctgctcatctctggcgctatcgtacccgagaccgaggccatgccggcgggggcgaggttcctgcgcaagccgtttgagccagaggcgctggctgaggccgtgcgaggcctggtcagcgcgcgtgaggcgggtaggcttgcgccagacggatcagtgatggggtga

SEQ ID NO: 9332 - DNA, 2271 bp, Methylobacterium sp.
atggccgagaccgacgcgcagatccttcggctgcaggtcgccaacgcccggccgcaggatgccgggcgcggcatcgcccgcctcggccacgcggccctgacccagctcggcctgcgcgagggcgacgtcgtcgagatcgtgggcaagcgccacaccgcggcgatcgcggtcggcccctacgaggaggacgaggggctcaacctcgtgcggctcgacggcctccagcgcgtcaatgccggcacggcgagcggcgaccatgtcgaggtccgcgccgcgtcggagatccgcccggccggccgcgtcgtggtggcgcccgcgcagaagaacgtccggctccagggctcgggcgaggcgctgcggcgcacgctcttccgccggccgctggtggcgggggacgtcatctcgacctcgacgcagtcgcgcgccgcgcccgacccgcgcatcccgccggagctgcgcccctatctggagggcccgacctacgggctgcaggagatccgcctcgtcgtggtctcgacgcagccccgcggcatcgtcttcgtggcggagggcaccgagatcgagctgcgcccgctcttcgaggagccgaaggacggccggcgcgccgacgtcacctacgacgatatcggcggcctcggcgacacggtcgaccagatccgcgagatggtcgagctgccgctgcgccatcccgagctgttccagcgcctcggcatcgatccgccgaagggcgtgctgctgcacggcccgcccggcaccggcaagacgcggctcgcccgcgcggtggccaacgagaccgaggcgcgcttcttccacatcgccggccccgagatcatgggcagccgctacggcgagtccgagcagcgcctgcgcgaggtcttccaagaggccgcccagaacgcgccctcgatcatcttcatcgacgagatcgactcgatcgccccgaagcgcgagcaggtcaccggcgaggtcgagcgccgaatcgtggcccagctcctcaccctgatggacgggctggagccgcgccagaacgtcgtggtgatcggcgccaccaaccggcgcgacgcgatcgacgaggccctgcgccggcccggccgcttcgaccgcgagatcatcatcggcgtgcccgaccagccggggcggcgcgagatcctgggcatccacacccgcggcatgccgctcgccgaggatgtcgatctcgacgcggtggcgcgcaccacctacggcttcgtcggggccgatctcggcgcgctggtgcgcgaggcggcgatggacgccgtgcgccgcatcctgccggaggtcaacctgcgggagggtatcccggccgagaccctggaggggctgagcgtccggcgcgacgacttcctctcggcgatgaagcgcatccagccctcggcgttgcgcgagatcatgatccaggtgccggatgtgacctgggacgatgtcggggggctagccgacgcgcagatgcgcctgcgcgagggcgtcgagctgcccttgcgctcgccgcaggccttccggcgcatcggcatccggccggccaagggcttcctgctcttcggcccgcccggcaccggcaagacgctgctcgccaaggcggtggcgcgggaggcggaggcgaacttcgtggcgacgaagtcttcggacctcctctcgaagtggtacggcgagtccgagcagcaggtctcgcgcctgttccagcgggcccggcaggtcgcgccgaccgtgatcttcatcgacgagatcgacagcctcgcccccgcccgcggcggcggcctcggcgagcccgccgtgaccgagcgcgtggtcaacacgatcctggccgagatggacgggctggaggagctgcagggcgtcgtggtgatggcggccaccaaccggccgaacctgctcgacccggccctgctgcgtccgggccgcttcgacgagctcgtctacgtgccggtgccggacgcggccgggcgccgccgcatcctggcgatccacacccgggacatgccgctcgccgaggacgtcgacctcaacctgatcgccgaacgcaccgcccgcttcaccggcgcggatctggaggatctcacccgccgcgccggcctcctggcgctgcgggaatccctcgacgcgacgcaggtccaccgcgtccatttcgagcaggccgcccgggagacccggccctcggtgacgcccgagatggagcgggactacgaggagatgctgcgcaccctcaagcaggagggcccgcagcgccagccgatcggcttcctggcggcgcggtaa

SEQ ID NO: 9333 - DNA, 273 bp, Methylobacterium sp.
atgccgcccgtcgaaccggtcagccccgttctcgataccctgctgtccctgctcgccgaggcgccgccgggccgcgaccgcaaggcggcggagcacgccgcggaacggctcgaccggctcgaatacgcggcgcgatgggacggcgcggccccggagacgctcgcggcgatcgccggcgcgcggatgctgctcggcctcgctgcctatccgtgtccccggcgcccccgcatcgcgccgcgtcacccgatcgccggggccctgctgccgcattga

SEQ ID NO: 9334 - DNA, 591 bp, Methylobacterium sp.
gtgagcccgacccggattctctgcgtcgaggacgaccgcgagatcgcagacctgatcgccgaggtgctggccgaggagggcttcgccgtcgagcgcgccgcgaccggcccggaggggctggcgcgcctgcggacccgcccggacgccgtgatctgcgacatcgacctgccgggcttcagcgggctggacctgctgcgccgcgcgggcgaggcgggcctcgccgcgcccttcgtcttcctcaccgccttcggcggccgccggaaccagatcgaggcccggcgcctcggctgcgcggacttcgtcacgaagccgatcgatttcgaactcctcgtggcggtgctgcgcaacgtcctgcagcgcgcgcccgtgcgccggaccgtgcaggagcccgcggtccagatgaccgagcgcgagcgcgagatcctgaccctggtctcgcggggcaagtcgtcggtcgagatcgcgcagatcctcgcgatcagcgagcggacgacgaacttccacatcggcaacgtgatgaggaagctgaacgtgacctcgcgcgtccaggcggccgtgatcgccctctcgatgggcctgctcgagaagtag

SEQ ID NO: 9335 - DNA, 378 bp, Methylobacterium sp.
atgaccgagcaccggattgtcagccatagcaagctgcgcgacgagatgatggccgttgccagggggcagcaggccgcgccgccgaatgccggggggcagagcttcgagtccgtcgaggcgctgatgcgccttctgacgccggacaaccggcggctgctggccatgatccgcgatcgcaagcctcaatccattgccgagctggccgaatggtcgggcagggctgcccccaatgtcacacgcacactggcaaagctcgaagcggtcgggttcatccgcatggaagaaaatcagcggcgcaaagtgccgacggctgtggtccacaagcttacgatggagatagacccgttctcgcagaatgaccggctggaaatcgcttag

SEQ ID NO: 9336 - DNA, 675 bp, Methylobacterium sp.
atgatcaccgtcgttggcggcactaagggggggtcgggcaagtccaccgtcgccacgaacctcgccatcatgctggcgagcgccggccgtgacgtgctcctggtggacgcggatgatcaggagacctcgaccgacttcaccaacctgcgcgaggccacccggccgggcggcgcgggctatacctgcgtcgccctaacgggcgcggccgtgcgctcaggggtccagcgcctcgccccgaaacatgcacatgtcatcatcgacacgggcggccgtgacacggtaagccagcgcgcggccctctcaatctgtgacgcctacctcgtgccgttcgccccccggtccttcgacgtgtggaccctcgacaaggtggccgagctggtcgaggaggcgagggccgtgaacccggagctgcgggcgctcgccttcatcaaccgggccgaggcacgaggctccgagaacgcagaggccgccgagctgatccgctcgaagccgggcctggagttcgtgccggcggcgctgggcgcccgcaaggcgttcgcccatgcggcggcctcaggcctgtcggtcacagagctgcgcccgcaggacccgaaggccagcgaggaaatcgccgccctctacgggcatctgttcgataccgccaagatatcctcccgagatccgaaaggagcctga

SEQ ID NO: 9337 - DNA, 1155 bp, Methylobacterium sp.
atgagcgcagttgtctacaatggcccgcgcgacgtggcggtgcaggacgtgcccgacgcgcggatcgagagatcgaccgatgttctggtgcggatcacgagcaccaacatctgcggctccgacctgcacatgtacgagggccggaccgatttcccgcgcgggggtgtgttcggccacgagaacctcggccaggtggtagaagtaggcgacgccgtcgaccgggtgaaggtcgggaactgggtcgccatccccttcaacatcggctgcgggttctgcaagaactgcgagcgcggcttgagcgcgttctgcctgacaacggcggaccgaagcgtcgtgccgaacatggccggtgccgcttacggcttcgccgacatggggccgtatcggggcggccaggccgacctgctgcgcgtcccctacggcgactacaactgcctgaaactgccgccggatgccgaggagcggcagaacgagtacgtgatgctggccgacatcttcccgaccggctggcacgccaccgagctggcaggactgcgccccggcgagtcgatcgtcatctacggggccggcccggtcgggctcatggcggcccatgccgcgatgatcaagggcgcctgcatggtcatggtcgtcgatcgccatcccgaccgcctgcgcctcgcaggcgagatcggagccctgcccatcgacgattccaagggctcccccgtggaccaggtgcttgagctgacgaacggcatcggggccgaccggggctgcgagtgcgtcggctaccaggcgcacgacccgcagggtcacgagcaccccaacatgaccatgaacgacttggtcaaatcggtgaaattcaccggcggcatcggcgtggtcggcgtcttcacgccccaggatccggctccgcaggacccgctctacaagcagggcgagatcgtcttcgaccacggcctgttctggttcaagggtcagacgatcggcgtcggccaatgcaacgtcaaagcctataaccggcagctgcgcgacctcatctcgaccggccgcgcgaagccgtccttcatcgtctcgcatgagcttccgctggaagaggctccgaacgcctaccagcacttcgacgcgcgcgacgagggctggaccaaggtgattctcaagccggccgcatga

SEQ ID NO: 9338 - DNA, 600 bp, Methylobacterium sp.
gcgcccacccagccccccttcccatccgcactgccgacgctcccgcgggccggggcggcgcccgccgcgacgggcctcgtggtggcgccggggcgggtgctgaccgcggcggccgcgctcggagggtgcgcgccgcgcatcggggccgcggcggcgcgcgtgctcgcgagcgacccggcccaaggactcgcgctgatcgaggcgccgggcctgccggcctcggtcctgccgacgccgcgcgggacgccggcgggcgtggacgaggcgctgacggtggtggcggcgagcgccgaggggagcgtcgtcgcgccgggcgcggcgctgggatccggcgtggtggcgccgctccagccgggcgcggccggcgcgccggtgctcgaccgcgcgggcgcgctcgccgggatcgtcgcccgctacccgagcacgccgcgcctcgtcgccggcgtggcgccgccgacgagctacccgatcctgccgggcgaggccgtcttgggcttcctgcgccggaacggcatcgccccctcggcagccggcgggtccgcgggggcgtcggcgggcgcgatcgcgccggccgtggtggcggtcacctgcgcgcgctga

SEQ ID NO: 9339 - DNA, 450 bp, Methylobacterium sp.
atgtccaagcgaaatgtagagcccgagctcacggctgcgcagctacaggaactcatcggcatggcgcgggggaacagcgagaccttgtccaccatggacggcaacaaccaagccctgtttctactgcgcacattcgacacggcagaccgtgtctatggtctctggccagattcatcgcggcccggcggctatgactacaacatcatgaagggtgagttgggcagcgcggccatgcggcgggttgcgaagagccccaacatctccgtcacggcagtattccaggagaacgagaaccacgccgaactgacacgcgagatctacgtggggctcgaaacgactggcgatgcttaccccgagacgtatgcggaggctttccacttttggatcaatatcgtgcccgctaacttcgaggacaccaagcggcgcatccggggctacatccttggctga

SEQ ID NO: 9340 - DNA, 420 bp, Methylobacterium sp.
atgcatctcgaaaccgcgcacgtcctcgccggcctcattgaggcgatgcccgaggacatccctgtcgacgacccggacgacgaggcggaaggcgcgcccgagaccgggtcggcgcgctcggctcgggagcgccgggatgctgcccagcgcaagcgcgacgagcgcgcccgccgtaaggctgggggcatgccggaccctcgcgtggtggacgctgccatcgccacggccatcgccgacatctgcatccgggcggacttccgcggccgggcgaaggcgaagggctctatcaagggcctgtccatcgggctcgacgccatcatcgggcaggtcatgcaggtgctcgtcgaacagcggaacgtcgggcagccgcaggctaagaaggccgcgatgcagcgcctcggcctgacccggcaggcctga

SEQ ID NO: 9341 - DNA, 735 bp, Methylobacterium sp.
gtgacctcctcgcattccgccgccggtccgcagcgcgtgctgatcacgggcggcacatcgggcatcggggcggcgatcgcggagcgctgccgccgggacggctacaccccgatcatcctcgaccgcgtgcccgcggcatcgggcgcgtgcatcgtcgccgacctgtcggaccgcgagcagaccgcccgcgcgctcgacgaggccctcgccggggggccgatcacgcggctcgtcaacaatgtcggcgtggtcgtgccgagcgaggtcgacacgcagccgctcgaatcgctggacctcgccgtgtcgctgaacttgcgctgcgcgctgcaatgcctgcaggcggtgctgcccggcatgaaggcggcgggcttcggccgcatcgtcaacatgtcctcgcgcgccgcgctgggcaaggaactgcgcacggcctacgccgcgacgaaggccgggctgatcggcatgacgcgggtctgggcgctcgaactcgggccgttcggcatcaccgccaacgcgatcgggcccggcccgatccgcacggcgctgttcgaccgcgcgaaccctccggacgcgccgcggacccgcgccatcatcgatgcggtgccggtcaggcgtgtcggcacgccggaggacgtcgccgacgcggccgcctacttcctcggtcaccgcagcggcttcacgacgggacagaccctctacgtgtgcggcggcatgacggtcggcctggcaagcgtctga

SEQ ID NO: 9342 - DNA, 834 bp, Methylobacterium sp.
atgccgatgcgctgccacatcggttccgctttgcttctcacggggctcgcctgcgcgatgccggtcggggcggaggcgggagcggggccgcgggttcggatcgcctacgagaatccggccccgggcgaggccagggagatctaccgcgaggtgagggagcgccgggtgctcgagggacttcgaaaccttctctcgcatctccgcctgccccgcacgctgacgctgcggatggccgcgtgcggcggcgagcccgatgcgtggtacgcggcgcgcgatcggaccgtgaccgtctgctacgactatgtccgggacgtgcgggagcgcgcgcccgccaccgtcacgcccggcggcgtgacccggcaggccgccatcctcggcgggttggcgcaggtcttcctccacgaggtcggccacgcgctgttcgacatcctcgatatcccggtcctcggccgcgaggaggatgcggccgaccagttcgcggccctggtcgtcctgcgccttccgccggaggaggcccgccgcgcgatcgacgggggcgcgcatctgttcaggagcttcgcggccgaggaagcggtggaggaggcgatcctggccgattcccacgggccgttcgcccagcgcctctacaaccttctctgcctcgcctacggctccgaccgccgcgccttcgcctatctggtggagcgcgccagcctgccgagcgcgcgcgcggccgagtgcgccgcggagtacggccaggccgcggatgcgatggaccgggtgctgcaccgtcatctgcagggccggcgcctcggccgcggtcaggtccggcgggccttccggtggatcttctga

SEQ ID NO: 9343 - DNA, 987 bp, Methylobacterium sp.
atgccccacctgcaaccctcgcgccgcgcgatcctggccgggggccttgccgtcgccgcgctcccgctctcggcgcgggcgcaaggggcctatccgacccggccgatcaccctgatcgtgcccttcgcggccggtggctcgaccgacgtggtcgggcgcctcgtcgcgcagaagctgtcggaggtgctgggtcagcaggtggtcgtcgagaacgtggtcggggccggcggcaatgtcggggccgcccgcgtcgcgaaggcggagccggacggctacaccatcctgatgggcacggtcgcgacccacgcgctgaacccgctgatcctcaagcgcaagccctacgacccggtgacggacttcgcccccgtcgcgctgctcgcggtcgtgccgaacgtgctcgtggtcaacccgagcctgccggccaagaacgtgcaggagctgatcgccctgctgaaggccgacccgaagaagtacaactacgcctcctcgggcatcggtacgccgctgcacctctcgggcgagctattcaagagcatggcgggcgtgcagatgcagcacatcccctatcgcggctcgggcccggcgctcaacgacgtcgtggccggccaggtgccgatccagttcgacaacctgccctccgcctcggaattcatccgggcgggcaccctgcgggcgctcgccgtgaccacgaaggagcgcgcgtcctccttccccgacgtcccgacgctcgcggaatccggcctgccgaactacgagacctacacctggaacgccctgttcgcgccgcccggcacgccgcggccgatcgtggacgccctcaacgcggccgcccgcaaggcgctcgccgacccggccctggtggaacggctgaagaccttcagcgccaaggtccagctctccaccccggaggaactgggcgagcacgtgaaggccgagaccgccaagtggaccccggtcgtgcgcgaggccggcatccaggccgactga

SEQ ID NO: 9344 - DNA, 1416 bp, Methylobacterium sp.
atgtcggacctgtcttccaacctgtcccccttccgcgagcttctcggcgagggcggtgtcgtcaccgatgccgacagcctgacccgctacacccatgaccagcgggccctgatgcaggggcagaccccgggcgtcctgcgcccgcgctcgacagaggaggtccaggcggtcgtccgcctcgcggcgcatctcggcttcggcctcgtgcctcagggcggcaataccggctatgtcggcggcgccaccccggagcccggccgcgggcagctcgtcgtgagcctcgagcggatgagccggatccgcgcggtcgacgcggccggcttcaccctcgcctgcgacgccggcacgatcctcgccgacgcgcaggccgccgcggaggcgcagggctgcctgctgcccctgagcctcggcgcggagggaagctgccgcctcggcggcaatatcggcaccaatgccggcggcctgcaggtgctgcgctacggcatgacgcgggatctcgtcctcgggctggaggtcgtgctgccggacgggtcgctgttctccgacatgcgcaccttgcgcaagaacaacatcggctacgacctgaagcagctcttcgtcggcgccgagggcacgctcgggctcgtcaccggcgtggtgctcaagctctggcccgcgcagacgcggcgcgccaccgcctggctccagctcgcggagaacgcgcccattcccgagatcgcggccctggtccggcgggagaccgcggatctcgcctccaccttcgagctcatctcggcctcgtcgctggcgctcgtcgccgacatgcgcggcgccgatctcgggctcgcggccgggcccggcggcgcggtcctcctcgaactctccgcctcctcggagcgcattcccctggacgacgtgcttctgggcaccttggaggcgctgatggaggccggccacgtcgaggatgcggtgctcgcgcagtccgagcggcagcggcgcgagatgtggacgatccgcgagacgatccccgaggcggagaagcacgcgggcggctcggtgaagctcgacatcgcggttccgacctcggccgtctccagcttcctggttcgggcgggcgcggtcgtcgcggccgaggcgccgggcacgcgcctgtcgttctacggccatgtcggcgacggcaacatccacttcaacctgatggtgccggcgggccgcgaccggctcgccttcacgcgggaggtggaggagggcgtcgcgcatgccgtgtacgcggtcgcggtcgatctcggtgggagcttcagcgcggagtacggcatcggccgcttcaagcgggacctgctggtccgctacggcgagccgaaccgtctggccctcctgagcgcgatcaagcgggccatcgacccgcacggtttgatgaacgcgggcgcgatgatctga

SEQ ID NO: 9345 - DNA, 768 bp, Methylobacterium sp.
atgctcgcggcgggccttgccggtcctgtgacggcacgcgccagcccgatcaccgaccagtggtccgcggaggccgcgcagacccggcagggccatacctatcgcaccgtgctgaccttctcctacgacggaaaggtccagaatgggcgcgccttgtggctggtcgatgtgcggtgcgaggtccgcagccctggggcgagcaaggtctcggcggtcaccggctcggggactgccatgctcgcgcagggcggttggggcggaaacgcgccacccgtcggtgacgtctacgtcatcgaggcggagaacgacccggagggcaagggcaggctggaagtcgacaacccaggctgcgcgtccggcacacctaccatcaagcggcggcccggagaggctaccgtgccgacgctgccgaaggtcgaaccgaccggtcggccgtggatgcacaacggcagcatggtcatgatcgaccccgaggccgggatcatcgcctatcgtgagcccaaggcgtccctgcgtcctgccgtgggccccggcacggtgctgttccgggggaccctcaagcccggcggcggcgcgcacggcaccgcctacgccttcaaggaaggctgcccgcccgcaccctacgcggtccgcggccggtactcagaccgtgactacacgctgaccctgcgcggcgccggacccgtccggaagggttgcgaggtcgtcggctactccgagcgcagcccgcatgccgtgctcgccttctcttacctcctcgacgattga

SEQ ID NO: 9346 - DNA, 987 bp, Methylobacterium sp.
atgggaattgccgtgcgagccgcgatcggggccctgttgctgaccgccacctcggcgcaggcctgggaacccaccaagccgatcgagatcatcgttccgttcccgcccggcggagcctccgaccagatggcgcgcaccatccagggtgcgatccagaagggcaacctcgtcaaacagccgatcatcatcgtcaacaagcccgcggccgccggcggcgaggcgatgctcgacatccagaagtcggccggagacccgcacaagctcatcaccacgtcgagcggcatctacatgacgccgctcgccaccaagctcccggtgagctggaaggacttcaccccggtcgccatgatggcgcaggacgcgttcgtgctctgggtcaacgccgcgaaaccctacaagaccgcgcaggacttcgtcgcggccgcgaagacggcggcgccgccgctcaagaccggcggcaacggctcgaagcgcgaggaccatctcatctcggtgacgatggagcaggccacgggcaccaagatcacctacgtgccctaccagggcggcggacccgcctcggtgcagctcgcgggcgggcacatcgacgccaacatgaacaacccggccgaggagatcgccaactggcgctccggctccgtgaagcccctgtgcgtattctcgccgaagccgatggagtacacccagaaggtcacggccgacatggcatggtcggacatcccgacctgcccgtcgcagggcgtgaacgtcacctaccagatgctgcgcggcatgttcatgcccggcaaggtgacgccggagcagcaggccttctacgtcgacctgttccagaaggtcacacagactcccgagtggaaggcctatctggagcggaacgccctggtgcccgatttccgcgccggtcagagcttcgtcgacttcctgacggaggacgagcgcaagcacaaggagctgatgaccaaggccggcttcatcgcgacgaactga

SEQ ID NO: 9347 - DNA, 498 bp, Methylobacterium sp.
atggcgcaagcctcacccccgctcccggagcgcggcctgtcgcgccggctcgtcgagatcctcgtggcgctcctgctgaccgggctcgccgcgctcgccctctgggactcgtacggacgcggggcgggctgggacaacggaccggagaacggcttcttcccggcccgcgtcgccgcgatcctggcgatcgcggccggcgccgtcctcgtgggagccgtgcgccgggaggacagcgtgttcgtcacctacggccagcttcgcctcgtggcccaggtcttcgtgcctctgttcctctacgtgctggcgatcgcgtttctggggatctacctggcctcggcgctgttcatgggcctgttcatggtgatgctcggtgccttccgctggtggcaggtcgcgctcgccgtcgtgctcacgccgctcgtcaccttctgggtgttcgagctccagttccgggtcccgctgccgaagggacccgtcgaggccatgctcggcttctga

SEQ ID NO: 9348 - DNA, 1542 bp, Methylobacterium sp.
atggacgacctcaaccagctcctgctcggcttccaggtcgcgctgacgtggcacaacgtgctgttcatggtcgtgggcgtcctgctcgggatcgtggtcggcgtgctgccgggcttgggcggaccgaacggcgtcgcgatcctgctgccgctcacgttcgggatggacccgacctcggcgatcatcctgctgtcgtcgatctactggggcgccctgttcggcggcgccatcacgtcgatcctgttcaacatccccggcgaggcgtggtcggtggccaccaccttcgacggatacccgctggcgcagcagggccgggccggcgaggcgctgacggcggccttcaccgcctccttcatcggcgcgctctcaggggtcgtgctgatcactttcgtggcgccactcgtggcgaagttcgccctgcgcttcggcccggcggagttcttcggcgtgttcttcctgaccttctgctccttcatcggcatggggcgggagaacaaggccaagatcgtcgcctccctggcgctcggcttcctcctcgcggcggtgggcctcgacaccatctcgggcgacctgcgcctgaccttcggctcccctgagctgatgaagggcttcgacttcctcgtggtggtgatcggcctgttcggcgtctccgagatcctgctcaccatcgaggaggggctgcacttcaagggcaagcgcgcggccatcgatctcggcgtggtcctgcgcacctgggccgggctgccgcgctactgggcgacgctgatccgctcctcggtggtggggatgtggatgggcgtgacgccgggcggggcgatcgcggcctcgttcatgggctacggcctcgccaagcgcttctcgcgccggcccgacgggttcgggcgcggcgagatcgagggcgtgctcgcgcccgagaccgcggcgcacgccgcgggcacctcggcgctgctgccgatgctggcgctcggaatcccgggctcggccacggcggcggtcctgctcggcggcctgatgatctggggcctgcagccgggcccgatgctgttcatcgagaagaaggagttcgtctggggcctgatcgcctcgatgtatctcggcaacctcgcgggcctcctcatcgtgctggccacggtcccggtcttcgccgcgatcatgcgcatccccttcgcgctcgtcgcaccgatcatcctcgtcgtctgcgccatcggcgccttcacggtggaatcctcacgcttcgacatctggctgatgctgatcttcggcgtcgtcggctacgtgttcaagaagctcgactacccgctcgcccccctggtgctcgcccttgtcctcggcgaccgcgcggaggacgccttccgccaagcgctgctcgggtccggcggagacctctcggtcttcttctcgaacgccctcgtttcgacgctgatgatcctcggtctgctgcttctggtgtggggaccgctcggcaacctgcgccagcgcctcacgcgcaagggcggcatcgatcaaccaccccgggaaattgccggttccaaggcctcttga

SEQ ID NO: 9349 - DNA, 981 bp, Methylobacterium sp.
atggcggcagaagaacgatcccacgggctgacccgccgaaccggcctcgccctcggtctctcggccgccgcggcggtctgccgcccgttcgccgccgcggccgccccgcgccgctacgccctcgacccggtccggatcgcggagggcgtctggacggtctacggcgcccaggaagcgatcacggccggaaacggcggcgccatcgccaacgtcaccctgctggacacgcgcgagggctgcgttctgatcgatgcgggcccctcgcaccgcttcggcacggccctcgacgccctggcgcgggacctgacgggcaaaccggtcgtccgggtctacctcacgcatctccacgccgaccatagcctcggcgccaccgcctttcccgacacggtgctccgggccggccccggcctgcggaccgacctcgcgcggttcggcaacgatctcgcgagcgggatgtaccgcgttgccggggactggatgcggggcacgggcgtgcccaagcccgccatggaagcccgtgagggcgtggaggatgtcggggggcggcgcttccggctgctgtgcctgtccggccatacccgggaggatctctgcctgttcgaggaaacctccggcctgctgttcccaggcgatctcgtcttcctcgaccgcgccgcgaccacgcccgatgccgatctgccgcgctggcgcaccgccctgcggacgatcgctgacatcccctgcggtctgcttgtcccggggcacggccctgcggaggccggccgccgcggcatcgatcaaacgctcgcctggctcgatgccgtcgaggccgggatcggagccgggttcgagcagggtctcgacgttactgagatcatggcgcgtcctctgccggcctggacggacaggatcgcggtagcgcgctacgagtttgcccgctccgtcatgcacctcttgccggctatcgagacggaacggctcccaaacctcccaactctgtag

SEQ ID NO: 9350 - DNA, 591 bp, Methylobacterium sp.
gtgactgccaagcgcaaatacgctcgcctcaccccggcgacctgggccaccatcgaaggcctctgggcctcgggcagtgcgaccctgtccgaaatcgcagagcgcttcggcgtgtcgccccgtgccattcaggcgcacatgagccaacgcggcattggcaagggcagtgctgccgaagcgcttgccgcgaacgtgcgctcggaggtccttagcagggcgctaagggagcctgacgatctggttgcgcgtgcggccgcaatccgcgaaggcgctgtccagggtgccgagaaagtcgagcgcctacttcatgccgccctcgacgctgcggccgccgaccccggcaaggtgttcgccctggctgctaccgccaaggcgcttgccctgagcgctcagaccttggagcgcctccacaagctcaagcgctcggccctcggcctcggggatgacgatacattgtcggatgaattgcccacgctgctcatcgaggatctgagcgcatcggatatcgctgccatgcgtgaggatgacgaggaggacgacggccccaaggcacgccacgaggaggacaacgaggttgtgctgatcacgtga

SEQ ID NO: 9351 - DNA, 624 bp, Methylobacterium sp.
atgacgctccagacgtggtggctcttcctcggcgcggtattcctgctttcggggacccccggcccgaacatgctgcacgtgatgacctgcagcgcccggtacggcctcgggccgagcgccttcgcgatggtcggctgcctgtcgggcctcgtgctggtgctgatcgcggcggccgcgggcctcggcgcggtgctcgcggcctctccgctgctgttcgagatcctgcgctacgccggtgtggcctacctcgcctgggcggggatccgggcttggcggggcggcggcgcggcacccgatccggccacgggcatcgcccgggcgccgtccgccggtggcctcttccggggtggcttcctgatcggggtgagcaatccgaagcttctgatgttcgtggcggccttcctgccgcaattcatcgagccggcccgtgcgcagacgccgcaattcgtcgttctgatcctcaccttcgcggcggccgaggcgttctggtacgcggtctacggcgtcggcggccgtcggatcgcccggctgctggtccggccgggcgcacggcgcctgttcgaccgggccacaggagcgatcttcctgggcttcggcgcggcgctcctcggcgggcaccgatga

SEQ ID NO: 9352 - DNA, 363 bp, Methylobacterium sp.
atgcagcgggcagcggtgtggcgggccgccatcggcgtgctcacgctctacgcgctcgtgctgcagggcctgctcggcggcgtcgccgccacccggatgagcctccaggccaccggcatcctgtgctccgaccaccgcgcggacgcgagccaggagccggacggacaggccggccaccaatcctgctgctccaccgtctgccggctcgccggtttcgcgctggccgccccggaggtcgaggcgatacccgccaccgtgccggcgctcgcccgcgagcggcactggcacgccgtacaggcccacgcgccgcccgcccggacccaccgctcagccgcgccccgcgcaccgcccgccgccgcctga

SEQ ID NO: 9353 - DNA, 105 bp, Methylobacterium sp.
gtggcgccggcccaggtgcgggcaccgaaccggccggaatggccgcacccgctgaacgaagaggagctccgcgccctggaaaccggctggggtttcgtcgagtaa

SEQ ID NO: 9354 - DNA, 543 bp, Methylobacterium sp.
gtggcacgggtcgcagacctcgcggtcgactggggcatgctgccgatggtgcgcttgaacgagatccgcctcggcgaggtcgcggtggatctgccgccggccaccgatgcgggcctgatcttcatcggcaccatccgcacgccctggaccgaccggctggcctgcccccgccagggccgcctcgacggcccggtctgccgcctggagatcgccgagcccttcgtcgcggcgctcgccgggctggagcagtacgccgaggtcgaggtgctctactggctcgaccggtcgcgccgcgatctcgtcctgcagagcccgcggcgcgacggcgcggtgcgcggcgccttctcgctgcgctcgccggtgcgtccgaacccgatcggcagcgcccgcgcccgcctcgtcgatatcgcgggcgcgacggtccgcgtgcaggggctcgactgcctcgacggcacgccgctgatcgacctcaagccggaccgctgcgccttcacgccgctcgccccgccgcagcccggcgatttcgagaccggaccggcatga

SEQ ID NO: 9355 - DNA, 411 bp, Methylobacterium sp.
gtgggcgctctcttctccatcctgccgatgctgatccagttcctcggcccggtgctcgacaaggccatcccggatgccgcgcagcgcgcgcaggtacaggccgatttccagaaggccgtgctggagaaccaggccgcgctcaacgcggcgatggccgacgtgatgaaggccgacgcaggctcggaatcctggctcgcccgctcggcccggccgatcgtggtcatctggtcgctggtgatgatcacgtggtgcggcgtcgttgcgccgatgctcggcgtccagaaggaggttttggccgcgctccaggccgtgccgtccgacctgtggtcgctcgcgagcgtcggcatcggcgccttcatgctcgcccgcaccgtcgagaaggtcgccccggcgatcgccacccgcaagtag

SEQ ID NO: 9356 - DNA, 1254 bp, Methylobacterium sp.
atggaacagaggacggccaaggggccgggatcggcgtcccgtttcgaaacgctcgacgcgctacggggcgtctgcgcgctcgcggtcgccttcttccacatgccgttcgcgcacccgctgcacggcgcgccgcgcttcgacaacgtgcaattctgcgtcgacgtgttcttcgtgctgtcgggcttcgtgctcctccacggctacggagggcggctggcgagcccgcgtcaagcgctgcgcttcatgctggcccggttcgggcgcctgtggccgctccacgccgcgacgctcgggctgctggtcgcgctggaggcggcgcgcctcgtctacctcacgggccatccgggcacgccggtggtgacgccgcccttcggcgcggcgcatcggccggtcgaggtgctcacccacctgctgttcctgcaggatttcctcaccttcggcgagttcagctggaacttcccgtcctggagcatcgcggtcgagttctacgcctcgctcgcactggcctgcaccgtgatgctggcggggccgcgggcgcgctggaccttcgcgggtctggccctgctcgccgccctcgccctgcacgcggcgagccccgggaccctgttcgcgatccaggactggggcatcctgcgctgcctgttcgatctgttcgtcggctgcctcgcctactgcctgcgcgacgcggcgcgcgtcccggaccgctgggcgggccgggccgaggccctggcgctcgcccttctcctcgcggtcgccaccctggttccgccgggagactgggcctacggggcgcccctcgtcttcggcgcggcgatcgcgctgttctcgcacggccgcgggaccgtctcggccgcggccaggcacgggctgccccagacgctcggccgctggtccttctcgatctacctgctccacctgccggtgctgcaggtcgtcctcaccgggctgcactacgcggtgccccgctcggcgggcctcgcgcccgacgcgggcgtcgatctcggcggctcgctcgtgaatctcgcggcggccctcggcatcgtcggcgccgccacgctcctggcggggctgagctaccgactcgtcgagcagccggcccgcgcccggttcaggatgtccgatccgcgaacccgcaccggtcggaccggccgcgtgtctcagattgagaaggcgtcgcccccgccggcctgcggggattggtcaccaatcggacagtatttctggagccgagcagtgttgcgtcgaccggagtga

SEQ ID NO: 9357 - DNA, 858 bp, Methylobacterium sp.
atgcgcgtcgtcgccattctcgccagccacaacgaagaggtctacgtccgggcctgcctggacacctacatcgcccagggcgtcgaggtgtacctgatcgacaacgactcgacggatcgcaccgtcgagatcgcccggacctatctgggccgcggcctgatcggcatcgagcggtttccgcgggcgggccagttcgagctgctgcccatgctccggcgcaaggaggagatcgccgacgcgatccgggccgactggtacatccacgccgacatggacgagatccgcctccccccgcgcgggcagggcacgctggcccgggcgctccgggaggtcgaccgggcgggctacaccacggtcaacttccgcaacttcctgttcatgcccccgcgggaagagcccgaccacttccacgcgcgcttcgtggagacgatgcgctggtaccgctacatggagccctcctacccgaaccaggtgaagggctggaagcggcagaagcacttcacgctcggagagcggctgcgccgccttctcttcgggctcgaggcccggccggggccccgcagcgtcgacctcgcgggcacgggcggccaccgcgtccacttccccggcgccacgctctgcccggacgacttcatcctgaagcactatccggtgctcagcctcgaccacgccgtgcgcaagtacgtggagaagacctacgcggagaccgaggtctcggtgggcttccacggctggaaggcgcgggccgccgcggtcgacctgcgcctgccctcggtcgcggagctgcgcgagttccggggcgacgccgcgctcgacatcgccgacccgatcacccgaacgctgatctacgccgcctga

SEQ ID NO: 9358 - DNA, 1623 bp, Methylobacterium sp.
atgaccctgcaccagcatgcggctcgcgccgcactcacgctcgctgccctttccctgaccacgccggctttcgccgcaccggggcagaccgccggcctcaacctgacggcgatcgtcctcttcctcgccttcgtgctgctcacgctctggatcacctggcaggctgcccagcgcaccaagtcgaccgatgatttctacgcggccggcggcaacatcacgggcttccagaacggccttgcgatcgcgggcgacgcgatgtcggcgggtgccttcctgggtcttacggcgcttgtgttcacctcaggcttcgacggtctgacctacgccatcggctacaccaccggcatgccgatcgtggtgttcctgctcgccgagcgcctgcgcaagcttgggcgctacaccttcaccgacgtggtgtgcacgcggctgtccgaggggccgatccggatctttgccgcctgcgcctcgctcgtcgtggtcgccttctacctcatcgcccagatggtcggcgccggtcagttgatccagctcctgttcggcctcgactacgcctacgccgtcttcctcgtgggcgtcttgatgatctgctacgtcatgttcggcggcatggtcgccaccacctgggtgcagatcatcaaggccggcctgctgctcgccggcgcgacgctgatcgtggtgctggtgctggtggcgttcgggttcgactacggggccctgctcgcccgggcgacggcggtccaccccaagggtgccgccatcctcgccccccaggccgcctcgcgggatccgctctcggccctctcgctcggtctcgcgctcatgctcggcaccgcaggtctaccgcacatcctgatgcgcttcttcaccgtgccggatgcccgggcggcccgcgtgtccgtgttctgggcggcgacgttcatgaactacttctacgccctggtcttcgtcctcggcttcggtgccctgaccctgaccgcggccaatccggactacgtcgatgcggccggtgcgctgcgcggcggcggcaacatggcggcgatccacctgagccacgcggtcggcggcaacgcgatgatgggcttcatctcggcggtggccttcgcgacgatcctggcggtggtcgccggcctgacgttggccggtgcctcggcggtcagccacgacctctatgcaggcgtgatccggcgcgggcagctcgacgagcggagcgaggtgcgcatctcacgcatcgcgaccttcgtcctcggcctggtcgcaatcggcctcgggctcgccttcaagggtcagaacgtcgcctacatgatcagcctcgccttctcggtcgcctgctcctcgaccttcccggtcctgctgctggccctctactggcgcggtctcaccacggcgggcgcggttgctggcggcacggtcggccttttgagcgccctcggcctgacactgctcggtccggcagtctgggtgaaggtgctgggcaatccggctccgatcttcgcgatggacccgcctacgctggtgacgctgccgctcgccttcgcgacctgttggctggtctcacgcctggatcgaagtgcacaggctgcgcgcgaccgtgcccgcttcgacctgcagcaggccgccacctga

SEQ ID NO: 9359 - DNA, 516 bp, Methylobacterium sp.
atgactgaacctgagcagatagcccggctgcgcatcagcctcgaaggcatcgagccggctatctggcggcaggttgaggtgccccttactgcgacgctaaaagccctgcacgacgtgatccaagcagcgttcgggtgggagggctaccacctccatcttttccaggtaggtgaggagcgctacggggcgcccgacccagagtgggagggtctgcggccgattcgcccggagaagggtatgcgcctcgctgtcctgatcgagcgtggggttacgagcttcacctacacctacaacttcggcgacgactggcggcacgagatcgtggtcgaggcggtcgaggcagcggacccggctcttgagtacccgcaccttgttgctggcgcgcggcgcgccccgcccgacgacgtcggcggcgtataccggctacgaggagttcgtccgcgcgatgacccggccaccccatcgggagcacaaggccatggtggcgtggcacggtggtccctacgatcctcatga

SEQ ID NO: 9360 - DNA, 276 bp, Methylobacterium sp.
atgcgcaacgatgccgaatctccgggatggtccccggacctgctgagcgcccaggcactgcgcgtgcaggacgccgccctgatcctcgcggacgaatgcgtccttctctcgctgggcgcgcagatggcgtggctcgatctctggatgcgcccgctcctccaggcaagcgctgagatgcaggtctggcaggagcggcaggccaggactgcgcggctgatgcggcggggcatacccggcccggtagcgcgcgaggggcttcacctgctgccgagctga

SEQ ID NO: 9361 - DNA, 2217 bp, Methylobacterium sp.
atgcagatgaacgccggatcttcgcggcggccctggcggattctcgcccggccggccgcacgccgtccgcgcgtggcgggagccttccgccggctggtgccggttctggcccgtctcacggcctgcctcgccctcggcgcccacggggccgcggcgcggaccatcttcgtgacgccgaccggcgccgggccgggctacgccgccgatggtcgcctcgtcgccgagcgcaccgagtccttctcgacggacacgatgcggacggtcctgccgggcgacgtggtgcaactgctgctcgacacgcccgatccggccgcgacgacggtctaccgcgcgcacgtcgtcctgtcccggaagacgagcctcgcgcccgccgcgatcgtgatccgcggcctcgggccccggacccggctggtcggccggagcgtcgagcaggtccgcgactgcccgatgccggaggacggcgccgagcgcgcctgcggcgatctctacagcgccctcgcggcggccgagacgccggatctgctcgcggcgctgttcggctcggccgccgtccgggccacgccgggcgagcgcgcggccggtgcccggcccgccatcccgatcggcaggaccgggcgactggccgaggcggcctgcctcgacctcgaccgggtcgacggggtcgtcgtcgaggacctgaccttccaggattgctggctggtggccgtgcgcgccctcggcagccggcgcgtgaccgtccgccgtgcgctggtcgtcggcggcagctacgggctggccgcgcgcgggcgccccggccagcccgccgaccacatcaccgtcgaggacgtgacgtgggtgcaggacgcgagcggctacgacgcggcgagcctgagccgcgaggggccgttccggtgccgggacggccgcgagacggcgttgggctgcccgggcctgatgtggcggagcatcccctggggcgtcagccatcacggcgtctacgagcacttcaacggcgcgctcctcgggggcgccgatctcgccggcccggtcgtcttccggcgcaacacggtcctgtccgcctataacgggatccgcctcaaggcgagcgcctgcgaggatctcccggcatcgagcctctccccggcgacctgcccgtacaatgccggcctctggatctccgagaacctgttctcgtacctccgcgacaacccggtcgagctggagacctgggcgaccgacgcgcatgtggcccgcaaccggatccacaacgcccacgcctggttctcgttcgacgacatggccggcggcccggtctacgtctacggcaaccgcggctggttcgacgacatgccggcgctcgcatggtcgggctcggcgcccggcggtgccccctgccgccgccggcccgtctcggctccgcccgatgcggcgggcttcgatccggttctcgaccgccggttcgactatctcaaggcgcgctggctcccggtcggcgtcgaggcggtcgacgcctccggccgggtccagcggatggatgtcgaggagcaatcctgcgaggcgagcgtcgcgggacgcgtcgtcaagctggcgctgccgccgcggggggcggccccggacacctaccgctacccgacgcgggggccgatccacctcttcaacaacagctggtacctgcgcgcgccggtcaccgggatcggcgcggccgccaacctccggcactggaacaacgccatcctgttctgcgagccgggcacgccgggctacgcgcccgaactctgcgaggcgcgccccgagacgttcgacgcggccgcgtgcgggcgggagttcgtccgggcggacggaatcggccgcttccccggtgcgcggggaagccttccgttcttcgattgcttccgatggctgcccgtggacgagcgcggacgggatctgccggaccttgccagcacgttcgaccacgacatcagcagcaacggcttcccgcagggtttcggcgggccggcgacgttcgagctccagggccggcagggcgatcccggcttccgcgcgcccgagcggggcgacttcaccctgctgcccggtgcgctggcgcggacctccgcctgccgcatcgaggaggccgacgacggacatctcgactgccggcccgtgccggccgacgccgccttcgccggagccgtcgcgcccgacggccgcctctacgagcccccggcctcgccccgcttccggcccccggactga

SEQ ID NO: 9362 - DNA, 1647 bp, Methylobacterium sp.
atgacggaaacgctgaaactcacggagttcgaggccctgagcccgttcgagatcaaggacgagctcatcaagctcgcgaaggcgacgtcgcggcgaacgcagtcggccttcctcaacgccgggcgcggcaacccgaactggatcgccaccgcgccgcgcgaggccttcttcctcctcgggcagttcgctctcaccgagagccggcgcgtgatgagccacccggccggcctcggcgggatgccccaggccggcggcatcgccgcgcgcctggagggctggctcgccgagcgtcccgacacccctggcgcgccgttcctgtcggccatggtcccctacgcggtgacgacattcggcttcgagcccgatgccttcgtgcacgagctcgtggattcgatcatcggcgacaactatccggtgcccgaccgcatgctggtccacaacgagcggatcgtgcacgaatacctgatgtgggcgatgtgcggcgggcagaagccggcgggccggttcgacctctacgcggtcgagggcggcacggcggcgatgtgctacctgttcaagtcgctcaaggcgaaccggctcctgatgcccggcgacacgatcgcgctcggcacgccgatcttcaccccctacctggagatgacgcacctcgaggactacgccctgaacgtcgtccacatcagggccccgcaggagaacaagttccagttcccggacgaggagatcgacaagcttctcgatccgaagatcaaggccttcttcctggtcaatcccggcaatcccaccggcatggcgctgagcggcgagacggtcgcgaagatcaccgagctcgtgcggaccaagcgtcccgacctgatgatcctcaccgacgacgtctacggcaccttcgtcgagggcttccgctccctgctgggcgagctgccgcggaacaccatcggggtgtactcctactccaagtatttcggctgcaccggatggcgtctcggcgtgatcgcgatccacgaggacaacatcttcgacgaggcgatcgccgccctgccggccgccgagacggcggccctcgaccggcgctacggccccctcacgctccagccgcgccagctcaagttcatcgaccgcatcgtcgccgacagccgcgacgtggcgctcaaccacacggccggcctctcgctgccgcagcaggtgatgatgagcctgttctccctggcggagctgatggacgagcggaaggcctatcaggccgcgtgcatggagatcgtccaccggcgggtctggtcgatgatcgagggcctcggcctccacctcacgccgaacccgaacttcgacgcctattacggcctcatcgacttcgagttctgggcgcggaagaacatcggcgacgaggcggtcgagtatctgaaggcgaacgtccatccgctcgacctcgccttccggctggccgaggtccacgggatcgtcctcctcaacggcggcggcttcgaggcgccgaactggtcgctgcgggtctccctcgcgaacctgccggacgaggtctacgacgatatcggccgcggcgtgcgggccgtcgcgcgcggctaccgggacgcctacgaggcgagcagacggacggcgcagacgcgggcggagatcgcggaagcgccggccgagtag

SEQ ID NO: 9363 - DNA, 300 bp, Methylobacterium sp.
atgaacacagccgtcttccgcgtctcacagatcgccatgccctgcgtcgggctgtggttcggcctgcgcacctacgcgtggctcagcgcgcatccggccgtctacgatccgctcagcgggtccgtcagcatcggcgtcgccgtctggctgctgggcggcgctctcgtcgtcgcgctctccgaggcgatcgcgaaggcctacgccgatgcccggcagacccgcacgcgtcccagcttctacgccatgctgatcgccgccgcctcgctcgcactcggcgtcctcagctatctcaccaagtga

SEQ ID NO: 9364 - DNA, 540 bp, Methylobacterium sp.
acggcgctgggcgacggcaagatcctgttcagcgccagcaccgcggcgaacggccaagagctgtgggtgacggacggcaccgacgcaggcaccaccctcctcaaggacatccgcactggctccggcagttccgccccgaccggcctcacggcactgagcgacggcaaggccgtgttccgggccactaccccaacgcatggcagcgaattgtgggtgacggacggcaccgccgcaggcaccaccctcctcaaggacatccgcactggctccggcagttccgccccgaccggcctcacggcactgagcgacggcaaggccgtgttccgggccactaccccaacgcatggcagcgaattgtgggtgacggacggcaccgccgcaggcaccaccctcctcaaggacatccgcactggctccgataacaatgtgatggccggtttcacggcactgggcaacggcaaggccctgttccgggccaccaccgcaacgaacggcaccgagttgtgggtgacggacggcaccgacgcaggcaccaccctc

SEQ ID NO: 9365 - DNA, 393 bp, Methylobacterium sp.
ggctttactacgctgggcaacggcaaggtcttgttcagcgcctacaacgcgacggacgggcgagatctgtgggtaacggacggcacagccgcaggcaccaccctcctcaaggacttcaatacagggtttgctcattcccagccaaccggcttcaccgcgctgggcgacggcagggtcgtgtttagcgccagtactgcgacaaacggccaagagctgtgggtgacggacggcaccgctgtaggcaccaccctcctcaaggatatcaacactggatctgacgactcccagccgaccggctttagggcgctgggcgacggcaggatcctgttcagcgccagcaccgcggcgaacggccaagagctgtgggtgacggacggcaccgacgcaggcacc

SEQ ID NO: 9366 - DNA, 1206 bp, Methylobacterium sp.
atgaccgatgccttcatctgcgacgcggtgcggacgccgttcggccgctacggcggcgccctcgccgacatccgggcggacgacctcgccgcggtcccgatccgggcgctcatggagcgcaatcccgcggtcgcgtggggggcgctcgacgacgtgatctacggctgcgccaatcaggcgggggaggacaaccgcaacgtcgcccgcatggccggcctcctggcgggcctgcccgtcgaggtgcccggggtgacggtcaaccgcctgtgcggctcgggcctcgacgcgctcggtgccgcggcgcgggcgatcaaggccggcgaggccgatctgctgatcgcgggcggcgtcgagagcatgacgcgcgcgcccttcgtggtcggcaaggcccggagcgccttcgcgcgcgacctgagcctgcaggacaccacgatgggctggcgcttcgtcaacccgcggatgaaggccctccacggcaccgacgcgatgccggagacggccgagaacgtcgccgaggattacggcgtgagccgcgccgaccaggacgccttcgcgctccgcagccagcggcgcgccgccgccgcgcaggcggcgggacggctggcggaggagatcgtgccggtcacgatcccgcgccggaagggtgagccgctcgtggtcgcgcgcgacgagcacctgcggccggacacgacgccggaggcgctcgcccggctcgggggggtggtaggccccgagggaagcgtgaccgcgggcaacgcctcggggatcaacgacggggcggccgcgctgctggtcgcgagcccggcggcggcggagcgccacggcctgcggccgcgcgcccgcatcgtcgccagcacggcggccggcgtcgctcccagggtgatgggcgtcggcccggtgccggccgtgcgcaagctccttgcgcgcaccggcctgagcctcgcgcagatggacgtgatcgagctcaacgaggccttcgcggcccaggcgctggcggtgacgcgcgaactcggcctgcccgacgacgcggcgcaggtgaacccggacggcggcgcgatcgcgctcggccatccgctcggtgccagcggggcccggctcgcgatcgcggcgctgcgccagctcgagcgcggcggcggccgctacggcctctgcaccatgtgcgtcggcgtcggtcagggcatcgcgctcatcgtcgagcgcgtctga

SEQ ID NO: 9367 - DNA, 2202 bp, Methylobacterium sp.
atgaacatcaatcctgctcctctccgtttccaggccggcatgcggccgagccctctcgcgttcgcggaccgccgatccaagacttggacgatcacgcaggtcgtcgatgcggcggtgcgcagacgccggaccgttgcgctcgtcacgctggcgtgtttcgcgatcgcggcagcctacgcaaaccttgcggcgccgacctatacctcgatggcaagtgtcgttctggacacgaagctgacgccgccatcgccgggtacggtatcctccgagacgacgattgatcccgccgtggtcgacagccaggtggagatcctgaaatccgacaagatcgctctcgatgttgtcgaccgcctgaatctcaccagggattcggagttcgtgggctcgaagccctcgttcgtccacgccctcatcggccgcatcatggcgctcttcgagccggacgcgggcggggccgtgcggacggacccgcgtcaagccgcggcggcagcgctcagccgcaaggtcaaggtcacccgggccggccgcagcatcttggccgagatcacggccacgagcttggatccggccaaggcggcggcggtcgcgaacgcggtcgccgaggcctacatccaggatcagctgagcagccggatggaggcgagccagcgcacgacggactggatgcagcggcgcctcgccgaggtccgcgaacggctcgatgccgcgaacgcggccctggccgcctaccgggccggcgaggacgacggcaagagcggcgtcggcggcacccgcgccgagcgtgaaggagcccgtgcgcgcgcggccgacgctctgacccgcgctcgggccgatctcgaccggagcgcgcagctccgcgccgccgtcgcgcagggcgatcccggcagcgagaccctcgaccagatcgatcggctcggcgatcccgcgctctcgaagctggtgaccgagcagcgcggggccgctccgggcgccgcagtgctccggacgctcggcgagcggctggacgcgcgcgtcgaggcccagcgcaaggcggtcgccgcagcggagctgcgcgcgacgctgctcgacaagcagattcaggatctccggtccgacggctcgagatccgacgttcccaggacggatgacggccgcgagcgcgcgctcgagcgcgccgcgcaggatgcccagggcaactacgaggcgctgcagaaccgggtgatgcgcgtgagcgccttcctgcagcagcaatcgatgccggtcacggaggcccgcatcgtcaccacggcgctgccgccgctctccaagagtgcgccgaaatcctcgctgatcctccttctcggcctgatcgggggcatcggtgcgggcgtcgcggcggccttcctgaaggatgccctcgaccggcgtgtacgctggtcgcggcagatcacgcacgagctcggccagccgtttctcggcaccctcgaggcctgcccgacccgcgcgcgcgagttccggcacgcggccgacggctcgccggggtccgaccgccgcctgcccgtccccctcttcatcgcgaacgggtccgggtcgcccgcggtcctggagaccttgtgcaccacgaaggtctccatcgatcaggccctgcaccgcgaaacctgccgcgtcgtcggcgtcatctcggccaacgcacaggagggtaagaccacgctggtcacgaacctcgccgtgctgctcgtcgagatgcgcgcccgggtcctcgtcatcgacgccaaccttcacggatcggggctcgccggtctcgtcgagggcgatcccggtccggggctcgcgcgggcggtcacggagcgccgcgctcttccggagtgcgtggtcgcgacgccgctcggcttccacctgctgcccggcagcgtcggcccggttccgaaccacccggtcgagatccttggctcggccgctctgcggcagctgctggccgaggcccgcgaccactacgactacgtgctcattgaggtcccgcccgtgctctcggccgtcgatgcgcgggtcgtctcggatctgatcgacgccttcgtgctggtggtgcggggcggccggaccaagcgcgacgaggtcgagcatgccttcacgacctgcccggccatcgccgaccgcatcgtcggcgtggtgatgaaccgcacgaagtccggcgagcgccccgcgccggcaagcgccgcaccgtcctacctgcagggagccgcctga

SEQ ID NO: 9368 - DNA, 930 bp, Methylobacterium sp.
atggacctcgcccagctccgcaccctcgtgcacgtggccgagctcggcagcctcagcaaggccgccggccgtctgcggatcgcccagccggcgctgagccggcagatccgcctgctggaggacgagctcggtgcgcgcctgttcgaccggcacggacgcggcatggtcatcaccgaggccggccgcgaggccctgcgccacgccaagcgggtgctcgccgagaccgaggagctgcgggccagcgtctcgggaccgggcgccgaactcaccggccacgtcgcggtcggcctgccgcccacactcgccgacatgatctcggtgccgctggtggcggccttcggcgccacgcatccgcgggtgcggctccagctcgtggcggcctatacgggctacctgctcgacagcctctaccgcggcgagatcgacctcgcggtgctctacgacccccgggcgccccgcagcctgcgcatccgcccgctgatgcaggaggccttgttcctgatcggcccgggcgatgccggcctcacggccgaggaaccggtgccgttccgggcgctcgccggccagcgcctcctcctgccgagtacccggcacgggctgcgcaacatggtagagcacttcgccgacgaggccggcatcgccctcgacatcgccctggagatcgacagctacacggcgctgaaggacctcgtgcgccagggctacgggcgcaccatcctgacgcgcgccccgatgcacgaggacatcgcggcgggccggctcaccgcggcgccgctggtcgaccccgccccgatccggcggctcgtcctctccttccagcccgaccggccggtctcgcgcgccgccgagttcgcgggcgcggcgatcgccgccatcatggcagagcagctcagccagggcgtctgggtcggcgagatgctggcggggtga

SEQ ID NO: 9369 - DNA, 312 bp, Methylobacterium sp.
gtgcgcacgctgatcggcccgatcgccgctgatgccgcgttcgccggcctccatcccgcccgcggccggcccgcttacgcaccctggcgcttggcccgcgtcccgctcctgcggttccgcgaaggcctcggcgaccgtcgggccgccgatgcggtccgggcgcggatcgcctggaagtacctgctcccgaccggctgcggagccgcgcccggcccgagtggcacgcgcgctacgctcgccgcatcgacgatgcgcgcccgggcatcgcgcgcagcatcccgatggccgcagcagcgcagcgacacgacctga

SEQ ID NO: 9370 - DNA, 1389 bp, Methylobacterium sp.
gtgtcgctctggctgcaggacctgagcgcactcaaggaccgcctggaggactggcgcgcggccggtatgaccgaccttcgcacgtggctgcgggaccctgagcacctgctcgccgttcagatgctgatccggatcgagcgcgtgaaccggcagacgctccggctctatgaagcccgcgacgaggcggagctgttcgctcacattccggcgatcttcgacgatccgcgcgcagacgccctggtcgaggtgttgtgccagctctgggcgggggcgacgcaggcccgcctcgtcacccgaaacaggaccgtcgccggccgcgttctcgacgtgagctacgcgggccggatgctgcccgggcacgaggcgagctgggcgcgtttcctgatctcggtcgaggacatcacccagcgcgaggagatgcgccgccgcgaggacgcgctggcgcgcttcgccgcgagcctgttcgagcgctcgcccgtgccgacgctggtgcgcgacgaatccgggctcgccgcgatgctggcggacctgcgcgcggccggcgtggtcgatctggcagcccacatggccgcgcatccggactggacggaggcggcccgcgcgagcctcgccctcgtcggcgcgaacgcgcccgcgctcgccctgttcggtgcggcggatggcgacgcgctcgcccatcacgtcgccgtgggcctcggtgcggaggcgcggcgggtcttcgccgaggaggcactggccctctgggccggggcgggccacggggtccgcgacgtcctcttccggcgcatcgacggcggtgcgctccacctcaaggcgcagtacgccgagcttccgggccagggcgacgggcgccgcctcgtgcagatcgcgctcacggatatcggtgcgaacaagcgcgccgaggcgcgcctggagaccctgagccacaccgattccctgacgggcctgctcaaccgcgcggcctacgcggcgcatctcgaacggctggaggccgagcggatcgtgccgacctccgtgatcgtcgccgacttgaacgggctgaaggccgtcaacgaccgccgcggccatgatgcgggcgacgcgctgatccgccgcttcggtcgcgtcctggcggccaggacgccggcctcggcccacgcggcgcggatcggcggcgacgagttcgcggtcctgctgccgggcaccggcgccgagggcgctgccgcgctggccttgcggatcgccgaggggatcgagcgggcgaacggcggcgccgacatcccgctcggcgtctcgctcgggatcggcacctggaccggcgagggtccgctgaaggcggcggtcacccgggcggacgcgcggatgtacgcggccaagcgcggccgccgcggccgggtccgggtagcctga

SEQ ID NO: 9371 - DNA, 255 bp, Methylobacterium sp.
atgtcggatgaaattaccttggttgctgagcagtgccgcgccgcccgggccctcatcgggtggtcgcgcggggagctgtcggagcgctgcggcgtggccgcctcgacgctggcagacttcgaggcgggcaagcgcgcgccctatccccgtacgctggccgatgtgcgccggaccctggaggaggctggcgtcgccttcatccaggccagcgtggacgggggcgcgggggtcaggctcaaggccggcgtcgcctaa

SEQ ID NO: 9372 - DNA, 1185 bp, Methylobacterium sp.
atgacgctcgaagaagctctcaaggttgcttctgattttatcgaggcccaggaccccgggaatgctctgaatctctatcagcagattgcgaatcgcatcccgacgcatgtcgaggcgcggctgggcatggcgaaggcctttctgttgcaggacaagtcgttgcaggcgaaatcgaccatcctcaacgtcgcgatcggcaacgctaccgacgccgccgtcctgtcggattgtgcgggcatcctcgaggcgagcggcttccatgacgaagcggccgccgtccgccagttgctcgtggacctcggcaacaacgtgagccggatcctgaatctcctgagcgacgacctgtccatgatcgacctcggatcgtccgggcaggccgtcattcaggctcccaactggatcgcgccgaggatcgccttcacctccctcgatgcgctttccgtcggcagcaaccattctcgtttcggagcctatcaccccgtgcgcgaggtgatcgccccggaggccggacccgctgtgtttcacgagcgcgcgttcctgccctgttcgtctctcctggacatcgaccatgagacgttcagggcgttcggccttcaggatctgagtgcgatcgtgaagtctcatgaggtcgtcgccacgaccctcgccgatgtccttcgcgacgcacggatagaccggatcgactatatcaagaccgacctcgaagggatggacgagagagtcgtccggagcgccgaaagcttggtcgccggcgccgccgtcgttcagatggagcttcgcttcctgccgctgttcgagggtgagccctacctcgatgagactgtcgcctacatgcgcggtcgagggttcgaggtgctgcatctcagcacggagacctggcgctacaacacggagcaccgagattatacgcaaagaggtagatcaatatttgcagacacgacattcatcaagaatttcgaggcgtactctctcattcatggcaagagcgatgagactgtggtgaggtattgcctcatttgcctgctgtccggaaatgtgaattacgccgagtacgtcatcgaaacacatggcgccctcgtcgacccgagcgtgagatccgcgttgaagttcctgatcttcccgctgggcaacgcgcagcccgcaccgtaccggcgcgagtccctcgcgcatgtcggcttcagctag

SEQ ID NO: 9373 - DNA, 2433 bp, Methylobacterium sp.
atgagtgaggtgctctcgtttccgcctcccgctgcggcggcccggcgcggctggtcgcagcaggaactcgcggaattctaccgggtcgaggccgcgctggtccgggccgggctgccgatcgacagcgagcagggtctcagcgacgaggcggagccgtggttcgtcttctgccgtccggacggtgcgcccatcatgcatttcgcgcggatcggcgggcgctacctggttgcctccgaggtgctggacagccccctgtggggcgacgatttccgcggccttatcaaccaagtggcgctgcgccatcccgagcttctgccgatccggcagggtggcgacggtacgcgggtcaccgtccatccggccgccctgctcgcggcgctggtggctgccgcgaccgtgatcctgtcatccgaggatgccgaggccgccgtgttgggcaacgccgcggcgcccgtgcccgccggccaactcgaacaggctcccccgccgcgtacgggaggctctgccggtccggccgaggcggaagagcgggacagccatcgcatgcagttcgaggcgctcgtcgtctcggccatgatctttgctgcctttgcggcggaggaggcggagtcgagagccgggctggagtcgctcgccgatccgcaggtgcgcaccgcgacgcagcaggatgccccggctgatgctgggtcgtcagcgtcgctggacggtgcggtccacaggtccggcccgggcacgcagcaggcgcagggaacggccggcgcggttcccgctggctccggctcggccgcacaaccgggtgcggccgccggtgtccgccccgtgggcgccgaggtcgggccggacggccccgaaagggcggcgcccgcgcccggcggctcgctcgcggcggcggagccgaacggccatgtcgtcctccggcccggcgaggcggggccggcccgggccgcgggatcgcctgcatccgtcgagcctggcccggagcggagcgcggcatcgtccagcgccgccagcttgggggacgcggcgggctccccgcgcgcgggcgcggacgacaccgctgtgcagagccagccgcggagcgtcgcgcatccggtccaggacgcggtctcgggcgggacggctcggatcgagcgcgtccttcaccgcgatgcggacaagggtgcgaccgaggccgatgaggcgggccgcggagcggccaagggtatcgagggggagaagggtatccgaggggagaagggtaccgaaggagcgaagatcgcaggcgatggccacgctgggagggggcccgcggagcgcccgggcgagtcctccggcaaatcggatccgggccgccgggacagcgacgacgatctcgaccggggcggcgacagaggtgacgaccatggcggtccggcggcggcccgcgggcagcacgctgtggcgtcggccgatgcgcccacggcggagccggatgccatctcccaggacggtcgcggcgattcccgacccgccaacggcagcgacaaatccgatccgagcgagcatggctccgggaaaccaggcgcctcggcggagtccgcatccgcgtcgcaccccgcgacgcaggcgtccgagacccaccccgcacagggcgccgagccatcgggcaaggccgcgggcggggccgagcagtcctccgggcacggcgcggacgcacccggttccggcgagcatggctcggagaaggcagccgctgcctccgcggcgcacgcggagggcggaccaagcgcggcgacccattcgccgtcttccgggtccggacgcgacggcaatgttcccagccagcacggcgaggacaagctcgctccggccgggcagggcgaggcgcgaccgggtgcttcgggcgaagctgcatccgcctcacacccgcacggcgaaccgacccatgcggacgaagccccgagcgccggggcgcatgggcgcggctctcacggacccggccagacgaccggcctcggcacggacagcgcggctccggatccgcgcgacgccgcgggcaaatccgcagccgcctcccatctcgcggaccgacctctcgacgtgaaccgaaagccggacgccgggaatttggagaccgatgccggacacggccgggccgccgatggcgccgtgctcgctcagcagccggatcctgcggtgcacgcccccgctgcgtcgcatcagaccccgccacagaccgacgacggatcggtgcagactcgaaacgctggcgcggcctctgctcagggcccgggaaaggcgctcgcggcgagcgtcgatgcgcacggcaacatcgtgttcccatccgatcccgggcatgactcagctccggcaccgggccacgtgcaggtgtacgatggcgcgcacgccgaggtcggtctggtcgggctggcggaccatcccgggcagatgtatcacctcgatctccacgggtga

SEQ ID NO: 9374 - DNA, 411 bp, Methylobacterium sp.
atggatgagagcgaaatacacacgctcgccttcctgctggatttcgacggccgagtgcactggtacgagcagggctacttcgtgaagttcgagatcaagcggatcgaaccgacgaaggaacggcctcacgggctgcgctactcgttcacgctacatgcgccggaaggcgagcggatgatgggcttcgacaatgcccataccattgcgccgggaagccggtatgcgaaacgccaggtggaggcggaccactggcaccgcgacgaaaccgatcggggccggccttatacgttcacggacgcggcgaccctggtcggcgacttcttcggggaggtcgaacggattttgacggagcgcggcgtcccgctcgacgccgtgagagaagggaccattgaagaaaggaccaagccatga

SEQ ID NO: 9375 - DNA, 852 bp, Methylobacterium sp.
gtgatttgcgacctgtggagcgagggctgcaatgccgccgccgtgttggacctgatcggcaagggcgcgcacatcaggacggtcgagggcttccacgccaaaacctacctgtattcggaccgggttgtgctgggctcggcgaacgcatcgcggggcggtttgggcgccgagagcgagccgtcgacccggacggaaactgcgctgtggtgcgacgatgccgctgtgctggaagaggcgtccagctggttcgaaaccacttggctgcggggcacgcctgtcgatgctgtgatggtggaggcggcgcgcgacgaactcgcggccatcagagacgcccggcgcatatcgctcctgcacacgctagcgcatgagccaaagccgttcgacggcctcgacgtttatgtcacgctctatgaggatgaaggcgtcagcgaggaagcggagcaaacctgggacgtcgttcgaggcaagtatggcgccgatgatcgggctgcctatgaggcgcgcggcgaatggccgttctatgaggtcgcaggcgaccagctcgaaaactgccctgaaggcaggatctacctcgacttcacccgcgggaagaagggcaagctgaccttcaacggcatctggaaagtgcgcacaggcggccacgagccggttggcgacacgggtcgtttccttgtcctgctcgaccgcctgccgagcatacacgggcgccggatcatcgatgctgagatgaaggcgttcgctgctgccctggcaagcatttcatcggaggatcgggcagtcagttcgaaggagatccgggaggctgcccgccaagcttttcaggctgccgccaagcagccctctggcaagtaa

SEQ ID NO: 9376 - DNA, 516 bp, Methylobacterium sp.
atgatctacgtcgcgccggaggttcacagggccgtcaggcagatcgccctggacgaggatagatctacgagcgagatctacgtcgaggccgcacgagccttccttgcccatcggggagttgctctccaggggcatccagtacccgcagctaaggtcgagcccgaaccatcacgtcccattattgctccgtccgtgacgacggatgacatcgccggtctcatggatgcgctcgcacatcggatcgaagcggtccttgagcgcgcggtcgaacgggtcgggtccccttccaaggacgacccgtcaccgccggctgggatcaggacggcagatgccatgacagccgtcctccggatgctgcgggaagccggttcggatggcatcggcagcgccgagctggatcaggccttgcacgcggcccgcattcggtcagggaccgcagagcaggccaaggcggttctgcgggacgctggtttggcgcgctacgaaaggcgtcgctggtactcggcgagcggctga

SEQ ID NO: 9377 - DNA, 327 bp, Methylobacterium sp.
atggcctcgcagctctccctccccatgccgacgcccggcgtcacgtccgaggacgaggctctcgtgcgggccttcgttgccgacatcctgcctcgggacgtgccgacgtacgtgaggcgcgtgctcggggttgcctcggacaggtacggattcgtcgcccggatcgagcttccggacggcggctggtgcgacgtgaccatcaccggccgcctcggcgaggggggttacgcatggtccttccccgacgggggagcgccgttcggctgggacgaacgccgtcggaagtgggtccgctacccgaagctgaagaaggcggacgacgggtag

SEQ ID NO: 9378 - DNA, 165 bp, Methylobacterium sp.
gtgaccgccgtgaccgcccggcaggcatgggctcgcgccgcgaccgaggacgagatcctcgccgccgggatctcgctccccgtcgccctggtgggcgccgatctgctcgcggccatccgggccgaggcggccgaggacgccgccgccgcgcccgaggcagcctga

SEQ ID NO: 9379 - DNA, 840 bp, Methylobacterium sp.
atggcgctgatcctgatcctgatcgccgtcggctccgtggcgttccacctgtcgagcccgtggtggtggacgccgatcgcgtcgaactggagctacatcgacaccacgctgatcatcacgttctggatcaccggcgcggtcttcgtcggggtcgtgctgttcatggcctactgcctgtggcgcttccggcatcggcccgggcggcgggcggcctacgagccggagagcccgcgcctggaggcctggctcacggcggtgacggcgctcggcatcgccgccatgctcgctccgggcctcgtcgtctggagccagttcgtgcggacgccggcggacgccaccgaggtcgagatcctcgcccggcaatggcggtggagcttccgcttgcccggagccgacggccgcctgggcgccgccgacatccgccatgtcggggacgacaatccgctcggcctcgatccccaggacagggccggccgggacgacatcgtggtcgacgggggcgatctgcacctcgccctcggccggcccgtgaagcttctgatgcgttcctacgacgtggtccacaatttctacgtcccggaattccgcgccaagatggacatcattcccggcatggtgacccacttctggttcacgccgagccggacgggcgccttcgacgccatctgcaacgaggtctgcggcaccagccactacgccatgcgcggccgcgtcatcgtcgaggacgagcccgccttccacgcgtggctcgaccggcaggaaaccttcgcgcgacgcgccgcccggtccaccggcaggcgtgaggccggcctccaccggcccgcgacggacgcgcggtga

SEQ ID NO: 9380 - DNA, 1767 bp, Methylobacterium sp.
atgtcggacgcgatcaccggtccgcagggcggatccagcctcctccccgaagccgacgacctctaccatccgcacagctggtggacccgctacgtcttcagccaggacgcgaaggtcatcgcgatccagtatgccggcaccgcgctggcgatcggtttcgtcgccctggtcctgtcatggctgatacggctgcagctcggattccccgggttggccaccttcatcggcccggccgagtactaccagctgatcaccatgcacggcatgatcatggtcgtgtacctgctcacggcggtattcctcggcgggttcggcaattacctgattcccttgatgctcggcgcgcgggacatggtcttcccgtacctgaacatgctgagttactggatctacctgttggccgtcctggttctcgtggccagcttcttcgcgccaggggggccgaccggcgccggctggaccctctacccgccccaggccatcctcgcgggcacgcccgggcaggaatggggcatcgtcctgatgctcgtctcgctcatcctgttcatcgcgggcttcaccatgggcggcgtgaactacgtcgtgacggtgctgcaggcgcgcgcgcccggcatgacgctgatgcgcatgccgctgacgatctgggggatcttcacggcgaccgtcctggcgctgctggcctttccggcgctgctcgtcggtgccgtgatgatgctgctcgaccgcctgctcggcacgagcttcttcatgccggccatcatcgaggcgggccagcgcctgcgctacggcggcggcagcccgatcctgttccagcacctgttctggttcttcggccatcccgaggtctacatcgtggcgctgcccgccttcggcatcgtctcggacctgatcagcacccatgcccgcaagaacatcttcggctaccgcatgatggtctgggcgatcctggccatcggcgcgctgagcttcgtcgtctgggcgcaccacatgtacgtcagcggcatgaatccgtatttcggcttcttcttcgcgacgacgacgctgatcatcgcgatcccgacggccatcaaggtctacaactgggtcctgacgctctggcgcggcgatatccacctgaccgtgccgatgctgttcgccatcgccttcatcgtcacgttcctgaacggcggtctcaccggcctgttcctcggcaacgtcgtcgtcgacgtgcccctctccgacacgatgttcgtcgtcgcgcatttccacatggtgatgggcgtcgccccgatcctggtgatcttcggcggcctctatcactggtacccgaaggtgaccggccgcatgctcgacgcgcgcctcggccaggtccacttctggatcaccttcctgggcgcctacctgatcttcttccccatgcactatctcggcctgctcggggtgccgcggcgctactacgagaccgccgggctcggcttcgtgccgccatccgccgagacgctcaacgccgtcatcagccttgtggccttcgtcgtcggggccgcgcagatcctgttcctgttcaacctcctgcgcagcctgaggcatggcgcgcccgcgggcggcaatccctggcatgcgacgacgctcgagtggcaaacgccggagacgccaccgccgcacggcaactggggtccgaccctgccggtcgtataccgctggccctacgactacagcgtgcccggcgcgccggaggacttcctgccgcagaaccagcccgaccccgtccgcgcaggggccgtgccgtga

SEQ ID NO: 9381 - DNA, 738 bp, Methylobacterium sp.
atgacccacaccgcagccggagacggcaccgcccttcaagaatcaccctcgaacctgccgccgacgcgccggcaccgtctctcggccgagtgggcgggcgaccggcaggtcttcgccgacgcatcctggcgcaaggccatgatgtggatcttcctgctcagcgacaccttcgtgttcgggtgtttcctgatcggctacatgacggttcgcatgtcgacgcccgtgccctggccgaatcccagccaggtcttcgccatcgagatcgccggcacgccctggcccctccttctcatcgcgatcatgaccttcgtgctgatctcgagcagcggcacgatggcgatggccgtcgcgttcggctaccgccgcagccgccggaccacggcgctcctgatgggcctgaccgcgctcttgggcgccgccttcgtgggcatgcaggccttcgagtggacgaagctgatccacgagggcgtccgcccctgggcgaatccctggggcgccgagcagttcggctcggccttcttcatgatcacggggttccacggcacccacgtcaccatcggggtgatcgcgctcctcgtgatggtccgcaaggtgtggcgcggcgacttcgataccggccggcgcggcaccttcacgagccgcccggggcgctacgagaacatcgagatcatgggcctgtactggcacttcgtcgatctcgtctgggtcttcatcttcgcgttgttctatctctggtag

SEQ ID NO: 9382 - DNA, 201 bp, Methylobacterium sp.
ttgccggaatgcctgacccgcttcctcgacatgccgctccccggcgcaccggcgcccgcggcaccgccacgggtggtgcagccacgggcggtatcgcgccgacacccgaatcgggcgctgcgcggcacgctcgtctgggccctgctctacaacctgatcgggttcacggtcatcgccatgctctggcaggcgatgccctga

SEQ ID NO: 9383 - DNA, 714 bp, Methylobacterium sp.
atgacgagcgctcaatccgccccccggcccgatcctgacccagccgggcaggcgccaccaccgggcgcctcggccttcctcaccgagcttcgggaccggatcggcaccgaggtcggtatctcggcctggatccttgtggatcaggcccggatcgaccgattcgccgaggcaacgggggaccgccagttcgtgcatgtcgatccgctgcgcgccgcggccgagacgcccttcggcggcacggtggcccacggctacctcaccctgtcgatgctcggcgggaccgtcggagaggtccttccggcgcatccgtccgtgcgggcagtgctgaacatggccgccgacaaggtgcgattccttgcccccgtacgggtggacacgcgcatccgctcggtcttcaccctcaccggggtgagcgcgctgccggagggtaaggcggcgctgcggctcggcgccgcggtgcaggccgagggcgatgcgggccggtcggtccttaccgccgagctgacgctgatgctccttctcgaagaggcggcgcgggaaacgcccggctcctctgaccggcctgccgtccccgaccggcctgttgccggtccggacgggaatctgcctgcgcctcaacgttcgccaattcggaaccaccagaccccggaatgccacaccgccagcgggtctcgagacggcgacccggagtcgatgccgcccctgcgtcgctga

SEQ ID NO: 9384 - DNA, 462 bp, Methylobacterium sp.
atgcagcgtttcgtcagggccaagctgcacggcatccgggtgacgggtgccgacctcaactatcacggctcgatcaccctcgacgccgacctctgccgagaggccgggctcgacccgctcgaattcgtcgagatctggaacaagatgtcgggtgcgcggatcagcacctacgtgctgtacggcccggccggttccggctgctgcgtgctgaacggggcggccgcgcgcacctgccaggtcggcgacgaggtgatcatcgcctccgccagctacggcagcgtggacgacgtgatcggccacaagccgcgggtgctgatcttcggcgagggcaaccgggtggtggaccgggtggtctacgacgtgttccgcgacgaccagggccgcctcgacatgcggatcatcgaggcggagaccggtgcggaggagccgccgcgggtagcgacgcagatccgggtggtctaa

SEQ ID NO: 9385 - DNA, 1551 bp, Methylobacterium sp.
atggcacatagctggaagcgtgaccgggcggccgaacacatcgccgccaagatcaaggatgtgaagaaggtcgagatcgtcgacttcaagcgcgagatgtcgctcggaaacatccccacggcgaaggcctatcggatggaggccgtgcatatctacgcggacatcctgaacctcgacgacatgctgaactgcacgtcgagcgagggggagacgtgccacaagcgaacgctccgattccttgacctgcacggtcgaagcgtgcgccgcatcctcaacaggacggatgcgctgcgcgtcgatttccataaccagcggctgcacgccgtcgtccacaagccctacgacagcgacgacgaggacggcagcgccgaggctcggaggctgcatcgcgctgtggccatcgcccagctcgtcatcgacgtctgcgcagccaccggcgacgacgacgagtacgtgcccgccgccagggtcagggttgggatcgacagcggtctcgccctcgtcgtgaacaacggccgcaatggtggtcgtgagcccctgttcctgggggatccggcgaaccatgccgcgaagttctcggcggcggggtccgcggtcggcatatatctgacgaacaatgcccggcgcgcgataggcctgccggaggtcaaggagccgtccaagaccaagttgaccgccagcgaggtcgctctatcgcaggccgacgccgagctcggcctcgacgtcgaggacctcgcggaggaatggcgcgccgacctcgccaagaacccgctctccaactacggcttctcgcgccacacgccgccgttgcgaaccattgatatcagcgtcctgacgccctccaactcgcggcgccaggaggccgtctccgtctatgccgacatcgatggcttcacggcctatgtggcccgccacctggaagcgggaacgtcggaggatgtcgtgcgcgccctgcacgtcattcgcgccgaactcgaccgggtgctgggcgtcgacttcgagggccgccgggtccgtttcatcggcgactgcgtccacggcctactgtgcgaaggaacggcgcagacgaccgacgacgaggagaccgtgagcacggccgtactgtgcgccgggggccttcggagcagcttcgagctcgccctggagaagctcgacgaggagggggtcgacgtggaaaagctcgggcttgcgataggcatcgagttcggcccgatgaccctgacgcggctcggcgcccatggggaccgcttgcgatgctcggtgagccgcggcgtactggcgtcggaggccgaacagaagcgttgcacgggcacgcagacggcaatcgggcaggtcgcatacgacaccgggacgcaagccgtcagggacctgttcggcccgtcccggcgcttcgacggcctcgattacaacgaggcggtggagggacttgcggccgacggcgaccagaccgccaaggccatcaaggccgaggcgttcgccgccgccgcgccggcggtcaaaagggcttcggatcaagtggtcacaccctacgtcgaggttggtggggaatga

SEQ ID NO: 9386 - DNA, 510 bp, Methylobacterium sp.
atgaatatgatcatcaagggcaccgtcatcggcatcgggtcgaccgtcctcggggacgtccgaacgaacccctcggggcgtgagatctgggtcggggtgcggatcaggaccgaggacggcaagtcccgtttcctcaagggcatgctcgtcgaggcggaagccgcgctcatcatcaacgaggcggtggaccgcggcgagtcggtcgaactctggctgagcggcaagcccgagcgggcatatccctacgcggtcaggaccgcgcgggagggctggtactacgacgggtacagcgactacctgcgcgggcaggggcttaagacgttgggcatcggcatcctgatgctcccgctcctcggcatcggcatactgatgatgatcggttccatcgggtacttcatcgcgtcgaaccagttcgctgcccagcgttcccgggcggcgttcgagcgcggttacgaggctgcggtttcctcatccggctcgaacgaaggcggccgcctccaggcagcttag

SEQ ID NO: 9387 - DNA, 651 bp, Methylobacterium sp.
gtgaaacttcttctggtcgacgaccacgctctgttccgggatgccgtccgacgggtcctgcaggccggctttcccgaagccctgatcgaggatgcggactcgatcgaggccgctaccgccgcgctcggccataggcccggtacggatctcgtcatcctcgacttgtcgatggatggaatccgcgggttcgagggcttcatggcaatccgggcccgattcccgcggatcccgatcctgatctgttctgggctgcaggaggcccctatcatccgcgaggcgctggcgctcggggcggccggcttcgtaccgaagacgtcgaaccgtgccgcttatctcgaagcggtcgcgcgcgcactggaaggcgagatcttcgtccccgacagcgtggctgccgcccccagcgctggtccgagatcggcctctgcggcctccgcccggatgtttaccctgtcccacgcgcagatgaacgtgctgatcctgatcaaacagggcctcagtaacaaggagatcgcgctctgcctcggcatcggcatgtcgatggtgaagacgcacgcaaccgagattatgaggaagctcggcgtccgcagccggacccaggcagtcatcttcgcatccgccctcgacttcgagcgcatcggcacgggcggatga

SEQ ID NO: 9388 - DNA, 213 bp, Methylobacterium sp.
atgtcctgccgccatcagcccgacgcacccaggcccggctccctgcaggacgcgccctccttcgcgcgcaaatggcgccgcttccccagcgcgctgcccccggcctgcaacgacaatcatcggcccggccggctgcgcgcggcgctgctcgccggatccggcatcgccggcctgctggtcggtctggtggccgtcgcggcggccctgatctga

SEQ ID NO: 9389 - DNA, 1050 bp, Methylobacterium sp.
gtgctcgcggccaagctcgcggcggtgcgccaccatcagggtcgcctgctcggccggatggaggcgctcggcctcgcgctggagagcgaggcggtcttccaaaccctggtgaaggacgcgctcaagacgagcgagatcgagggtgagatcctcgatcaggcgcaggtgcgctcatcgctcgcccggcgcctcgggctcgaccgcgccgggatggtgcccgtcgagcgaccggtcgatggcttggtggcgatgctcctcgacgcgaccacgggtttcgccgcgccgctgaccgaggaacggctgttccgctggcacgccggcctgtttccggacggtggccacggccgccgcgagttcaccgtcggcggctggcgcaccgacaggctgggcgccatggaggtcgtctcggggccgctcgggcgggagcgcgtccattttcgcgcgccacccgccgagcgggtgcccggtgagatcgcggctttcctggcgtggttcgagacggacgatcccggcctcgaccccgtcctcaaggccgcggtcgcgcatatctggttcgtgacgatccacccgttcgacgacggcaacgggcgcatcgcccgcgccatcgccgatctggcgctcgcccgctccgagggcacgggccggcgcttctacagcatgtcggcgcggctgcgggtggagcgggcgcagtactacgagacgctggagaccacgcagaagggcgatctcgacgtcacgacgcggctcgcatggttcctcgacgtgctcgacgccgccctcaccgatgcggagacgacgctctctgccgtgatccgcaacgcgaagacctgggaaacgctgacgacgcgggcgctcaacgagcgccagacccggatggtcaaccgtctgctcgacggcttcgagggcaagctgacatcctcgaaatgggccaagatcgcgaagtgctcgcaggacacggcgctgcgcgacatcgaggcgctcatcgccgccggcattctcgtcaaggagccgggcggcggacggagcacgagctacgcgctcgcgctctga

SEQ ID NO: 9390 - DNA, 933 bp, Methylobacterium sp.
atgaccgaaaccctggtcttcgcgagcgccgtcgacccggtcgagccctggcgcgaggcattggaggggctcctgccggacatccgcgtccgcacgcccgaggagatcggaccgcaggacgatgtccgctacgcgctggtctggaaaccgcccaccggcttcttcgcccgtcatccgggcctgcggctcgtcaccatcctgggcgcgggcgccgacgcgctcgtggggcgtgacgacctgccggcggtgccggtggcgcgcctgtccgaccccgagatggcgcggatgatgacacactacgtgctgttcgcagtgctgcgctacgcgcgcaacatcccggccttcgaggcggcccagcgggccggccgctggcactacgtccatccccgcgaggcccgggagatccgggtgggcgtgctgggcctgggcgaactcggcagcgcggcggcgctcgaactcgcgcgtcaggggttctccgtcgccggctggtcgcgcacaccgaaagcgcttccggggatcgactgccaggcaggtccggacgcgctgatcccgtttctcgcccggagcgagatcctggtggtgatgctgccgctgacgccccagacccggcgcctgattggggcggccgagatcgccgcgctgccgcggggcgccgcgctcatcaacgtctcgcgcggggcggtcatcgacgaagcggcccttgtggcggccctgcgatccggccacctcggtggcgccacgctcgacgtgttcgagactgagccgctcgcggaggggcacgccctgtgggggatggagaacgttctcgtcacgccgcacttggcctcggtggcgattcccgcctccgctgcccggcagatcgccgagaacatccaccgggtgcggacaggacacgcaccggagcaccgcgtggatctgagccggggatactga

SEQ ID NO: 9391 - DNA, 456 bp, Methylobacterium sp.
atgaccgctccgatcccgatcctcttcctgaacggcccgaacgccaacctgtacgggctcgacccgagcggcacctacgggacggagagcttcccggtgctgaaggcgcggtgcgagcggcacgccgagaccgtccgcgtagccctcgacttccggcagtcgaaccacgagggtgtcctcgtcgactggatccaggaggcccgggggacggccgcgggcctcgccatcaacgcggccgggctcacctacacctccgtggcgatcctcgacgcgctgctggcctttccgggacccatcgtcgaggtgcacatgagcaacatctggaaacgggagcccttccggcaccattcctacgtctcgcgggcggcgaccggcgtcgtcgccggtctcggtggcctcggctacgaactcgcggtcacggccctcgcgaggctcgtgcgggagacccggccatga

SEQ ID NO: 9392 - DNA, 1125 bp, Methylobacterium sp.
atgaacgcgcaaacctccgtccccggctcctcctcgcccctcggcccgggagacctgttcccgcaggtcgcgccccgcacgcaagggcgtccgagcttcgccatcgacaccctggcgggccgctacatcgtgctctgcttcttcggctccgccgccgatccgcagggggccgcagccctcgggacggccctgcgggagcgcgcgcgcttcgacgattcccgcgcgagcttcttcggcgtcagcatcgaccccgcggacgaggccgagggccgggtccgggacctgatgccgggcttccggatcgtgctcgacttcgacggcgcgctgagccggcgctgcggcgtgacgagcgagggcgagggcccccggccctaccggcgatgctggatggtggtcgatccgaccctccacgtggccgcgaccttcccgctcggcgaggcgggcgaggcggctctgttcggctatctcgacgccctgccggagcccgcggcttacgcgggcttcgagatccccgctcccgtgctcgtcctgcccaacgtcttcgagccggcgctctgccgccacctcgtcgggctctacgatgccgacggcggctcggaatcgggcgtccaccgcgcgggcgcgggcgtgatggaccacagcttcaagcggcgccgggactgcacgatcgaggatccggccctgatccggcagatccagcagacgatccaccgccgggtggtgccggagatcgagcgactgttcttcatgcgcatcacccgcatggagcgctacatcgtcggctgctacgcggccgaggacggcggccatttccgcgcgcaccgggacaacggccaggggctcaccgcgcaccgccgcttcgccgtctcgatcaacctcacgggcgacttcgagggcggcgcggtgagcttccccgagtacaacccgcgcgggatcaaggcacccccgggctgggcggtggtgttcccgaccaacatcctgcacaaggtcagccaggtgacccgcgggcggcgctacgccttcctgcccttcgtgtacgacgagacgggcgcgcagatccgccagcgggaactcgccaggcaggccgaggctgcggtccgggccgaggtcgcggccgaggcctga

SEQ ID NO: 9393 - DNA, 1137 bp, Methylobacterium sp.
ttgagggcgttcgttcgacaggcaggcgcggcggggcaaggcgtatcggagccgtcttcgagccgggtttcggagcaggcctcggagaccgcccagtcgcgcggctcgcgccggctctggctgcacgccgtcgcctacggcctgatcctctgcatcttcgccgccgacgtggtgacgccgcccgacaacgtctcgatctgcttcgcctacacggtgccgatcctgctcggcgtctatacgggcccgcgcgcggccttcgggctggcgctcgcgaccaccgcctcctcgctgctgggctccttcatccggcccccgagcggcggcatcgcgctgagcttcgtggccaaccgcctgatcgccaccgcggcgcagtggctcgtcgccttcctgatcgagcagcgcaagcgcggccgggcgatcgtgcaggcccatctggcggacgagcgccgcaaggcggagaccggccagcgcttcgtgcgcatcctcacccacgagatcgcgagcgcgctcaccgcgatcggcggccagagcgcgcgcctcgccaagctcgcccccgggatcgagcccgccgagatcgtggcgcgcaccgacaagatcggtcaggcggtcgcgcgcctcgacgccctcgtcggccgcatccagctcgccgccgaggtcgatggcggcgagatcgcgctggcgcccgagcacacgccctgcatggagttcctcaggccgctgcacaccgagtacgaggcgggccccgagctcagcctcaccctcgtgtgcggcgcggagacgatctacggcgaccgcggcctgctctaccaggccgtctcgaacctcgtctccaacgccatcaagtactcgcacgcgcccgccgcggtgacggtgagcgtcgcgtcctcggacgtgacggcgggcccgatgatcacggtctcggaccgcggcatcggcatcgacgcggacgaggtcgagcgggtgttcgagccctattaccgggcgcgcaacagcacgggcatccggggcctgggcgtcggcctgcacatcgtccgccacttcgtggaggcgcatggcggcgagatccggatcgcgagccggccgggccagggcaccagcgtgagcctccacctgccgcccgagaaggttgccgcgtga

SEQ ID NO: 9394 - DNA, 1368 bp, Methylobacterium sp.
atgcacaagctcgtcgcaacgatccggcgctcggccctgtcaggcccgttcgccaccgccttcgtcacgcgcttcggaagcgcggtcctcggcttcctcacgctgctcgcggcgagccggctgctcagcacctacgagtacggcgtctacgtcttcctgttctcgatcggcagcggcgtcggcctcgtcgccgtgctcggacagcagaatctcctgctgaagcactaccgcatggacggcgcgtcggcggccgccaacggcgtgctcgtgcgccacaacctcgcctggctcggcctcgcgctggcgctcctcctggggacgggctcggtgctcgtcctggcggaacggaacctgcccgagccctacgaccggctccatctcgccctcgcgttcgcggccgtgttcgcggtcagcgagtacctgcagaacttcttccgcatccatcgccgcttcgccctggcgctgctgcctcgggagatcgtctggcggggcggctgcgcggtgatgctctatctcggctccctcgcgggcgtcctctacggcgcgacggaggcgatggaactggtcctcgccctcttcgtcgccgcaaccgccttccaggtcgtccacctcgtgcgcctgcacggcgccgacatgcggccgggccgggcgggcgccgcgccgtccgagcagggtgccgagcgggcggcctggcgctcccagagcctgttcttcaccgccaacaacggcctgcacgcgctctcgctctacctggagaccgtgatcgtcggggcggtgctcggcatggaggaggcggccttctacttcgtcgccctgcgctacgcgacgctgctgctgctgccggtcgcggccatcgacacggtcggcctgccgatgatcgcggcacggatccaggccgcggactggccgggggtgcagcgcctcgtcgcgcgcctctcgtttgccagcttcctgatctccgtcgcgggcgcgctcgccatgctggtggtcgggccctacgcgctggcgctgttcaagccggatttcgtcgcgcatatcgacgtgctctcggtgctctgcctctcctcggtcgtgggggccttcttcggcccgggggtgtcgctgctgatgatcggcggcggggagcgcttcctgctcgtcagcaacgccgtcctgttcggcgtctacggcctcctgctctgcggcctcgccgatgtcctgggcatgctcggggtcgcggtcgcgagcctcgtcgtgaccctgagctacaacctgctggtggtcttctgggtgcggcagcactggggcgtcgacaacatggcgaccgccatcctgcggccgtcgaccggagcggccggaggactggtgccccgtcatgcggcgggctga

SEQ ID NO: 9395 - DNA, 438 bp, Methylobacterium sp.
atgctgaggccgcgcgacgccgaggccgcgtcggcggccctgaagaccttcgacttcgcggagcgccatcccgagtgggtcttcctgcgcgtcgaggcaggttgcagggccggacgctgcatgacgatcatcgctcgggccgacgagacgagcatgacgcccgaactgctgctgaacgtcggctcctccgtcctcttcaacgactactcgttcggcctctcgggactgaacgcgtggtcggacatcgtgttcgatggagctggaagctccgcggtcaccgtcacccgccggggcgatcactgggtcgtcggcgcctgctccgattgcaacagctgggccggcgtgaaggagccggagccttccctgccggaaccttcaccacccaagcccgagcgcttcgaggacttccaccggttcatagatggcgagaggggctga

SEQ ID NO: 9396 - DNA, 354 bp, Methylobacterium sp.
gtggcctacctctacgcccgcggcgggaacatcggtctgcgttccttcggggcccatgaggagggatccggcgccgtcgccaccgtgaagggtcaccgggtcacgattgccggcggcttcacacggtcgggcaaggcgcccagccgacacctcgtgcggaagctcggcggacaggtgttcgtcaacaccaagggcaagaagtggcgcggccacatgaccaaggtgaagtcgggggtctacatcccgtccgagatgacgagcggttcgaccctagcggccttcgagcgggtcgccgcggcagagctacccgccgaggcagcgaaggccctggcggccctcctgccgggcaagtga

SEQ ID NO: 9397 - DNA, 441 bp, Methylobacterium sp.
atgcccctcgtctgcgtcacgcgcctgcgcgtccgcgccctgcgcttcctgccggccttcgcgctccacgcggtccgcacggcccggcaggtgcgggcggcgccgggcttccggggtggggcgatcctgcgcgatcgggactgggcgtggtggacgctcaccgcctgggacaggcccgaggacctgcggagctacatgcaggccggcgcccaccgggccgcgatgccgcatctcgcgcactggtgcgacgagtcctgcaccgtgcactgggacgcggcggagctgcccggctgggccgaggcggacaagcggatgcgcgacgagggccgcgcctcccgcctgcgccatccgagcccgcgccacgagaccctgagctaccggccgccgcgcctctcggcctccgcgccgctccgcccgagcccgcgggccgccgggatgtga

SEQ ID NO: 9398 - DNA, 1359 bp, Methylobacterium sp.
gtggcagcgggcggcagtctcacgatcaacggcactggtgtagagactggcagcaccgcacggcaggggggcaccactggcgccagaccgggcttcggtgcgggcatcttcttcgagggcggtccaaccagtggaacggccgccacgctcaccttcggggctggcaaccagtccttcgcctcgcagatcgccgacctgaacggagcagcaggcaacacgacaaccggcaacggtctcggcggaaccggcggtgtaacggcgctcgccaaagtcggcaccggcacgctcacgctcggcgccgccaacacctatacgggcgggacgcgcctcgatgccggtgcgatcagcctcggcaggctgacgtccgccggttcgggcgccatcactttcgggagcggggcccagaccctacgggtcgaagcaagtgggacgctcggcaacacgctgacgaacttcggctcggacggtgacacactcgacttggccacgatcaacccgaatggggccacctacacgctgagtggaacgaccctcacggtccgggaggcggcggccaatgggctcgacagcaacaccttcacgctcaacgccgtgccatcaggtttccagttcgtcctcgcgtcggacggtcaggctcaagccggcacgacggtacggctccaggcaatcccgaccccgccgccggatccgggtcccgcaggcccgacctcgggcgacgacaacctcgtgggcacgtccggcccggacacgatcagcctcgggctcggcaacgacacctacgcgggcggggccggcaacgacctcgtctacggcaacccgggcaacgacctgatctacggcaaccaggacgccgacaccctctacggcggccagggcgacgaccgcgcgtacggcggccagggcgacgaccgcgcgtacggcggccagggcgacgaccgcctgttcggcaacctcggcaacgacgtgctgttgggcaacctcggcaacgacatcgtctacggaaaccaaggtgccgacatcgtctacggcaaccagggcgcggacgtgctctacggcggccagggcaacgacgtgctctacggcgggcaggacaacgacacgctggtgggcggcatcggcgacgatacgctggtcggcgggctcggggcggacctctaccgcttcgatccgaattccggccgcgacctgatcctgggcttcaaccagggcgagggggaccggatcgcgctgggcgggcagacctacacggtctcctcggcgcagaacggggacgcggtgctcctgctctcgggcggtggcgtggtcgatctggtcggcatccgggccgatcaggtcaacgccgcttacttcgcggcttga

SEQ ID NO: 9399 - DNA, 486 bp, Methylobacterium sp.
atgcacgcgaagcaccccgcccggtccggccggatcccgtccggtcgccgcttcgggctggccgtgctgctcgggcacgccgccggggcctacgccttctgcgcgagcggcatcctgttcgccgccctctcggaccttgcgaccgccgaggggcgcgccgcgctcgccccggtgaactggggccgcctgatcgaggggatctgcgtcttccccctggtcaccgtcgtccttgccctgtgggcggccgtcctgatggtcccgctgaccctgctgatcctgcccatcgcgtggctggcggcccgacggctcgacgcggatgcggcgcccacggccgcgctcggcgccctggcaagcctcctgcccgccgtcatcgccttccggggggcgcccgtcctggacctgcgcccgtacggctcggccgcggtcgcgggagcggccttcgcgggcatcgtctggctgctctgcatcaggccgcgccggggatag

SEQ ID NO: 9400 - DNA, 936 bp, Methylobacterium sp.
atgcactccgatcccgaaaccctcgcaccgccgcagctctccctgctggtctgcacccgcggccgctcggcccagctcgcccgcctgttcgcctcgctcgagagccagagcctgggtgatttcgaggtggtgctcgtcgaccagaacgagcccggcgtgctcgacgacatcgttgcgcgccaccgcgggcgcctgcggatcgaccatgtgcgctcgctgcccggcctgtcgcgcgcgcgcaacgtcgggctggcccggtgccgagcgcccctcgtcgccttcccggacgacgattgctggtaccgccccgcgctggtggaggaggtggtccggctcttcgcgcagcatcccgaggcggacgccctcacggggcgcacgatcgacgcgcagggacgcgaatcgctcggcgccttcctgaaatccgatcaggcgatcggccggcgcaacgtctggtcggccggaaactcgaacaccctgttcgtccggcgcgcggcggccgaggcggtgggcgggttcgacgagacgctcggcgtcggcgccgcgacgcggttccgctccggcgaggagaccgacttcctgctgcgcatcctgcggcaggatcgcgccgtcgtcttccggcacgccctcacggtgcatcacgatcaggtcgggaaccagggccgccacaagcgcgcctccgactacgcgcacggcttcggacgggttctgcgcctccatcgctacggcctgccctatctcgggctgcgcctggcacgcttcgcggcgagcggtgcgcgcgccctgctgcgcggcgatgcgcgcacggcgctcgacaaggccctctgggccgccgggaccgccgcgggcttcttcgcggcgctccccggatcggcgagccgcgtgccggacggcgcgccgtcctggcggttccgggccggcctgacgcggggcggctga

SEQ ID NO: 9401 - DNA, 1299 bp, Methylobacterium sp.
atgagcgagcctgacacgccggatgccggtcccgaccggtcctctgccgtcgcggccttccagaagcgccggcccggcgcgacgatccacctgcagcaggaccgcggcgcctcgtggatggcgtggttcttcggcgcgatcgtcgtcgccctggtggcgggcctgttcctcgggcgcttcgcgcgcagcgagtcggtgcggggctacgtctcggccgcctccggcctgacccgtctcgatgcgcgggccgccggcatcgtccaggccatcgacgtgaaacaaggcgaccgcgtcacccgcggccagcggctgatgcagatccaggtccgcgaccagaccacgggtggcgtctcgaccgtgacggccaacctccggagcctgcgcgagcgtaaggccaacctccagcgcgaccgcgagcggctgatcgcgttcctcgacgccaccaggggcgaccgcagcgagaccgagagcaacgtcgccagcgtcacccgcgccttcgacgagcaggagcgcgccctgaaggagggcctgcgccagcaggaggagatggtggcgcgcgtccagtcctacatgaaccagggctacgcgacgcgcgaatcgctcaacggccagcgccgcatcgccctcgactacgcccgccagatcgcggagctgcgcgcccgccgggccgagctgaagcagtccaccgccgagcgcctgaccggccagcgcaccaccgcgaccgagaaggccgcccagctcgccgccaccgagaacgagctgagcgcgatcgaggcgcagctcaccggctacagcgcgctggagcgcctcgacatcgtctcgcccgtcgacggccaggtggccggcctcttcgtcgagcccggcgcctcggtctccgccgaccagatcctcgcgatcgtgggtgatgccggggccgaaccggtgatcgtgctggaggtgccggcccgcgccatcggcctcgccaaggtcggccaggacgtggtgatcaagtacgacgcctttccgttcaagaccttcggcatcgcgcacggcacgatcacgcagatcgccggcacgccgctgcgcgcgcccgccgtggcgatggcggatgcgggcgaggcggtgttcgacccgacctcgctcacccgccagtcgacctaccggatcgacgtgcggccggattcgcgcacgatccgggcctacggcgtggacgagccgatccgcatcggctcgacgctctcggccgacatcgtcgtcgagaagcggcggctgatcgactggatgctcgacccgatccgcgcgatgcgcgggcgcggctga

SEQ ID NO: 9402 - DNA, 2151 bp, Methylobacterium sp.
atgagcgagtggctgagaggcttgacgggcggacggcggcgcgtgcgctccttggtgcagagcgagaccaacgagtgcgggctgacctgcctcgccatggtggcgaactaccaccggcacgacatcgacctcgcctacctgcgcgcgctgttcccgctctcgcgcaccggcatgtcgctggccgacatcgtggagctcgccgacacgctgggcctcgacgcgggcggctacgcgctctcgaacatcgacgagctgaagggcgtccagctgcccgcgatcctgcactggaagggcaaccacttcgtggtgctcgaatcggtccggggcgggcgctaccgggtgcacgatcccgaattcggcctgcgcctctacgagcgcgccgacatggagcagctcttctccggcgtggtgctggaattcgccccccggatggacctcaagcgggtccgggccgagaggaagctgaccttccgggaggtgttccgcgcgacgagcgggctcggcagcacggtctggcagatcagcctcgtcaccgtggcgatcgcgctgctcgggctcgccatgccggtgctgctgcagatcgccctcgacgtggtgatcccgcaggtcgatctcgacctgctccacgtgctggcgatcggcctcgtcctgctgatgggattcgaggcgatcgggcgctggctgcgggactacgtgaccctgcgggcctcgacgctgctccagctccagttcacccgcaatgtcgtgggccacgccttccggctgccgctgaactacttcgagctgcgccatcccggcgacttcgtggcccgggtcgactcgatcgagcacgtcaaggcgttcctcgtcggcggcctcgtcacggcgttcgccgacagcgcgacctcgatcctgatcatcgggctgatgctctactacgcccccgccatggcggtggtgacgatgctcaccctggtcgccgtgatcgggatgcgcttcctgaccttcccgaagctcaatcaggcgacgttcggctcgctcgaggcgcgctcggaggagcgggcgcggcttctcgacggcctgcgccgggtcgatagcctgaaggcgcataacggcaccgaactcttcgcgatgcgctggttcgagagcttctcgcgcttcgccaacctcgatttccgggcgcgcaaggccgggatcgacgccgagctgttcatgcacctcgtcatcgtgctgagcacggtcgcgacgctctacatgggcatcgtcggcgtgatcgcgaacacgctgacgatcggcacgctctacgcgttcttcgccctgcggaccgagttcttcgagcgcgtcaacatgctcaccagcaacctgatgcacctctcggcgatgcgcgtgcacttccagcgcctcgacgacgtgctcggccaggagccggaatcgggcctgcaggacgcgaccttccaccggacgctgaaccgcgaggtgcggctggagaacgtgacggtccagttcggccgggccgacgagccgatcctgcgcgacgtcaacctgcgcatcgacctcgcggcccacgagaccgtagcgatcgtgggcgtgtcgggctcgggcaagtcctcgctgatgaagatcctcgcgagcctgcacgagccggcggagggccgcgtgctggtggacggcagcccgctcgcccagttcggcaagcgcgagtaccgcagcaatctcggcgtggtcttcgccgacgacggcctgttcgccggcaccgtggccgacaacctcgcgctgttcgacccggccgtctcgcgggccgagatggaggcggcgctcgtctgcgtgggcctgcgcgacgagatcgagcgcctgccgcagggctacgccactctggtctcggaggagggcggcctgctctcgacgggccagcgccgccgcctgctcttggcccgcgcgctctgccgccgcccgcgcctgctgctgctggacgaggtgacggccaacctcgacccgacgaccgaggccgcgctcgtcgagagcctgaaggggatccgggccgccaaggtcttcatcacccacagcgagcgcatgctcgatcaggtcgaccgcgtcctgcgcatcgagggcggccgcctcgtggaggacgcgagggcaccgggcgccgggcggaggatcccggcgcgggcgtga

SEQ ID NO: 9403 - DNA, 240 bp, Methylobacterium sp.
atgcactggcctgccgcctacgccgcctacaacgtgttccgccgtcgccagtacccggccctgcgctgcgccgtgcgccaggatcgtccggtgccgggcttcatccacggggtgatctgggagtacgggggcacggtgatggaggagcgcccgccggaaggcttccagccggcggacgcgcaggccgcgaccgcgagcgccggctactacctgttccgggcgccccacggccgcgcctga

SEQ ID NO: 9404 - DNA, 1248 bp, Methylobacterium sp.
atggtgtcggtgaaggcgcgcttgagcgccatcatttcggttctgagcgtcttcgctctcttcacgagcggccgtgatctatccagtgcctacgagcgctggggacgggccgatctcgtctcccatcttgcggcagccaacctgatgctctcgcgcggcatgtcggacgtgcgcttcgagcgcggcgccgccgcctcggcgctcgccctcgaccccgcccagatgggcgcgaacctgcaggacatcgccgcgcgccgcagaaccgtcgacggcgggctgcctcaggggctcgcgatcctggcggccgacagcgtcggacgggacgcgccggaggcgcgggaactcgccgagcgctacgcggcgtggcagcgcacgcgcgtggaggtcgatgccaacctgaccaagcccgtcggagcacgcgacccggccctgcccaagcggctcgccgacgaggcgggcgccctgacggcggcggccgaggcgctcgtcggcgcgatggagaaccagatccgccgcagggatgccggcctgtccaacctgctgcgggtgcgcgagctgacctgggccgcgcgcaccttcgcgggcaacgctcacctcatcgtcaacgacgcgctggcgcagaagcgcgtcctcacggcgaaggagaccctggatttccatgttctcgatcgcgaggcggccttcgccttcggcatcgcccagaagatcgtcgagagcctgtcgggcatggagccgctgaagcgcgccgtcctgggagcccgggacgggtacttccaggggcccttccaggcccgcacccgggcgctgctgccggcgctggcggatctctccctgccgcggccgacgctcgccgagtcgcgcggccagtccacccccgccctctcctcgatcatgaccgtcgcgctcaccgccgtcaccgaactcgacggcgccgcgtccgggatcgccgcggaggcgcggcgggacgtcatggtccagggcatcgtgatggccctcgccctggtgctgggcctcggcggcatggtctgggtggtgcgcggcgtgtcgcggccgatcgagcggatgacctcggcgatgcagcgtctcgccgacggggacacggcctccgagatcccctatggcgaacgccgggacgagatcggcgcgatgtccggcgccgtgcaggtgttccgccagaacctcgtgcgcacccgcgagctcgaggcggagacggcgctggcgcgggcctcggcggaggagcagcgcaag

SEQ ID NO: 9405 - DNA, 837 bp, Methylobacterium sp.
atggatctccgcggactgcacgccttccggatcgtcgccgaatcgtcgtcgatgacggcggcagcggagcggctcggcaccgtccaatcggccctctcggcgcgcatcggccagttcgaggccgcgatcgggacccgcctgttcgaacgcctaccccgtggcgtccgcctgaccgcggcgggcgcacggctgctgccctacgcggagcggatggagatcctcgccgcggaagccgtgcaggccgcccggggaaccgggacgatcggtccgttccggctgggcgccatcacggtggtggccgccaccctgcttccccccgtcctcgcccggttgctggcggaccatgaccggctcgatctgcaggtcgcgacgggcgtgtcgcgcgacctcgatgcggcgctggcggatggaacgctcgatgcggccattctgggccatcgctcggcccgtgcggggatcgtctcccgtccgctcgacagcatcccgctcgccctgctgcgtcccaccggcgtcccgatcgaggcggtcggccaagccttcaccttcgccgcgggctgcgtctgccgcgagcggttggaccggttgctgcgggaacgcaggatcggcgcccggatcgtcgaactcggctcggtggaagggatcctcggttgcgtcgcggcgggcctcggcgtggccttgctgcccgagatgctggcgcggcgggacggcctcgcggtggagcgcgtcggccgcctcgacctgttcatcggttcacgaccggaggcggagacccaggtgcgggccctgctctccgcctatcgagcctgccgggcggccttcgagcgggagatgccctga

SEQ ID NO: 9406 - DNA, 2427 bp, Methylobacterium sp.
gtgaccctcggcagcggcaacgacagcgtctcactctataccggcgtggtcggtgcctcggctgtcaccgttgccgaccagattctcggcggcgccaacacggtcaccctgcgggccgccggtgactatgccgccgccgttttcggcgcgatcaacctcggcgttgggaacaacaccctcagccttcgcggagccgggaccactgtcggtggcggcgcgggctcgaccggcgctgctggctcgctggacctgtcatcggtcaccggtgcgacggccatcacgaagtccgacattggtacctggacgctgaccaagagcggcaccaacaccaacgccggcacgctcaacgtccatgcgggtacgctagcgctcggcacggcaaatgcgctcgcagccggatccagcgtggcggtaagcggcggtaacctctcgctcggcgccaacaatcagtccgtcaacggcgtacaagtgacgggcggcacggtcggcggatcggcgacactcaccagtgccacggccatcgacctgcaggccggcaccgtcagcgccgccctggccggctcgtcaactgtgatcggtctgacgaagagcacctcaggaacggcaactctcacaggcgccaacacctacgcgggtgcaacaacgatcaacgacggtacccttgcggtctccggcggttctgcgatcgccgacaccggcgcggtcgtggtcaacacgggtggtacgcttgcggtcaatgcggccgagacgatcggctcgttggccggaaccggctcaactgctgcggtcaacctcaccagcgacctgaccgtcgccacagccaacggcgtcagcacggcctacgcgggcggtctgaccggtgcgggcagcctgcggaagaccggcacgggcacccagacgctgaccggcagcatcgcgaacgccgggatcgatgtcgcggctggcgcgctggtgatcggcgacggcgctacagcggccaacagcgccaccctgctcgtcagctcgacgaacagcacactgcgcatcgaccgcactcaagcgatcatgctggccaacatcgtgtccggctctggccggctcgagaaggccggctcgggcacgaccacgctcacgggcaataacacggccttcaccggcacagccgccgtcactgcgggcacgctcgcggtcaacggcacgcttggcgacacgaccaaccaggccgcgaccatcaccgtcggcgacggcaccaacgcgaataccggtacgctcggcggatcgggcacgatcgccggcagcgtgagcattcgaaacggcggcacgatctcggccggcaactcgccgggaacgctcagcaccggcaacctcacgctggccaccggcgcgacgctgatggaggagatcaccggaacgacggcgggcagctatgaccgggtcaacgtcaccggttcggtcagcctcgccggaacgctcgacctgcgcgtgaccggcactttcgccgatacggtcgggcagaatctcgtcttcatcaacaacgacctcacggacacggtcaccggccgcttcgacgcgctacgcctcaacggcgcgagcgtcgccctgtcgaacagcaacaccttctctgtcgatggccgcagctatcaactcagctaccaagcgggcgacggcaacgatgtggcgatccgcgacgtcacacccgcgccattcgatccaggtcccgggccggcgccgaacactccgacgcccggtgatgatctgatccgtggaaccggcggagacgacaggctcgtcctgggccttggcaacgacaccttcatgggggcggctggcaacgagatcgcctacggcaatcagggccgtgacagcctcttcggtgatgccggaaatgacagcctgtatggtggccaagacgacgacgatgtccggggtgggctggacaacgacgtcgtctacggcaacctcggcgcggacatcgtctacggcaaccagggtcaggatacactttacggtggtcagggcaacgacacggcgttcggcggccagggtgacgaccgcctgtccggcaatctcggcgacgacattgtctacggcaatctcggcaacgacatcgtgtacggcaatgccggcgctgatgtgctctatggcggccagggcgacgacgtcctgttcggtggtcagggtgacgacgtgctgcttggcggccttggcaacgatacgctggtgggtggagtcggcgccgaccgctatgcgttcgcggcaaaccctggtgggctcgatctgatccttggcttcaaccaggccgagggtgatcgcatcagcctcggcggccagacttacacgctcagctcagctcagaacggcgacgcgctgctgaccctgtcaggcggtggcaccgttgatctcgctggcatccgggcccagcaggtggatgcgaccttcttcgcctga

SEQ ID NO: 9407 - DNA, 225 bp, Methylobacterium sp.
atgcaggctgtccagtgcaagatggcgcgaacggcgctcggtctgggcgttcgcgatctggccgctgccgctggtgtgtcggctgataccgtggcccgtttcgagcgaggagatgcgctcaaggagcgcacggtcaccgccctgcagagtgccctcgaagccgccggcgtcatcttcattgatgagaacggtgagggagcaggggttcggctgcggaagaagtaa

SEQ ID NO: 9408 - DNA, 165 bp, Methylobacterium sp.
gaggacatcatcgagccctacctgatccagcagggcttcgtgcagcgcacgccccgcggacgcgtcctcaccccgcaggccttccgccacatgggcctggccgtgccaagcgccgacccgggccggcagcccgggctcttcccggacgacggcgccgatgcctga

SEQ ID NO: 9409 - DNA, 1266 bp, Methylobacterium sp.
atggaaaggcggggacgcgggctcggtccgctgcgcgtcctcggcgcgggggtcatcacgggggcggccgacgacgatccctcggcgatcggcacctacgccagcgcgggggcgaagttcgggctcggcttcctgtggatcgcccccgtgctcctgccgatgatggtcgtggtcgtctacctctcggcgaagatcggccgcgtctacggcaaggggctgttcgccgccgtgcgcgaccgttatccgcccgccctgctctatccggtcgcggcgggcgccttcgtcggcaacgtgatcgaggccgcggccaatctgggcggcatcggcgcggcgctcgggctggtcgtgcccctgccggtgcccgtcatcgtggcgggggcgggcctcctcgtcctggccttccagtttctcggctcctacgccctgctgcgccgcatcttccgctggctggcgctcgcgctgctggcctacccggtcgccgccatcctggcgcggccggatttcggcgcggtgctgcgggcgacattcgtgccgggcatgcgcttcgacgcggagttcctcgcgatgctggttgcctgcatcggcacctcgctctcggcctacgtctacacctggcagtcgaaccaggaggtcgaggagcaggtggccgagggcaagcggagccaccgccagcgccggggcgcgtccgaccgcgagctcgccgcgacgcgccgcgacgtggtgaccggcatgctgttctcgaacctgatcctgtactccatcatcctgtcgaccggcgccacgctccaccctgccggccagaccgagatcgagagcgccgcccaggcggccgccgcactggagccgctggcgggtgccggcgccaaatacctcttcgcggcgggcatcgtcggggtcgggttcctggcggtgccggtgatgacgacgggcgcggcctacgacctcgtccaggcgctcgaccgcccgggcagcctcaacgcgcgtccatccgaggcgcggctgttctacggcacgatcctcgtcgtgacgcttgtcgcggtcgggctcaacttcctcggtttcaatccgatgcgggcgctcgtctggtcgggcatcgtgcaggggttctcggtgcccccgctgctcctgctgatgatgctgatgacccgcgaccggcggatgatgggcgagcgggcgaacgggcgcctcaccgcattcctcggctggaccaccaccgccgtcaccgtcgcggcggccctctgtctcgtggcgacttggatcctgtga

SEQ ID NO: 9410 - DNA, 948 bp, Methylobacterium sp.
atgcggttcaccctgcgccaactcgaatacttcatcgccgccggtcagaccggcagcatcacgctagcctccgagcgcatccacatctcgcagccctcgatctcgacggccatcgcgcacctggagcgggaactctccgtgcagctcttcgtccgccaccacgcgcaggggctcacgctgacgccgatcggccgcgaggtgctgcgcgaggccaaggccctcgtggagcaggccgaggggctctacaccttggcctcggaggcgggcggacaggtgcggggccccctctcgctcggctgcatggtgacgctcgcgccgatgctcgtgcccgaactcgcccacgccttcaccaccgccttccccgccacgcagatccgctacgtggaaggcgaccaggaacagctgatcacgggcctgcgccgctccgagaccgaggtcgcgctgacctacgacctgcacgtgccggacgacatccacttcaccccgctggtcgacctgccgccgcacgtcctggtggcggaggggcacccgctcgcggaacacgccgcggtcgcgatgaccgatatcgtcgacgagccgatgatcctgctggacctgccgctgagccgcgaatacttcctcgccctcttcatggccgagggcctgcagccgaagatcgccgcgcgctccgcccaccaagaggtggtgcgcacgatggtggccaacggccacggctacaccctgttcaacgtgcgcccgcgctccgacctcgcgctcgacgggaagcggctgaggcgggtgcggctcgcgggcacgcaccgcccgatgcgcatcggcctcgcgcgcctgaagcagctcaaccgctcgcgcctggtggaagccttcgagacgcactgccgcgccttcatctccgacgcctacatccccggcatggtggcgcccgccatcgagcgacgtgtgccgcgctga

SEQ ID NO: 9411 - DNA, 315 bp, Methylobacterium sp.
gtgaagcgcttcacgctcgcggctcttgccgccctgacgctgggaacgaccctggccgccgcgccggcgaacgcgcagtactacgacgacggaccgcgccgttgggaccgcggctacgaggaccgctacgagcgccgccgccgggatgattattacgaggaccgctacgagcggcgccgggatttcggtcgccgcggcggcagcatctgcgtgacctcgcggggcaattgcccgacccgcccggcgccgttcaacgcgccctgcggctgcgagattccgggcttcggcttcaagcgcggcgcgatcggcggctga

SEQ ID NO: 9412 - DNA, 1116 bp, Methylobacterium sp.
gtgaccgaccgcctcgccatcctgcacgtcgtccgccagttcctgccgaaccgcggcgggctggaggatttcgtcgccaacctcgcgcgcgagcaggtgcgcctcggccacgacgtgcgggtgctgaccctcgaccgcctgttctcggagcccggcctgcggcttccctcggccgagcggatcgacgggatcgcggtcgagcgcatgcccttccgcggctcgtcccgctaccccctggcgccgggcttcctcggccggctgaagggcgccgacatcgtccacgtccacgcgatcgacttcttcttcgacgcgctcgccctgaccaagccgctgcaccgccggcccctcgtcgccaccacccacggcggcttcttccacacgcaggcccatgccgggctgaagcggctctggttccacgggccgacccggctctcggcccgcgcctacggcgccgtcgtcggctgcagcgacagcgacgcgcgccagttcgcggcgatcgtgccgcggggcgtgccggtgatcgagaacggcgtcgatctggccaagttcgcgggcgcggcgagtcctgtcccgcgccgcacgctgctgacgctgggccgcttctcgcacaacaagcgcctcgaccggctgatcgcgctgatgcgcgcgcttcgggcgcaggaatccggctggcagctccggatcgtcggcgtgccctcggacctcgccgtcgcggacctcgccgcgcagatcgaggccgcgggcctcggcgggacggtcagcgtccatgcgggtctcgacgccgccgaggttcgggctctgatcggcgaggccagcctgttcgtctcggcctccgagtacgagggcttcggcatcgcgctgatcgaggcgatgagcgccgggctggtgccggttgtccacccgaacgcctccttcacggacctcgcggcccgtcatcccggcatcgcgctctgcgatttcgccgacccggccgcggcggcgcgggccgtgcgggaggcccatgcgcggctcgccgcgcgggggcggccgcccgccgaggatctcgaacgctacgcctgggccggggtcgccgcccgctacctcgatgcctacgcgcaggtgcggcgtgccgcctga

SEQ ID NO: 9413 - DNA, 231 bp, Methylobacterium sp.
atgaccgaagccgaccggaacactaccctggtgcgcctcatccgggcctatcccgccctgcgcgaggagctcctcgaccactggtgcgagatcgtcctcatggagctccgggccgccgcctacccggagccggactgcccgccggttgacgagggcgtcactgcccgggcgctggagcggttccgggcgttggaggtggaggtcctggcgcggtcgccgcaacggttttga

SEQ ID NO: 9414 - DNA, 216 bp, Methylobacterium sp.
atgccgcgcgctctgcccaaccggcgcgggccgcgccaccacctgctgccgcaccggcccgcccgccaccacgcgcacggtcgtcgtgcgcacggcgccgaggccaagacgctgcgcacctcggacctcgtgctggcgctcctcggcgtggtgctcctcggcggcctcgccctgctggcggccgtcgccctgaccgcgggcgcgcccgccccctga

SEQ ID NO: 9415 - DNA, 237 bp, Methylobacterium sp.
atgccgcacttcttcttcgacattcacgaccacgagctctcgcaccgggacgaggagggtagcgagtggccggacaccgcctcggcccaggatcagggcaggcgcctgctggccgacatcgcgcgcgacgaggtcttccggcacgatccactccacctctcggtgagcatccgcgatgaccagcgccgggtggtcgcgacctgcgccctctcgctggcgagtacgccggtcgtctga

SEQ ID NO: 9416 - DNA, 699 bp, Methylobacterium sp.
gtgagcctggtcctcgcctatctcgccgctctcggcgccgtggccgcgcgctggctcgcgcggcagcacctcgcggaccggccctggctcgccgtgggctcttcgcccccaatcgccgcgcccgctgtcccgtcctcccctgcgagactcggcctgtgcgtcttcctcgcgagcgccgggctgctcttctcactgctggtggcagcctacggcatgcgcgttcccagaacggcgcccgttccgctcgatccgcggctgctctggctcaccacgagcctgctcgcgggcgcgagcctcgccttgcacggggcccgcgccgcggcgcggcgcgggcgggaggcggacgtcaccgccgcgctcggctttgcctcggcggcgggcctcgggttcctggggggacaggcacttgcgtggcgcacgctctggcaggcgggcctcgcgcagggacccgacgcggccgccgccttcttctgcctgatcacggcgctgcacggcctgcacatcctggccggcctcgtcgccctcgcgtggatcaccgcccgggccgccctcctgccggcccccgcgcgcctggagccgggcatcgcgctctgcaccctgtactgggacgcccttctggcggtctggctggttctgttcgggctcctgttccgaacgccctggtcgggactgatcgacgccctgtgccggcccggctga

SEQ ID NO: 9417 - DNA, 333 bp, Methylobacterium sp.
atgcaggcgacggcccgggcgaccgagcaggcccacccgatcgggctctacctcgcggtgtgggcgtggctgttcgtgctcagcgcctgctcctacctcgtcgattatctgcacctgcagggcggggtgcgctggtccctgatcctcctcttcatgatcgtcaaagccggattgatcctcgcggtcttcatgcatctcgcctgggagcgcgtggccctgatcaccgtgatcctgatccctccggcggcactgctgatcttcatcgccgtcatggccgtcgaggcggattacacgctggcgacccggctcgcgcgacaggtcagtggcggttga

SEQ ID NO: 9418 - DNA, 222 bp, Methylobacterium sp.
gtgctcctcgtgcacctgctcgaccgcttcggcaaaggttggcaccgtcgcctcagcctttcggcgctcggcgaacggatctccaccgtcacgggccaccttgcgataggacagcgccttctcacgagcctcagccagcgagacgaggcttgcgcccccgagcccgatatcacggcgtcggccctgtacgacggttcgcaggagccaacgcttcgagcctga

SEQ ID NO: 9419 - DNA, 801 bp, Methylobacterium sp.
atgcccgcgccgaatcccgccgcatcgcccgtcccccgctcggcgggccggcctgtgccgaacgccagcaccacgcgcgatcccctcgattcgccgctctggccgagcatggccgagcgctatctcggcggcctcccggcgatcttcgacgaccgcgtcgccgtcgccctgcccccggtcaccgaggaccagacacaggtgcccttgacggtcgacgcacgggcgatcgggccggtcgaggaactgctcgtcatcgccgacctcaacccgttcccactcaccctgcggctcgttcccaaagccgcgcaggccttcgtggccttccggatgaagatcgagcagggcacgccgatccgggccgccgcgcgccgggacgggctctggcatgtcggcggccgctacctcgacgcggccggaggcggctgctccgtcccgcccgtggtcgagaagaaggtcgactggccgaatctcggccgcatgcgcggccgggtctggcgcgaggcggacgacctgcgtcttcgcctgcgcatgacgcacccgatggacaacggcatgatcgccaacgtgccgctcttcatcgtggagaccctgactgtctcggacgcgtcgggccgtcagctcgccagcctcaccctgtcggaggcgatcgccgacgacccgaccctgacgctgctggtcgcagggcccgagaccgaggcactgaccgtcacggcacgcaacaccgccggcaacgatttccgcgcccgggccgcggtgccgcccgcggatgcccaatcggccgagatgcaggggaggccgtga

SEQ ID NO: 9420 - DNA, 270 bp, Methylobacterium sp.
atgcgcgaggccgtgaccgggtggctgtcgcgcctcggacacgagcacatggcggcagccgccttcctgacgggtggcccgcgcggcgggcaggtcccgccgatgccgaccttcacgacctttcgcaagatcggctgcgtcccggccgagccgaagcccggacacacctgcgagttcgagatcgcggtcgacggcaagcccgccgccaaggaccgggcacgcttctacaaggcaccgaacggctctctggaagcggacgccgcgcgatga

SEQ ID NO: 9421 - DNA, 264 bp, Methylobacterium sp.
atgggcctgtccgcgaaacccgtccgcgtggccaaacaggctccggccgatgccgtcgaggcgttcatctccaagggcggcagcgtcccgacaggggccccggacgcggcccccaagggggcgcagcacccgctaaagttcccgcccgacagcgacctgttcgagcgcctggaacgcgcccgggcggccagcgcggtcaagctgccgcgcaacacctggatcctccaggccatcgccgagaagctggagcgggaccggacttga

SEQ ID NO: 9422 - DNA, 930 bp, Methylobacterium sp.
atgctgcaggacgcctcaccgagccagagcggcgggatccgcctgatcatcgtcggcgcgggcgccagcgcgctgaccctcgcctcgcacctgctccggcaggacgcgcgggcgcaggtcgtgctgatcgaggcccgagccgaggtctgcgcggcgctgcggcgcggcgcctacgcgacgatcctgcgcgcaggcctcgccgatgcgcaggcgtggctgccgccagaggcggaagccgcgacgcacccgctgcgcctcgtgcgcgaactcgtcgcacaccgcgaccggctgcacgtcgtgcaggcgcgctgtaccggcgtcgcgccgacgagccaggggatcgcggtcgccacggaggcgggcgcgacctggctcggccacgcggcggcttgggcaccgcccctgtcggccgtccggtgcgttccggccggacgccgcctccgggcggtgccggcctcacgggcacgcgggcgggcgctgcggctcgacgctacggacatccctctcggcaccggaatcgcctatctcacccgttggctgcgggcgacggtgcgggcggcggaccggcgcggcattccctggaccgaggtgctcgacggcctgcgcctgcacgggccggaggtctggcgccacctgacgccgcggagccgggcgaccttcctccggcacggcttcgcggcctggaaccagctcaccaccggcctcccggacgaggcccgccgcgcatcggcggccggcccggagcgcggcggccacgtattcgccctgcacccggtcgacctgatgccctacgccgcgcagacgaacctgctcgacctcgacatcgcctgcgcgagcctcgccgggcgcgtcctgcgccgctccaccggcgcggatcatccgggcgcgctccggcgcggtgcccagccccgccttcgcgcctcgtcctga

SEQ ID NO: 9423 - DNA, 468 bp, Methylobacterium sp.
atgcggcctaggcaccccgcgcggctcgcagtcccggtcgcctggctgctcgccgcgatggggggagcgctcgcggcggacacggcgccggcaaccgacctgcccgatctctcggccgcgcgcgcccggatctacgcgggcgactacggcaccgcggctgccgaactcggcgccctgaccgcgaccgtgcggcacgcggacctctacaatctgctgggcttcagcctgcgcaagctgaggcgcttcgaggaggcggcccgatggtatcgggaagccctgttctacgacccgacccaccggccggcactcgcataccagggcgagctcttcgtcgagatggccgacctcgccaaagcacgcaacaatctcaagcttctgcggctgctgtgccacccggccggctgcgaggaggcgcgtcggttggaggccgttctggcggccgccgatccatcgggcacgctccggtga

SEQ ID NO: 9424 - DNA, 1644 bp, Methylobacterium sp.
atgaccggcaccatcgtcctgctcgacctcgccggctgggtggcactgctgctctggggcatccacatgatccgcaccggcgtgcagcgcgcctacggggccgacctgcagcaggtgctgggcgcgagcctcggccacccgctcaaggcgctgctcgcggggctcggcgtgaccctggttctgcagagcagcaccgcgaccggcctgatggccacgagcttcgcggcgggcgggctcgtcgagctcgggccggcccttgccgtgatgctcggcgccaatgtcggcacggcgctgatcgtcaaggcgctgtccttcgacgtggcgaaggccgccccggttctggtgctggtcggggccgtcgccttccgccgcgcgggcggaccgaagggccgggcactcggtcggatcgcgatcggtctcggcctcgtgcttctcgccctgatccagctcgtcgcgacgctggagccgttcacctccgcgcccggcctgcaggcggtgctcagggccgtctcggcggatgcggtgatcgcgcttctgctcggcgcgatcctcgcctgggccgcccattcgagcgtggcggtggtcctgctcgtcgcagccgtcgcgcagcagggcatcgtcccggtcgaaaccgcgctcgccctcgtcctcggagccaatctcggcagctcgctcaacccgcttctcgcgagccgggaagccgccggccggcgcgtggcgctgggcaacctgctcgtacgcctcgtcggctgcgcggccgctctgccgatcctatcctggtcggcggcgagcctgacaccagtggccggtgcgagccgggacgcggtcgccgatttccacgtcctgttcaacctcgccctcgcggcggtcggcctgccgcttctgcgtcccctgtccgtccttgtcgttcagctccttcccgaccggacggccgccccgacggagccgccgctccacctcgatgagggtcttgcggaacccccctcgatcgccctgggcctcgccgcgcgccacgcgctgcgcatggcggaccgccttgaggtcatgctcaccgactccacccgcctgctgtccggggaggaaggctctcaggagcgcattcggcttgcggagcgggacatcgacacgcgcggggccgagatccagcgctttctcgccaagctcgatcccgaagccttgagcggcgccgagcagcgccggctcgccgccctggtgagcttcacggttcagatcggccatgcagcggacgtgctcgctcgcaacgtcgccgcgcagatcagccgcagacacaagcaggcgggtcgcccgcagttccgcgccgatggggatctgacgaccatgctcgatcgtctgtcgacgaacctccgcacggcagcctcactcctcgtgaccgaagacgaggtgctggcgcgccggctggccgatgagaaacagggcttccggagcctggaagagacgcgtatcgcatcccacgtcgcatcgttgcgggacgtggcaagcttcgagcctctcaatcgggttgcggatctcgatctcgttcgagacataaagcgtataaacgatcatcttgttgcctcttcagcctatcctatactcatgaaaagaggagagcttttagaaagtcgattgaagtatgcggattga

SEQ ID NO: 9425 - DNA, 1002 bp, Methylobacterium sp.
atggatcgctctctgcttgggcaggctgtcatcgaggccgaagtcgatcgcttgcagcggcacgcccagttccgcaaatcgcctaagctcgccgccctgctcgtctacctcgtccacgagagccttgtcggacgcggcaaacgcctgaaagcctacacgatcgccacggaggcgctcggccgccccgacgacttcgatcccatcaccaactccatcgtacgggtcgagatgcgccgccttcgcggcaccttgcagcggatctatgccgaagccgagccgcatcaggtcgttgttgagctcccggtcggccgttatgaacctgtcttccgtcatcctaggacgaacggctccgccgacgcggccggcaagcctgatgcgcacctgtccgcagcactgcacgagagcgaggagcgctacgccgcgctcgtcaaggcgagcgcggtcatcgagtggcgtgcggagccgaacgggcacatcacgcggagcctcggctggagcgagcggacgggacaggaggaggaggtctatcgcggtatgggatggctgcaggcgctgcatcctcatgatcgggggcgtacggcacgaagctgggttgcgctctgccgggcaggggcggcattcgcgctgagcttccgggtccgacagcaggacggccactatcagcccatgctcgtacgggccgtaccgctggagcaagcaggtgggacctgtcgcggttggatcggcacgatggtcgagcaaatattcccggccagcgggccgacaaaggctgatcgaggggacttgcagcaagtcctacaccgggaatccgagatggccagacgcgtcctcaaggtggcgcagcaaacggttctggatatcgatcggaaagagatcggacgcgcccgagcgatcatcgaactcaacacgcgccttcgcggtacgggcgtcaccatcggcgaggcggatcgcgcagccgcggcgtcgaccggcacgtccacacccgagatccgtcctcgatag

SEQ ID NO: 9426 - DNA, 1002 bp, Methylobacterium sp.
atgatatccccgatcgctacgcccgccgcctcgcccctgaaggaggcgggtcgcggcggccgcctcaccggcaacgcggccatcgccgccgcctgcctcgccctggcgctgctcccggtgctcctcggcgccagcaactacctgctcgggctcctcatctcggccctgatcctctccggcgtgtcgctggcttgggcgctgctcggcaatctcggcggcatggtctcgttcgggcatgccgccttcttcggcgtcggcggctacacctcggccctgctcgcggccaaactcggcctgccggtcctgctcgcggtgccggcgggcggggtcgtcgccgtggtggcctcgcttgccatgctgccggccctgcggctgtcgggaccctacttcgcgctcgctatcctcgcctacgcgcagatcttccgcatcctggccacggaggccgcctggctgaccggcggtgcggccggcttccagcgctatccgggcctgccgaccgtgttcggcttcgatctcgcgagccgcaccggcagctacctgctgctcgtcggcatcgtggcgctctgcgcgctggcctatctcgcggtgcggcgcagccatgtcggcctggcgctgcgcgccatcgccgacagcgaggacgcgacgcgggtggtcggcgtcaacagcacattcctgaaatccctgatgctgctgctctcggccttcatcaccggcgtgttcggggcgttgaacgcccacatcatcggcttcctggagccggactatgccttctcaggcatctggagcctgatgccgatcatcgcggcgatcttcggcggctaccgcacgatcctcggtccgatcggcggcgcgctgatcatctacctgttcgatcaggtggtggcgaaggggctgatcgcggtgggccaccagatcatcctgggcttcgtcctcgtcgtgatggtgctggccgcgccgaacgggctgctgggcctcgtcaagaagggaggccgcgatgcttga

SEQ ID NO: 9427 - DNA, 1572 bp, Methylobacterium sp.
atgcacaaaggaaccgcgttcacgcaagaggagcgtgagtcccttggcctcgaaggcctgctgcccacggccatcgagacgctggatcggcaggtcgagcgcgtgatcggccatctcggtgccaagccgaacgatatcgagcgcttcatctatcttcaggaactcagcaacagcaaccagacgctgttcttcgcgacggtgatgtcggatcccgcgcgcttcgtgccgatcgtctacgatccgaccatcgccgaggcctgcctcacctacgggcatatctatcgccggccgcagggcatgtacctcacccggtacatgaaggcgcgcttcgagaaggtcctgcgcaactggccggtcaaggaggtgcgcttcatctgcgtctcctccggcgggcgcatcctcggcctcggtgacatcggcgccaacggcgcgccgatcccgatcggcaagctccagctctacaccgcctgcgccggcgtaccgcccgaaagcctgctgccgatccatctcgacctcggcaccaccaacgcggcgctccgcgccgacgcgctctacactgggctgcgcgaggaaccgccggagcccggcgaggtggacgcgatcgtcgacgccttcatggaggcggccaacgcggtgttcccgggcgtctgtgtgcacttcgaggactggaagggcgacgacgccattcggctgctgaagcgctacaaggacaggtatctcgtctacaacgatgacatccagggcacggcgagcgtcgcgctggcgggcatcgtcaccgccctgcagatcaagggcgaggcgctcgccgaccagcgcatcctgttcgctggcgcgggctcggccggcaccggcatcgccgacatgatcgtcgaggcgatgcggggcgagggcctgagtgaggccgaggcgcgcgggcgcatcgccctgttcgacatcggcggcttgatcgagaacggccgcaaggacctcaatgcgtcgcagaagccgtatgcgcgcgactggaaaccgacggaggatctcaccgaggcggtgaagcagatccgcccgacgatcctgatcggggtctcgacggtcggcgggctcttcaccgaagcggtggtgaaggccgtggcgaagacctgcgagcggccggtgatcttcccgctctcgaaccccaccgacaaggccgagtgcacgcctgagcaggcctatcaatggacacagggcaaggcgctcgtcgcatgcggcgtgcagttccccgacgtgacgctggacggcaggaccttccatcccggacaggccaacaacttctacatctttcccgcgatcgggctggcggtctacgccacgaagccgaagcggatcgacgacgcgatgttcatcgaggcggcgcgggccacggccgatcaggtgagccgggccgaccgcgacaacggcatgctgttcccgcgccagaacaacatcctcgagacggagcggacgacagcgacgcgcgtggccgaatccatcttcgagcgcggtctcgccaccgtgaagcgccctgcggacatccgggccttcgtcgagtccctgagttacacgccggaatactga

SEQ ID NO: 9428 - DNA, 453 bp, Methylobacterium sp.
ttgttccgtctgatctacaagagcgcggcacgccacgaggcggaggagatgttccggccgtccaacctgccggcgatcctggcggcctcgcgccgacgaaacggcgagcacggcctctcgggcgtcctcgtctatacgggggccgggttcctgcaggtgctggagggggacagggccgaagtcctcggcgtgttcgagcgcctgctcgtcgaccggcggcaccgcagcgtctcggtgatcgagatgggcgagaccgagcggcacctgttcggaggctggtcgatgggctttctgggagcctcgccggagatcgatgcgcggctcgaggccgcgatcggaccggtctcgggtctcgagcgtgatcccgcgcggcgggtcgagctcctgcgcgccaccctgctcctgctcgtggacgctccgatcagcctgctctggcgcgagggcctgacctga

SEQ ID NO: 9429 - DNA, 330 bp, Methylobacterium sp.
ttggacgacaccccggaaatccgcgagcagctgtcccaggcgtggcgctcgaccctcgacgccgcggtcgcgaacggcgcgccgccccaggcggtgatcgagacgatggtcgaggtggcgcatgcctgcttcgccgaggcgttcggcgcgacggcggccgcgagctacctccagctcctggccgagcagctgcgggcgggcgagcgctgcgagaccgacgagctggtgcgcggcgcgcccgacgagcgcccgtcgcgcagcttcatgcccgccgatgccgaggcgctgatcgacccggactggctgacccggaaagacctgttcggctga

SEQ ID NO: 9430 - DNA, 795 bp, Methylobacterium sp.
atggacatctggcagcgcatcgagaacgaccacgcgaacatcgcgcagctgatccacgagacgccgaacgccctgaacggtccgggcgtggtccgcagccgcgagcggctgctcggcgacctgatcgacgaactcgaccggcacggcgcggcgctcgccgccagcctctacccgccgctgcgacgggacccgagcaccgcccggctcgtggacgagctcgcgcacgaacagaccgcgttcatgcgcgacctccgggcgctcgcgcggcgcggcggcggggcgggctggctcaaccgcttcgaggacgtgacctacgccgtcgaccagtgcctgcaccgccacgtgcacgaactggtgcccgcggcgcgcgagcggctctccggcgacgcagccgagcgggccggccacgcctatgtccgggcgaagatcgaggcgttgcgcgggcggggcgacctgctggcgggtgcgggcctcgtcggcggcaccgccgcggccggggcggcgatcgccgccgtcgccggcctcgccctgctggcttggcgcctcgccgcgcggccacggcagacgtcgaaccgcgcatcggaccatcgctccgagcgggcgttcggcggcgcgcccggccgctccggccccagtcgctggcagccgctctccgaccgggctgcggatgcggctccgggcgagcgacgcgacggcgaggacatgcgggcgcgccaggagcggttgctcgacgagtcgctcgaggaaacctttccggcgagcgatccgatcgcgccgaagcggatcacccgctag

SEQ ID NO: 9431 - DNA, 1545 bp, Methylobacterium sp.
atgccgggtcggatcgtcacagcacgggtcggggggcgggcgctgctcgcggggctcgccgccgccctcatcgcggggccggccggcgcccagacgctcgatcaggccgccgccgcggcgctggagaacagcttcgtcctgcgcgccgaccgggcgcgccaggacggcgccgaggcgcgcgagcgcggcgccttcgacgccttcatgcccaccgtgtcgctgctcggcgacaagccgctctccagccgcttcacctacggcccgcgcatcgagccgacgcagatcggcatcgattccacgccccgttcggcgccccgccagtacggcatctccgccgacctgccgctcttcgacggcttccagcgcctgcacaccctgcgctcggcccaggcgctcaccgatgcgggccgcttcatcaccctgagccagcgccagcaggtgctgctcgacgcggcggtcgcctatatcgcggtcctgcgcgacgtgcggatcctcgccgcccgcgaggcccagatcggggcgatcatgcgcatccgcgacgcgacagcccgccagttcgaggtcaatgacgccactcgcacggacgtggcgctgacccagtcccgcgtgcaggaggccgaggccgcccgcgatcgggcgcgggcggaactcgccgccgcgcgcctcgccttcaagcgcgtgacgcagatcgagcccgagcggatggtgccgccgcgcttccccgaccggatcccgcgcgacgagctggcctacgccgagctcgtccgcgccgccaatccggggctcgccgccgcccgcctcgacgcgaagtccgctgccttccaggcgagcgcgacggtgagcgcggtgctgccgcaggtgaacctccaggtcacccacgcctcgaccttcggctacagcccgacgctcgaccgcatcaccgacacgaccgcccgggtgatcgcgcgcgtgccgatctaccagccgggcgccttcccgaagatcgacgaggcctccgcgctcgcccgccagcggggctacgaggtgcaggaccaggaactggccacgatcaccgcggcccggaccgccttcgccaagcgggtggcgatcgccgaccagctgcggcgcctgaccgagcggctgaccttcctgcgcgcgacgatccggggtttcgaggtggagcggggtgcgggcttccgcaccgtgctggacgagctgaacctgcgggccgaactcgccgacgcggaggtcgccgccgccgccgtcctgaccgagcgcgacgcgctgagcctccagctctcggcggccgcgaatctcctcgacgtcggccagagcgtgccggcggaccggcgcttcgagacgctcgccgcggtgcgcgacccgctgacgaccgccgccctgcggcgcggcggcgcggcggcatcggtgaagctcgcgagccgcgccgggggagaccgcccggagcccgcagcacccgccctgcgcggccggatcgacgagccggcgcaggcgcgcttcgggctcgtgccctacggccgcaccggctgggtcgccctgacgccgtga

SEQ ID NO: 9432 - DNA, 954 bp, Methylobacterium sp.
atgacggagatcgacacgcgcatcggttttctcgcgcgccggatcgccggcctgccgctccggatgcggcgccgggtgctcagagcgaccttcaccctctcgggcctgatgcgcggcttcgagaagtccggccatgcccgcctgttccagcgcgtcctgcgccagtcgagccgcgaggcgcgccgcctggagcgcgaggtgaacctgcacaacctgcagaccgaggccgagtggctggcgctcctcgtgcgcagcgtgcccgcgctcctgcgcgacacgcggcatgtcgcggtctcggatccggccgcgctggagcgggtcgccgcgaccgggcgccccgtgatcctgacgccgctccacatgggcgcctacgtgttctcgctcgccagcctgatggtgcgcttcttccccggccggccgctcctcgttctgcgccagcgcgacgacatgcccctggagaccgcggtgatcgagcggatccgcgaggtcggcgtcgcgatgcgcttccatcaggtcaccgaccggatgggcttcctcgaggccgtgcgcttcgcccgcaacggcgcggtcatcgtgaacttctgcgatctcgatcccgcctacggcgcgcccgccccgatgccggtgctgggcctcgacacccgcttcgccttcggcaccgacacgctggcccggctcaccaacgcgctcgtcgtgccgctggcctgcacgatggagccggaaggcgacctcgtgcgggtcggccccaccttcgaggtccacgcgagcgccccgcaggagcgcgcccgcgtcgccgccctggtgcgcacccatatcgaggcgagcctcagggcgcggcccgagcagtggcacctctggtcggcgcttcaagactatttaccggtcaccgatacagtcacggacgccgccgcccggaccggggaggcggatgaacagatccggactgccgcgtga

SEQ ID NO: 9433 - DNA, 1230 bp, Methylobacterium sp.
atgacagacagggtcgcccccgcgccgcgcgtcaccaagcgctacgccgccaagcggcaggccatcctcgacgcggcggtcggccacttcaacgcgcgcggcgtgcgcgggaccgccctcaccgacgtggcggccagcgtcggcctcgtgaccaacagcatcacctactactaccgccggaaggaggatctcgcggcggcctgctacctgcgcggcctggaatggcataccgccctgctcgacgcagcccaggactgcgaagcggcgaccgacccggcagcgcggctgcgcgccttcctcgccgcctacttccgcgatctggccgcgatcgaggcgggcacacagccgccgcaggtccgcctcggcgacctgatggccctgccgagcccgcagagcgacgccgtgttcgccgcctacaacgacctgttccggcgcgcccgcgccctcttcgtgcccgagcgcgccgatctcggccgggcggagcgcggcgcccggacccatctcgtgctctcggtggtgcacacggcgcgcctgtggatcgaccgctacgagccgcaggattacgggcgcgtcgccgagcggatcgccgacatcctgctcggcggcctcgccggcccggacagccggtggtccgcggcggggccgccgctcgtgcgcgcgccgggcgggccgaccgagccgttcctgcgcgcggccaccgtgctgatcaacgaggagggctaccgcggcgcctccgtcgagaagatctcggcgcggctcagcgtgacgaaggggtccttctaccatcacaacgacaacaaggacgacctcgtcgccgactgcttcgagcgcaccttcgcgatcctgcgcgccgagcaggcggcggccgaggcgcggggcggtccgggctgggaccggctcaccgcctgcgcccgcgcgctggtgcgtcatcagttcgacccggggggcccgctcctgcgctgcgccgcggtcggggcgctgccggatgggctgcggagcgaggtgccggcgcggctccgccgcctgtgggaacggctcgcctttccgatcggcgacggcgtcgccgacggctcgatccggcccgtcgatccgacgatcgccgcccaggtggtgagcagcgcgatcgacgcggcctgcgatctcgggcgctggtgcccctcggccggcccggacaacgccccggacctgttcgtacgcccgctcttcctgggcatcctgacggcggggtga

SEQ ID NO: 9434 - DNA, 1269 bp, Methylobacterium sp.
gtgaccgcgctggacgcgcgcgcgccctaccagtcgcgcgccgcgcactgcgcgctgatgggcgcgctcctgttcaacgccgccctctgcttcctcaacacgatcggtctgcccgtgaccggcggcacggtcgccggagcggaggcctgcatcgtgatgctggcgctggccttcgcgctcgacgcgcgcgccggcccctggctggtcctcgcggttctggcggcctacgcgatcctgatcctcgtcctgcgcggctcgagcgacccgaagatggtgcgcgacctgctcatcccggtcgccttctacaatctcggcctgcgcgcgcccgacatccgcgacgccgaccgcgcggcgctcgccgcgggcctcgtcgtggtggcgatgggggtgttcgagtacgcggcccttccggtctacgagcagctcttcaacgtcgtgcgctactacatcgcccgcggcaccatgacggcggcggagatcaacgggctcaccggctcgctcttcgtcagcggcgtgcggccggacgcgcgcacgatcctgcccttcctggggccgcaccgggtctcctcggtcttcctcgaaccggtctcggcgggcaatttcggcgcgatcctgttcgcctgggggctctaccggccgggcatgcgcggccgggcgctgctcttcggctgcgcggccgtcaccatcatcctggcggatgcccgcttcggcgccgtggcctgcgcggcggtcgccgccgcgctgctggcggcccaccggctgccgcgcctgctctggttcgcgctcccttgcgcgatcctgctggcgctcgcgatctgcggcttcgagagcaccgcatcggaccggaccaacaacttcgtcgggcgcctgctggtggccgccgacatcatcaccgggctgcccgtcgagggcgtgctcgggatcagccccgagaaggtgttcgtctcggatgcgggctacgcctacgtgctgctccagatcgggctcgtcggcgggctggcggcgtggctgctcttcgtgctgatgccggtgggcagcgcggatgcgtggcggctgcgctgcgctgcggcgacctacatctgcctgctgctcgtcatcagcgactcgcccttctcgatcaagaccgcggccctgctctggttcctgctgggcgccgccgacggggcgggcgaagatcccggctgctccgaagaggaggtagcggcatcggccccctgtgcgggggctctcgtgagcccgtggccgggactttcggggatcgcgcggtag

SEQ ID NO: 9435 - DNA, 633 bp, Methylobacterium sp.
atgatcggagaattctacgtgttggcaccgtcaaggcagcgttatttggacctcctgccggactttggcaaaacgccagagcgcaagacgacggctgatagcgccggcatcatcggctacatcattgaagctgccaagactgccgtccactggattgcggaaagctggaccggagaaaccctgtcagagaacccggatccgaccaccgcctcgaatgaaagcagtctggtgcagatggcggtaatcgataaccgacaacttgtcctcaccggtgatgtcgggccagatgggcttcacgaggccgccacgtacgccgaggctctggtgggggtgctgtcaccgacgttcatgcaggtgccgcaccacggcagccggcgcaacgtgacgccatcggccctcaaccgctggcttggcccaatcaagccgcagggcagcgccactatcggctcagccttctgctcggccgcccgtctggatgaggatcacccgcgccagaaggttgttaacgccttcacccggcgcggctatggcgtgcacaaaactaagggccgccacatctacaaccatcacggcacccagcgtctaggcgattcgttggcgcccgaaccgttttctgatcgggtcgaagagtga

SEQ ID NO: 9436 - DNA, 741 bp, Methylobacterium sp.
atgagacttgcgccgggcctcgtactcggtgcgctgctcgcgccgctgccggtcgcggctgaggaggttgcggtggatgcgggcgtctggccctacgcggcggtgggcaagctcaacgtcgtgctcggggccaatcgccgtgccttctgcagcgccacgctgatcgctccacgtctcgtgctgagcgccgcccactgcctctgggacgggccccgtgcgcgctgggtcggcccgcagagcgtgcatttcgtcgccggctggcggcagggcacctacaacgcgcacgcggtcgcctcgagctaccgcaccggccccggctacgccttcggtacgacgccggcggatctcgcgcgggactgggccctgatcgtgctgtccgagccggtggacatccgcccggttcccctggctcccgcgcatatcgacgacacgccggagaacggccgccaggagatccgccgggccggctacagccatgcccgggccgagcgcatgagcgcgcagggccagtgcgcggtcgagaaccagagcgaaccgcctttgctgctgcacgattgccgcgccatcccgggcgagtccggctcggctcttctgcgaatgggggagggcggtcccacggtgatcggcgtgctggtcgcgcgccgtccggaagggacgggcgcccgctcgctcgcggttccggtccgcagtttccgggaggaggcggaccgcatgcgcgcagagctgtccccggtccgttaa

SEQ ID NO: 9437 - DNA, 804 bp, Methylobacterium sp.
atgcgcgcgcgctccggtctgcgcggcggtgcccgcctcggccatcgcggcgcggtcgacagcctgttccgcgacggcctggaggacgcctacgagccggggcgcctgatgggcagcttcggcgaccggatcgcggcggagtacggcttcacccgcgcggatcaggacgccttcgcgctggagagcctgcgccgggcgctggccgcacaggcggagcacgccttcgcgcgcgagctggtcggcgtgccgtccggcgcggctcaggttgagcaggacgagcagcccggaaaggccaagcccgagaagattccgaccctgcgcccggccttctccccggacgggaccgtgacggcggccaatgccagttcgatctcggacggggccgccgccctcgtcctggccgatgcggccggcgcggaagcagcggggctgacgccactggcccgcttcgtcggcacggcctcccatgctgggccgcccgcccgcttcgcctgcgccccggtccccgccatccgagccctgctggatcaggtggggtggggcgtcggcgaggtcgacttgttcgagatcaacgaggccttcgcgctggtgccgatgatcgcgatgcgggaactcggcatcccgcacgcgcggctcaacgtccatggcggcgcctgcgcgctcggccatccgctcggggccagcggcgcccgcatcgtcgcaacgctcctcggtgccctgaaggcccgtgggttgaggcgcggcgtcgccagcctctgcatcggcggcggcgaagcgacggctctcgccctggagatcacttga

SEQ ID NO: 9438 - DNA, 393 bp, Methylobacterium sp.
atgcgcgttctgctcgtgggctatgagccggaggtggtcgatttctcggatccggccttgccgcccggcctcgacgccgggaagatccgtcacgggatccgggtggctctggaggagatgcgcggtcgcggctggacggccgaggactgcctcatccggcccgacgatcaggccggtcccgcactgaaggcgaagctctcctccggcgccttcgactgcctcgtgatcggtgcgggtatccggggctggccgcgccatctgtccgtgttcgagcgcgtcctcaacgcggcccgggaagctgcgccgacggtcccgatcgccttcaacacgcgtcccgaggacagcgcggaggccgtcgagcgcgtctgcggcgggcagccgaccgccggatga

SEQ ID NO: 9439 - DNA, 189 bp, Methylobacterium sp.
gtggccccacctcagaccgtcgagttcggccgcgggctcagtccgcgcgatccgaccggcatcctgcgcggtcagggaatcagcagccgccacggtggcatcggcaacatgggcggcggctccggccgaagcgcgaacacgggcgtcgggctcggcggcatcggcgccaatcagggcgcccggttctga

SEQ ID NO: 9440 - DNA, 1002 bp, Methylobacterium sp.
atgcaacgccgcagtttcctcatcggcgccggagcagcgctgggcctcgggcggacggcccgcgccgacgtcgtgaaggtccgcatcggcgtcggcggcaagcccctgctctactacctgccgctgacgatcgccgagcggaagggcttcttcaaggaggaaggcatcgacgccgagatcaacgatttcggcggcggcgcgcgctcgctccaggcgctgatcggcggctcggtcgatgtggtcacgggcgcctacgagcacacgctgcgcatgcaggccaaggggcaggacgtgcgggcggtctgcgagctcggccggttgcccgccatcgtcatcggcgtgcgcaaggacctcgccggccaggtgaagagcgtggccgacctgaagggccgcaagatcggcgtgacggcgccgggctcctcgaccgcgctgaccgcgcagttcgcgatgatcaaggccggcctgaaggccaccgacgcgccgctgatcggcatcggcggcggggccggcgccatcgcggcgatgaagaagggcgagatcgacgcggtttcccacctcgatccggtgatcgcgaagctggaggcggacggcgacatcaaggtgctggtcgatacccgcaccgacgagggcacgcgcctgctgttcggcggcccgaacccggcggcggtcgtctataccaagcaggactggatcgagcgccacgcgatgggcacccagaaggtggtcaacgccttcgccaaggcgctgaaatggctcgccgccgcgagccccgaggagatcgccgacctcgtgccgccggcctaccatttcggcgaccgggcgctctacgtgcaggcggtgaagaactcgctcgcgacctactcgcgcaccggcattccgagccgcgacggcatgaacagcgtgctggaactggtccgcaccctcgacccggaactgcagggcgcgcagatcgacctgggcaggaccttcgaggaccgcttcgtgaagcgcgccatggagtag

SEQ ID NO: 9441 - DNA, 849 bp, Methylobacterium sp.
atggacggcagccggcacggctcggccgagaggatcgacgcgcgggtgccgcaggacgcggccgtggcgctgcgcgacgtcaccatcgccttcacgctcaagggcggcaagcgatacgtcgccgtggagggcatcgatctcgcggtgcggccgggcgagttcgtcgccgtcgtcggcccgacgggctcgggcaagtccacgatcctcaacgccgccgcgggcctgctgaagcccgcctcgggccgggtcgacatcttcgggcaaccgctcggcggcctcaacggacgggccggctacctcttccaggccgacgcgctgatgccgtggaagaccgcgctcgacaacgtcgcggtggccctcgaaccccagggcgtgcgccgggccgaggcgctggagcgggcgcgcgcctggctcggccgagtcgggctcgcgaccttcacggaccgctacccgcacatgctctcgggcggccagcgcaagcgcgtggccctcgcccagatgctgatccgcgaccccgagatcctgctgatggacgagcccttcgggccgctcgacgcgcagacccggcagatcatgggcaacctgctgctcgacctctgggcgcagaaccgcaaggcggtgatcttcgtgacccacgacctggaggaggcgatcgcgctctccgaccgggtgatcgtgctctcggcgggccccgccgcgcgcatcgtgggcgacttccccgtgccgctcgcccggccccgcgacatcagcgagatccgcctggagccccgcttccacgacctctaccgcgagatctggtcctgcctgcgcgtcgaggtcacgcgcgcctatgccgacggcccggcctga

SEQ ID NO: 9442 - DNA, 213 bp, Methylobacterium sp.
atggccaacaccatgaacgcccagtgccagagctgccgctacttcgacacgcacaaggccacgcagtcggccggccagagcggcgacgagggtctgtgccgcttcaacccgccggtgacgcagccggggccgcaggagcacggtctctggcccgtcgtgtcggcgtccgactggtgcggccactactcgcccgagatgatggccggcgagtaa

SEQ ID NO: 9443 - DNA, 1263 bp, Methylobacterium sp.
gtgtcggcgctcgccctggcggggctcgcctccgcggccgtggcgcaggaggcgccgcctcttccgcgggcggaccccgccgcgatgggcttctcgcccgagcgcctcgcccgcatcggcacggtgctgaaccgcgaggtggcggagggccggatgcccggcgccgtcctgatcatcgcccgcgagggcaaggtcgtgttccacgaggcctacggcttccgcgacaaggccgcgggcgcgccgatgccgcgggacgccctgttcaacatcgcctcgatgacgaagccgatgaccgcggtggcggtgctggggctcgtcgagcgcggcgacctcgtcctcgacgatcccgtgagcgccgccctgccgggccgcttcgccgagcagcgggtcgcgagcctcgacctcgcgggcaagctcgccggcaccgtgccggccgcgcggccggtctcgctgcgcgacctcctcacccataccggcggcctcgtctacggcgggcgcggcaccacggaggtgcaccggatgctccccgcgggcagcgtcgcggcggccaaggagctcgacggcgagaaattcctcgacgcgctccaggcggcgccgctgctgcaccagcccggcacggtctgggattacggcttcggtctcgacgtcgccggcctcgtggtcgagcggcagaccgggcggccgctcgacgcccatctcgccgagaccgtgttcggcccgctcggcatgcgcgacaccggcttcgtgatcccgcccggatccgtggaccgctacgcccgggcgctccccgcggatccggcgaccggcaagccgcaggtgctggagcccgacgccacccggccgacgaagttcgcctgcggcggcggctgcgccgtgtcgagcgcggaggattacctgcgcttcgccctggcgctgatgaacgagggcgagctcggcgggcgccgggtgctgagccccgtcttcacccgcgccatgctcaccgaccagctcggtcccggcgtgcgcaacctcatcggcaacgccgacccgacccgggccgattacggcttcgggctcgggctcgcggtgcgcacccggcccggcgtggtgcggctcctcggctcggtcggcgacttctcctggccgggctccagcggcacgaactggtgggtcgacccgggccgcaagctcgccgtggtcttcatggcccacacgccgggcgccgcccgctggcgctaccgctacctgatcaacagcctcgtctatcaggccctggagcggtag

SEQ ID NO: 9444 - DNA, 264 bp, Methylobacterium sp.
atgatccgcatcgtgaagcacgtcatcgtggagacgaccgaggagcgcgatcgacaggtcgagcaggtcgaggcagcgatccgggcgcggtttcccgatgccacgacggaggtcgtgcagggactgctggacgaggacagggtggtcgaggcgcggctgcccctgcggcagctcgccgagtggcatgtgcggcgcccgcaactgctcgccgaagcgttggagaccgacacggatcacgccgccgacatcgaccggcaggattga

SEQ ID NO: 9445 - DNA, 393 bp, Methylobacterium sp.
atgaagcgcttcagaccgatcgtgatggcgggcaccatcctgggtgccgtcctgggcaccgtcctgggcctcgggccgatcgagagagggacgaccggctccgccgtggcgctggccgcgcagggctgcggccccggcttccaccgcaacgcctacgggtcttgccggccgaatgcctacggggtgccgggcacctaccggccctacggcgcctacggctatcgcggcggctacgcctatcgcggcgcctatggacggcgggtctacggcggccgcgtctacggcggccgcgcttacggcgcacgcgcctatggcgggcgcgtctcgggcggccgggtccgcgccgggcgcgcctacggcggctatcacgggggcttgcgcggccggcgatag

SEQ ID NO: 9446 - DNA, 249 bp, Methylobacterium sp.
atgcgataccgcccgctgccgcggcagaccctcgtcctcgccggcgccctcaccggcctcgtcgtggccctgccgagacccgcggaggccgtcgtctgcgcgggcggcgtctaccgggccggctgcgtcggcccccgcggcggggtcgccgtacggcgcggcgtctacggcccgcggcgcgtcgtcgtgcggggcggcgcctatcggccgcggaccgtcgtctatcggcgcggcgtccgccgctggtga

SEQ ID NO: 9447 - DNA, 828 bp, Methylobacterium sp.
atgtccgagtccccgaccgatccgggcgcgcgcgcctggtcctgcgaccgcttcgagatcgacgcggtcgcggtctgcgacatgccgctcaccgccgtgttcgagcacctgcgcggcgccatggacgacgggcggcaggtcgcgctcggcttctgcaacgccaacatgctgctgaaggcgctctgctcggcgagctacgcggcggcgctgaagaagctcgtgctcctcaacgacggcgtggggctcgacctgtgctcgctcctgttccgcgggcgcttcttccgcgagaacctgaacggcacggacctcgtcccggccctgctcgggggcgagacgcgggagcggaccctgttcctcctcggcgccaggccgggcgtcgccgaggcggcggcgcgcaacatcgccctgcgctatccccagcaccgggtcgtcggcacccggcacggctacttcgcgcccggcgaggtcgaggcggtgatcgccgagatcaacgcggtcgccccggacatcctgctggtcgccctgggcaacccggaccaggaaaccttcatcgccgagaacgcgcaccgcatcgacgcgcggatcctgatgggcgtgggcgcgctcatcgactacacggccggcatcgccgtgcgggcgcccgcccccgtccggctcctgcggctcgagtggctctaccgcctgatgcgggagccgcgccgcctcgggcgccgctacacggtcgagctcgcgctgttcctcggcctgatcgtccggctccggatcgcggcgctggtacggggccggacggtcgtcgcggcaggcggggccacctcctccgccccgtga

SEQ ID NO: 9448 - DNA, 1044 bp, Methylobacterium sp.
atgcggcgggctgaggcggtgccgcgcgccgccgcgctccgcctcgccctcgccctcgccggagcggccggcgttccggcccgggccgcggagcccgcctgcctgcgcggggtcaacctgagcgggcccgaattcggcaccgtgccgggccgccacggcaccgactacgcctatccctcaacgcggacgattgcccgcttcggcgccctcggtctcacgggcgtgcggctgccggtgcgctgggagcggctgcagccccggctcggcgcgcccctcgacgcggcggagctgctgcgcctcgacgcggcggtggtcgcggccaagctcgccggcatgcgcacggtgatcgacctccacaacttcgcctattacggggcggaccgcatcggcaccggcgcggcgactgctgccgccttcgcggatgtctggcgccgcctcgccacgcatttccgcagcgagcccttcgtcgccttcgggctgatgaacgagccccacgatatcccggccgcggactggctgcccgcggcgaatgccgcggtcgcggcgatccgcgagtccggcgcgcctcagctcgtgctggtgccgggcacgatctggacgggtgcgcatagctgggagtccgacacgccgctcggcaacaacgcccgcacgatgctgggcctcgtcgatccgggggagaacgtcgcctacgacgtgcaccagtacctcgacgccgacttctcgggcacgtccggaacctgcccgcgcggcgccgacgctctcggcgccgtagagcggctgaccggctggctcgcgcagaatcgccgccgggcctatctcggcgagatcggcgcctcgatgcaggccggctgcccggaccagctcgccgccatcctggcgcacgtgaacgcccatccccagcagtgggtcggctgggccgcctggggcgcgggcgactggtggccgccggcctaccatttcaggctggagccgggcacgggcccggtcaccgcggtgatccaggccgccgcccgtgcggcgccgcgctgcggggggcgcccgtga

SEQ ID NO: 9449 - DNA, 1161 bp, Methylobacterium sp.
atgcaggtggatccggtcgtcgtcgccagtgcggcacgcacgccgatgggcgcgttccagggagagctgaaggccctctcggctccggaactcggcgccgccgcgatccgcgccgcggtcgaacgcgccggcctctccagggagggcgtctcggaggtcgtgatgggctgcgtgctcccggcgggcctcggccaagcgccggcgcgccaggcggcgctgggggcgggcctgcccgagggcacgccctgcgccaccctcaacaaggtctgcggctcgggcatgaaggcggtcatgctcggccacgacatgatcgcggccggctccgccgacgtggtggtggccggcggcatggagtcgatgtcgaacgccccctacctcctcgacaaggcgcgcggaggccatcgcctcggccacgggcgcgtcctcgaccacatgttcctcgacgggctcgaggatgcctacgaccgcggccggctgatgggcaccttcgccgaggacacggcgcagcactatcaattcacccgcgaggcccaggacgcctacgcgctggagtcgcttgcccgcgccaagcgcgccgcggaggcgggcgccttcgacgcggagatcgtccctgtctcggacctggcatcggacgagggtccgcggaaggcccggcccgacaagatcccgacgctcaagcccgccttccgcccggacggcaccgtgacggcggccaacgcctcgtcgatctcggacggcgcggcggcgctcgtgctgatgcggcagtcggcggccgagcgcggcggccacaccccggtcgcggtgatccgcggacacgccagccacgcggcggcccccgcctggttctcgacggccccgatcggcgccatgtccaagctctcccggaaggtcggctgggccctggacgatgtggacctgttcgagatcaacgaggccttcgcggtcgtcgccatggcggcgatgcgcgatctcggcctgccccacgacagggtcaacgtccacgggggcgcctgcgccctcggacacccgatcggtgcgtcgggcgcgcgcatcgtcgtgaccctgctctccgccctcgcgcgcaccggcgggcggcgcggcatcgccgcgctctgcatcggcggcggcgaggccacggcgctcgcggtcgagcggctctga

SEQ ID NO: 9450 - DNA, 885 bp, Methylobacterium sp.
atgacgaagttcgtcctgaccgtgacctgccgatcgacccggggcatcgtcgcggcgatctccggcttcctggcggagcagggctgcaacatcgtcgacgcctcgcagttcgacgatcttggcagcgggcgcttcttcatgcgcatcgggttcctgtcggaggaggggaggggggcggaggccctcgccgcgggtctcgcgccgatcgcggcgcgcttcggcatggagacggcgatccacgatgaggcccagcgcatgaaggtgctgctgatggtctcgcgcttcgggcactgcctcaacgatctgctctatcgctggaagatcggcgcgctgccgatcgacatcgtgggcgtcgtctcgaaccacttcgactaccagaaactcgtggtgaaccacgacatcccattccaccctgtggccgtcacgaaggcgaacaagccggaggcggaggcgcggatcatggagatcgtgcgcggcaccggggccgagctgatcgtgctcgcccgctacatgcaggtgctgtccgacgcgatgtgcgcggcgatgtcggggcggatcatcaacatccaccactcgttcctgccgagcttcaagggagccaacccctacaagcaggcctatggccggggcgtgaagctgatcggcgcgaccgctcattacgtcacggcggacctcgatgagggaccgatcatcgagcaggacacggtgcgcattacccacgcgcagagcgcggaggactacgtctcgctcggtcgcgacgtagaggcacaggtgctggcccgagccatccacgcccacatccaccatcgcgtcttcctgaatggcaaccgcacggtggtcttccctccgagcccgggaagcttcgcgtccgagcggatgggctga

SEQ ID NO: 9451 - DNA, 363 bp, Methylobacterium sp.
ttgaacggcgagcgcctctcggaggtctcgcggctcgcaggtgtcctggcggatcaggtgctgctcgagcccgtggacggcgacacgtcgctggcgaagctcaccgcgctcggcaaggcggcgctgctgctgcaggattacgaccgcccgattccggatcgggtcgtggacgtgctcggtcgagcgcttcgcgggacggaagaggacggtgccgcggcaggcgggacgcctgggaccgacgccgcggccggtgccgaggagggaggcggagaggtcgccacgatgccggcggcggaggacgacgggggcccgcggcgcctgttcccgcgcctgatccagtccctgcgcccgttgcgcgggtag

SEQ ID NO: 9452 - DNA, 741 bp, Methylobacterium sp.
atgctgaacgcgcgttgcctgcaccggcccgagctaaccgccacgctcgccagcggcgaccgcaagctcgacaacctgaccgccccccatccgcgcaccttcgcggcgggcacaacgatcgtcccgcagggtacggagcacggctacgtctaccgcctgcgtaccggctgggtcggccgcgtgcgcgcgctgccggacggacgcgcgcagtacctgatggtgttcctgcccggcgacctcttcgccatcaagagcgtcttcgtcgcggcccacccggacgcggtcgtggcgctgtcggacgtgacggtcgagcgcctcgagcagcatcgcctgcgcgatgccttcgataccgatcccgagatcgccctgcgctgcacgtggcagatcgtcgaggaggagcggcgactgcacaattgggtggtcagcctcggccagggcagcgcggaggagcgcatcgcccacgtgctgctggaattcagcgtccggctcggagccgccaccgggacggcgcgcgccctccagtacgggattccgctgacgcaggaccagctcggcaacgtgctcgggctgacctccgtccacgtcaaccgggttctgcggcgcctgcgggaggacgggctcgtcagcatccgcaaccgggtggtgagcatccacgacgcgccagccctggagcgcatggccgagccgcttcgggacgccacccttcaggccacggcacgtcccgaagtcgcggccggctga

SEQ ID NO: 9453 - DNA, 912 bp, Methylobacterium sp.
atgttcgccccgggccgcctgacagttggtgttttctttcccatcgaggccttccagcgcgaccagccaaccatgcgcgaccaagagcgtctggcggttcgggcggaggagctcggctacgcggcgctctggatccgcgatgtgcccttgcgggatcctgatttcggcgacgttggtcaggtctacgacccatgggtctggctcggctggatcgccgcgcaaacgcgcgagatagcccttgcgaccgggtcgatcgtcctcccgcttcgccacccgctccataccgccaaggccgccgcctccgtggaccggctgtcgagaggccggttcattatgggagtggcctcgggagacaggccgatcgaattcccggccttcggcgtgcttgccgacgagcgcgacgttctgttccgcgaaagcatcgccgtcatccggaaggtcctcggagaggagttcccggccctgcattcgcgcttcggagaaatgctcggccacgtcgatctcgtaccgaagccgatcggacggctaccgatcctcgtcaccggatcgagccggcagagcctggaatggatcgccgaacatgcggacggctggatcacctacccgcgcccgctcgagcgccaggccgaactcgcggcccggtggcgggcgaccgccgcgggtctggcgccgggtacgttcaagccgttcgcccaatccctctacatcgatctacatgccgacccgcattatccgccgcaacccattcaccttgggttccgcagcggtcgcaaagccctgctcgactttctggtcgcgctccgctcgatcgacgttcaccacgttgtcctgaacctcaagtacggttcccgcagcgcgggcgaagtgctcgaagagatcggcctcgaggttttaccgcatctgaatgcatag

SEQ ID NO: 9454 - DNA, 2127 bp, Methylobacterium sp.
atgccgtcctgcccgcgcctggcctcctgcgtacccgcctcggaagcgatcgagccgctctcgttcgagaccatgctggaggtgctgccggtcggcgcgatgacctgcgacctgcgcaccttcacgatcgattacgcgaatacctgctcgatccgcctgctgcactccatccgcgacagcctgggcatcgatccggaccggatcgtcggcacctcgatcgacgtgttccacaagcagcccggctaccagcgcggcctgctctcggacccggcgcgcctgccccacaaggcgcgcatccgcttcggcgacgagtggctcgacctgcacatccacgcgctgccggattcgcggggccgcgtcgtgcgcgcgctcctggtctgggcgatcgcgaccgcggaggtggccaaggagaacgaggagtacaagctcctgcgcatgatcgacgacatgccggtggcggtgatgacggtcgatccgacgagcttcgcgatcacctacctgaacgagacctcgaagcgcacgctctcgcagatcgagaccctgctgccggccaggcccgaggcgctgctgggcgcgtcgatcgacatcttccaccgcaacccggagcaccagcgccggctgctcgcctccccggagaacctgccccaccgcgcccggatcaagctcgggccggaggtgctggacctgcaggtctcggcggtcacgggaacggcgggcgactatatcggcccgatgctgacatggtcggtgatcacccagcaggtggccgccgaggcgcgcatccatcagctcgcccactacgacacgctcacggggctcgccaaccgggcgaccttccgcgagcacctcgaggccgccctggaccgggcgcagccccgcctgggcctgctcttcatcgacctcgacgggttcaagctcgtcaacgacgccaacggccacctcgtcggcgacgccctgctcaagcgggtcgccgagcgcctgcgcgaccgctgcggcgccccgggcgtgatggtggcgcggctcggcggcgacgagttcgcgatcctgatccaggacggcgacgacgcggccgcgacccggctcgcgggcgacctcgtcgaggccctggtggagccgttccacgtcgcggacgagcggcgcctgcaggtgggggcgagcatcggcgtcgcggtggcgccgctgcacgggagcgattccgagacgctgctgtcgcgggccgacatggcgctctacgccgccaaggccgccggcaagaacaccttccggctgttcgagcccgagatggagcggcggatgacccagcgcgtgcgcctggaggcgaagctgcgccgggcgctggagcgcgaggacgagctgttcctgttctaccagccgatcaccgacatccgcaccggccgggtcacggcgcgcgaggggctgatccgctggcaccatccggcacgcgggtggatcccgcccggcgatttcatcccgatcgccgaggagagcgggctgatcgagaagctgggcgcctgggtcctgcagcgggcctgcgcggacgcgatgggctgggaggacggggcgcgggtcgccgtgaacgtctccccgcgccagctcggcagcggccggctgacccagtccgtcctctccgccctggtggcgagcggcctgccgccgcagcgcctggagctggaggtgacggagagcgcgctgctcagcgagcacgtcgactgcctgggcgagctgcgccggatccgcggcttcggcgtgcgcatcgcgctcgacgatttcggcaccggcttctcgtcgctggcgcatctgcgcgcctttccgttcgacaagatcaagatcgacgggtccttcgtgcgcgacgcgacgagccggccggactgcgcggcgatcgtcggcgtggtcgccgatctcggccgccgcctcggcgtgaccacggtcgccgagggcgtcgagacggaggcgcacctcgccctcgtcaccgcggagggctgcagcgaggtccagggctacctgctcggccgcccccagccgcacccgcgcgacgcggagcgggtggcgcggctctcggcgcgagacgctgcggaacgccccgccgcgccgccggccgacgacgagagcgccagtgccgcggcctga

SEQ ID NO: 9455 - DNA, 279 bp, Methylobacterium sp.
atgcgcaatccctacgacgtgctgggcgttcccaagaacgcgagcgaggccgacatcaagaaggcctatcgcaagctggcgaaggcctaccaccccgaccgcaacaaggacgacgccaaggcgaaggaccgcttcgccgaggcgaacagcgcctacgagatcatcggcgacgccgagaagcgcaagcagttcgaccgcggcgagatcgacgccgacggcaagccgcgcgcgaccgggttcgaggggttcgggggcggcttcggcggcgggcgcggcttg

SEQ ID NO: 9456 - DNA, 1476 bp, Methylobacterium sp.
gtggctgaatttacgggcggaactggcagcgatacattcgcgggtacgtcggccgacgatatcatccgggggcttgccggcaacgacacgcttacgggcaatggcggcaacgacctgatctacgggaaccagggcgacgacgtcatcctgttcggtactgcgaccggcagcgcgctcgccggcaatagcaccctctacggcggtcagggcgacgattcgatcgactacaccggctcgacgggccgcaacctgatctacggcaacctcggcgacgacacgctgacgggcggcaccggcaacgatacgctcttcggcggccagggcgacgacgtgctgaacgccggcggcggcaacaacctgctgttcggtggcctgggcaacgacacgctcaccggcggtgacggcaacgacaccctcaccggcggcgacggcgacgacagcatcgtagcgggcagcggcgacaacctgatctacggcaaccagggcgatgacacgatcgtcggcggcaacggtgccgcggcatccgacaccgtcttcggtggccagggcgacgatctggtcgattactcgaccgcggccggtgcgaacgccatctacggcaacctcggcaacgatacgctgatcgccggcagtggcggcgacagcctgttcggcggtcagggggacgacagcctcgtcggcggtgccggcaacgacctgctggtcggcggccagggcaacgacacgatcgtcaccggccagggcggctcggatgtcgtctacggcaaccagggtgacgattcgatcacttacggcacaccggccgggactgcaggcgtcgacactgtttacggtggacagggtaacgacgttgttgattacagcctcaacaccgcgggcggcaacgtcgtctacggcaacctgggtgatgacacgatcacgggcggtgaaggtttcgacttcctttacggcggccagggtaacgacgttatctccggctacggctacctgagcggcggccagggtaacgacagcatcactgctgttggcgaggcgggctcctacctcctcggcggccagggtgtggacaccctcacgggtagcctcgcgggcaacgacaccttcgcctttgcggccggcgattcgggcatcaccgcgtcgacatccgacctgatcacgggcttcggcagcggcgacagcatccaggtgcaggtcgtgggtggcgtcgttcgtgccgagaaccgcgcggctgccggacggagcttcgatcagcagcgcgagctcgccaacgaagccttcgcgaatggtcaggccaacgcgatcttcatcacgggtgcaccggctgcggacggatccacggctgcctcgggcggctacctcttcgtcgacaccgatggcagcggaacggccgatatgtcgatccgcctgacgaacggcacgctcggcgatggcgatggcgtcgttcagcgctacaccgctccgacgcccgacgcctga

SEQ ID NO: 9457 - DNA, 120 bp, Methylobacterium sp.
atgacgaagctcgacgcgaagaccctgaaggccgtcaccggcggcaccgcctgccctccggccaaggacccctgcgccccggcctgcaaggacaacggcggcaagtccaagaagtgctga

SEQ ID NO: 9458 - DNA, 120 bp, Methylobacterium sp.; identical to SEQ ID NO: 9457

SEQ ID NO: 9459 - DNA, 174 bp, Methylobacterium sp.
atgcggacctgcctgctcctcgccctcgcgaccggcctcctgggtctcggcctgcgcctcgtcctgccggtgattccggccgacgccgccttccgcgaggtggtgcgttactacggcgcggaccggcccccgggcgaatccggcaatatgcgcgaaacgtcggcgccgtactga

SEQ ID NO: 9460 - DNA, 174 bp, Methylobacterium sp.; identical to SEQ ID NO: 9459

SEQ ID NO: 9461 - DNA, 105 bp, Methylobacterium sp.
atgcagaagacgatgaaggcgttctcctacggcatgatcggcgcgttcgtggccggtctcggcctgaccctctggggctcggccagcctgctcgcgggcctctga

SEQ ID NO: 9462 - DNA, 201 bp, Methylobacterium sp.
atgtctcagagaatcaagcccgaccgcccgatctggccgtcgctgccggagaccgaggtcagagccgtgccgtcgtccgggccggccgaggcaccccgcgccgcgccgctgcagggcggaagcggaccgggggcggccggaccgcaggcgcagcgggtggcgaccgccacggtggaggccttcggatcgctcgccggctag

SEQ ID NO: 9463 - DNA, 489 bp, Methylobacterium sp.
atgagcgatttcgccggttcctatctcggagagctgcgccggctggtcggctcgcggctgctgctggtgcccggcacccgcgtcgtggtgagcgatgcgggcggccggatcctcctcgagcagcgctccgacttccgcctctggggactgcccggcggggtgccggacgcgggcgaggacatcaccgcctgcgccgtgcgcgaggtcttcgaggagaccggcctgcggatccgcgatccggtgccgttcggcttcgcctccgcgccggagcacgaggtctggacctacccgaacggggatcgctgccactacttcacgttgctctacgcggcccgcgccgagccgggcccgctccggcgggcgggcggcgagaacctggagctcggctggttcgagccggagagcccgcccgacctgatgccgaccatggcccgcaccctggacgcgtaccggcgctggggcggaagcggaaccttccagatgctctga

SEQ ID NO: 9464 - DNA, 1110 bp, Methylobacterium sp.
atggaacagaccctgaccgacggcgtgccggcctctacggccggcggggctgatctctttcacgtcgcctacccgcgcgtgctaccggagcggaagccgcccggccacaagccggcggcgccgcgctacaccctgcgctggcacaagcccgtcggcacgatggtgagccagtatcacgcggtccagaggacggacctagacctagagcagcgccgcgccttcttcgacctgatgatcggaagcttcgcggagcccgacgggccgtgcgcgcacgagatgatgacattcgtcgacgagcaaggcgagaccaacgcggtcgtggcctcctactggctcgacgcgacggcgcacgcgcgatggagcgtccgcgccacagcctcccgctggttcgcggacccggagcgacagaccggcccgaccgggtgctggcgcgagaccatcgcggtcccctacgatcggcacgagacgatctactcggagccgcattaccggatcgggctggcacgcaccgcggatgcagcgatcgtgccgatgacgaccaacgggtacttcggggccgcacgggaccggctgccgatagcggcgatcgaccccctcgacagcccgctggcgagtgatccgccgcgagcgcgcacgctcgagagccgcgggtgccacctgctcgcctcgacgccacacaacatgactgcactgcgctccggacagttctggcaagcggcgcaagcggcacaactagaggattacgttgagaatatggagcccaagttgatgcgagggatggattatctctcgcacaacaagaccgagagtggaacgctgtcgcttcgtgtgatgaccaatctggatgatgacggtcgcgagaaggccgagacgtcggtccttgcctacttcctatcgatggaacagctcgagggctgggccaagtcgcacgatactcatctcgacatctatcggcacgcgatcgcgatgaaccgcaagtttaaggcgagccgtgaagtcgtgacgtggcacgagctgttcgtgatgccggcgtgcagcgcgttcgagtacgtcaactgccatccgaagaccggggttctcccgttcgttgccgcgtatcgcgtggcgtga

SEQ ID NO: 9465 - DNA, 387 bp, Methylobacterium sp.
gtggcggccgatgagcttcgacagttcattgagcgcatcgagcgcctggaggaggagaaggctggcgtcgcgggcgacatcaaagatgtgttcgccgagctgaagggtcggggcttcgatgccaaggccgttcgccaaatcctgcgcatccgcaagaaggatcacgccgagcgccaggaagaggaagcgatcctcgaactgtacatgggcgcgctcggcatgcttgccgacacgccgctgggccgcgccgcgatgagccgcgagttccaggatgcccggatcacgatcagcgggaacggcatcgacacgatcgagaccacgggcgccggaatcgcgcaggcgacggctcgcatggagctccaggcctcggtcggcgggagacgctga

SEQ ID NO: 9466 - DNA, 927 bp, Methylobacterium sp.
gtgggcttcgtcgaactcggccgccagagccttccggccgcggagcaccggcgcgcggagctcggggcgcgtctcttcggtgaccggcgcctcgacgcggacggacgcctcgcctgcaccggctgccacgaccccgcgcagggctggaccgtgcgaacgcctgcagcgccgggccagcgcggcagggccgggcgccgcaatccgccgggcctgcgctccgccgcggccgcgacggcatggggctgggacgggcggcaccgcacactcgccgcgcaggtgctcgcccccctgaccgaccccggcgagatggccaatcccgggctcgcgcccgtcctcgcccggatcggcgccgatccgggctacgcggcggcctttgcggcggccttcccgggtgcgggtctcacggcgggcacgctcgcggacgcgctcgtcgcctacctcgccgggctcgatgcgccgacccggttcgaccggttcgcctccggggacggcgcggccctgagcgaccgggaggttgcgggcctgcacctgttccgcacccgggccggctgcgccaactgtcaccacgggccgctcctcagcgacggtcgcttccacaacctgcgcctgtcggccttcggcgagccggcccaggatctcggccgccacgcggtgacgggcgcggccgaggatgccgggcgcttccggacaccgggcctgcgccacctgcgcgagaccgcgccctacggccatgccgggctcttcgaaacgctcgcgggcgtggtcaacctctacgaccggggcggcggcgagatctgggcccgcaatgccgccgaggccgcccgcccgctccacgcaccggcggcgcggctctcgccgcacatccggccgctcgggctgacggatgcggagaaggcgagcctcgtcgcctttctcgagacgctctga

SEQ ID NO: 9467 - DNA, 516 bp, Methylobacterium sp.
atgagcgacgcccttccggcgcctctggcgcccccgcagcctgcccgccccgagcggccccgcctgcgtaccctgaccatcgtggagaacggcgagccggtgcagaacgccgccttctgcccctggtgcgaggacctgcacttccacggcctgccgccgggccaacgcggcgcgcactgcgtccgtgaggactccccctaccgctgcaccggctacgtcctcgacgtgcaggggacggtcccctctgccggggccgcggtcccggacgcgccccggccccgcggccggtatctgcaccagagcctcgaccaagcctcggcgtcgctgcgccgggtcgtgctgcgccacgtcctcggccgcaagttcgcgggcacctggggcgagggcaaggtcggccgtgccgtggtgagcgtgtgctgcgaccactggaccccggccaccgtgccggaatgggtcggaggggaaggggtttttagaaggaagcggtgccccgcagtgggatcgggagccgtgtaa

SEQ ID NO: 9468 - DNA, 312 bp, Methylobacterium sp.
atgagcgcatcgaagccgcgcccgaccctcgacagcctcgccagccgcttcgctcggaaggatccgcccgcaggtgcgccggcggcgtcagcccagcccgaggctgcggaagtggccgcgcccgccccgtcgacggccgaggcctcgccgccggccagcaagccggagaaggacaagcgggtccagatcctcacgcgcatcgacgcaccgacccggaagcggctgcgcctgatcgcggtggagcaggaccgcaccgtgcaggagatctgcgagcaggccattcgggacttcgtcgcgcggcacagccggtag

SEQ ID NO: 9469 - DNA, 1035 bp, Methylobacterium sp.
gtgatccgccttctgaccccgctcttcgccgcctccgtcctggccgcatcgatcctcccagggcaggcagccgagaagctcgtcgtcagcacgtggggcggcagcttccgagacctgatcgacgaggccatcgcctcgaagttcaaggccgagaccggcgccgaggtcgagtacatcaccggcggcaccatcgatcggttgaacaaggccaaactcgccaaggacgcccccgagagcgacgtgaccttcaccaccgcccatgtcggctggctctacgtcaacgacggcctcttcgagacgctcgacctcgcgaagatcccgaattcgaagaacctcgtcgaccaggccaggatcagccccgcgcatatcggcacatggggctacgtctacacgatcggctaccgcgcggaccttgcgccaaagggcatgaccttcggctcgtgggcggatctctgggatccgaagctcaagaacagcctcgccgcgcccgatttcgatccgagccatatcatcgcggtctcggcgatcctcgcgggcggcgacccggccacctgggagaaggggcaggccaagctcgaggcgctgaagcccaatttccgggccttctacaccaacgacgccaacagccagcaactcatcgccaccggtgagacgcccgtgcaggtcgtgctgaccatgaacgcctattacatgaagggtcaggacgtgccgatcacggtggtgatcccgaaggagggcggagtgctcggcatcgacacggtggcgatcaacaagggctcgaagaaggccgagctcgcctacaagttcatcaacatcgccctcgacccgcaggtccaggcgaagatcgccgagctcaagaagggcagccccaccgtcacaaacgccaaggtcgaccccgagaccgcgaagctgccgggcgtgttcaccacggccgagcagtggaagacccaggccatcaacatcgacccgaagctgagggccgagaagacagcgctctggcgcaagtggttcgccgagaacatcatggcgcgctga

SEQ ID NO: 9470 - DNA, 159 bp, Methylobacterium sp.
atgcaggacgagaagaagaccgccgcctttcaggtgcgcatgcgcccgacggtaaaggccgcagctgagaaggccgcagccgacgagagccggtcgctcgcctcgctcatggaatacctgctgatcgagcacctcaaggccaagggctatctgaagtga

SEQ ID NO: 9471 - DNA, 246 bp, Methylobacterium sp.
atggccgatcagaagaccacgggcgagctgcgcaaggccgccatcgtcaccgacgacgagatcaacgccgcggtcgaggcgctgctcgcgaagccgaagacaggctcctacccgatcggcggcggctacctgctcgacctcggcgtggccgcggaggcttaccttttctcgagaggcgctccccacgccggatcgcgcgcgccagccaaagcagcgcacacagaacatgggatggcgtctcgctaa

SEQ ID NO: 9472 - DNA, 246 bp, Methylobacterium sp.
atgtcccagaccgacgatcccgggggcgaaccccggaccccctccccggctgcacctccggccccccgccggaaccagaccctctccctcgcggagcgccgcatcgtggaggccggcgaggccggcccgcacgcgcccggccatccggatccccgacccgacccggggcccgagaccggcggctacgacgaccattccccgagccgcgcgccggacaacgcgaagggcggctacggggccgggtga

SEQ ID NO: 9473 - DNA, 243 bp, Methylobacterium sp.
gtgcgcagcatgaagatcatcccagcgctgctgggcctcttctacggaaagaagcaaaggactggaatcagcagtctgccgtactccgtccgccaccgcctcggcttgccgggcggtatggccatagccgctatgatagacgatcgcgacgcggataccgctttccgtccgcgcctcataccgaccgtgtctttcgctgatgtgcattatgccctcatgctcgaacgcattcggaaggcatga

SEQ ID NO: 9474 - DNA, 834 bp, Methylobacterium sp.
atgagcgacacagccaacacgatcgcgggcgcgggcttcgcggcgacgaccgcgcaggcgccccgcgcgcgacggcgtccgcgcgtcaacctgacgggtctcgtcctgccgctcgcgatcctcgtgctgtgggaggcctccgccaccttcggctggatcgacccggtcttcctgccggcgccccggaaggtcgcgaccgccttctggaagatgctcaccgtgcagaacctcgcgcaggatttcctggcgagcatcaccatcgtggggcaggccttcctgtacggctcgaccgccgccatcctgatcgggatcgccgccggcctgtcccggcgggtcgaggccttcttcggcccgaccttcgacaccattcgccacatcccgggtatcgcgtggctgccgctcatcgtgctgtggctcggcatcggcgcgcccgccaaggtgctggtgatcgccaagtcggtgttcttcccggtcttcctcaacacgctgcagggcatccgcaacgtcgaccgcaaccatatcgagctcgcccggacactgaccctcacgcgctggcaactggtgcgccgcgtggttctgccctcggcgctgccgagcatcctcgtctcgctgcgctacgccgccggtctcgcctgggcgctcgtggtggtggccgagggcctgagcgggctcgaagggctcggcttcctgatcttccgggcccagggtctgctgctgaccgaccagctcatggtctgcatggtgctgatcgggctgatcggcttcgccatcgaccgctcgatggccctcgtgcagcgacggctgctgcgctggaagcagggcttcgagggctga

SEQ ID NO: 9475 - DNA, 732 bp, Methylobacterium sp.
atggcaacaagcgcactcaaacccgtcgtcaaactctccgcggaaacgcagacgctcgaaaacctgcggaactatctcctttccggtgccgtgaagccaggcgctcggctcaccgagatgagcttagcggagcaactaggtgtagcccgggccacgctgcgtgcgagtctcaaccgcttggtgacggagggcatcgtcgttctcaccccctatacgggctggcgcgtggcagccctcaccgagggcgacgcctgggaactttggacgttgcgcgcaagtctggaaggtctcgcggccaagcttgcggcggagtcgatgtcgccggatcgccgcacccggatcgagcaggcgatggcttcccttgtcgtcgcctgcggcgatggggacgtccgttcggccagcgatgcggactttgcgctccatcgtacgatcgtcgaatcaatcggacacagcaggctggagcgacagtatcttcaggtcgagcagcagatacgtctctacatcatgaccagcaatgcgctcgtcggcgatctgggtcagatcgtttcccagcacgagccgctcgtcgaggccctgctgcgcgccgatccggaactggccgctcgcgaggcgtggattcataacgagaccgagggccgaaaactcgcgaactggcttcacgagcaggaaaccgatcgtttccgagcgcccgttaagagagcgatgaagccgaaaggcaggcacatggcctga

SEQ ID NO: 9476 - DNA, 927 bp, Methylobacterium sp.
gagacgtcgagatcaccggcgctgcggcgctcgcgggagatctccatgacgctcgccaccctgtccctcgtcgtcctcgcatccttcctgcatgccggctggaacctgctggccaagcgcgccgcccatatcggcccgctcttcgtcttcgcctacaacctcgtcgcctgcatcgcctacgcgccgtgggtgctctggcgcctctcgcagggcgtcgccggcggcatgacctggacctgggcggcggtcggcatcgtcggcctgagcgggctcatccatctcgcctacagcctctgcctccagcgcggctatcagacggcggatctctcggtcgtctatccggtggcgcggggcacgggaccgatgctgtcgagcctcggtgcggttctccttctgggcgagatgccctcgggccgggcgctggccgggctgggattggtggtcgccggtatcggcctcatcgcgacgcagggccgcctcgcggccttccgcaagcccggcggcgtggccggcgtgcagtggggcacggcgacgggcggcctgatcgcctcctacaccgtggtcgacgcctatgcggtgaaggctctcggcatcgcgccggtcgttctcgactggtgcaacaacctgctgcgcttcgtgctgctggcgccgatcgtcgccgccgacccgcgcggtgcctgggaggcgctgcgcggcttccggctggtggcgctcggcgtcgggctgctgtcgccgctctcctacatcctggtcctggcagcgctcgacggcggcgcgccgctcagcctcgtcgcgccgatgcgcgagatgtcgatgatggttggcgccctgctgggcatgatcgtcctgggcgagaccgccggcccgtggcgcctcgtcgggtgcgcggtgctgatcggcggggtggtgctgctgtcctccgcctga

SEQ ID NO: 9477 - DNA, 1167 bp, Methylobacterium sp.
atgtacatgccgccgagcttcgtctccggcctcgccttcgttaccgtgccggcgcagatgcgggagagcgggcattccctcgccctgatcggcttccagaccatcgtgatgctgccgtggctggccaagatcgtgtgggcgccgtacgtcgagcgctatcgtctgccggccctcgggcgtcatcgcacccccgccatcgcggcggccggggtagccgtcgtcatcgctatgatggcgacgatgacggtcctcggcgaccgctacccggtcgccctgctggcctgcctgctggtcgcggcgacggcggcagcgaccgtcaacatcgcctgcgacggcttcaccatcgatgcctgcccggcggagcagcgcagctgggcgaacaccgcgcaggtgagcggcgcctatctcggcatcgcgctcagcggcggcctgttcctgatcgttgcggcgcgggccggctggaccgcgaccctgtgcggcctcatggtcctggcgatcgtcctgcctctgccgttcctacttctgtcgaggcgggtcgacctcgggtccgtgcgcccgcaccggcccgacctgcgcagcgccctcgcgaacccgaaggtccgcatcgggctcgtgatcgtcctcgcctgcagcgcggggtctcggttgagccagagcatgatcgtcccgctcctcgtcgatcgtggcttcacgctctcgatggtcgggctgatcgacggtgtcggcggcgtcctcgccggtctgttcggcaccctgtgcgccggcttcaccgtccgccgtatcgggacgcgacgatcgctcgtctgggcccttgcggtgcaagtcgcgtgtctcgcgacgctggcacaggccggctacaccggtaccatgcccgcctggcttctcggcggcgcggtcatgctgatgttcggggcgctctcgttcgcgagcgtggcgctctacgcggaactgatgggatacacctcgtcccgccagcccggcgtcgatttcgcggtgtttcaatgctcggatgccggactgggcatgctcgcgggtcccgtgagcggtttcctcgcgacgcatctcggttacgtcggttgcttctccatcgcggcaggcgcgtcggccctggcggccggctcggcaccctggctcgtcagccgctgtagatccattcccgctcgataa

SEQ ID NO: 9478 - DNA, 681 bp, Methylobacterium sp.
atgcaggcttcccccgcccgcgcgctggtcctgtccggcctgatcctcgccggcacggccctgtccggcgccgcggcccagaccgtgatcgtcaaccgcgaggagcggcccgatccctggatcatcaacggctgcaccatcgctcccaacgccgcctgccccggcgcggacctgcgccacgccgatctcaggaacgccgatctcggcggggccgacctcaccggtgccaacctcgcccgtgccgacctgcgcggcgccaacctgcgcggcgccctgctcgaccgggccaatctcggcggcgccaagctgcagattgccttcttgcagggcctgaaggcccggggtgcctcgttcgtgggcgccaatctcgaccatgcccgcgccgcgggtgccgatttcagcggcgccgatttcacggtcgctgacctggagatggtgcaggccaagcgcgcccagttcgtgggtgcccgcttcgtcaacaccgacttgcaggagaccaagttctacgaggccaacctcgccgacgcggtgatggagggggccaagatccgcttcgcgatcttccaggacgcctggatgaagggctgccggggctgccccgagacctggcagcagggcaagccggtctgggacgtctacccggaggcgggcccgccgcccgcgaccgggtcggatccgtga

SEQ ID NO: 9479 - DNA, 345 bp, Methylobacterium sp.
atgaaccgttacgacacgagctcaacatcgcccgcggagatgcgggcgcacatcgagactgcgaaggccaaccgcgagcacatcgaagaaagccccgaccccgaggccgagcttaggggcatggtccgtggctgcgacctggtctggggcgtctggccggaccgcggccccggcacgcgcctcggccacggcctgtgcatcgtcaagggcaccctgatgatggaggccgtcattgagggcgacttgcgagcgcaggtcgccataacgacgctatggtttccgacgtttgaggcggccaggttcgcgttcgaccgggacggtgacggattgctgctggccgcgtag

SEQ ID NO: 9480 - DNA, 918 bp, Methylobacterium sp.
gtgccggttcctgagcgcgcggacaggagcgatgcggacgatccggcgccggtgccgggcggcgatgaccggccgttccgcctgatcgcggatccgcgggtcgcggccgccatgcggttcgccgaggcgcggctcgacgcccccatgaccaccgccgcgctcgccgccgcggtcggcctgtcgcagttccacttcctccggctgttccaggcccagaccggcgagacggtgagcgattacagccggcgcatccgcctcgacgccgcggcccgcacgctgcggacctcgccggaaacgatcgtctcgatcgcgctctcggtggggtacggcagtcaggccgccttcacgcgcgccttcaccgcgcggttcggccgctcgccggcgaactacaggcgcggcacccgccgcgcggtcgcgatcgatgcggcacgccagcgcccggtaccgatccgcagcgtcgggaccatccactgcctcggtcgacgctatctcggcctgcggccgggcgaagccgagccgtggcacgacttcctcagcgcgcttccgcccggctccgccgcccggcgcgaccgccgtctcctccgggtcgtccacgacgatccgcgcgtcaccccgccggagcagatccggatcgattgctgcctcgtcggcacggagcgcgcgggcgaggaccgggatctcgccgcgcgcggcttcctgcccttcgagatcgtcgcgggcacctacgcggcggtcggcggcacggagagcggcatcggcggcgccggggacgatcttctcgacatctggctcgcccggcagggacgataccggctgcgcggcggcgccggccgcctggagttccgcgacgccgccgcgcagccggacgccggcgagaccctcgtgccgatccgcgccctcggcacggacgcgacctga

SEQ ID NO: 9481 - DNA, 393 bp, Methylobacterium sp.
atgaccgatccgatcgagcgcatcgctaccgccgccgtgccgacgccggccgggcactactcccaggggaccgcgtggcgcgacctcgtcttcgtctcgggccagctcgggccgcgacccgacggcacgcacaccgccgacgagcccttcgagacgcaggtgcggcaggcgctcgcgaacctcctcgccatcctgaaggaggcgggctgcggcccggagcgggtgctgcgcgtcaccgcctatctggtcggcgtcgagaactggccgcacttcaaccggatctacgccgaggtcttcggcgaggcgaagcccgcccgcaccgtggtgccggtgccggaactcaaccgcgggtatctcgtggagatcgaggcgatcgcggcccggcccgagtga

SEQ ID NO: 9482 - DNA, 585 bp, Methylobacterium sp.
gtggccaagaaggggcacgacgacctcctcgacgccctggcggcgctgccggccagtctccactggcatctgaccctgatcggcggcggcgagatgcgggccgcgaccgaggcgcgggcggccgcgctcggcctcggccggcgggtcgcgttccggggggcgctggcccagcccgccgtgatcaccgcgatgcgcgaggccgacctcttcgtgctgccgaccaagccggcgccgggcggcgaccgggacgggctgccgaacgtgctgatggaggcggcgagccaggacctgccgatcctcgccaccgccttcgccggcacgccggaattcatcgcctccggcacgcacgggctcctcgtgcccccgggcgacccggcggcgctggccgcggcactggcgcatctcgcccgcgacccggatctgcgccgccgcttggccggggccgcgcgggcgcgcctcgtcgccgatttcgccctcgatccgggcatcgacctgatcgcggcgcggcttgccgccagcgccgggctcgcccccttgccggaggttgcctcccaccccgccagggcttgcgcatgcgcgtcctga

SEQ ID NO: 9483 - DNA, 2382 bp, Methylobacterium sp.
atgttccgcaccgcgcacaagctggtcatcctggcgccgctgctcctgcccgccgcgggctgcctcagcatcgcgggcgacgcctgcaccgacccggacaccacggccggcatcgccgtcgtgaacgagaaggacgtcacgccccgcaactgcgacggcaagttcctctcggcgcgcaaccagcgcagcgtgctgtacacgggcgaggatcggccgcggctctggaccggcgaggcgccccgcgaggggcgggacatcgatgtgcgccgggtcaacgccccgccgctcggctacgaccgtgccggctcggtcaccggctatctcggcaccctgaagctcaactacgcggccgccgacgaggcggtggaggccgacgtcgccgcgctccagaactcgctcgggcgccgcttcgacccggaccagaaggtcgccgtcgatttccgcaaggccaccctcgactacgtcctcaagcagatgctcgggggcgcgctcgggctgaactacatcgcgccggaggatctcggcggctcggtcaccttccgcaccgaggagccggtgccgaaggcccaggtcctgcagatcgtgcgcgacatcctggcccgcaacgggctggagatgcgcagcatcaacggcgtgttccacatcggcaagccggagctgatcggctccatcgaggcgaccgggcaggccgggcgcgtcggcgagcgcaccacgcggatcctgcgcctgcgcaagggcgcgggcagcgacctgctggcgctcgcccggcagatcatcccgccgagcatcgagctcgttcccaccaacaacccggacacgatcctgatccgcgcgaccgcggccgagatcgatcaggccgagaagctgatcaaggggctggtccagaccgggctgaccgaggaccgcgtcgccgtgatcccgctgcgccagagcgcgccggagaagatcgccgggcagctcaccgagttcttccgcagccgcaacgccgatccggtcagcatcgtgccgctcgacgggcagcaggcgctcctggtctcctccaaggcgccgggcatgatcgacggcgtccggcggctcgccgaggcgatggacacggaggtccgggacgaggtctcgctccgggtcatcccgctgcagcacctcgtcgcggacgagatcgcccagcgcctcgccgtcatcttcgggaccggccagggcagcggcggcgggcggccgggcacgctggctccccccggcgcacgcgtcggcgaggccctccgcgaccccgctcccctgccccgcgtctcgccggcctccatcgaggacggcgtcgcgcccccgccctacccctacgccaacggcccgggcaacggcgggccccggggggcgctgcccggcgaggccgcgccgggcccatccggcggcggcatcgggaccggccagcaggccacccgcatcgtcgccgacaagaccagcaacgccctgctcgtctactcgaactacagcctgttcaagaaggtgcgcgaggtgctgcgcgccctcgacgtaccgcccgcgcaggtggtgatcgaggccaccgtggtcgaggtcgagctgaccgatcagctccagaccggcgtgcaggtcttccttcagggcgcgggcttcgtcgtcggctccggcaacatcgccgatatcggcatcgacggccggaccgcggcgaccggctcgaacaccggcggcggcaccagcggcgtcggcagcaccggcagcatcggcggtggggggagcaacggcttcggcggcgtcgcggcgatcggtgcgcgcatcggcaacgcgctccgggtcgacgcggtgctgcgcgcgctccagggcgtgaccaaggtgaaggtgatctcctcgccctacctcacggtgctcaacggcaagcaggcgcggctcgtcatcggcgatcagatccccttcgcgcagcgctcgcagacggcgaacaacctcggcaacaccaccgtcacgtcggaagtcgtgatcaaggacaccggcatcatcctcgacatcacgccgcagatccacgcgaacaactcggtggcgctgaaggtcaatcagtcggtgagcacgccggtgcagtccgccctcggcggcgccctgacgccggtcatctcgacccgcagcgtcgagtccgacatcctgctgcaatcgggccgcacggtgctgctggccggcctgatccaggaccgcctggagcagcaggaggacggggtgccggtgctcaagaccgtgccggtggtgggcgacctgttcaagcagaaggtcgacaacgtccggcgggtcgagctgatcctgctgctgaccccgcgcgtgacccgcaacgcctcgcagatcgaggacctcgcccgcctgctgcaggagcaggtccacacccgctga

SEQ ID NO: 9484 - DNA, 453 bp, Methylobacterium sp.
atgctgaccaacaaggggaagtacggcctgaaagccatgctgtacctcgccgggattcccgagggcacgcgggtcggggtggcggagatcgccgaggccaacaacatccccaagaagtttctcgacgcgatcctggcggagttgcgcaatgccggcttcgtccacagcaagaaggggccgggcggcggctacaccctggcccggtcggcgcaggagatccggatcggccacgtggtgcgggtgctcgacgggccgctggcccccttcccctgcgccagccgcagccgttaccagcgctgcgacgattgcgcggacgaggcgcgctgcgccgtacggctgaccatgctggaggtgcgcgacggcatcgccgccgtgctcgacccgctgacgctcgccgcgatgcgcggtctctccggggccgccgacgacgcgagcttcttctaccagatctga

SEQ ID NO: 9485 - DNA, 810 bp, Methylobacterium sp.
atgacacgcggtacgcgcctcctcgcagcgctcctggccagcgtcgccctcagtggcctcgccgcttccggtcatgcgcccgccggggagccggcaccacccgccgatgccccgctgccggagcacttcaccctcgccgtgcccgacctgcccgcggcgggcgcgccggacgggcggatctacctggatgaggggttcgaaggcgacctcgccgccctgctcggcgagggactcgggcggccgctgcacctcgcagtgccgacgacgggcgcgccggtgcccggtcggttcgacggagtgctcctgcggctgcggccggatgatccgctcctcgcctccggcgcggccgtgccgctcggctaccggtcgggcctcagcgtcgccatgcgctccgacaccgccatccggcgctgggaggacctcgccggccgcacggtctgcgcctccgcggcgaaccgggacgggcagcgaatcgcccgcgcctacggcgccgcggtggttacggtacgcgcgccggcggtcgccctgatgcgcctgcgcacgggcacgtgcgacgcctcgatccacgaccgggcgctgctcgacgccctcttcacctcgcgcgcctgggccaagttctccgcgaccctgccgccggtcgagcccacgctgctcgccctcgtgccggccgcgaccgggccgggcgccgccctacgtcgcgcggcggcggcgctcgacgatccgctggcctggcgccagcgccgggcgcgatggggctcgaccgtggccttcgaggtctatcgcgaccaagtcggtggcgactgccactga

SEQ ID NO: 9486 - DNA, 1050 bp, Methylobacterium sp.
gtgaggctcgccgccctcggcgccgtcacgctcggtttcctcggtatggtgccgtcctcgcgggccgagacgttgccggcgatcaacctccagttgacgccctggacggtggtcgcgcgtcagaaggggttcttcaaggaggcgttcgagccgatcggcacgcggcaggtgaacctgatcgcctccggcgcggcggagctgctcggggccgaggccgcggcggtcggcggcggcgccatcgcgatcgcccagcgcatgatctatccggcaaccgtgcaccgcgcgaacggcctcgacggcgtcgtgatctgggcctccgagccctcgaaccgctaccgtgccccgatcctggcccgcgccgacaacgacgcgatcaagacggtcgccgacctcgacggcaagaagttcggctcgagccggatcagctgctactggtcctcgcccttcgagatcctggaaaaggccggcctccctctcgattcccgcgagaagcagggccgtgtgcgctacacctccatcgacaactcggcggtggcgatctcctcggtgctctcgggcgcgaccgacgccaccacggcgcatctcgcggccggggccttcaccggcgcgtggctctccggacgcctcaaggtggtcggacgctcgcccgacgacggcgtctacgtcaacaatgccggccgggtgacctacttcgcccgccgcgacttcgccaacaagtacccggaggtggtcaaggccttcctggccgcccgcgagcgcacccgcgagtggaccttcgaccacgtggacgaggcggccgagatcgtcgcccgcgagacccgcgtgccgctggaggtcgccaagttccagatcacccatgccggggaatgggagttcatggccggcgagccgaacgcggaccgggcgcgcaacgccatcaggacgttccaggcctggtacatcgagcacggcgacgacatcctcgccgagcgcaagctcaccgaccagcagatcgacgccttcatcgacggccgcttcttcgcgggcgggcagtactcgatctacaactga

SEQ ID NO: 9487 - DNA, 777 bp, Methylobacterium sp.
atggccgccggccgcctcgacatccgcgacgtctcgaagtcctacccgcaggagggccgaccgccgctcaccgtcctctcgcatatcggtttcgcggtggagcccggctccttcgtctccctcgtcggcccctccggctgcggcaagtccaccctgctgcgcctgattctcgggctcgatccggactacacgggcgacatcctggtggacggggtgcgcgtgtcgggccctgcactgagccgtggcgtggtctttcaggaccatcgcctcctgccctggctgacgctggagcagaacgttgcgctgagcctcgagaacgcgcgctggccggcatccgagaaggcgcgcgccgtgcgcgagcacatcgcgctcgtgggcctgcgcggcttcgagaaggccttcccgcaccagctctcgggaggcatggcgcagcgggcggcgatcgcgcgggggctggccaatcggccggagatcctgctcctcgacgagccgctgggcgccctcgacgcgctcacccgtgtgcggctccaggccgagctgcagcggatctggcgggccgagggcgtcaccatgatcctcgtcacccacgacgtggacgaggcgatctttctcagcgacacggtgatcgtgatgggcgccgggcccggacgcgtcgtcgagcgggtgacggtcgacctcgcgggcgagcgcgaccgctcgggaaccgacttcctcgcccatcggcgccggatcctgcgggccatggacgacgcgttcggccaccgccatgcggcctag

SEQ ID NO: 9488 - DNA, 597 bp, Methylobacterium sp.
atgagaacggaatacctcgggcacggcatgccgaaccgcgttccgctcacgctgggcacggcgatcatctgcctgctgctctgctgcaccgtgatcgggatcctgatgataccgtccgccctgctggccacgttgagtgggcgtgccgcaggggtcaatcgccgctgggatcgcgaagcgaggcgccggttcgtcgggttcatcggcgccgatccccactacatcgacagcgccgtgttcaagtacgaggacggcttcagggggaccggcatcgcctaccatgacggcaaggtcttcatgatgcaggccgggcacgcggtcgaggtggagtggcgcgatgtcaggcgctggtcctattccgtcgaggcgcccgacctgctgacgacatcgagcaacgatagccaggtgttgacgcacgtgaccagcgacaacctcgcctgcgcctaccgggctgccaagaacagcgggtttaccctgcaggtcgcctccatcgatcgcccgacttggaagttcacgacctccgacgtttccgtttgtgagcgctggatggagatcctgtctcaggtcgacgaacgcggcggacggctcacggcctga

SEQ ID NO: 9489 - DNA, 402 bp, Methylobacterium sp.
atggcccttctacatgccgaactcatctcccccgaacgcacgatcttcgtgggcgaagtccgttccatggtcttgccgagcgtcgagggcgacatgacggtgctgcctgggcacgcccctgtcgtgactgcactgcatgcaggtgtgatcttcgccaccgatgcagagggaaccggacgccgcgccttcatccgcggcggcttcgctgacatcatgccgacgcaagtgacgatcctggccgagcgtgtccggccgatcgaggaactcacccgcgatcaactcgacgaggaaatctttcaccttcaactggaacgcgacggctcctcgaatccggagctgcgggccgagcacgatgtctccatctcgcggcttgagtccttcaaggccagcctcaacctctga

SEQ ID NO: 9490 - DNA, 711 bp, Methylobacterium sp.
atgcttgagctcgacgccgtcaccgtccgcttcggcgggctggtggccctgcgcgacgtcaccttcacggtggcgccgggcgagatcctgggcctagtgggcccgaacggggccggcaagaccaccctgttcaacggcatctcggggctgacccgggtgcgcgggcgcatcctgttcgagggccgcgacgtcacgaagctgccgttgcaccgccgagcccgcctcgggatcggccgcaccttccagatcccgcagccgatgcagcacctcaccgtgcgggagaacctcgcggtcgcacaggtcttcggtgcgggccgccacgaccccgcgcggatcgaggagatcctcgccgtcatggagcttcaggcccagggcgaccgtccggcggagagcgcgctggcgctgcaggaactgaagcggctggagatcgccaaggcgcttgccaccgagccgcgcctgctcctcctcgacgaggtactggccgggctggagagccaggccaagcgccagttcgcggccaagctccgcgagttgcaccgccgcttcgacctgaccatcgtcatcgtcgagcacgacatcgagacgatctcgggactgtgctcgcgcgccgtggtgctgaacttcggcgagatcatcgccgacggcacccccgcccaggtcttccgcgacccgcgcgtgatcgagagctacaccgggacggcccatgcttga

SEQ ID NO: 9491 - DNA, 669 bp, Methylobacterium sp.
gtggcctgggagctgtggagcgagcgccgcttcgccgagatggcacggcgcgggaccggcctgctctacgcgacccgcctcacgctcgggctgcagcgcgaccttgccgctccctgtccgaccccgaccgccaagattccgatcgaggtccgacccctgcgagagacggacctgccccacctcttccccgaggaccggggcgctctgagccgcaaggagcgggtggagctggcggcccgccgcttccacctgcgggccgggatcccgacctgctacgtcgcgctcgacaggcgcacggacacaccctgctacatgcagtggctgatgggcgcgagccacaaccggatgatccaggataccttcccgccgcgctggtttccggaactggcgcccgacgaggcgctcctcgagaacgcctacacgcccgccgcgtatcgcggtcagggcatcatgtcctgtgccatggcgctcatcgccgagcgcgccgtcgagatcggcgcgcgccgcgtgatcactttcgttgagaacaccaacgttccctccctgcgcggctgcaccagggccggattcgagccccacctcgcccgtatcgagcggcgggccctgctcgatacgatccgcctgcgccgcttcgagccctacgacccggcgcggcacgcgcatcggtga

SEQ ID NO: 9492 - DNA, 300 bp, Methylobacterium sp.
atgctgcgggcagcgctcgtcctactcacggttctcgctccggcgggcgcgatccgcgcggaggggatcaaggagtaccagatccggcgtctcctcatgctgaagacggagtgcaccgtcagtggtctgcaggtcgaggagctggagggtggtgcaagccgctttcgcgccggctgcgagaatgtcagccactatccggacggcgtcgagatccagtgcccgaacacggaggacgaccgcgagtgccgcatcctgacggcgaggcgcgagttcccacacctgcgcgctctgcaacgatga

SEQ ID NO: 9493 - DNA, 429 bp, Methylobacterium sp.
gtgagatggtcgccgatcctcgcgaccgggcttgccctgccggtcggcgcggcggctgcgcccgcgccggaggcggccttgcgcccggccttcgcgcagtgccgcgccctgagccaggagggcgagcgcctgcgctgctacgaccgcctcgccgcgatcctcgcgccgccccgcttccagggccgtctgacgatgcagaccgagcccttcgcgatcacggcccccaccgtgctccgctacgagagcgacggcccgatcttcgtcctcgccctcaaggatgcgcggggcgaagtcgtccagaacctgcacatcggcggcggcggcagcgcgacgcacaccatcgcggtgccgggcacctacgccctgcaggtcagcggctccgagtcctggcgcatctggctcgaccccgtccgcgaccccaccccctga

SEQ ID NO: 9494 - DNA, 690 bp, Methylobacterium sp.
ttgaaggtcagcctgcgcgatccggtcgccgaggaatggtacgaccacgaccaggggagtctggcggagatcgcgttcttcgcggatgccggcgccctgcgggagggggccgtcgtgttcgatctcggcgcacaccaagccgtcgtcgcgctccagctcgcggtccgcgtcggcgcctccggccgggtcgtcgcgcttgaggccaacccgcacaacgcgcaggtggcgggtgagaacatcctgctgaacggcgctcgcaacctcacgctcgtgcacgcggccgcggcggcgaaggacggcgagatcgagttcaacgaaagcctgaacggtcaggtcgatggtggagcgggcacgcacggcgtcatccgcgtaccgagccggtccatcgacagcctgatggcggagttcggcatcccggacatcatctacatcgatgtcgagggattcgagtgcgcggtgctcgagggcgcgggcggcgcgctcgagcaggtgaagcactggttcgtcgaggtccacggcggcgtcggcctggagaagttcggcggctccgtcgacaagctactcgcccatttcgacgcgggccggttcgagcgccatttctgccggacggatgcggggccgttcacgccgctcgaagacgcccggtccctcgacgggacccggtggttcttcatcgccacccggacctga

SEQ ID NO: 9495 - DNA, 162 bp, Methylobacterium sp.
atgcagctgatcacccgcttcctgaaggaccgcgacggcgcgaccgccattgagtacggcatgatcgcggcgctcatcgccgtggtgatcatcggcacgcttcagatcatcggcacccagctcaacgccaagttctccagcatctcggcccagctgaactga

SEQ ID NO: 9496 - DNA, 1056 bp, Methylobacterium sp.
atgacacgccgcacccgaacgcgttcgaccagcccgcggctgcgggcgcccctcgcccttctgctcgccgcgctcgccgccggcaccgcgcgggccgaggaggcgcgcccgcccgggatcagcctgcacctcccgctcgcctgcgagccgggccgcacctgcttcgtccagcactacgtcgaccgcgacccgggcccgggcgcgcgcgactacgcctgcggcagccgcacctacgacaagcacaacggcacggatttccgcgtgcgcaccggggccgaggcccggggcgaggccggccgcgtcctcgccgtggcggcgggccgggtcctgcgcacccgcgccgacatggcggacgggcgcgtgcgcggcagcgacgcggccgagatcaagggcgcggagtgcggcaacgggctcgtcgtcgcccacgcggacggctgggagagccagtactgccacatggcccgggacagcctcgtggtgcgccccggcgacacggtcgcggccggccagccgctcggccaggtcggcctctcggggatgacggagttcccccacctccacctcacgctgcggcacggcgggcaggtggtcgatcccttcgcgcccgcaaccccgccggattcctgcgatcccgccgcgccgggccgcggcggcaccctgtgggagccgaaggcggccgccgccctcggctaccaggcgggcagcgtgctcaacgcgggcttcgccgacgcgccggtgagcatggaaagcgtcgaggccggcgcgccgcgggtgccgggcgcggaatcgggggccctcgtcgcctacgtgcgggcgatcgggctggagacgggcgacgtgcagagcctcgtcctcaccgatccggccggcacggtcgtcgcgcagagcgtccagcccgccctggagcgcccgcgggcgcagtcgctgctcttcgtcgggcgcaggcgccccgccgagggctggcccgccggggcctacacggcccgcttccgcgtcgagcggggcggccgcgtcgccctggagaagaccttcggcctcgcgccgcgcgcgccgtga

SEQ ID NO: 9497 - DNA, 1647 bp, Methylobacterium sp.
atggtggctggcgcggcaatccccgaacaggtcttcgacgcgatgtccggcacggacaggttcgagcggaccgccatcctcgttctggggatgcaccggagcggaacctccgccgtgacgcgggtgctgagcctgctgggcgccaccttgcccgagcgcctgatgcccagggcggaaggcaacccggtcggctacttcgagccgatggagatcgtgtccatccatgagcggctgctggcgtcggccgataccgagtggtcggactggggcgcctttccgcaggactggtaccggtcggggagccgcgaggctttcctgggggaactcaccgaggccgtgatccgcaattacggagacgacggcctcttcctggtcaaggacccgcggctgctgcgcttcgtccccctgtggcgcgacctcctgacggggttgcgggtgcggccggccgccgtcctgccgttccgcaacccgatcgaggtggccctctcgctgaagcgccgtgacggcttcccgcaggagcacggcttcctgctctggctgcgccacgtgctcgacgcggagttccatagccgggacctcgtccgcgcgttcgtgtcctacgatcgactcctcgaccagaagcggatggccacctacgggctgatcgagagcctgcccttcgattggccgcgcaagacgtccgccgccttcgacgagatcgcgcaattcctcgacggcaagctcaggcgcaacacggcctcgcgcgacgatctctcccttctggccggcatccccgagccggtgcgcgccgcgttccgggcttacgaggcgctcgagcgcgacccgtacgaccgcgtcgcgatgacggccctcgatgcggtgcgcgcggagttcgaccgcaccaccggcatcatggccgacaccttcaaggctctgcgccgccagttcgaggcggatcagagcgaggcgctcgcgatgcgctcggaggtggccacctacgagaagcgggtcgaggcgcgcgcccgcgaactgctcgaggaggtcacagcgctcaagcagcaacatgccgaggtcgccgccctgcacgccgagctgcagcaccgcctcgccgacatcgacagcctccacggcacggtgcacgcgatgcaggtcgaggccgcccgccagaacgacgcgatccgcatcaccgccgaccagcggcacgaggcgctgcagatcgaggcagcccgccatcgcgatgagatcagcgcggcgcgggccgcctcgggcgcgctggaacggtcggtcggcgacctgcaggaagatctgctgcggctgcgcggcgcggcggcctacgcggactatcgccgtgagcaggagcgccggcaccgctggtggcgccgcgagaaggccgatccggagcgcgcggcgctctgtgccctcgtcctgcgctccggcctcttcgatcccgattggtaccgggcacgctacctggcggatgagcccgatcgcgatccgatcgatcactacctcgatcacggacgcgcgcagcgcctcagcccgggcccgaacttcgacgcccaatggtacgccgagaccaatcccgacgtggccgcttccggccacgacctctttctccactacctgcagcacggccgcgaagagggcagacctccgcagcgccgctga

SEQ ID NO: 9498 - DNA, 468 bp, Methylobacterium sp.
atgagtgacaccgtgctggaccgcctggcggccctcggactggtccttccgcccgttccgccccctcggggagccttcaaaccctacgcgcgcgccggcaacatcatctatctcgcggggcagatctgcgagtgggacggcgaggtccgcttctcgggacccgtcggcgaggtgtacgatctcaaggtcggccaggaggccgcgcaactctgcgcgctcaatctgctggcctccctctcccttgccctcgagggggatctggatcgggtcgtggcctgccaccggctcggcggtttcgtctacgccaagcccggctatccggacgtgcccaaggtcatcaacggtgcctcggacctgatgttcgcgctcttcggcgaggcgggccgccatgctcgcacagccgtgggcgtcgcgactctcccggcaggcgcgagcgtcgaggtggacggcatcttcgaggtatcctga

SEQ ID NO: 9499 - DNA, 492 bp, Methylobacterium sp.
atgaagcgcgtgctcgtaggcattgccgttccgcttctcatggcggccggcccgcaacagacgcgctcggctccgccccccgcgccgccgctcagagccggcgccatcccgccgggtgacgcccctggggcccgcgacgcgtccgcgctgccccgctacggcggcggccttctcctcgagagcaaggcgggcgccttcgacgagatcgcgctgccgaacgccaagctggagcggcgcgcggacgaggtcgacgcccacaacaacgatctcttccttccgcccgagccactgacggtcgaagggcgggtcacccggatgagctatctcctgccggagggccgcaccgccctcgaggtggtgcggggctaccagcagaccgtgaaggatgccggcggcagcgtgttgttcgagtgcagccgggacgagtgcggcggctccggcgtcaccgcggcgcgttcgggcggcagcaagaccggcctgatccacaggtag

SEQ ID NO: 9500 - DNA, 141 bp, Methylobacterium sp.
ttgtcctccatcaagatcaagcccgcctgcgacggcacctacacgctctaccgcgacggcgacgccgtcagctcgggcctcaccctgtatcaggcccaggagctcgccgccgtgctgcgctgcctcgagccgaggggctga

SEQ ID NO: 9501 - DNA, 570 bp, Methylobacterium sp.
atgctgacattcagctttgctgatcccagcctgtcgctcgcggccgaactcggcgacgcggtcgagcgggtcttcgcgatcaacacctacgattatctgccggggctggaacgctcgaacctgctcgcctcaatcattatcaagagcgtgcgggcgccggtcgtcggtccggtcttcgcggctttggagaaccggtcgatcaccggcggcatcatgagcggaggcttccacgacccacgcagcctaccctccgacctgctcgacgagtacgcccgggtcggcgctcgggccggctacagcacggccgcgagaaaactgctcaaggcgctcccgagcttcgtcgcggcccgcgcccgttacctttctgtcaccgcgccgatcacgctggtctggggtgacgaggactgggccaacctgcgggaccgcgccggcgtcgcggccgcactccctttgccggaggtgatcaccctcgaccagacggggcacttcagcgccctggagcgctcccaggcctgggccgacatcatcctggctcggacggcgaggccgaagctctcggccgtcggctga

SEQ ID NO: 9502 - DNA, 159 bp, Methylobacterium sp.
ttgcggacgccctcgcacaagaccgtgcagggtgacgcccaggcgagtgccgtccgcgaatggcggcgctcgctggcagagctgcccacggcgaccaatgggttcaattccgatggcattgccgtcgcgatcgaaggactgctcacgcttgccgcctaa

SEQ ID NO: 9503 - DNA, 438 bp, Methylobacterium sp.
ttgatcttgccgcccttcggcgcgaccctgctctcgaccgctggtgcggtcgtttcctcccagacttggcccgcccggctcagcgccgcggcgggttttttcgtcctaaccggtcaaaggttcgtgattgagcgggagcctcgtatcctaatccacgttagccccggcctcacccctgccgagccagtgatgcctctctacacaatcgataccgatgacggggacctcttcgtcgcgggttccctagaaaccggcatcgactgtccgctaaaggccaggatggaagcgcatcgggtgctcggatcgatgacaagatacgctctgcccgatggggagcaccgcgtcctacaggccatcgttcgcgacgacatcgggcaggaggtctacgtcgcgaccatcacgtccacaggcgagtggaaaattccgcttggcgcctaa

SEQ ID NO: 9504 - DNA, 186 bp, Methylobacterium sp.
atggagcggcggaacgatcgtgaggtgcgctgggccgcggagcggcacgcgcgagagtcggcgcggaaccaagcagtcctgctctggtccgcgatccgggcggagcgccgggccgacgcggatccgggcgcccgactcaggcccatcctgctcgccgcgatgaccgacgagatgcaagcccgctga

SEQ ID NO: 9505 - DNA, 519 bp, Methylobacterium sp.
atgcaggatcccgatctcctctcagcccaccgcatcggcgccgccctctcgctggcgggtctcgccgtgctgatgctgggcgaggccggggagccgcagcccctcgggaccgccacgggctgcctcgtcgcggcgctcgccgccttcgcggtcgatgccctgcggcgcgggggcagccgccgcacccgccgccccgccgccgggcggcgccgggctctcctgccggggcggcaggcggcccccgcggtccctgcgctctctcccgcccccgcggcgccggaggccgggcccccggaggccgtcacggcggggcgctgggcgatgcccgcgacgcagcgcgatccgcgcgtccacgccgccctctccatggcggtcgcgcgcttccggagcgcgggcccgcccgcggcggatggcgggccgggacgcggtccggatgcgggcccggatccggggcaggacgatgcgcgccgggcggcgctggcggacgtgcgcaaccgccgcctcgcgcgccgggattga

SEQ ID NO: 9506 - DNA, 174 bp, Methylobacterium sp.
atgctcctcgccctgcctttcatcctcgtcgcgctcgccgtcctcgtcgtcggtgtccagatcctgctggtcgtcaagatggccgacctgttcgaggcgccccgcgacgcgcgtcgcgacgtccgcaacgtccatgcccgctatcccgccacgccggccggccgctacgcctga

SEQ ID NO: 9507 - DNA, 705 bp, Methylobacterium sp.
atgcgcgtgatgtcccagccggtgggcttgccggaggtggtcgagagcgatcttgtccgtcaggtcgcgcgcagcctgaccgcggcgatcgtgcaagggcacctgcgccctggcgccaaggtgtcggaggcggcggtggcccgcgaactcggcatcagccgtgcgccggtgcgcgaggcggctcgcctcctggagaatcaaggcctgctgcgcgcctcgccgcggcgcggcttcttcgtgcgcgaactctcggcagccgatgtcgacgaactctacgacctgaggatctgcgtcgagcgccacgccgcggtcgcggcttcccgccggctgacgccggaggcgcgcgtcgccctacgccgccagctcgacctgatggacacgatcgcccgcgaggacgacccgtccaccatcgtggaggcggactaccagttccaccgcatgatctgcgaggtcgctggcaacggccgtctgttgcgcctgttcgacggcctcgcctcggagttgcgcatcgtgatcggcctgatcgggcgtctgtacgatgatccgatgaagctcgctcgcgcccatgtgccgctgctggacgccattgaggccggccggccggacgcgatcctggcggaggtcgaccaccatctcggcgtcgctcgccgcgaggtcggcctcctcctgcaaagcctctccccggcaaaaccggatgtcttgtga

SEQ ID NO: 9508 - DNA, 936 bp, Methylobacterium sp.
atgcgctgtgtcctcctgagcgcgaccttcgacctgcgcgccctctgtccgagcgcgctcgacgcggcctccgacgtgatcgagttcgtcgacgatccggcggattcgcccgagacggtgcggctcgccctggcctggcagccggccgacgacgcgctgacccgctacccaaacctcgctgccgtctgctctgtgggtgcgggcgtcgacagtctcgtcacctgcccgagcctgcggccggacctgccggtggtgcgcgtggtcgatcccgaacaggcgcgggcgatgtcgggcttcgtgctctggcacgtcatcggccaccagcggcgcttccgcacctacgccgccaatcagcttgcccggcgctggcgctacctcgctccgccggaggcgagcgcggtccccgtcggcctgctcggctacgggaggatcgggcagcgggtggcctccgatctcatggcgctcggctttcccgtctccgcctggagccgaacgccgcgggagggggagcccggcggcgtcgcccaccaccacggcccggagggcctccgggccatggtggccggcagcgaggtgctgatcaacctgcttcctctcacgcgggagacgcgcgggctcatcgatgcggccttcctccgccggctcccgcgtggcgcctacctggtgcaggtcggacgcggcgagcatctggtggaggcggccctgctcgacgctctggaatccggccatctctcgggtgcggccctcgacgtattcgccaccgagcccttgccggagacgcacgccttctgggagcacccggcggtcttcgtcacgccccacgaggcctgccacgcgaacgagcgggcgatcgcccggaccctgcgcgccacggcggagtccgtccacgccggacgtcggccgcccgacaccgtcgacaccgcgcgcggctactga

SEQ ID NO: 9509 - DNA, 1044 bp, Methylobacterium sp.
atgagcggccaccgtccacccaactatctgccggtccggccggactggctggctgccggctacgaggagccgctcaagcccgagttgccgatcatcgacgcccatcaccacctgtgggaccggccaggctggcgttacctgttcgaggagtacctgaccgatgtccgcgagagcggccacaaggttgaggccagcgtctacatgcaggcgcagtccatgtaccgcgccgaaggtccgccggcgttcaaggtgatcggcgagaccgagttcgccaacggcgtggcggccatggcggcgagcggcctgtacggcccgacgcgggtgtgcgccggcatcatcggccacgtcgacctccgcggtgggaccgcggtggcggccgtgttggaggaccatctgcgggccgccggcgatcgcttccggggcattcgccatctgaccacctgggatcccgatgcgagcctgaccaacccgctgagtgcctgcccgccgggtctcctgggagacacggcgttccgggctggcttcgcttgcctggctttcctgaatctgagctacgacgcgtggctgttccatcctcagatcgatgagctgaccgacctcgcccgcgccttcccgaccaccacgatcgtgctcaaccactgcggcggcgtcctcggcatcggcgcctatgccgggcggcgcgaggcgatcttcgcgcagtggtcgaaagccatccgcaggctggcggaatgcccaaacgttgtggtcaagctcggcggccttggcatgcgcatcaacgggttcggcttcgaggccggcgccgtgccgccatcatcagaccagctcgcgcaggcgtggcgaccctacatcgaaacctgcatcgacgccttcggccctgcgcgctgcatgttcgagagcaacttcccggtcgacaagggctcctacggctacggcacgctctggaacgcgttcaagcgcctcaccctccaggcagcggaggatgagatcaccgcgctgttcagcgggaccgccgcgcgcatctatgcggtgccaacccggtcttga

SEQ ID NO: 9510 - DNA, 3267 bp, Methylobacterium sp.
atgagcagcgtcacctccgccctgacgagcgccctctacgcgagcgcggcgcagacggggacgcgccccgacaccgtcacggccgacgcattcgcccgctggcccgtcgccgcgcaggcggctctcgtgcgcagcttcggcaccggcagtccaccgtccatcctagtcggccaagccggccagcgagccatcgcgacgctgaacgagaccggtaccgacgtggacgtggtgcaggcgcccgcgagcctcgacacggcgcctgcggacctgacccgcgaggcgttcgagcgctggcccggcgcggcgcagatcttctacgttcgggcgaacggcagcggtgatccgtgccgcgtcgatctcggcgggacggcgccgggcggctccaccgcgacgctggcggagacctacggcctagccaacggcgtcgtcctgacggacaggggcgcgccgacggctgccgaggacgcgttgatcaagatgccggtcgcccagctcacgtcggcggactttttcacgctctcgccggacgaccagtacgcgtatttccagaaaaacggcacttcggtctcgatgccctcgggtccggcagtgctggtcctgaagctcgacacgcagcctccgaaccccacgacgcgcgccatcctcaccctcagcagcaacggacgtccattcgcggtcgaggtgcaggcgagcgactatccgggattcgcaggcctgaccggctcgaagatcgcgcagacaagtcccgtgaaggccagcctcttcgccgcgtggccgcgggagatccagcgcgcttacgtggagggcaggttcaccggcgcgaccgatcccgacacgaccgacgcctttcagcccgcgttctatccgaaggtggtcgttttcaccgacggttcgaagatcgcctccgtcaccgcgccgggcgcggaggtcgagatgatcgacatcccggcgggcttcggcaacggcacgaccggtctggcggccggaaccttcctgtcatggtcgccggccgcgcagctcgccttcgcgcgcgaggtgtacaacagcacgagcctgccaagcttcaccctgccgggctccaccggcgcgcaggcactctccgtgacccttgcgctcagccggaacggcctgacgcttgcgagcgtcggcgaccgcgcgaccaacctcgccgtcgatccggccgccctcgatctcgatctcttccatctctggccgatcgaggaccgggtagcctacatcgatgcgaagggcggcggcacaccaagatcgctcctgacgggcgccggcaccttcctgctgagcctcggcccggacgcactgccacgtctcgagagtgtgccgaccgggttcacgacgacgcccgctgccctcgcgcccgcgaccttcctcggctggtcgcccgcgatccgagccgcctatctcggccagtccggccttgcaggtgtgacggagacaacggtcgtcgacgctgccggcaacagcgtcatgcagcggtcggcgacgatcggaacggcgcccggcccggtcctgacggcgacgcgtataccctccggcgacgtcgtcacgacgggatcgatcctcgctatcgacccgacccgcggcatggggctgccgatcccgaacgctggcacctacggcggcgcgggcggccttgaccgagacccgaacgcgtcgagcgcggatgcgctcttcccgggcctcgacggcacggccgggcgctccatcgagaacaagccggccaaggtcgcggcgcagttcgcgaaggcgcccaaggacctcgcgcccgatgagttcgggacttggaattccgtgattcagttggagtacctgcgcaagcacggcacggccagccagggctacgccctcgtgatcggtccaggccccgacggcgccaccgccacgacggccttcatgtcggaatcggggactaaggtctacaccgtcggcaccctgcagaagacggatgtcggcaagatgtcatccagggatcaggctgttctggtcaccttggacgccttcaccaagccgctcacaggccgcgcggccgccctggaactgacggccggcaacgcggcgctcctcaaggcgatcgacgacctcgccagcgcgatcgcgctcgatcccaccccgctcaagggcggccagacccccatgccgctcgccgaccgccaggtcttcctgcatcaggtcgcgatcctcaaggacaaggttgcgggcagcagcatcgtctctgccagcagcattcagccgcagatcgacgacctgaaagcgcgtttcgagcgcgcgaacgcgttcgcgaccgcgctcccgcggaaagcgctcactgccgatcccctgaaggtcgaatatgaaacgcccgctttgagcctgggcgaaggcataccgcccgcgacggcaaaaatttcggtcgacccggatcataacacgaagatcgacctttcgaagtttctcaccgatcagttgggcagcgtacatccattgactgcagattctgcaaaggttattaactatagttcgccgataaagatcaaattctacgacggtgccggaaatcaaattaaggtgagtggtagcctgaacgctgtggagatctcccgccttcaggccggcgtcgtgcaggtcaacgcgccgacgttgagtacggacggcaaccaagccctgcagcaatgttacaggaacctgatatcccaggagcggcagctcctcagcctcgccgagagccgggcatccctggcccagaccggcaagctggcgggcagtacgcagcatctggacgtcccgaacctcgtctacctcttccagcttcaggccaacctgaccggcgaggcgaagctgcgcgccgatacggaggagctcaaccagatcaatgcgctggtgaagctctacggtgtggcgcaaaacatggtcaaccgcattctaaaggacaacgattcctccggaaagggaaatatctcccccagcggaggcatgacgcgggaagaaaaggaggccggcgtcttcttcgctggcggggcgtctcatccgatcgagatcatctacagcaacatcagccatccgaacgatgggttcggagcgcggccgtacgagcgctggggcaagctctcgacgcagctgtcggagcgcgtgacgctgatcaaccaggagagtcagatcaaaatgaactcggtcaactcgtcgaccaaggccaaggaccgcaacttcgacttggccaacaacgcgctgacgaagatgaacgagatcgtgcagaagatcgccggcgcgatgtga

SEQ ID NO: 9511 - DNA, 216 bp, Methylobacterium sp.
atgtggaagctggttgctctggtgcaggcgcagctgccgaattcggctcaccaagcccgcgttcacctgctggagcagctctacgcactggagcaggaggccttggagcgcggtgcggatccgggcaccctccgctcgattcttgcgacacaggcgttcgtccggagaagtgatccattgatggggcgcatggcgacgccggaacggccccaatga

SEQ ID NO: 9512 - DNA, 1245 bp, Methylobacterium sp.
atgctcgcgtccgcgatgcccgctggactcccgatgatgaggatagacggaatgttgctggtcaatacgaacccggcgcacggccgtgcgctcgaagtggcggatgccgaaatgctgtcggtcgcggcagccgagacagtcgagcgcttcctggaacatcgcccggatcatcgcccaacgccgcttcacgcgctgccggcggcagcccgatcgctcggcgttgccgcgatccatgtgaaggacgagggattccgcctcgggctcggcagtttcaaggcgttggggggcgcctatgccgtcatccggctcgtgctggaggaggccgggaagcggctcgggcttgccctcggtccggccgacctctcgcgacaggacgtgcgggccgtggcggccgggatgacgttcggctgcgcgacggacggcaaccacggccgctcggtggctcagggcgcgcaactcgtcggagcgcgatcagcaatcttcgtccatgccggcgtgagtgaggagcgcatcgccgccatcgccttttacggggccgagatgatccgctgcgccggcacctacgacgacagcgtcgaggaggccgcccgcgcgtgcgccgtcaacggctggacggtggtgtccgacacctcctggcccggctacgagcacatacccggcctcgtcatgcagggttacaccgccctactgcgcgaggcgttgcgcgaggtgccggagccccccacgcacgtattcatccaggccggcgtcggcgggatcgctgcgacattggccggccacttggctgtcgtctacggcgccaaccgcccgaaactggtcgtggtcgagccggcgcgcgcggcctgcctaatcgcctcggccgaggccgggaagccgactaaggtcgcccacggtgagccgaccgtgatggccatgctggaatgctacgagccgtcgctggtggcttggcgtgtgctttcgcgcgcggcggacgccttcatgacggtggacgaggacgatgccgtctcggccatgaaccgcctcgcccgccccgagaccggtgacccggccatcgtcgctggggaaagcggcggggctggcttcgccggactcgtacgggtcgtcggcaacgcggcttggcgtgacgccgtcggccttggtcctgaggcacgggtccttctcgtcaacacggagggtgcgaccgatcccggccgctaccgggaactgacgggcctcgcgccgacggatgtcgcttgcgccgcctga

SEQ ID NO: 9513 - DNA, 459 bp, Methylobacterium sp.
atgaacgtcgtgaacttcgcgcacggcgccctcttcatggtcggcgcctatgtgggcgtgctcctctacggctataccggcagcttctggctgagcctcgtcgcggcgccgctggcgatggggctcctggggctcgccgccgagccgtgcctgctctttctcgacgagccctccgaggggatcatgccgatcctcgtcgaggagatgctcgagcagttcgtcgcgatgaagcgggcgggcacgacgatcctgctcgtcgagcagaacgtggacctcgccctcgacgtctgcgaccgcgtctacatcgccaaggcggatgtcggcggcaagatcgcgaccctcggcggccgcctcatgcaggcgacatcgcgcaagctcgccgacgcgttcttcggcacgttcgcggctgagctcggcaccgccggcgatcccggagtccccgcgccggcagcggcctga

SEQ ID NO: 9514 - DNA, 765 bp, Methylobacterium sp.
ctcgaccaccgtgccgagacccacccgcccacacccgtctggtggcgggacgacgacgcggtcgccgccacgcccgccctcgaccggctgctcgccctgggagagacttgcgccgccccgatcctcctggcggcgatcccggcgcacatcgccccctcgctcgggcggcgcctcgacggcgcgccgggcgtgcgcctcgccgtacacgggctcgcccacgcgaaccacgcgggcccaggcgagaagcccgccgagttcggcccgcaccgcccgctcgccgcgctggtggccgatgcgcgggagggcctgcgccgcgcccgggagcacctgccgcaggacgccctgctgccggtcttcgtgccgccctggaaccggctcgcacccgatctcgccgccgcgctgccggatctcggctatgccggcctctccgccgccgcgccccggcaggcgcctccggaacgggtcggcctcgtccgcgccgacatccacatcgacccgatcgactggcgcggcacccgctcgctcgccgatcccgaccgcttggtggacgacctcgtggcgcggctcggggccggcgctccggtcggcatcctcacccaccacctcgcccacgacgcggcgctctgggcctttctcgaagccctgctgccgctgctctccggtcacccggccgtgacggttctcgatccgcgacacctgttcgcccgtccgcccgtggacgcgggcgccgcgccgtggtctcgtcggccggcgagggcttcgtga

SEQ ID NO: 9515 - DNA, 393 bp, Methylobacterium sp.
acggcactgggcgatggcaagatcctgttcagcgccagcaccgcggcgaacggcaccgagctgtgggtgacggacggcaccgccgcaggcaccatcctcgtcacagacgtcaacgctgcgacgatgccttccttcccgagccgcttcacggcgctgggcaacggcaagggcgtgttcgtcgccaacgatgcgaggagcggcttcgagctgtgggtgaccgatggcaccgccgcaggtaccagcctcctcaaggacatctacgcaggacccggtgcatcctccccggccggcttcacgacggtgggcgacggcagggtcctgttcagcgccagggacgcgtcgaacggcaccgagctgtgggtgacggacggcaccgcagccggcacatccctc

SEQ ID NO: 9516 - DNA, 3351 bp, Methylobacterium sp.
ggcggcggtggtggtggcggcatcggcggcggcatcagcttcggccgtggtggtgcgggcggcttcggcggcggcggcggcgcctctagtggcttcggcggcggcggtggcttcggcggtggcggtggcaacggtggccgcggtggcttcggcggcggcggcggcggcggtggcagtgcccgtgtcggcggcttcggtggcggcaacggcggcgtcgggagtggcggcggcggcggcggcctcggagcaggcggcgacatcttcgtccaggcgggcgccacgctcgtcatcgtcggcggcagcctgagcggcggcgcggtcagcccaggtggcggcgccggcgccggccaggcctacggcagcggcatcttcctccagcgcaacgccggcgatccgcttccgagcctgacgctggccgccacgcccggcgccccggccaccttcgccgacgtcatcaccgaccagaacggcgcggcgggcagcacggcccacggcgcggtcgggctctcgatcggcgacgccaccacacccaacaccggcatcgtcacgctctcggccgtgaacacctacacgggcgacaccacggtccaatccggcaccctgctggtcgacggtcagatcgccaactcggccgtgaccgtccggagcggcgccaccctcggcggctcgggcacgaccggcggcgtgacggttctgtccggcggcacgttctcgcccggcaacagccccggcctgatccgcaccggcgacctcgccctcaccgccggatccaccttcgtcgagcagatcggcggggcgacacccggcacggactacgaccagacccgggtcaccggcacggtcgatctcggcggcgccacgctcgacctgcagcgcctcggcgcctacgcgcccctcctcggccagaccttcacgatcatcgacaacgacggcgcggacgccgtcaccggcaccttcgccggactggccgaaggccaggacatcgtgctcggccgctaccggttcgcgatcagctaccggggcggggacggcaacgacgtcgccctgcaggtgtccggtgcccccggcccggtggtgaccgcctcgcccggcgcggccgccttcacggagagcgacaacgccgccgctgtgcccgtcgcggtcgatcccggcctcacggtcgccgatcccgacgcggcgaccctggcctcggccaccgtggcgatcaccggcaacttcaccgtgggcgaggacagcctcgccttcgtcaacaacagcgcgacgatgggcaacatcgtcggcctctacgacgccgcgaccgggcggctcgtcctgacctcggccggcgcgagcgcgaccctggcgcagtggcagaccgcgctgcgcggcgtcacctacacgaacggctccgacacgccgacgaccgccgaccggaccgtcagcctcacggtcgacgacggcgcgttcgccagccccgccgtcacgcgccgcgtcacggtggcggccgtcaacgacgcgcccgtcaacacgctgccggccagcctcgccgtcgggtcgagcgggcgggccgcgctcagcggcctcgcggtggcggacgcggatgccggaagcggcgtgctggtcaccagcctgacggtgcaggccggcacgctcacggcaacgagcccgccgggcggggcgctcgtcgccggcagcggcaccgccagcctgaccctgaccggcacgatctcgcaaatcaacgcggtcctggcggccccggacggcctcgtgttccagggcagccccggcaccaccacccagctcaccatggcgacccgcgacggtggccacgcgggcggaccggagaagaccgatacggacaccgccagcctcgtcgtcgatcaggcgcgctacgccatcgcggtcgcgccggcctccgtgagcgagggcacgggcggccccggcaacgccctgacctacacggtgacccgcaccggcgacctcagccagatcacgaccgtcgcggtcgggttctcgggcacggccacactcggcagcgactacacggtcgctggcaccggcacggccggcgacggcagctacgccgccggcctgctcaccttcgcggccggccaggccacggcgcgcgtccgcgtcaccaccgtgccggacggcacgcacgagcccgacgagaccgtcgtcgcgacgatcagcggcccgagccagagcggtctggtcacgaccgcctcggcgacggggaccctcgtcaacgacgacgcgccgccaccgagccccggctccgaccccgatccggtccctgtcccgggcacgtggagcgggggccggatgaccggcctcgtcacgaccatcgacccggccgccgcacttgccgcggccctgcgggccctgcagggcctgcccgcgggccccgacgaggccgcagtgcgggccggcatcggtgcgtttctggccgggttacccgccggcaccacgatcagcgtctcggccttcgagcccatacccggcaccggcgacatccgcatcgcggggccgacggacggcacccggaccatcgtgatcctcgacgcctcggccacgccgcaggggacaccgatcaccctggacgacctgggcttcgtggtcctgtcaggaccgccgtcactcataggcggtgccggcgcgcagatggtctacggcgatgccagcgctcaatcgatggtgctgggcgccgacgacgacaccctgcacggcggcgccggcaacgacgtggtcggctcgaaggccggcaacgacctgctctacggggacgcgggcaacgacaccgtgttcggcggcatcggcgccgacacgctgtggggcggcacggagcaggatctcgtctacggcaaccaggacgccgacctgatctacggcaacctgggcgccgacagcctctacggcggtcagggcgacgaccgggcctatggcgggcagggcgacgaccggatctggggcaatgccggggccgaccgcctgttcggcaatgccggggccgacctcgtctacggcaaccagggcgcggacgtgatctacggcaaccagggggcggacacgctgttcggcgggcaggaggccgacacgctgttcgggggacaggatgcggacgtggtctacggcaacctcggggccgacctcgtctacggcaacctcggagccgacgtgctctacggcgggcagggcaacgacgtgctctacggcggacaaggtgacgacgtactggtgggcgggctcggcgacgacatcctggtgggcgggctgggcgcggaccgctacgtgctcggtgccggcagcgggcgcgacctgatccggggcttcgaccaagccgcgggcgaccgtctggttctgggcgggtag

SEQ ID NO: 9517 - DNA, 189 bp, Methylobacterium sp.
atggagacccggcgcggcgccgacatcgtcgcccggaccctggaggcgctcggcggcttcggcgcatgcgtgacggacgcggccgacctgccggccgcgctggcggcggcccaggccagccgaaagcccgcccgcctcaccgtgatgatcgagagggtgccggcgcgggtgatccgccggccgggctga

SEQ ID NO: 9518 - DNA, 234 bp, Methylobacterium sp.
gcggcggcggtggaggagcagggcgcggcgacccaggagatcgtgcgcaacgtctcgcaagcctcgaccggcacgggcgaggtgacgcgcaacatcgcgggcgtggcgggcgcggccgaggagacgggggcttcggccgcccaggtgctcggcgcggcctccgagctgtcgcgccagtccgagcacctctcggcggaggtgcagcgcttcctcgcgagcgtccgcgccgcctga

SEQ ID NO: 9519 - DNA, 153 bp, Methylobacterium sp.
atgagcgacgacgacaggaagcccgacgacaagcctgccaacatcgcgccggacgcggtgaaggacccgaacgagaagaccgagggcaagccgggtgagggcccgaagggcggcggcacccagcgggacgagacggatccgggcggcagctga

SEQ ID NO: 9520 - DNA, 402 bp, Methylobacterium sp.
atgggcgatcctcccgcacctctggcgggcctgcacatccttctggtcgaggacgattacctcgtcgccaccgagctggcgcggtggctgcgcgcggccggtgccgacgtgatggggccggtggcccggatcgagcaggcctgcgggctgatcgaccggcgcaggcccgatgcggccgtcctcgagatcaggctcgaggccgaacccggcggcggagacacggtccatcccctggcggaccggctcgacgcgctcggcgtgccctgcctgttcgtgaccggcgaccctcgtctcgcccgcctgccggcctacggcggcatgccgtgcctcgagaagccgcttcaggaaacggacctgatcggggagctcgggcgcctgctcgacggcgcgcgcgccggttga

SEQ ID NO: 9521 - DNA, 1305 bp, Methylobacterium sp.
atgacccagcacagacgtcgcggaaatccggtccggtgcgcggcggccggcattgccctggccgtctcactcgggccggccgcggccgagagcggcgacctgctccatgtcggagaccgcctgaagatcacggtctacgaggtcgtcgagagcgcggaccgccccggcgcgggtgagccgcaggaggcgggaacggctccccccgtgcaggccgcctacccgcgcctcgatctctcgggcgagtacgtcatcgagtcgagcgggcgcgtgatgctgccgctgatcggcgccttcgacgccgtcgagcgcccggtcgaagcgctgcgggcccagatcggcgacgccttcgtgcgcaccttccggcgccgtccggacatcgccgtgaccttcgtgcagcgcgcgcccgtctacgtcgtcggcgccgtgcgcaaccccggcgcctttccgttcgcggcgggcctgttcgtcgcccaggcgctcgcgctcgcgggcggcgacctgacgaacgcaccgcccgagcgcgcgctggaaatcgtgcggggccgggaacagcgcgagaccgcgcgcgagcgcctgaaggcgctgctcgtacgccgagccgtcgccaaatccgagagcgagggggcggcgctcgcggcggacgagggcctgatcaagctcgtgggagccgagacggccgccgggctgatgaaccgcgagcagcggctcatcaagctgcgtgcccaggagcggtcgagcgcccggacggttcaggagcgcgcggtcgcgaccgccgaggaggaggtcgagctcctgagccagcgcctcgcgaactacgacgcccaggtcaaggcccgcggcgaccggctccggatcatggaagggctgttctcgcgccaagtggtcgagaacgagcgcgtcgtcgacatccgccgggactacgcggacatggaggggcggcggcgggacatcgagatcagcctgctgcagagccggcagcgcttggaggccgtcaagcgcgccctcgaacagggtgagctcgaccggcgcctcgccctcgagaacgagttcgtgagggtcaccggggagttgcgcgaggccgagcgcggcttcgaggccgcgaccacggtggcaagcctgctcgcccgcgggcaggggcccgaagcatccgaggccgccgcggtcacctacgacatcctgcgccgcaatggtggcggactggagacgctgcatgtcggacagggggagatgctcgaacccggcgacgtcctgcgggtgcagatcggccggccgagcgagggggtcggcaaggtcgcggggaaatga

SEQ ID NO: 9522 - DNA, 975 bp, Methylobacterium sp.
atggacctgcgtcagctccggtacttcgtcgccatcgtcgagcagggctcgttctcgcgggccgccgaggtgctgcgggtggcccagccggcgctgagccagcacatgcgccacatggaggcggagctcgggttgccgctgctgcaccgggggccgcgcggggcggtgccgacggaggccggggcgcggctcctcacccacgcccgcgccatcctcgaccgcttcgccgagatccccgacagcgtgcggggggccgaccggccggtgacgggggacgtgcgcatcggcctgcccggcacggtcagcgagatcctgtcggtgccgctgatcgagcgggtgcgggcggagcatccgggcatccggctccgcgtcgcggaagccatgagcggctacatcctcgactggctcaaccgggacgccgtcgaccttgcggtgctctacaacccggccgcgccgaagggcctcgtcctgcgccacgcgctcaccgaggagctgtgcctgttcgggcggcccgcgggcgggggggacctgccagacgggccggtgtcgctggcgcgggcggcggcgctcccgctgatcctgcccgccctgtcccacggcctgcgcgacctgatcgaggaagtcgcggagatggacggtgtctcggtcacacccggcatcgagatcgattcctacgcgcgcatcaaggagctggccgcgcgcggccacggcttcggcatcctgccgcgggcggcggtcgccgcggaggtggcggccggcatcgtccgggcctggccgatcggcagcccgcccctgcggcggcggatctacctcgcccacgccgccgaccggccgctctcggcggcggccgcggccgtgtcgggccacgcctgggacctgctgggcgagctggtgcgcgctggcgtctggcctgccgaattggccggcccggatccagcgcggccgttgaccggtgcggcgggggcggccatctag

SEQ ID NO: 9523 - DNA, 438 bp, Methylobacterium sp.
atgagcgcggtcatcgagcgccgggtcctcgatcgcctgatcgccctcgggcgggcgacggggcggatctcgtccgacgagttgcgcgcccacttgcccaccgcgaccatgacggccgaggacatcgcggtcgtggtgctggaactggaagagtccggcgtcgaggtggaattcgagggaccgctggagaccgcggggcgcccgtccccggtccggccggtcgccgagctgccgccgctcccgacggcgccggccgtcgcggcctcccccgccccgaccgtgcgtgcggcggatccgcccgcatccacctcgtcggcggcggcccggtccggagcttcctggtcgggcggccggaatacggtcacccgtgcggtgattgcggccggcgcgctcaccgttctggtgatcgcggtcgtgctgctgctcgtccggcgctga

SEQ ID NO: 9524 - DNA, 225 bp, Methylobacterium sp.
atgtcctttgccctcgccttgcctgtcgccgaagcctccctcttcaccctcggctgcctgctgatccacgccctgcgccgccacgccgacgtggtgacgggcgccctcgcctgtctgctggtgctcgtcacgctgctgctggcggtggccggcacgccggagccggtgctgcgggcgcatgccctggccctggagaacggcgaggtgatccagttcctcaactag

SEQ ID NO: 9525 - DNA, 660 bp, Methylobacterium sp.
atgatcgctctgcgcagtctcatgacggcactaccctacaatccggccgagcgccgccgggcctgggcgggggcgttcgcgccgtatttcgacatggcgcccaaggaacgcgatccggcgccgggcctactcgccctgacccggcatcgcttcgaagccctcacgctgttcgagatgacggccccggcccagaccttccggcggacgccggtgatggcggccgggcaggcgctcgatcacctgatggttctgttctggctcgacggcgaggggcgcgtgacgtggcatggcggcacggccgcgttcggtcgcctgcagggcgtggtgctcaacctcgcccagcccgctaccctcgtcgtcggccccgtccaggcgactgggctcgtcctgccgcgggcgctggtcggggatcggttgcccgatctcgcggctctgcacggagccgtgctcgatctcgcctccgatccggtgagtcgcctgttctttacgagcgtgcaggacctcgccgagaacgcgagcgccgtgcgcgacgatatgctcccgcaggtcacgcgggccattgccaccgtcgccgccgccgccctgtgccgcctgaccgccgtatgtcccaccgcgatcgttcccgcgccgaagcgcctactggaagaggtcccggcgtga

SEQ ID NO: 9526 - DNA, 219 bp, Methylobacterium sp.
gtgagccgcgaggaattgctcggccccgcgacactgaccgtctggccgcacagcatcgacgccaaggcagtcgaaccgcgcgagatggcaagcctcgtcgtcgccttggaggaggccgcgaccgccctgcgcagcggcgagggcaccccgtgggtcatcacgagtgccggcacgatgcttccgcccgatcttctgcggaacctgttggcagcaccgtga

SEQ ID NO: 9527 - DNA, 240 bp, Methylobacterium sp.
atgcctgtgctggacgacggcttcacttacggtggtctggtcctcggactggctgcgctcgcgctctggctccgtctcgcctcgcgcgccgtaccgaacttcgagaccatgctggcgcgttatcaggacgagcgggtcccctcggataccgcgccgccgagcggattgggccggctcgtggcatgcgccaccgcgctggccctgaccttctcggccatcggctacgccattccggactga

SEQ ID NO: 9528 - DNA, 267 bp, Methylobacterium sp.
atgacgttcgcccgctcgacgctttcggtcgccctgcttctcgccgccctgcccgccgcggcccagactcaggctcccgacctcaccgggaccggcggcggtcccacgaccacgatcaccgcgccctacacgaaccgggagggcgtgacgaaaccgccgggcgacgccctcggcccccgcgacatgtcctcggccgcggcggagcgccgcgaggagcgcgcgatcgagcgcatcgagaacagcatctgcgccggctgcgaggattga

SEQ ID NO: 9529 - DNA, 834 bp, Methylobacterium sp.
atggcgctcaacctgaagcagtggttggcaggcctgttcgggctgatgctcgtcctggcgctggcgcagggcggcctggcgctcgtcaagctcgacgcggtggcggaccggacggcgctgctgctcgacgacacgatcccgtcggtgaacgccgcgcacggcatcaacgccaccatcatccgcacgcggctctggcagttccgctacgtcacggccgagagcgagaccgcccggggcgagagcctggccaaggtctccgagttcacgaacgaccgggacgcccagatcgaggcctaccgggcgcgcgtcagctccgcggcggagcagacggtctacggcgacctccagaccaagctcgcccagctgaagcccgactgggaccggctgcgcgccttcccgcccgagcgccacgcggaggccatggccttcttccgggggccgatgaacgcgaactacctcgcggtctccggggcggcgcgcgccctcgtcgacgtcaatctcgcggccgccaagaccgccgacgcgaaggtgcgcgccgagcaggcctcggccacccgcgcgacgctgctgatgctcggcgtcgccgtcgtgatcgccctcggcgcgacggtcttcagcttcctcggcgtgtcgcggccgatcgagcggatgacctcggcgatgcggcgtctcgccggcggggacacggcctccgagatcccctatggcgggcgccgggacgagatcggcgcgatgtccggcgccgtgcaggtgttccgccagaacctcgtgcgcacccgcgagctcgaggcggagacggcgctggcgcgggcctcggcggaggagcagcgcaag

SEQ ID NO: 9530 - DNA, 861 bp, Methylobacterium sp.
atgtcaatctcgatcgcttcccctctcgcgggtatccgcgatgtcctggtcggccttacggaggagggccgcggtgacgaggccgcggcctcccttggctatggcctgactctggcacgggacgcgggcgcccacctcaccgtgcaatccgccgccctccggctcatgactaccggcctgccgctgtgcgggttcgctgacgagctcgtcggcgccgagaacggtcgcctagccgtcctcgcccgaaaagcggcggagcggatcagggaggacgcggaaggagcgggcgtcgtttgcacggcggagtcgccgagcctcatgtaccacgaggtggtcctccggctctcgacccgggcgcggttgcacgacctgaccgttctcgacacagagcctttcgcggcgatgccggaccgcgacttgatggagggcgtgctcttcgggagcgggcgcccgatcatcgtggtgccgacgggttgggataccttccgggcgcgccgcgtcgtcgttgcctgggacgggagcgcgcaggcggctagggcggcgaacgacgcgctgccgttcctgcgcgcggcggaagcggtcgctgtggtctgcgtcgaggaaaccgagcggctgttgtcgatggtgcccggcgcggagtttgctccgcacctcgcgcgccacggcgtcgcggtcacggtcgacgaccgtccggtcgaggtcgacgtcgccgagaccctgcgcagggcgaccgagcagttcggggccgacatgatcgtgatgggcgcttaccggcactcgcgcatgcgcgagtggttcctaggcggcgccacgcaatcgctgctagcccggagtagcatccccctgtttttggcccactga

SEQ ID NO: 9531 - DNA, 603 bp, Methylobacterium sp.
atgccgatgtcgatccgatcccctctcggcctgagcgtcgtcctggccgccctggttctcgcgcaggccggtgcccgcgccgagccatcggccggaacctggacggatccgccggccaagtccgcggccaagtccgccgtcgagccccccgagccgcccggcgccggggtggctcaggagcggggcgccagatcggtcggcgccaagtcggtcggtgccaagtcggccgagacgaagtcggccgagaccggatcggcgaccccgcgggccgaacccgtgaagcggaagcccgttcgcgcagtccgcgcacccgcgccgcgccgcacggtggcggcccggccggtgcgccggcccgagccggtcgtgcggagcgcgacggtgcggccggtccgggtcgcgcggccgctccaccgggactggccgccggcggagccggtctacgtggcgccgcgcgcctacgatccgcgcgacccgcggctggagcggctctggagcgccgaggaggccggctacctcgcggtgcacgggcgccacgtggcctatccggacgggcgcaccctgcggatctaccggccgagccgcgacgacgaggatctcgactga

SEQ ID NO: 9532 - DNA, 225 bp, Methylobacterium sp.
gtgacgcttactgacctggtcgctgcgatgcaggcccgcgaggcggcccgggcggcgcggggcgagcccccggcttacatcgtcgaggccgacgccacggggacgtccgtcacatggagcctgcccgggcacggcctcgtccggcgcgagcccggcggcaggtgcgtgcgtctgcgggacggagtcgagatcccgacgacgggatggggctatcccgcccggtag

SEQ ID NO: 9533 - DNA, 489 bp, Methylobacterium sp.
atggaaccgatgagaaagctgcgctgggagcccccgggcgggatcgccgccgagcccgctcgccccgatccgctgaccagcctcgtgcgcctcgtcagggggccgacggcccggccggacgcgccgccggtctcccccgaggactggaccgggctgatcgaccgggtccgtctcgccgcgggccgcgcccgcgaggccgaggcccacgccctcgagcgcgagcagcagatgcaggagctgatgcggcaggtccgcgcggaggccgaggcggccgaggcgcgcgtccgcgcggccgagatccgggccgccgccgccgaggcgcgcgccgagacctgcctgcgcgaggccgaggcgcgggtcgagcaggccgaggcccgcgcccgcacggccgagacgtggctgctgcgggtccacgagaccatcgccagcgagttcgcccccgtccaccgggatctcgaacccgctctcgaccgcgaggcggcgcgatga

SEQ ID NO: 9534 - DNA, 270 bp, Methylobacterium sp.
atgatcaaagcaggcccgttcgccgtcctcgccatcctggccgccggccccgcgctggcgcagcccgcgaccacggccgcgcctcccgcggcgggcggcacggtgacgacccagcccaacaccaccggcaacagccccgacgtcgtgatctcccgcggcggcaccggcgccgagaccgccaccacgaactccgccgcgggcggcaatgccggccagccggaacgcggcgtgccgcagggcagcgccaacggcggcggcggcagccgctga

SEQ ID NO: 9535 - DNA, 276 bp, Methylobacterium sp.
atgaacgcgcaggcagaggcacagggagagacgctgagggagcagcttgggcagaagcgggccgcgatcgcggcgggggtcgcggcggggggcctgtccggaacggaggcggaagcgcgggtcgccgacctgctggcgggacgcgcggagccggagacggcggatctgcgccgcctgctcatggagtaccgcgatctcgaagcgcgacctgccgacgaggccgacgtgcgcttggccgaggcgggcgaggtcttcgcgccggaggacgacgcctga

SEQ ID NO: 9536 - DNA, 294 bp, Methylobacterium sp.
gtgacgacccgccgcccgaaccccggccccggcggtgccgttgtcccggacccgcacgcgaaggaggccggtgccatgacgatcaacctctcccttatccgcagccacatggaggtggttggcccggacggcagccatgtcggcaccgtcgacgcggtggagggccggcggatcaagctgacccgcaaggatccggcggctcacggccagcaccacagcttcgacgccgacctcgtggccgcggtcgacgacaaggtccggctcaacaccacggacctcgcggccggcggctga

SEQ ID NO: 9537 - DNA, 876 bp, Methylobacterium sp.
gtgggcgccctcctcacctctcatgctgacggcccgctcgctggccgtcagcccttgacctacaaggggcagcgagtccttacgaccgaactggccgcgagggcgttcggggcgtcggacaagcagctccaggacaactaccagaacaacgccgaccgcttcgaggtcggtaagcacttccataaggtgacgggcgccgagctgcgggcgctcaagaaccaacccgatttcgtcgggttagtgggcccgcaggccccgcacctcaccctctggaccgagcgcggcgtcgcccggcacgcgaagatccttgagaccgatacggcctgggagatcttcgaggcgctggaggacacctacttccgggttcgggaggaggcacgggccgagcgcaccgccgggccgccggtcgagacctccgcccgcgagatccgcctgatgcacaagcacgccctcgccatcgccacggcggccggtctcgcgggcaatcagctccttatcgcggccaaccgcgtcacgaagcgcgggaccggcttcgacgttctggccgagatgggcatcacgcacctcgtcgccccggtgaacgacccgctggtgatcccgacgaagctcggccaggatctcggcggcctgaccccgcgggaggtcaacaagctcctcgcacggctcggataccagtgggccgacaaggaccaccgcgaccgcaacctctggcgtccgacgccgaagggcgaggcgctgggcgcgcaactcatggaccgcgagcgcagcaacgacacgggcgcggcgcagcagctgatgtggcccctggccgcgacgctagaggtgctgcgggcgggcctgcgcgacgatgccggcgacgacggagaggcggcatga

SEQ ID NO: 9538 - DNA, 774 bp, Methylobacterium sp.
atgaacctcttcaaacagttcgatatctacagcctcaaggcgcgggttttcccggcgttgatcgctggcctgccgacgttggcactcctgtttgtcatcgttccgtgggatcatttcggtatgtcccacgccatcgcggcagcaatgggtgcggtcttgctgtttgccttcgcagatatggcgcggcatcgcggccgggtcgtccagacgcggcttgggactggggcgacacccgagcaatggcaccgaggcaaccctgacgtgccagaggtctccaaggataccttccgtgactacatggcccgccagctcaagcggccagccccgacgattgaaaatgaacaggccgaccccgctcgtgccaacgacttctacctgagcgccaatgcgtggctacgtgaccgcacgcgcgacacccgcgcattctcactcttgttcagcgagaacgtcacttacgggttccggcgcaacctgctcggactgaagatgaccggtttggtgctgaacctcctagttttggtgttctgctctggcattctgtggttccggccgccatacttcgccgcgctgcccaatatggatgagaagctgacgttcatcatcgcggcagtagtgctgcactcggcctacttggtgttcgcagttggcaaagcggcggtccgtgacgcttcacgggcgtacgggcggcagctgatcctcagcacggaagccctgatgaagaaggcgcctgccgcatcgaaaggcgtcacgcctgacggatcgaaggctgggtga

SEQ ID NO: 9539 - DNA, 441 bp, Methylobacterium sp.
atgcgctgcacgctcaccctccggacgggcgaggacccccgcccctacgccgtgctcgaccgggccgcccgcgacctcgcggcggcgctcgttccggtcccctccggcatcctgctgctcggcgccgagcacgggcgcgacgtcgcgcggctcggcgccctgctcgcggtgcacgaggcggagaccggcctggccgacggcgccctgcggatcgtgccggtcctggggacggcccgcgccgtgctggcggcggcgagcttcgcggatgcggggccgcgcctcgcggccctcgccctcgacgcgacggccctggcggagcaggccctgggggaggccgaacgcgtgcaggcgcgggcgatggcggggctcgccgccgccgccgcgggcgtgccgctgatcgcgctcgcccgcgacgcggcgggccgcctcggggacgcgtga

SEQ ID NO: 9540 - DNA, 1059 bp, Methylobacterium sp.
atgactgaccggaccgatcaggaggccgagagcgggagacaggcggggcgccccagggcaccggacgacctgccgacccgggatgagaatttccggctcctcgtcgatacgatcccgcagctcgtctggcgcgcgcggggacggggcgattgggtctggtcgagccggcaatggcagggtttcaccggccagagcgaggcggaggcgcgcgaccgcggctggctcgcggccgtccacccggacgaccgggcccgcaccgaggcggcctggacccgggccgaggctgaggatcggctcgcagtcgagcaccggctgctccaggcctccacgggcgagtaccgctggttcgagacgcgggccctgccggtcggcggatccgacggagaggcgcgggagtggttcggcaccgcgaccgacatccacgacctgaagatggcgcaggcgcagcaggcccacctgctcagcgaattgcagcaccgggtccgcaacaccctggccacggtccgcgcgatcgcccggcgctccgccgagacgagcgagagcgtcgaggattacgccatgcatctcgagggccggctgaacgccgtctcgcgggtgcagagcgcgatcatccgcaacccgatcggcggcctcagcctcccgctcctggtggccgacgagctcttcgcctaccgcgcccatgagggcgaggacttcaccatcgccggccccccggtcgtggttccggcgcgcgcggcggagcgcctggcccttgccctgcacgaactggcgaccaacgcggtgaagttcggcgcgctcgcgcagcaggagcggggctcgatcgcgatcgcctggacggtggaagaccgtcagaagggccccgtcctgatcctcgactggacggaaggcggcctcacgctcgcgggcacggagccgcagcgctacggtttcggcatggacgtgctgcagcgtatgctgccgcacgacctgaaggcggaggtcgtcgtcgccttccgcgccgacgggctgacctgtcgcatcgccctgccgctcgacgccgcgacgccgctgccggcctga

SEQ ID NO: 9541 - DNA, 279 bp, Methylobacterium sp.
atgcccgtgctcgccctcgccgccctgctcgccggggcgctggtcgccctgccgaccccggccgcgacggccggtctcgaccgcggcagcccgttctaccgcgccgccccctacgtgcccccctccgccgccaccttcagcgcgcccgccgaggcggagcggttccgcccggtccacgtccacgatgcgccgcccatacctccaggcggccggttgccgaaccagcgggccggaccggtgcgcgaccatgtggtgcgcgacatctgcatcggttgctga

SEQ ID NO: 9542 - DNA, 756 bp, Methylobacterium sp.
atgaccgaagagaccggggcgccggcaggcctcgacatccgccacctcgtcgtcgaggaggccgagcagtcccggatgaacggcgtgcacctcgtggcgaaccggctcgcccgcgagcaggtccgcctcggccagagcgtgcggatcgtcgtcctgcacccgccggcgcgggcggtcgatccgggcgtgtgggacgcgcccgtcgaggcgctgccgctcgagggccacagcctgttcggccacctcgtccagccggcgccgcgcctcgtcgcgggcctcgtcgcgggcgccggcccgggcaccctggtccacgtccacggtgcgcgccggccgctgctgctggcgatcgggcgggagctggcgcgccggggcatccgctacgtcgtcaccatccacgggcgctacgcgcacgtcgccgatgccgggatgcgccgggcgcaccgctcgaccagcctctacctcgcgatgttcgagcgccggatcctggagcgggcgtggttcgtccacgcgctgacggtgcaggaggccgaggccgtccgccagatcgcgccgcgcgcgcgcatcgcgatcgtggcgaacgcggcctattcgagcgccttcgacgcgccccccccgccgcccgcgcgcgccttcccctcgccggacttcccgctcttcgggttctgcgggcgctacgccgcccatcacaaggggctcgacctgctgatcggcggcctcgcggcccaccgggcggcgggcgggcggggacgtctggcg

SEQ ID NO: 9543 - DNA, 1314 bp, Methylobacterium sp.
gtggcactcaagctcgaccgcagggaaccgggggtctggatctcggtgggcacccacgtcgccgtggtggccgccgcgatcatcggcatctcggccccggccctgccggaggcgcaggagggcgtgcccgtcgaggtgatcaccgagaaccagttctcggagctgaccaagggcgagcgcaacgccgagaagccgctctccgacgccaagccccgcgccgaccgccaggcggaaaagttcgaggagcgcgagcccgagaacgccaaggtcgattcgccgaccgcgcccacccgcaccgccgacatgaaggtcgccaacgcggacgcgatggcgctccgcatgagcgagccggacccggccgaggagcgggccaaggcggaggccaaggccgccgcggagaaggcggccgccgagaaggccgaggccgccaaggccgcgaaggcggcggccgccgagaaggccgctgcggagaaggcggaggccaaggcgaaggccgaggccgccaaggcggaggccgagaagcgcgaggaactcgccaagctgatcgagcgcgaggaggccgaggccgccgccgaggcgaaggccaaagccaaggcggaggccgccgcgaaggcgaaggccgaggctgccgccaaggccaaggctgaggccgccgcgaaggccgaggccgagcgcaaggaggccgagcaccagaagcagatggccgagaaggcggaggcggagcgcgagaaggcggaggccgccgcgaaggcgaaggcggaggctgccgccaaggcggaggccgccgccaaggccgcgaaggccaaggcgatggcggacgccaaggcgaaagcagatgccgaggccaaggcgcgcaagcaggccgagatcgccgacaagttcaacgccggcgacatcaagtccctgctcgcctcgaaggcgccctcgcaatcgacgggcgcgacggggcgcgacgtgcagcgcgtcgcctcgctcggtgctgccaccggcacgtcgcagaagctctcgccctcgatgcgcgacgcgctcgtcggcatgctccagcagcagatcgagcgctgctactcggccccgcccggcgcctcgcagggcgtgatcctgccggtactcgacatccgcctgaacccggacggatcgctgggcagcgagccgcgggtgatgcgctcgggccagaacgcgaccgaccaatcgatcgcccaggccgcgctgcgtgccgtgcggcgctgcgcgccctacaagatcccggctcagtacgcgcccttctacaacgactggaaagccatcaacgcggagttcgagttcacggcgacctga

SEQ ID NO: 9544 - DNA, 279 bp, Methylobacterium sp.
gtgatcgttctgttggccggcctctggccgggattggccgtggccctcctcctcggactcggtatcggcgccctctcgggatggccgcaggaccgcgcgatcccgctcggcctcggcatcctcgcgctcctgctcgccgggctcgcgacctcaggcctggtcacaggcgtggccggcctctggctggagagcggcgcgctgatgctcgccgtctatgccgtgggctgcgtgctcggaagtctcgcgcgcgggcagcgcaccgatccggacgggacgtag

SEQ ID NO: 9545 - DNA, 507 bp, Methylobacterium sp.
atgcccaccattcgtcgcgcgtcctggcgcccccgcaagatgttcggctacgacgtcgagtcgtacaagacgaacgacaactgggaactcgaactcaactaccagttcagaaattcagacataacgcccgaggcgagggagatgctcctaaggctgcggttggatatctggttcattcgtttgcctgtagagcacaggcagattgcaacgctcatcaagatcgatacacaccatcgaaccacgaaagagttggtggagagtctggatgcagccccacgcgtctatctgacggaggaattccaaaccagaaatgacacaagggtcggtcggagcgacatgcatggatacattagatatggcacttaccactattcgttcgtcgatggcagagtgaaggaatatactaacggcaatcaagaatttctttggaatgccgtccgagactacatgtactggagcaccgtatcgagagcggacaaagccgccctcgccgccatcgagttctag

SEQ ID NO: 9546 - DNA, 309 bp, Methylobacterium sp.
atggccaggaacacccccaaggatcgggccgcggcggcggcggccctcgctcggatcgccgaattcctcgacgtcccgatcgcgggcttctacgagcctgtgccgggatcgaacgggggcgcacctgccgatccggcccggcaggcggagatccgggagctgatccggcagtttctgaggttgcacgacccgcaggcgcggggacgctgcctcgcctatgtgcggcgcgtcgccgacgaggccggctggcagcccgcccccgtgccgggtgccgccgaggagaccgcctcgcgcctcaaaggctcgtga

SEQ ID NO: 9547 - DNA, 1470 bp, Methylobacterium sp.
atgcggaccctgccggaagatttgcccgaagatctggccttcgcgccggccgtgacgctgctcgatctcctcgcccggcgggcggtgacggcgcgggcgctcctcgaactgcacctcgcgcggatcgcgcggtttccgcggatcaacgcggtgatcttcaccgatcccgacgccgcccgggcgcgcgcggacgccgccgatgccgcgctggagcgcggcgagcgctggggccccctgcacggcctgccgatgaccgtgaaggaaaccaacaacgtcgccggatggccgacgacctacggcgacccggcactggcgcgccacgttcccgcccgcaacgccgtggtggtcgaccggcttctggcggccggcgcgatcatcttcggcaagacgaacgtgccgatcaacgcgctcgactggcagagctacaacgccctgcacggcacgacgcgcaacccctgggacctcgcgcggacgccgggcggctcgtccggtggcgccacggccgcgctcgcggccggtctggtgccgctggaactcgggagcgatgccggcggctcgatccgcctgcccgcgcatttctgcggcgtgttcggccacaagccgacgccggggatcgtgccgaacctcgggaacgagcgtcccggcagcctcctcgacaacgacttggttgtcagcggccccctggcccggtccgtcgccgatctggtgctcgccctcgacgtgatcgccggaccggcagggccggacgcggccgcgtggcggctccagcttccgcccccgcgggcgacgggcctgcgcggcctgcgcgtggccctgatctccgactcgcccgtggccgaggtcgatcagaaataccgcgacgcgatcctcgaactcggcggacggctccgggccgagggcgcggaggtcgtcgcggatgcgctgccgttcgacgatcacgagcggcaccacgcgatctatctccagctgctgcgcggggcggcatccggacggcttccccaggccgcgttcgacgaggcggtgcggcgctccgccgtcgcggacgcggatgcgagcccctacgtttcgcagaccttcagcgcctacgcgcagcgccatcgggactggatcgcggcctcggaggtccgtgcgcagctgaaacgcgcctggagcgccttcttcacccggttcgatgtcgtcatcgccccggcgggcgtcggcccggccttcccgatcgacgaacggcgaccgcgcgaggagcggacgctgacggtgaacgggcaccggatcgactacaacgatcagctcttctgggcaggcctcgcgacgctcgcctcgcttccggcgaccgcagcgcccatcgggcggatcgatggcctcccggtcggcgtccagatcatcgggccctacctcgaagatcgaacgaccctggccatcgcggcagaactcgagcggctgaacccgttcgttgctccgcaggaactcgcctga

SEQ ID NO: 9548 - DNA, 804 bp, Methylobacterium sp.
gtgagcgtcgcgcccgcggtcgcgccggagccgccggtgctcgccctgtccgatgtccggttcgcctatcggggctcggagcccccgatcctcgacgccctcacgctcgacgtggccgagggcgccttcgtggcgatcctcggcccctcgggcgggggcaagtcgaccctgctgaagctgctggccgggctcgaacggccgcaggccggcaccatgacgctcgccgggacgccgatccgcggcccgcggcgggagatcggcatggtcttccagaagccgacgctgctgccctggcggagcgtgcgcgacaacgtcctgcttccggcggccttcgcgtcgcgcgcgagcgatgccgagcgcgcccgcgccgaccacctgatcgagaccgtgggtctggcacgggcggcggctctctacccgggcgcgttgagcggcggcatggcgcagcgcgtcggtctcgcccggatgctgatgcaccggccgcagctcctgctcctcgacgagcccttctcggccctcgacgcgatgacccgcgagcggctctcgctggagctgcagcggatctggatggaggagcgctcgacggcgctcttcgtcacccactcgatccccgaggccctgttcctcgcggaccgcatcgtggtgctggcgggccggccgggccgcatcctcgcggacatggaggtcccgctggcccgacccaggaccctggacagcctcggtgctcccgagttcgcgcggctcgcgcgcgagctgaggcgtctcttcgacgattccgtcgccgcgggagacacggtccgatga

SEQ ID NO: 9549 - DNA, 1092 bp, Methylobacterium sp.
atgatgaaatcgccgtcgcgcctcaggttctccgcgtgcctgatcctcgcgggcctcctgggcacccacatcgcctgtgcgcaggcgcaggaccgggtgaaggtcggcctcgcgatcccgccctccgtcaccgagggaagcgttcaggcgatcgccgaggagctgcgcctgttcggcgacgagaacctgcaggtcgagtacgtcgtcctgccgggtgccggcgccctgctcccgcagctcctccagcgcaacatcaccctcgcgctgccgctccccgagaccctgctgtccgcccacaagaccggcgagccgccgctcccagtgagctacgtgtacaatgccgggccccgcaacacgctcgagatcgcggtcaaggcggattccggcatcaagagcctcgccgatctgcgcggcgccgccatcggggtcggggccctgacctgggggacgatcccgcagacccgcgcgctgctgcgctcggtcggcctggagcccggcaaggacgtgcagatcgtggcggtcggcgtcctcggcgcagggtttcacgcgctgcgggagaaccgcgtccaggccctcaacttcaacagcacgtggatcgacctcctcgagggcgagggcacgcccgcccggcgcctcgcgtttccgccgaccttccgccggatgatcgtcaacgggttcctggcgcaccgcgcgacgctggagagcgatcccgggctgatcgagcggttcggccgcgcctggaccaaggcgctcgtcgtctgcgacgcgaatccgcgcgcctgcatcgaggcgttctggcgccgcaacccgggcgtccgaccgcagggcgacaccgccggtccgctggccgcgaacgtccgcctgctgcagcgctggatcgagccgctgctgcgcgacgagacggggcaggcccgggttcccggcgcctacgacctcgacatcatcaaggcctacatcgccgagatgcgggccaacggcgagttcgcggccgacgacatcccggtcgcgtcctacttcacgaacgcgctggtgccggcctacgcggcgttcgatcgcgaggccctgatcgcccgcgcccgggccctgccgtga

SEQ ID NO: 9550 - DNA, 390 bp, Methylobacterium sp.
ttgggggcacgcattgttccacgaccaggatctgccggccgacaccggcgtcgacgctgctatcggcgagctcgccgacacgggggcgcggtcgcccctcccccggagaccgggtcccgccccgacctccgcccgatcctcctccgtccctgcgcgaccgacgactacctctccgacaagaccgacatcctcgacctcatccggcgccgcatcaaggagcgcgcgctggagccgaaggacatccgccggaccatcagggggtggcggcccgaggagcactaccgggtcacctgcggcttctacgactgcgacatcagccagaggcgcgcctaccagctcgcggccgccgtcgggctcaagcggaccaagcgcctgcccttcgagctctga

SEQ ID NO: 9551 - DNA, 246 bp, Methylobacterium sp.
atgcgcccgatcctgcttctcgccctgctcgtcctgcccgcctccgcctcggcgcagatgatggacggtcccgtggccggcggggcgttcggaatgagcggcgccgactatttcggcgacatccacgaccggccgccgcccgaccgcgaggcgatccgggcccgggcgaaccggcaccgcctcgcatcggcggcgaagcctcgcgcgagcaagccccggatacccgcgcggcgcgcgccgctctga

SEQ ID NO: 9552 - DNA, 1233 bp, Methylobacterium sp.
atgtccgagccgaccccgcaagctcttcttcgagaactgagacagcagttggccagcgctattgcggacgctgaagcctacgatgtgccgagcctttgtgttcgcctcggtctggccgaaggctccgatgaggaagcgttcagcagcaagttccgctacgccgcaacccggctggccgccatagacagtggtgcagtcctcgaggccgcacgacgccttctcgccgaatatgagcacttcgggcttgccgaggcggcggcgcacattgaaaaggcgaatgctcgaagggtgagcgagctaacccgtcgccgcctcataaccgtttttgacggcgcagctctttgcactgagatcgaggagatcgacctcctgcgccgcgtttggccgatctcgaccatgctgtcgccttacagcttgcccggcttcgagccggcgacgctcgaagagcacatcatccagcacacaatccgcaactacgactggtcgaacaaggacctgctcgaagccgtaggcttgctcacctgctctcagcggcagctcttccgtttcctcgctgccgtcaccgatccggtggcccagcgtcgcgagaggcagactgagctagttgaaggcatcaacgcccatctgcggcacgacggctacacgctcgccgtgagcgggcgaatttcgggcagccccatctacgaggtgcgccctgcctctatcggtacgccagctgacgccccgatctcagcagccctcaagtcgttcaaccctgaccacatccatgatcggtggacttcggccctcgaacgccgcgcgaccgacccggcaggcgcgatcacactcgcgcgtacccttctcgaggacgtctgcaaatgggtgctgaacgacgcagaggttgagttcaagcacggcgacgatctgcctgtgctgtaccgtcgcctcgcgaaggtgctgaagctcgcgcctgacgaccacaccgagcaggtcttcaagcagatactcgggagctgccaatctgttgtcgagtcgctcggctcgttgcggaacaagctcagcgatgctcacagtcccggtccgaagcgcgcccgcccacaagcgcgtcatgcggagttggcggtgaacctcgctggagctatggcgacgttcctcgttgcaacacggcaggcgcgcccgccggcaggagaacgggccggaaccagtccggcagatcctgatgcctcaaagcccacggtgcaagcttcgacgtga

SEQ ID NO: 9553 - DNA, 561 bp, Methylobacterium sp.
atgctgatcggcgccggctcccttctgtgccgcgggccggccacgccgccccccgcgccgcgcgtcgacgcgcaggccttcgcgccggcggcggccgctggcgttcccaccactcccgggcgcccgcccgccgccctgatcttcgccgagcattttccggtgacctccggcgcggcctgggagccgccggtcgcggcgcgcccggtgcccgcaccgcgcgtcgccgcagcacccgtgcgccgcccagtggcggcgcaggctccggcccgccggccggagctcgtcgtcgcccgcgcggcggagcgcgcccgcgaacccctgccggaacccctgcccgaacccctggccgaacccgcgcctgcgcccgtggcgatctcccagccctggctcgtcccgccggccgcgatcccggacgtcgagggggaggaggacgggctgcccggcctcgccctgcccttcgcaccggcggcccaagcggtcggcgaggcggtgggctacgtgcgcggccgcgccgccgcgctgggcggctcggtctcgatcctcgtcgaccggatgcgctga

SEQ ID NO: 9554 - DNA, 252 bp, Methylobacterium sp.
atgtcgctcgcagcgagcccggacgcgggcgtgagcttcgacccgttcggggagaagctggagacgccgcatgccgtcggtttacccgcggcttcgcgcgacggtgccggccatcgggcggtcgcggccgccttctgggcgctggcgctgcttctcgtcggctgccgcgtctatctctcggattatccggtggcccaggccgtcgcctcggcgggcgaggccgtccgcacgcatctggccgccgtcttctga

SEQ ID NO: 9555 - DNA, 93 bp, Methylobacterium sp.
ttgtccctcgtcatcatgctcgccggcgcagtgggcgccatcgttctcactctggcggcgctgccggccgccgaccgcttcctgcgatggtga

SEQ ID NO: 9556 - DNA, 1014 bp, Methylobacterium sp.
atgaacctcaagcccggcaagatcgctgccctggcggcggccgcaatcctcaccgttcatgcgccggcgtcagccgactggaagccggaacgcccggtcgagttcgtcgcggccgcgggccccggcggcggaacggacctcttcgcccgtgtcgtccaatcggccctgtccaaagacaaactcctcgacgtgcccgtcatcgtcaccaacaaggctggcggaagcggcgccgagaccttcatccatgccaagacctcgggcggcgatgcctacaagctcttcttcggcacgcaggatgcctacgccctgccgctcgccaacaagctgtcctacagcctgaaggacctggagccggtcgcggcgatgaccttcgatccgttcatcctgtgggtgaacccgaaggcatccggcatccaggacgtgaagggcttcatcgagaaggcgaaggcggcgcccgggaccatcaaggtcggcggcgccaaggcgaaggaagccgacgagaccttgatgacgctcatcgagaaggcggccggcatcgacctctcctacatcccctacaagagcggcagcgaggccgcggtgcaggtcgcaggcggccacatccaggccaacgtcaacaatccgagcgagagcgtggagcagtggcgggccggcgtgcagaagccgctctgcgtgttcgaggaaacccgcctcaccgacacgacggtcatcgccgatggcatgtcctggagttcgatcccgacctgcatcgaggcgggcctcgacatcaagtccttcgcccagccgcggaccatctgggcggccaagggcatcccgccggaggcgctggcctactacacgggcctcttcaagaaggtcgcgcagaccgaggagttcaagggctacatggcgcggggcgcgcagatcccgcgcaccctcaccggcgatgaactgaaggccttcatcgagcagcaccgggccacctatgccggctactacaagaccaatggctggctgaagggcgccgtggactag

SEQ ID NO: 9557 - DNA, 483 bp, Methylobacterium sp.
atggaaatctcacgcaggaccagcgagatcgcgacgtccgcagccacagcgctcatcggcctgatcgtctgctacggcgccctggagaacggcatcggctgggaggagtccggcccgagttcgggcttcttccccttctgcgtcggctgcctgatcgtcttcggcagcgccgtcaccggcgcgcaggccacgttccgcccggccgaggggcggccgcccttcctggaccgcgagcgcgcccgcgccgcgatcctgttcttcctgccgatcgtggccttcgcggcgctctcggtctggctcggcctctacgtcgcgatggcgatctacatcgtctacgcgatgtacgtgcctggacggttgcggctcgcgacgtcgatcgcggcgggcctggccgtcgccgccgtcaacttcgtcatcttcgagaagctgttcatggtgcccctgctcaaggggcccctgctgaacgccgtcggcatctactga

SEQ ID NO: 9558 - DNA, 1539 bp, Methylobacterium sp.
atgagcaacatcagcctgctcctcgacggcttcggcgtcgccctcagcacccatcacgtgctgatcatggtcggcggtgtgctgctcggtctcgttgtcggcgtcctgcccggcctcggcgcgccgaacggcgtctcgctcctgctgccgctgaccttctccatggatccggtctccgcgatcatcctgctcaccagcatgtactggggggcgctgttcggcggctcgaccacctcgatcctgttcaacatcccgggcgagccctcctccgtcgcgacgacgttcgacggctatccgatggcgcggcagggcgaggcggtgcgcgcgctgacgctcgccttctcgtcggccgggatcggcgcgctcaccggggtcatcgtcatcaccctcctatcgggctgggtcgcgaacttcgccctgcgcttcggcgcggccgagtacttcgccgtgtatttcatggccttcgcgagcttcatcggcatgtcgagcggctcgcccttcaagacgctggtctcgatgatgctgggctttgcctgcgcgaccatcggcgcggacaccatctcgggcgagagccggctcaccttcgacttcgagcagctgatcggcggcgtcagcttcctcgtcgcggtcatcggcctgttcggcctcggcgagctgatcatgacaatggaggagaacctcgagttccacggcgtgaaggccagactcagcctgcgcgagatcggccgcgccgtgctcgaactgccccgctactgggccacgatcgtgcgcagcgcgctcatcggctgctggatgggcatcaccccgggcggtccgaccgcggcctccttcatgagctacgcgatcggcgcccgcttcgcgaaagacaagacgcgcttcggcaagggcgcgccggagggcatcgtggcaccggaaaccgccgaccattcggccggctcctgcgcgctcctgccgatgctggcactcggaatcccgggctcggcgaccgccgcggtcatgatgggcggcctgatgatctggggcctcgctccgggacccatgctgttcaccacgcggcccgacttcgtctggggtctcatcgccagcatgtatctcggcaacatcatcgcggtgatcctggtgctcgcgacggtgccgatgttcgcctacatcctgcgtgccccgttccgcatcgtcggcccgatgatcacggtggtgtgcatcatcggcgcctatacggtggccagccacaccttcgacatctggctcgcgctgatcttcggcgtcgccggctacgtgttcaagaagctcgactacccgctcgcgcccttcgtgctggccatggtgctcggcgacaaggccgaggacgccttccgccaggcgatgctcacttcgggcggctcggcctcgatcttctggtccaacggcctcgtcggcaccatgatggcgctgggcgttctgctgctctgcctgccgctgatctcgaaactgctgcgcgaaacgggtatcggtttccgcaggaaggcgctgccgcagcaacgggagatcggctcgacatga

SEQ ID NO: 9559 - DNA, 108 bp, Methylobacterium sp.
atgcaggacatgaccctgaagctcttctcctacggcatgatcggcgcgttcgtatgcggcctcgccctcaccacctggagcgcggcgggcctgctgatcggcctctga

SEQ ID NO: 9560 - DNA, 918 bp, Methylobacterium sp.
gtgacactgatcaatctcagcctacccggcaaccttctcggcggcaccaacgtcggcggactggtctctatcggcggcaacaatacgagcagcgataccatcgccgatatcggcatcgcggcgaacctgcccggtgcgaacatcgtgaacggcgtcacgagcctgctgacgccggaaggcaacctgctctcggtcgcggccgacgccaacgtgcaggtcgggaccggcgcgggcgacctcgtcaacggcctcatcggcaacgacctgctcatcggctcgggcggcgacgaccggatcaacggcggtgcgggcaacgacgtcctcgacgggggcgagggcggcgacctgatctacggcaaccagggcaacgacacgctctacggccgcttcggcgaagactacctcaacggcggccagggcgacgacctgatctacggcaaccagggcaacgacacgatcgccggctccctcgggcgcgacacggtctatgccggccagggcaacgaccgggtggactactcggccttcagcgacgcgcagctcatctacggcaacctgcaggacgacgtgctgatcggcggctcgggcgccgaccggatgttcggcggccagggcaacgaccagctggtgggcggggccggcagcgacaccctctacggcaatctcggcgacgacatcctgaccggcgggtccggagcggaccggttcgtgttcgccggtccgatcgccggccagaacagcggcgcggaccggatcaccgacttcaatgccggcgagggtgaccggatcgcgctgaacggtcagacggccaccgccttcgacagcggcggcaacacgatcctgctcctgtccggtggcgggacgatccagctcgacggcgtcgcggcgggttccgtccagagcggctggttcgcctga

SEQ ID NO: 9561 - DNA, 2259 bp, Methylobacterium sp.
atgccgccggatgatcgtcgcgagcgcccgctcctcaacccggtcctgacgctgcgcaaggaaccggtgccggaggccgccaaaggcggcggtcccagcgagaaggacatcgtgcaggaccgcctgtccacacagaggcgggcgctctcggcgcggctggaggcgatcgcggccagcggcgccaccgccccgcacgccgggcgcatccacctcgctgtcgagatgttcgaggactcgttcgcgccgagctggacgccccgccccctattcacggacggccgccgcgcgcgcctcgttgcacccgcccgcaacggctacctcgtcgaggccgaggttgcctacctgccgagcctcgcccggcacatccgcaccgcctcagcggtcgacgcgcgggtcgccatctcccgggtgcgcgacatccgggcctacggtgccgacgaattgctccgggggcgggagatcgaggcgctctgggaccgggctactgaggtcgagggtggcaaagccttcgtcctgtggctgcttcccttccgcgacgagggcgcccgtgcgtcggtggtccagaccctcatgcggttcgagaccgagcgggccgtggtgccgagctactcggcagtcgagttccccctcgcgcgcagggacggggcggacgcgctcgtgactatccgaggcgatgaaaccaacctcgcccggactgtccgccggtatcgcggggcgggccacgcgcgcggcgtcgtcacggtgccgagccgcgacgcgcttcggaccatcgtcctgtcgggctcgtccttccgcatcgacccggtgccgcgcatcgaggcaacagcgcccggcatcggcgccgagccgacgccgcccgtgccaaacgccagcgctcagccgatcgtagcggtggtcgacggagggctcaccgcgcagagctacgccggccttgaagcctggcgggcacacgatctcgtgccgccaggcatggccgatcacgtgcacggcaaccgcgtgacctccctcgcggtacatgcccatgcctggaacaaccgcctcggcctgccgcgcctcgactgccgtgtgggcacggcgcgcgccgtgccgcgcgagggctcgaactatccggccgaccccgcccgtctcgtcgactacctgcgcgccctcgcccgtgcgcaccctgagacgaaggtctggaacatgtcgttcaacgcgatcgagccagaggccgaagccgacctcgtgagctttctcggcgacgagatccgctcgatcgcgcgtgagcacggcatcctgccggttatctccatcggcaaccggcgtcgcggcggcaccgaccagctctgcgcccccgccgattgcgaggcggccctgacggtcggcgggcgagaccacgcgggagacggcatcccgggcggcccctgcagcgtctcgctgcgcggccccgggccagacggcatgctcaagccggacctgtcgtggttctcgcgcctccgcatgatcggcggcagccagcagacgggcagcagcttcgccacacccctggtgtcctcactggcggcgcacaccttcgccaacctgcgcgacccgacccccgatctcgtgcgggcgctgctcatcaacgcgaccgagttggaggggcacgacgcggccctgggctggggtacgccctggcatgaccacttcccctggacctgcgcgcccggctccgtgaccctcgcgtggcgcgccacgatgcggccgggcttcaactattactggcgcgacatcccgatcccgccggagatggtgaaggcgggtaagctcgccgggaaggggcagctcacggcgatcctcaatccgctcgtcgcggaggatgggggccccaactacttcgccacgcgcctgcaggttgccctgcagtacggcactcgcgctgggggcacaggcaacctgctcggctcgatgcgggaggaccgggcgcccgagcgggaggccagggccgacttggccaaatggcaccctgtccgccgtcacatccgggatttcgggaagcgtgggggcatcgcgtttagcggcaacaccatgcggctgcacgcccgcatctacgcccgcgacctgttccagttcgaggacgtcaccagccaccacgaccttggcgagcaggacgtggccttcgtcctaaccctcagtgacgggtcggacaggagcgacctctacaactccatgacgcagcagctcggcaccttcgtcgagagcgcagtggtcgagcagacggtcgagatcgagcaggagtga

SEQ ID NO: 9562 - DNA, 135 bp, Methylobacterium sp.
atggaagcgtgcattgcggcggccgagcgcgcccacgaggcgctcgcccggctggaagaggcgaacatcgacgcgccagtgagggggtgggcgctctggggctccaccgacatctggggcctgcccctgcgatag

SEQ ID NO: 9563 - DNA, 312 bp, Methylobacterium sp.
atggccgcttccgccgctattcccgccgtcccgctactcggcatcgacgccgacgacccggtcgtggccagcgtcttcgagattgccaggaaatacctcaagacgaccgacgggaactggaacaccgagacccggctggaggaggcgcagatcgactcgctcgacttcgtggagctggtcttcgagatcgaggaccggttcggcatcgaactgaacttcaacgcgaacgagcaggcggtgagcgagatgacgttcggcgacgtcgtcgagctgatccggaccgcgctcgcgcgcaaggcccgtaccgcgtga

SEQ ID NO: 9564 - DNA, 1191 bp, Methylobacterium sp.
gtgagtgccgtcgtcgtctccggtctcggcgtcgcggcgccctgcggccttaccaccgcggatttctgggcgagcctcgtcgccggccgctccgccttcacgccggcgcaagcgctgcccggttcgggcatcatcgccgcagagatcgtggagagcgcggatttctccggcctgccgatcccggtgccgggggcatgcgaccgcaacgccgtgctggccgtggcggccgcgcgcgaggccatggcggatgcaggcctgacgcccggctcggttgcgccacagcgcgtggcggtcgtgatcggaaacggcggcggcggcctcaccagcctcgacacgcagtacgagcgcctgttcgtggagaacaagcggccgcacccgttctccgtggttcgggcgatgggaagctcctcggcgagctgggtctcgatcgcgttcggggcgcaggggccttgcttcgtcgtggcgagcgcctgcgcctcgggcacgcaggcgatcggcgtggcggcccagctcgtgcgcgcgggtatcgtggatgtggcgatcgccggcggtaccgaggcgccgctctcccgcgggacgctgcaggcctggaacgccatgaagatcatgagccgcacgggctgccgcccgttctcgcgcgaccgcgacgggctggtcgtcgccgagggggccggtatcgtgatcctggagcgcgaggcgcatgcgcgggcgcgcgggcgcaagccggaggtcgcggtggcaagcctcggttcgggcgcggatgcgggcgacatcgtcgccccctcggcagatggcatggcccgggccatgcgcgcggccctggcagaggccgatctgtcgccggccgacatcgcctacgtcaacgcgcacgggaccgggacccgggccaacgacctgaccgaggtgcaggccctgcgcgcggtgttcggcggggcgttgccgccggtctcttcgacgaaggcggtgaccgggcatgcgctcggcggggccggcggcctggaggccgtcgcgaccgtgctggcgatgacgcacgcgctggcccccccgaccgcccatctcaccgatccggacccggacctcgacatcgacgcgatcccgctggaagcgcgcgcgatgccgatcctggcggcgatgtcgaattccttcgcgttcggcgggctcaacgcgagcttggtgctgcggcgggtgtga

SEQ ID NO: 9565 - DNA, 201 bp, Methylobacterium sp.
atgagcgaccgcgccacccaactggctcgctgcctgatggaggagggcatccgcttccccgtgggtcaggacggcaagatcgcgccgggctccatccggacgttcctggccgatcgcttccccggcatcagccaagccgaggtgacccgcggcgttctcatcgcgatcgaactcgccaagttggatcgggggttgcgatga

SEQ ID NO: 9566 - DNA, 1125 bp, Methylobacterium sp.
atggcctacgatgtcttctggttcctgccgacctccggcgacacgcgctatctcggcacctccgatttcggccgcgcgcccacgaacgcctatatccggcagatcgcagagaccgcggaccggctcggctacgacggcctgctgatcccgaccggcgcctcctgcaccgacccgtgggtgacggccgcgagcctcgccaccgtgacgcgacgcatcaagctcttggtagcgctgcgcacctcgatcaccggcccgacgctcggcgcgcggcaggccgcggcgctggacgaggcgctgggcggccggctcctcctcaacgtggtggtggggggcgacgccaccgagctcgccgccgacggcgccttctacgaccatgccgaacgctacgcagcggccgacgagtacctcaccgtctggaagcggctgatggcgggcgagacggtcgatttcgagggccgccacgtccgggtccagggcgccaggaacttccaccccgcggtgcagacgccctggccgccgctctatttcggcggctcctcgccggctgcgcacgagcttgccgccaagcatgtcgacgcctacctgacctggggcgagccgccggaggcggtggcagagaagatcgccgacgtccgcgagcgcgcggcgcgccggggccgcagcgtccgcttcggcgtgcgcctgcacgtcatcgtgcgcgagacggaagaggaggcctgggccgaggccgaccgcctgatcagccgcctcaccgacgacgacatcgctcgcgcccaggccaactacgcccggatggactcggttgggcaggcccgcatggcggcgctccacgggggccggcgcgaccggctcgtggtggcgccgaacctctgggccggcgtcgggctggtgcgcgggggcgcgggcacggcgctcgtcggctcgcccgaacaggtcgtacagcgactcaacgactacgccgcgctcggcgtcgacaccttcgtgctctcgggctacccgcacttggaggaggcgatccgcttcgccgaactcgccttcccgctgatcgccggaaaagaaccggtgacgctgcgggactccgcccagaccggcggcgctttcgacatccgcgccgccgcgcggtga

SEQ ID NO: 9567 - DNA, 1647 bp, Methylobacterium sp.
atgtccgtcatacggctgccgttcatgtgggaacgggcgcagctgacggagaacggccccctgaacgccggcgagatcgcgcagatggacgcggtcgtcggctacgcggcgagccggggcatgcaggtgatcctggaaccgcacaatttcgggtccggtttcgggcatctgatcgggagcgccgagacgcccaacagtgccttcgcggatttctgggctcggctggcgggccacttcgccggccgcggcaacgtcatcttcgggctgatgaacgagccgcacgctcagaccgcgcagcaatggctgggttccgccaacgcggcgatcgcggccatccgcgcgaccggcgcgcgccaggagatcctggtacccggcagctactggtcgggcgcccacagctgggtcagcagcgacaacgacacggtgaccgggcccggcatcgtcgatcccctgaacaatttcgccttcgaggtgcatcagtacctcgacagcgacagttcgggcacgcaccccaacgtggtctccgcggccatcggcgtggagcggctgagcgccgtcacccaatgggccgaggccacgcacagccgcctgttcctcggcgagttcggtgtcgcgcaggatgcgaccagcctcgcggcgctcgccaacatgatggcctacatgcgcgcccacccggtctgggagggcgcgacctactgggccgccggaccctggtggggcgactacatgtacacgatcgagcccaccggtctcggcagcgggcaggtcgtcgatcggccgcagatggacgttctggaactcttcctggggagcgctgcgccacagggcggtacggcgaccggcgcgatcctgagcgggacatccggcgcggacctcatcaccctgccgcccgggtccgtcacctaccggggcggcctcggcaacgacacggtctacggcagcgtcgatgccgacctgatctacggcaaccagggcgacgatcgcgtcgtggccggcagctcgccgggtaccctggggcgcgacaccgtcttcggcggccaggggcaggacctcatcgattacagcaacaacggcctcggctcgttcatctacggcaacatgggggacgacacgctcaccggcggatccggcgacgacgtgctgtacggagggcagggccaggatctcatcgcggtcggcgaggggagaaacctcgcctacggcaacctgggcgacgacacgctcatcggcggttcgggaagcgacacgctgttcggcggccagggcagcgatgtgatcaccgcacacagcgccccgggcgcgggatcgctgatctacgggaatttcggcagcgacctgctgacggcgggttcggggaacgacacgctctacggcggtcagggcgcggacaccctcgtggcgggcgcgggcagcgacgtgctggtgggtgggctgggggccgatctctacgtgctcggcaccggaacggggcgtgtccggatcgtcggattcgaccagagcgccggggatcggatgcggatcggcggccagaccttctcggtcggcaccgcccagagcggagatgccctgttgaccctctcgggcggcggcacggtcgatctggccaacatccgggcagagcaggtgagcgcgagcttcttcgcctga

SEQ ID NO: 9568 - DNA, 2316 bp, Methylobacterium sp.
atggcagttcccgagaccgccgaagccggctcgcgcttcgagcccttcgccgtcctgtcgttccaggcccggatcgccgaggtctgccagcgtcgtctcggcgcggcgctcgacggttacgtcgccgccacggacgccgccaaccgcgcctggatcgatgccgcccggccgctcacgccgctgggggcctggggtgaggcggtcagctactggaccgatttcacccagcgctcgctcctgttctgggacacgctccggcatcgcggcaacgactggctggcccacgaggccgcgggcaagccgcccctgatcgccttcgattacgagatcgtggccgatgcgcgccgctacgagcgcccggcgaactacgcgctcgcgcgcatcgccgcgcccccggaccgcccgaccgatcccgacaagcgcccctacgtgatcatcgacccgcgggcgggtcacgggcccggcatcggcggcttcaaggaggattctgaggtcggcgtcgcgctgcgcgccggccatcccgtctacatggtcatcttcttccccgagccggtcccaggccagaccctcgccgacgtggcctgggccgaggccgagttcctgcgcgtcgtgcgcgatcgccacccgacacgcgggaagcccgtcgtcgtcggaaattgccaaggcggctgggccgccatcctgatgggcgcgctagagccgaaaggcgccggccccatcgtgatgaacggcgcgccgatgtcctactgggccggaaacgacgccgagaacccgatgcgttacgcgggcggcctgctcggcggcagctggacggcgcttctggcaagcgatctcggcggcggcaggttcgacggggcctacctcgtcgagaacttcgaatcgctcaacccggccaacacgtatttcggcaagtcctacaatcttttcgcaaaaatcgacaccgaggcgccgcgctacctcgccttcgagcgctggtggggcggctacttcttgatgaaccgcgaggagatcggctggatcgtcgacaacctcttcgtgggtaaccggctggcctccgggcgagcggaatgggcgcccggcagggccttcgacctgagggcgatccgctcgccgatcattctgttcgcctcgctgggcgacaacatcaccccgccacagcaggccttcaactgggtcgccgatctctacccgacgaccgaggatctcaaggcgaacggtcaggtgatcgtcggcctgatgcacgagagtgtcgggcatctcgggatcttcgtctccgggagcatcgcgcgacgggagcacagccagatcgtggatctgctcgactacatcgagcaccttccgcccggcctctacggcatgaaggtcgaggagcagcaggtggacggcgcggtgcgctacgacgccgtcctgcacgaggtccgggtcgaggatctgcaggagctgcagaaatacgcccgcaaggacgaggtgccgttcgtggccgtggagcaggtctcccggctgaacgccgcggcctacgagagctgcgtgcgtccagtggttgaggccctagtccgcccggagacggcgcccgtgctgcgcgcgctgcacccactcagggcgcggcgctgggctctgtccgacctcaacccgttcctcgcgccgctcggcgcctgggcagatcttgtcaggacccaccgcgtgcggcgcgacgaggccggccccctggccacggccgagcgtcggggcgcggccggcatcatggccggctgggacctctaccgcgacctgcgcgatgcggcggccgagactctgttctacgccgtctacggcaccgtgagcctgacggcacgcacggaagtgccaaaagcggcttcccctgaccgagacaccgcaacgaaccgcgttgccctggaccagatcgacgagggcggcttcacggacgccgcagtccgggccggccttctggtgtcgcggctcggtcgcaatcagcgtcgcgtctcgaccttcaagcggatccgcgccctcgtgggctacgatgtcggcctgcttgccatgccgacggaggcggcggcgcgggtcgtgcggcggcaggctgccatcgtagagcacgcaccggatcaggctcttgccacgctgccgagccttgtatcgagggcggaggagcgacgtcggctcctcgacgtcctgaagcgtttggcgagccatctcgaccttcagccggaacagcgggccctgattccgcgcatcgaggagcttctcggagccgcaaccgaggccgaggcggcaccagaccgcgagtccgtgtcccagccgatccggcgccaagcgagctga

SEQ ID NO: 9569 - DNA, 1596 bp, Methylobacterium sp.
gtgattcagtccgaggcggaggagcgcgcgcggatcgcggcggatctcgaagaggcgcagcgcaaggcgcaaagggctctggcgcagctggaagcgcggacgcgcgaggctgagatgagcaaggcccgcctggagttcatgctcgacgagaagggccactacgtcggtgagcgtcttccccagatgctgaagcgctatccgatgccggctgaggagattgcggtcgtcccggtcaagcggggtcgcggacgtccgcgtaaggacggttcgccggcgcagccgcgttcggaggcggagcgcaccgcgtctcgcgcacgtcgctcttcgggcaaccgggcttgggataagcgcggacgtagcgctgcgttccgcctgcgtgtgccggcggctatctccgaccttaacgacacaggcaatatggtcacggcggatgcgtcgacacaggcggccatcgccctcgtgccggaccgcgagagccccgggccggagccggaggcccgtggcccggaggtcctccagccgcagagtgtcgagccggtggtgcagccgccgctcgcggccgcgctcatcctgccggcgctgacgcgcgaggtcggcgatctgctgggcgatgtcgataatccggacgaggatgagcgcggccagatcgaggccggcacgatcagcgataaggtgctcgacatcttctccgcggaggccttggccgagcgggcgaagctgcgtgatccccggcgtctgccggcgggctacgatccgtcctgggcggatgcctgggtgcgggatccgctcgcgccgctgccggagatggtgcgggagttcatcacgttcgggactgctgtcgacaagcgcccggaggatttgacggacgaggaggcgcgtctgctggcggggccggcgatgtttccgattccggaggacttcgatccggcggactaccggggccggcctctgccgcccttctttacacgggagaaggacgtgtcggcctatgagtggaaggccgagatcacccgggcgggcggcacgatgcagaagctcgtggcgaggaacgccctctacatcgatgagatccgggagatcgagcgggcgcgtcggcggatgtggccgtacgcggtcgcgcgtcgggacctgatcaagggcctgatggaaggcctcgcggtcggtgaactcagcttcgagccggtctcgatggcgccggccgatctggcgcgcagcgtgcgctggctggtcttccgctgggccgatcacgactggctgcagttgatcgcgaacgccgatctcgacctctactatacccggatcctcgacaaggtgccctggccggaaggcctgtcgcggcgcgccctgctggagcggttcggcaagggcgtcgatctgacgagcccgctgaacatgtcgtcccaggaccgtccgccgctgttcctcttcgaggaggttgagtgggtctacggcacgggcttcggcatcagagcggcggatggcggccggatcgatctcccccgcgtgggcatcgcgcccggtcccgacttcggggcgatcgactgcacggttccgatcgagcgcgatcccgatgtggatccgcaggcatggaggtga

SEQ ID NO: 9570 - DNA, 102 bp, Methylobacterium sp.
gtgatcctgctcgacctgccagaccggcccgcggtgatggtcccggagatcgaggcgattgagcagcatctcgcccgtctcatcgacgacctgctcggctga

SEQ ID NO: 9571 - DNA, 711 bp, Methylobacterium sp.
atgcttgaaaccaggaacctccgggccggctacggccacatcacggtgctgtgggacctctcgctcaccttccgagagggcgcgctcaccgcgatcgtcggcccgaacggggccggcaagaccacgctcctgcgcgcgctcaccgggctgatcccgcacgacggcgagattcggctcgggggtgagcgcctcgccggcaagacctgggatctggcgggccagggcatcgtgatggtgccggagggccgcctcgtcttccgcgacatgagcgtggaggagaacctctgcctcggcgcctacccgaagcgctgccgcggcgacgtgtcctccgggctcgaccgggtctacggcctgttcccgcgcctgcgcgagcgccgcgggcagatggccggctcgctctcgggcggcgaggcgcagatgctcgccatgggccgggggctgatgtcgcagcccaagatcctgctgatcgacgaaccctcgctcggcctcgccccggtgatcgtcaacgaggtgttcgacatcgtggcccgcctgaaggaggccgggaccacgatcctgctggtcgagcagaatacccgcgtggcgctctcggtggccgacgacgtgcatctcctgcgcggcgggcaggtgcggctcagcgtgccggcggcgcaagtcgatctcgaccgcctgcacgacctctacttcgcgcgggaggcgcagagcgcgtga

SEQ ID NO: 9572 - DNA, 873 bp, Methylobacterium sp.
atgatcgccctcatcctccaggccctgttctcgggtctcctcgtcggcagcgtctacgccctcgtggcgctcggcatcgccatcaccttcggggcgatgcggatcatcaacctcgcccacggcgagctcgtcctgctcgcggcctactccgcctacgtgatcgaggcccgcgccggcctcgatccctacctcgcggttcccctggcgctcgtcgtggtggcgatcgtctgcaccgcgctcttcctgatgatcgaccgcatccgcgagcaccgggagctgaactcgctgatcctgacctacgggatcggcatcgtgatcaccaatgcgatcctgctggtcttcgccagcgacgtgcgcacgacgaactcgccgcgccttcaggacgcgacctcgatcgggtccgtctacgcgatgaacggagagatcgtggccttctgcctgagcctcgcgctgatggtcgccctgtggtggtggctgaagaagagctggtacgggcgggcggtgcgcgccgtctcgtcgaaccgggcggcggccaccctgatgggcatcagcccggtccgcaccgagctggtctcgttcctggtcgcgggcgcgctcgcgagcttcgcgggcgtggcgctctacacgatgagcgtggtgcagccggcgctcggccacgcgctgacgatcaaggccttcatcgtcacggtcctggcaggcgtcggctcaatccccggcgtattcctggccgcgatcctgctcgggatcaccgaggcgctcaccgtcaccctcgcgagttccgccctgcaggaactcgccggcatggtgctgttcctcctcgtgctcttcctgctgccgaacggcctgttcggcgcgcgcgcccgccgcggctga

SEQ ID NO: 9573 - DNA, 264 bp, Methylobacterium sp.
atgttccaccacgttgcggtcgcgctgctcggcggctttctcaccatcgctctcggctggcggtcgctcggcctcggcgccctggtgctggcgccgctcgtcgccagcctcggcacgctcgccgtcgccgtcctgctcgatcggcgcgcccgccgggccgcgcccgccggctcttggatccgggacatcgaggccggcgcgccaagggccgtggccaacgaccggagcacggacccggcggccctgtgccgccgccgcgcctga

SEQ ID NO: 9574 - DNA, 309 bp, Methylobacterium sp.
atgggggttgcatcggatatggcaagagccacgcaggaggggggaagcgcgccggacaccgcgaccttgctccaggatgcggatcgctacgacccgctccggatcgctctgcggaacgcgcgcgacgcgttcgatccggatcgcgcgatgcgggagaggcgagcgcccgcagcgccgctgatctggtacatcgaggacacccccgacatggcactcccgcgaacgagggccggttcggacgcgcggccgcgtcagccggacatcggtgccgtgcgcggggacttcgacaccgctgccggcatcgtgtag

SEQ ID NO: 9575 - DNA, 255 bp, Methylobacterium sp.
atgacgcaagacccgaacagcggcgcacccgccgcgccggaggatgtcccgccgccacgccgcggcccgggccgcgcccagcgccgctaccggctcgatccggccgcccgcgcccggatcggccgcggcctgcggctgctctacgcggaagcgctgacccagccggttcccgagcggctcgaacggctcgtcgcacaactcggcgcggcccgccccgcttgccccagcgaacagattgaggagccgccgcgatga

SEQ ID NO: 9576 - DNA, 792 bp, Methylobacterium sp.
atgacccagccggcggcggtcgagatcctcacgtcggcagccccggcatatgggatcacgccgcttctctcgaccaatggtcgcctacgcgcagccgtgcccgtcctgatgacggacgggagccttcacggctacgaacttgaggtccaggcgagcggcggccggccttatgttcgggaggcgaccctaggggctcgtctcccggcgttctgcccgatgcggcatatcaatgccgatgggtcgttctgcctgaactgggaaccctacgagagcttggcgctcgaagccaccgcggacggcgcgacatggtggggtgccgtgttgcagttcctgcgcctgcaggagcgtgcgcggcgcctgcgccgatggccggaccgtcgcgaatgggcccatggcggcgctgccgtacaccagcgcaaggcgcttgaagcggccgcggcgatctcgccccggctgcgcgaccggctgttccagggacgcgtagccgcggttcggtcgaaagggtgttcgtcgcgggggagcgcggttcggttgcatgtcgacggccggacgatggcgcgtatcttcgtcaagcaacgtcgcccggcgacgcttcggcaagcctgcccgtgcgggcaggacgaacggcccctgacgctccggcgctgccgcgatcatgctgaccgcctcgtcgagatcgtcggcgcgatgcaggacatggcgacagcggagcgagcgttctggaagtcgttcgaaggtaaagcttgttgcgggaccatgaagggttgcccgttgggcaccgccaagccgtga

SEQ ID NO: 9577 - DNA, 549 bp, Methylobacterium sp.
atgcaggccgacggcgccacggttgtcggcacttggatgtggcgatgcggcgattgccacatcctcgatgtgggcgccgccgaactcctgacgggcgcctcggacctcgccgacacggaactgcctgccgaggcgctcgcccggcgcgtcctgctggcggatcgtccggccgttctctcggcgctggagcggatgggtcgcgagcgcggcgtcgtcgtgttcgagtatcgcgtctggacaccagagggcatccgctggctgctgagtcacggccgggtctatccggcgcagccgggcatgccggcgcacggccacggcgtcctcatcgacatcacccaccggaagccgccacctccggagccggccgggccggaagagacaacgccgtccgctctcgagcgtgcggcgcgccacgcgctcggcgcgcgcgccgcggtcgacgaggacggaagcgcctcgctccggctcctggtcgacatgttcctgctggaggtcggacgcgtgatcgcgcgccgagccggggtggcgggcgcacgcggcctgcactga

SEQ ID NO: 9578 - DNA, 315 bp, Methylobacterium sp.
gtgttcgaaaccgatgatccgcgaccgtcagaaacgaccgggacctcgaagttcggtaccgagcacgcgtccggccggccgctgcccgcggctgcgcaacgcaccctggacgacgtcgccgaggccctcggcctcgcgaccgatcttctcggccgcatcgattccgccgcgccgaaccgggacatcgctgccgccagcctcgcggaggcatcggccctcctgcaggccttcatccgcatcgaggacgcggcaacgcgccagcgctgcctcgccttcgtgcaggccgccgccgccgaggtacagggccgcagctag

SEQ ID NO: 9579 - DNA, 249 bp, Methylobacterium sp.
atgtcatcgcatcatcgcgccgtcgcactcgcgctcgccggcctcctcgctctccccgcactcgccgccgcccgcgaggcgcaccacggcaaaaccgcggcgcatcaggcagcaaagccgcagagccgggcggccatcgccgcttcggaaggcttcacggcccggatgagccgcctcgacgccctgatgggcggacagcaacagcaactcgcgccgcgcgcccgctcggcgagcgccctcccgaactga

SEQ ID NO: 9580 - DNA, 354 bp, Methylobacterium sp.
atgaccgaagaccttgcgccctcccggcgtcccaccgcgcgcggcctgtcgttccgccgccgcagccggatcgtgcccggcccgctccggccggcgcagacgcgcacgggcggtggcgtggcggccggcatgctcaccggcgccctgctcggtctcgccttcctggcagccttcacgctgccgttcgtgcgcgtcggcggttccgcgggcgaggcggagcacaaggccgcccgcgcggccgtccggacctccgcggcccaggcggaccggggtggggcggggggcatggccgcgccggagcgcgccgccgatcgcggggtgccggacggtccggcgggcgggagaccgaattag

SEQ ID NO: 9581 - DNA, 837 bp, Methylobacterium sp.
gtgccctctctctcgacccggctgatcccgcccgcgatgctggacgtgatcaagcgctcacccaccctctacggcgtcgggcgcaaggcccgcttcgcgctgggctcgcgcctcggcgcccgcccggtcgccgggatcgggcgggcccactacaacgacttcatgctgacctcgaccgcgcccgacaaggtcgcgagctacatggccggcgccgcgcagttcgtcgacatcctcgaggccgccgtcaccgaggccgggcgcgactgggagtcgatcacccgcgcgctggagatcggctgcggctacggccgcatcgtgcgccagctctcccgccgcctgccgggcgagcgcatcgccgtctgcgacatgatcgaggagggcgcccgcttcacggccgccgagttcggcgccgcgcaggtgccggtgatggagcgcgccgagccgaagccggcctccgcctacgacctcgtctacctgctctcggtctacacccacctgccgcgcgccgtggtgcacgccaacctcgccgacgtggcccgcgccctgaggcccggcgggatcgtggtcttcaccatccacggccagggctcggccgagcaggccgagcgctacgagcagttctggctcgacaagccggcggtgctcgccgccctggcgcgcgagggctactactacgcccgctacccctactacacggccgattacggcctgacctggttcagccgcgcagccgtcgaggcgctcgtcgccgaggcggcgccggacctggagcccctctcctaccgggcgatgcagctcgacgggcaccaggacgtgttcgtctaccggaagcgctga

SEQ ID NO: 9582 - DNA, 1278 bp, Methylobacterium sp.
atgcgcgggctcgcggccggcctcgtcggcctcggcctcgcgaccggttgggccgggccggccgccgcgttccagccgcccgcgaccgtcgaggccgcgcaggccggcttcgacgccgcgcggctcgaggcgatcgccgcgttcgtgcagcgggacgtggcggcggggaagatccccggcatggtgctgctcgtgatgcgggacggccgccccgtgctcgcccgagccttcggcgagcagacgcccggcacgccgatgcgcacggatagcatccaccgcatcgcctcgaccacgaagctcttcgtgacgacggccgccatgcgcctctacgagcagggccgtttcaagctctcggacccggtcgcgacctacctgccggaactcgcggcgctgacggtctatgccggcgccgagagcgccaccgagggagacgccccgccgccggtggcgccccagcgcgcgccgacgatccacgacctgatgcgccacacagcgggcttcacctactggtggatcggcccggccaatgccgtgcgccgcaaccagcgcgcgcagaacctcgaagggctctacgacctcaccggcgaggagatgctggggaagctcgcgcagcagcccctgctctaccagccgggctcgaccttcgagtactccatcgccaccgacgtgctcggccacctgctggagcggctggagggcaagccgctcgaccggatcgtggccgagcaggtgctggagccgctgggcctgtgggacacggtctggcaggtggacgacgcccgcgccgcgcgcctcgccgagccctcgcagcggacgcgggagacggacccgctggcctgggtctacacctggctcgacctgcgcaaggcgccgaagcgcttctcgggcggtgccggtctcgcctcgacggcgggcgatgtcgggcgccttctccagatgctggccaatggcggcgcgatcgacggggtgcggctcctggcgtcgcagaccgtgcgcctgatgctgcacagcgaccacctcgccgggatcaaggggccgcgcaacaacgtcgacccgggctacggctggagcctcgtgaacccggtccgcctcggctcggggccgcacgccacgccgggcgcggccggcgacgtctactggggcggcatcaccggcccgcgctacatgatcgacccggccgagcggctcgtggtggtggcgctgttccaggcgccgagcctgcgcggccactactacgcgatcctgcggcagatggtgtacggcgcgatgacgaagtga

SEQ ID NO: 9583 - DNA, 450 bp, Methylobacterium sp.
atgcctgaagcggacatcacccgcgctcagttcttcgccgacgacctgctccgctgggagacccgcggacccggcgacacggccaacgccatgcggcgtgtcgcgcagcgcgcggccctcccgttctcgaagctctgggcgctccgctaccggccgcccaaggccgtcgcctctcacgtcctcgcggctctccaggccgcccacgctcgcgaagtcgagcggcagctgaggaagctcgcccatgaagtcgagaccaccgcgcgcatcgccccgccttcggaccctgctgtggctgcggctgcggctgctctgcacgcggctcagggcgagggcgagggcgtggcgcgaccggatgtggaagcgcctcgagcggcgcccgcgacccggtcgcgaccgctgaaggatcaccgcgacctgccgctgtggcgggcgctggacgagggagagtga

SEQ ID NO: 9584 - DNA, 186 bp, Methylobacterium sp.
atgagcgccctcgcgacctaccgcatctccggctccggcggcctcctccgcatcgtcacctgccggccggaggagctgatgcgcctgatgcaccgcatcgggatcgcctcctacacggccgaggtcacgacccgccccgcctaccgcgagatgattgacaccctgcgctgggaggagatgctgtga

SEQ ID NO: 9585 - DNA, 300 bp, Methylobacterium sp.
atggcgcgcttcatcgcgatcgagcgagagaccggacgcgtttacggcgatacgggccgctttggctcggtcggcaacgtggtctcgccggcggatgcggtcagtctgttcgatcgtcaggtcgggcgcgccatgcgcggcttcggctacgtcaaggcggacagtgatgccgcccagtacgatgtctatgagatccgcgcgggcgattccggccaagcctctgccaccgatgcggacgcgcgcgcggcggttcgtgagcacggcgcgctggccgcctctctggtaacctacaacacctga

SEQ ID NO: 9586 - DNA, 2241 bp, Methylobacterium sp.
atgtccacgcccgccgcctccccgaaagcccgcctcgccatcatcggctgcggcgccgtggtggaccaccacctcctgcccgccctgaagcggcagggctgggccccgagcgttctcgtcgaccgctcgcccgagcgcctcgcgctgctcgccggccgggccgggcggcggcgcgccgacatcgcgaccgccgccgactggcgcgaggtcgccgaccgcttcgacgccgcgctggtcgccacgccccacaccacccacggcccgatcgggctcgccctgctggaggccggcaagcacgtcttcatggagaagcccctcgccaccacgggcgtggagggcgaggcgatgatcgccgccgcctcgcgcaagggcctcgtgctcgcggtcggcctgctgcggcgcaacctcaccatcgccgcctggaccagggccctggtcgaatccggcacgatcggcacgatccgacgggtcgacgcgcgcgagggcttcgtcttcaactgggcgacgagctcggacgcgctgctgcgccgcgacctctcgggcggcggcgtgctgatggacacgggcgcccacaccctcgacatcctgggccactggttcggcccgatgacgccgacgcgctaccgcgacgacggggccagcggcgtcgaagccgactgcgtcgccgaattcctgctcgacggcggcggcgaggtgcgggtcgagctgagccgcacccgcaacctcgccaacaccgcccggatcgagggcacgcacggccatgtcgaggtcgcgctctaccgcaacgaggtggtggcgggctcccccaacgcgctcgccttcacgcatgcgggggtgagcggcaccgcgatgaagccgcagctcttccccgcgctcttcgacgccgagatgcgcgacttccgcgatgcggtggcaggcgggcgcgcgcccctggtcggcggcgaggagggtctcgcctcggtgcggcggatcgagggctgctacgcgctgcgcgagccgctggagcagccctgggacgccgcccacgcggcgctcgtcgacggcctcgcgcccggtgcccgcgtcgtcgtgacgggtgcgagcggcttcatcggcggccgtctggtcgagcggctggtgcgcgccggcatcgacgtcacctgcatcatccgcgagatcggcagcgcgacgcgtctcgcccgcctgccggtgcggctggtcaaggccgacctcaccgatcccgccgcgatcggcgcggcgctccgcggggccgacacggtgttccactgcgcctacgatccgcgctcgcgccggcagaacctggagggcgcgcgcgtgctcatcggggccgccgccgacgcgaaggtgcgccgcctcgtccatgtcagcaccttctcggtctacgagcccttcccgccgacgccgctgaccgaggagacccgcgacggggaccgcgcctggatctacgtgaaggacaagctcgacatcgagggccagatgctcgccgccgcccgcgagggccgggtcccgacggccgtggtgcagccgaccatcgtgtacggccccttctgcaagccctggacgaacgcgccggccgaggagctgatccacggcgaggtggttctgccggacggcggcgccggccggtgcagcgcggtcttcgtggacgacctcgtggacggcatgctgctggccgccacccgggacgcggcggtgggcgagcgcttcatcctgtcggggcccgacacggtgagctggggcacgttcttcagcgagttcgcccgcgcgctcggcgtgccgggcccgacctcctggccgctggcggaggtctcgaagcagaaccagggcttcgtgcgcgacgtgaagctggtgctgcgcaacccgaagcgcatcgtccagatcatcgtgcgctggcccccggcgcgctcggccctccaggcggggctcgacgcgctgcccaagcccctgcgggcgctcgtcgaccgctactatttcggcagcggcggtccggtcttcggcgcgctcatcgtgccggacccgcagaagaccgccctctacaccacgcgggcgaccgccgagatcggcaaggcgcggcggctgctcggctacgcgccgcgcttcgccttcgccgacgggatgcgcgagacgacgccctacctcgtctgggcctatgccgacctcgtgcgggcggcgcggcgcgcccgcggcacctccgcaccgcccgccgccccggtggggacgccggtcgcggacgcgcgctga

SEQ ID NO: 9587 - DNA, 114 bp, Methylobacterium sp.
ttgcgcgtcgatcggcagggggccgcgcggatcggccggcagatcgtggatctggcggtgctggcggccggcgggatcggtctcgccctgccgctgatcctgccgctgggctga

SEQ ID NO: 9588 - DNA, 267 bp, Methylobacterium sp.
atgacttcagagcttcgcgccaccctgctcgcggccacgctcctcgtcggcctctgcgccgccgccggggcggccgagcggcccgacggcacggccgccccggcccggggcagcggcgcgaccggctccacgacgagcgtcggcgcgggcggcctcaccggttccggcgcgaccgaggacgggacccgccgcaccggcggcaaggcgcccgccccggccaccgagcggggcggctcgaccgccccggccgccggcacgacgcgctga

SEQ ID NO: 9589 - DNA, 741 bp, Methylobacterium sp.
gtgtccgtgatcgattacccgctcaatcgcttcaccgacatggccagcctgtcggacgacgagcagaagcggttgcgcagcctcggcgacgcaccggtcccctacaagcgcgccgcgaccatccgggccgagggcgatcccgccccctgcatctacctgatgctggagggatgggtgctggcatcgatggtcctgccctcgggcggccggcaggtgacgaaggtccacctgccgggcgacatcctcgggacgcccagcatggcgctggccgccgccgcggagacgctcaccgccctgacggattgcgtggtcgccccggttcccctgacgcgcctgcgcgacctgttcgtcacccatccgcggctcgccgcgctgttcctgatggccgttcaggtcgagcggatcgccctgatggatgccatggcggcgatgggcaagaccgatgcgcgcgagcagatcatcggcttcctcctcgatctgcacgacaggctggcgcggctcggcaaagcgtcggacggcaccttcgagctcccgatgacccaggagcagatcggcgagaagctcggcatgacctccgtccatctcaaccgctccctgcgggtgctcgatgccgaggggctcctcacccgcacggggcggctcgtccggctgaacgacatcgagaccctgcgcggcctgtcgcagctgccgcggcggcagctccgaaccgatccggaatggctgcccgtgagccagggatag

SEQ ID NO: 9590 - DNA, 1548 bp, Methylobacterium sp.
atgaccctgctgggcgatgacatcgccgatttgcagcgtctcctgtccgaggcgcaggccaaggcgaacgccgccgacccgcacgcgctggtacgcgccctggagcaggcccagcagcgcctcgatcgcgcgcgcggcgaggctgaactgcgcgtcgtcgatgagcgcctgcagctggccgagaaagccttcctgcgtgcgtaccatgcccaacgcgccgctgagcgtgcggccggcaagcacctgagcaacggcaggaacctgaatggcgagagcatcggcaacctggccatggccatggtcggcagcgatgcagaccgcgaagggctctacaaggacctgatcggccgcaccggggcagacgccctgtccgagaaggagcgtgcgcggctggaaggcgccaagaagctaggcggcgacgacttcaaggaggtgttggccgagctggctgccagccgcggccaggaggccacccagggcaaggacatccgcgacagccgggccctgctcgacaacatcaagaccgacgtcgcgagcaagctgatcccggcggtgcagtccatgcgcgacggcatcatcttcatggccggccagggcaagctgaccgcccgggagatctcccagcgtgtcgccaaggccgagtacgatgagcgggtcggctcggtgcgtgactcctacaaggaccggatcaccgcccaggacaacatcatcgcgtcgatcgtcggcgtcgagggcatggggctgctgtccatgacggacgagcagaaggcccagctcgaagcggcggcgaaggagaaactgcggctggagcgcgagcgcgacaagaagctcaaggagatgtccggcgcctacgaaaccaccaagaagaacatcgacgctgccgcagcagcggccacccaggtcgaggagcagcgtgcgcgccaggttgaggtgtcgcgctcgaggccaggtggcaacctccccggcatcaccccgatcgctgtaggtggtactggcgccagcgacctgtttgcgggcgtgatcgggcaggagtcgggcggacggcactgcaacgccgacggcagccttgtcacttcgccgaagggcgcacgcggcatctcacagctgatgcccggcaccatgcgcgatccggggttcggtgtgcgacctgctcaggatgacagcagggaagaaaacctgcgggtcgggcgtgagtacctggagaagctgcaacaggagttcggcggtgaccgggagaaggcgctggccgcctacaatgccgggcatgcacgggtgaaaaaggcggtcgcgaagcatggcgaggcctggcttcagcatatgcccgctgagacccgccactacgtccccaccatcctgggccgcgtggattcccagcagctgccggccagccatcgcgaattggcggccagcgccggccaggctgtgaccgtcaacgtcgaaccgctgacggtggtgcaccagaacgagcgcggccaggagatccagcagccgcagaagctcaacgtcacggtttcacaggcgaagccgtttaacggccagacgcgatag

SEQ ID NO: 9591 - DNA, 384 bp, Methylobacterium sp.
atgggcgggaagcggctgcaccctgacgccgtgccaacgcccggcccctggctggtgcgcggcaaagccgacgcggatgccacgcccacggcggcgatgctcggcatcgagcccgcagcgaacgatcagccgggcggctggccgtacctgatccggcaggatcggctgatcgagcccggcgcttgcccgctacacctcgccaccggcatccagcgcctcgccgacgccaagctgatggctgccgcgcccgaccttgctgagatcctgctgcgacttgtgacggcgcccgacctgcgccgggccgacctcgacccgcacacgcaggaggtgaggacgcgcgcctgggcggtgctggtgcgggtcgcgccgcacctagagctatga

SEQ ID NO: 9592 - DNA, 2409 bp, Methylobacterium sp.
atgagcctcgtcggcctggggctcgtgcttgccccgcctgaggccagggccatcgagacgccgtacaacgccatcgagggcagtgccctggccattgccgcctacgaggcgagcaaggagcaatgcggctattccgagcgcctcggcaaagccatggccgacctcgacgcgttcttcgcccggcgccatggctatgcctggacccgcgcgaagcagtccggccccgacatgctgatccgtatgcgcaacgtcggccgcgtgctcggggcgcagtccgactgcgttatctacggcaaggccatcggctacgtgcttccggcctacctcaacgccgtcgatatggatcccctggtcatggctgaactcagcacgttgctgagcggcaaggatgctgccccgggcaatcgcggggccgagccggtaccagcacccgccccgggcagtgcggccgagacggtcgcggagctgaagcgccagaacccgaacatgaaccggagcgcagaacctgagggcttccgatccagcctgtcgcgggtcggcccgaaccgggatcgcggtggtgcggtcgcgcaggcaccagctcagcagccgagcggcgtggtcccgccgccgcccggcccgccaccgcaggggcagccaacagcctcggcagccgagcgcacggcactgccgccgcagggggcacggccgggcgaggccccaaccgtcgcgcctcaaggcagcactggggttgtcgcgaacgccagtcgagcgatcccgctggcttcggcggcaggcgccgcgacctgcccgatcaacaccgaatgccgccttgcggagccgacctttgcctgcaacgtcgatgacgccacgcgccttgcccaggctgggccgggcgcggggacgcaggctgggctcgcggcggtccagggcgggcggtgcgagaccgtcgcagcaggtcgcctgcttcgcttcgaggccacagcgtcgccacaggtcgtctacgccacggaccggggcgtccatgtcggttacctgccagtcggcatcttcgccccagcaggcacggcggatacgacgacctgtcgagccccgggcttctgcgccatacgtcccggcccccaggttcaggcatgtccgaccgccgagaacctggccctgtcgacccctgaggcacgcacggctgccaaatgcgtgaccctcagccccgggcaggtcggcgaggtggtgtcggtggccgcgggcatggggccgattgccgtcgggttcggcggcaacccaccgttcctggccacctactacctcggtcgcgccgacctcgtcggcattgaggttcaacccacacccaccccagcctcgcgcggctggtgccgtccgggcgactggtgcctgatcgacgcgcccgcgttgttctgccgtgagaaggacgcctacgagcgggtggcggcctcgccgctgggcgaagcgcggcgcgcagccatcatggctgaatcgagctgtcgtgtgctcatccgcggcaacccgatgaagccgagcgcgctgcccgtgccgggcgaggggcgcaagctgatcgaggtcgaacacccggtgtacaggaccggctggacgaatgcggccgccttcaaggtcgtcgcctacgcacccccgatccgctacacggcgcgcctgtcggacattcgggtgagcgcgggccgtaccccagcccttacggcagtcagcctgagcgcccagggtacccgtgatgcgtcaggcacgttccgcacgggcgcgaaggaacgggcggagttctgcaaaggctaccagagtgaggacgacccaagcgccctgcgcgcgtgcttggccgagccggacacgagcctgacggttgtggccaactgcgaggcgaagcaggtgaagctctacggcaccctgtatgccctcgaggagcgaccgcacgacgctgaccccgacatccacgtcgatgcaagccgccagtggctgttccgcgataaggcaagccgagagtggctggatggtacgaccgcctccgacgaggtgagcgtggccacggccttcaacgcgctatgccccggcaccaaccccgacgctgccttcggcattgcctatcgtgatccaagtgcccggtatccccgagagctacacgggcgctggttcaatgatcggcgtgcgtgccttgacccgaggcgcaacgaacctgactatgacgattatagctacacggagatatccgctgaaacgcagcgaagtcgaggcagtgaggatcgagtcaatgccgtgcggcgagttgggcagggtgcttgggtgattgacgagagtagcaaatctcaggaggatacagatacattttcaacgagcgcatacgctttgacccgtaacggcttaaggctgatgatgaacggaaacacgagcgaatggtttcgatgccaatga

SEQ ID NO: 9593 - DNA, 168 bp, Methylobacterium sp.
atgacggcccccgcgccttcggacgggcgcccggaccggccgcgcctgccggcgcgcgcgtggctgctgctgatcctcggtctggtgctggcgacgtatccggcgtggcggctcctcgtgttcgagccggatccgccgctcgacgcattgctgcgcttgcgctgctga

SEQ ID NO: 9594 - DNA, 204 bp, Methylobacterium sp.
atggaggtggccgtgctgatcttcgcccttctgtttgccgccctcggcatcctcggcgcgctcgtcggcctcggcgagctgggccatccggtcggcgcccacggcgtgcagagctacggctggggtctcaccgtcaacgcgatcgcgctggcggtgtatttcctgttcatgtggacccagcgctaccacggccgccggacctga

SEQ ID NO: 9595 - DNA, 231 bp, Methylobacterium sp.
atgccacgatatttcttcgacacctatgacggcacggtggttcacgatgacgagggccgcgtcatgccggatcttaacagcgcgcggctggaggcacggcatctcttgcgggatctcctcttggacgccgcgcccgaagccgacgtgagccggttccgcgccgacatccgcgacgagtcagggcgcgtcgtcgttacggcgaccctcacgctagcctacgcggacacctga

SEQ ID NO: 9596 - DNA, 207 bp, Methylobacterium sp.
atggtcgtcgcccacctgttccgaatcctcagcgcggtcctgttcgccgcggcgctcgtcatcgcgccgctcgcgaacccgctcctcgtctcggcctgcctgatcctcggcggcaccctcgcggcctggcgcggcgccgccgatctcggtctcctgacgggcgccctcggcctcgcccggtccgcggcggtccgccaccgggcctga

SEQ ID NO: 9597 - DNA, 270 bp, Methylobacterium sp.
atgccgatgcgcctgtccggagaggagccgcgcctggacgagggcgcggcggtctgcctgaccttcacgatcacggacggtcacatcctggtcccctgccgggtggggcacgcggcgcttcaggacgccttcggcccgccgggcggcaacgccatgacgatcttccgcgcgcatcgggacgcggtggtcgacggcgcgatccgcaggtacgagcggagcggtgccgagggcggggtcgttacgctcgcggcagccgacctcaccgcctga

SEQ ID NO: 9598 - DNA, 153 bp, Methylobacterium sp.
atgaaccccctcgccatcgccgtcatgctcgggatcctggtcgcctgggcggggctgctcgccgccgcgctctatctcggcaacccgctcctgctcgcgatcttcgccgtcgtctcggtggcgatgttcatccgctgggacgtgttcggctga

SEQ ID NO: 9599 - DNA, 375 bp, Methylobacterium sp.
atgacgacgctactgcgcggcctcgcgctgcccgcactcctcgccgctctcctcgcggcgccgctcgcccggccggccgcggccgcgagcaacaccacggtcggcgtcggctcgggcgccgtggccggtgccctcgtgggcggcccaatcggcgccgtcgccggggcgatcgtcggtggcgtggtgggcgcctcgaccgagcgcccgcgccgctaccgccgggtgcgcgcccgccgcagcgccctgccggtccggccggtggcacagcgcgcggcaccggcggcgccccggggcgcgctgacgccgaccgtctcggccgagcccgcgcccgccagcaccggctcgaccgggcggcgctggaccgatccgcgctga

SEQ ID NO: 9600 - DNA, 2616 bp, Methylobacterium sp.
atgaatcccgagctacacctgacccgcgacgacgtccggaacttctacaccctgtgtctcggtcggccggtcgagagcgaggcggcggccgaggggcgccgacaccagacagcgctcgaatgcgcttcgagcctcctgctctcgggcgagttcgaggcggagatcctgcgcccggtgctcaacggacgggcactgaagcacgccgggatcagcgaccgcaccttccggaagatccgcgcctgggcggcgcagcacggccccgccgtcttcggccaggtggtggaggatcccgcagcgtggcacaagaagtggcacagcctcctgcgcggcctcgtcaccagcgagcccgtgcgcgcagacttcgccgcgcggtacgccgagcacgaagcgttctgcgaggctcttgccgaggctgcggcacacaacgaggcgatcgtcgccggcgtcgaggagatcaatgccggtcgctgccgcggctacttcgtcgacgtgaccgaccgcagccgccacttcgtgctccagctccggatcaacggaaagacggtggccggcgtcccggtcctggagttccgcaaggagctgcaggagaagtatggcggctccggccatgacggcttcgacatccgcttcgacgacatccccgagattctcgggctcggcggcggcacagtcgatctcatcgagccgcgcaccggcttcgtacttctggaaaaacaccacgtcaccttctcgaacgcagcggcggccgagcagaacgaccggactatcgagaccctgcggggttaccgcagctacgtcgacgggctgatcgacgccctcgacggcaatcgtccgcaatcggtgacgagtgtcgccggctacggccgcaaccgaatcttcgtccggccgcccgcggctccgccgacctcgagccgagtcgcggtcgtgatcgatacgcgcggcgtcgagccgatcgaggattcgaccgcgatcctgcgggaggatctggcagccttgcgcgcgcagacgcatcagccggttgcgatccacctgctgcaggacgctgcgcaggtcggtgccggggctgaggcggaacggggcgcgatgagccgcttcgacagcgtggctcgcctccgggagacgctgcgcgcgcagaccgatctcgtcgtccacctccggccgggcgagcgcctggaaccggacgcgatcgcttggctcgcctatgcggccgaacgcccgggcgcgcatgtgacgtacgccgacggcgaggtggagcgcgcccgccccctctccggcatcgcgctggacccgatcttccgcagcgccctcgacatcgacctgctgctgacgtccgacacctacgacacgccgctatgcctgggcgtgtcctgcctcgacacggccgacctctcggaggaggcggatttccgtcgcggcgtgctgctcggcgccctcgagcggcacgggcgctgcgccttccggcacgtgccgctggtcctctcccgcggacgcggcggtcggaacgccgaggcagccgcgcgcgcgcgcgccaccgttcaggcccatctcgatcgggtcgggtcaggagcggttctggagccgcacgtggatgccctcgcggccccgctttccgagcgctcgcgggtgcgctggccggtacaggcgcgccggccgatcagcctgatcgtgccgacccgcgattccatcgacatggtgctcgcgctggtctcgagcctcaaggagtgcacgcgctacctcagcctcctgcgcgtccacgtcatctccaacaacagcgtcgcgccccagaccgagcgcgccctggacgttctggcatccgatgagatcgtcaggatctcgacgttcgaggggccgttcaactgggcgggcatcaacgatgcggcgatccgcgccgacgactgcgccgagatcgccgtctgcctgaacaacgacatgatctgccggacccaagggtgggacgagttgctgcgggcgcagctcgcgcgcccggacgtcgatgtcgtcggcggtcggcttctctacgcgaacggcatgctgcagcacgcgggcgtcgccatgaccggcggttggatgcacgaggccatgggcgacgcacccggtcacggtctctacaacgaccgcacgcgggtggcgcacgaatgcgctgccgtcaccggcgccttcatggcgttcgagcggcagttctatctcgacagcggtggtttcgacgcggcgaccttcccgatcacccacaacgacgtcgatttctgcctgcgtgccgagaagcgcggggcgcgcatcctctacgatccggagcaggtctggattcacttcgaatccgtcacccgcgggctcgacagtctcgacacggccaagactgagatgctgcacgagtctcatcaggccctgctgagccggcttccgcggccggattatctcgacctctcggtcaatccgcacttcgtccgcgatgcgcggcccttcacagcggtcgcgtggccgcggcgtgacaccgttctgtcgtggatcgaccagcagcagacccgcaacgccgcaccgtcgattgcgggcatcccggcggcggacggcgcaagggaccggccggacgcgaccgtggagacgcgcgcgcggaccgcctga

SEQ ID NO: 9601 - DNA, 1200 bp, Methylobacterium sp.
gtgccgatgcgcgcgccgctcgcctgggtcgagatcgccaagggcctgtgcatcggcctcgtggtgctgatgcacgccaccctcggcctggaggaggccctgggcgagcgcggctacgcccacgcgatggccgatttcgcgcagcccttccggatgccgaccttcttcgcgctctcgggcctgttcctcgggcgcgctctggcttcgggctggcgccccttcctcgagcggcgggtgttccactacctgtacttctacacgctctggctgctgatccaggaggtgatccgcttcccgcatctcggcggcggcacgctcgccggcaccctgaaccacgtcgcgtggtcctatgtcgagccgttctcgaccctgtggtttctctacgcgctcgccctgttcgcgctggtgacgcggctcgtcgagcgcgtggccgcccccgcggtgctgggcgtcgcgctcgggcttgccgggagcgacgtcacgaccggctggcacatcctcgacgtcgcctgcgacacctacgtcttcttctacggcggctaccggctcgccccacagatcctcgccttcggggctcggatgcgcgcccgcccggccctcgccgccgcggtgacggcgggctggctcctcgtcaacgcggtcctgatcttcaccgtcgtcccgaccctcggccacaccatggtcgccgaagccccgctcgtcgcgctgcccctcggcgtcctcggcgtgttcggggtgatcgcgctcgcgacgctgctggagcgcagcgtcgccgggccggcgctcgcctatgcgggctaccggtccatcgtgatctacctcgcggccttcgcgccggtcgccgccttgcgcgcgctgatggtgcgctacggggtgcccttcgacgtgggcaccgcgagcctcgcgctcacggctgccggcatcctgctgccgctcgccctggagcgcgcgctgcggggcacgccggccgcctgcctgttcgtgcggccctcggcaggcctgcgcgcgcccgccacgatcctgcggcgcggccggtcgctgctcgacaccgccgccgtggcctcggcggcctccgtcgcctccgtggcggaggccgggacctccgtcgcgtcggcgctggccgcgccgcccgttcaccgtggcgcgcttgttcccgcaggcgcgccgctgccgctggccctcggcccgcgggaatcgtaa

SEQ ID NO: 9602 - DNA, 402 bp, Methylobacterium sp.
atgaaggccggcgagagggccggcctgagcgcgccggccaggaccgtcatcgcccacgccgcctacctcaccgtcgccggcctcgccttcctgctcgcccccgagggcgtggcgcggctgctcggcgtgacggccgagccctaccttgtccggatcatcgggctcctgatgctctgcttcgccgcctattacgggcagttcgcgcggcacgaggaccggccgctgatcggcgcgagcgtcgcggtccgggtctgcctcgccgcggccttcgtcctcttggtgatggccgacctcgccccgatgccgctcctcgccttcgcgctggtggatcttatcggggcggccgcgacggccctcgccctgcggggccgctcgaccacggggccgttgccggcccattga

SEQ ID NO: 9603 - DNA, 129 bp, Methylobacterium sp.
atgcacgccctcaccgcccagctcctcgtcatggtcgccgccgtcatcgccggcgtgctcgtggccgagatgatcgagtccccggtccgtagctgggcgagccgcctcgcagccggccggcgccgctga

SEQ ID NO: 9604 - DNA, 222 bp, Methylobacterium sp.
atgcagcgtcggagccggacgccctacagcgcgggctttcgctccgagaccgcgtcggaacgcgcgcggcacgctgtcctgaaccgcttctcctacagcggcgggttcgacggctacgagggccgcatgacgtgcccgccctcgtggcggacctccgcgttccgcgacgatcaggatcgcggcgcgcgttccgccgcgcgcgacggatcccggaacggctag

SEQ ID NO: 9605 - DNA, 153 bp, Methylobacterium sp.
atgatcatgatcgtggggcttgtcggcatgccgatcctgctgatggcggtgacgctcgcggcggacgcgatgctgaagccctatccgagcaaggacgacgtctggcgcctgccgaaggtctcctccctgcgcgcgatgaccttccacccctga

SEQ ID NO: 9606 - DNA, 138 bp, Methylobacterium sp.
atgaccctcctcgccgccctcgccctcctccccttcgccgccgccgtccacgtctcgctcgtgatcgcgctggccaagaccttcgacggcgatgcgcagaataccggcacggccggtgcggtcccgacgctcgcctga

SEQ ID NO: 9607 - DNA, 189 bp, Methylobacterium sp.
atgccggacggatccgacacgccgagacccgacgagacgaccgagccggccggcgatccgccggcaccgccccgggcgcccgagggcgatccgccgcccgagccggccgcgccgcctgcgaaaggaggccgctcggacgaactcacgaaggcgggcgacgcgggcgacaagctcggcgacttcgcctga

SEQ ID NO: 9608 - DNA, 339 bp, Methylobacterium sp.
atggaaccgacgccgagttccgccatcgcggagatcgatcgcttcatcgaggagagccgccagctcatcgcccgcgcggaggcctgccgacagagcctgatcgcgctgggtgcccgggaggggcacctgctcatggccacccgaaccatcacggcgatgggccgcatccaggccacgctgctgcggcagcgcgcgatgctcccgcagcgcgcgatgctcccggagggcgcggccccgccggaggccgagcgcgtgccggccgtcgtcgtggtcgcgcgcgccgcccgcccctggtgggcgctggtcgggcgccggaaggccgaggcccggctgtcctga

SEQ ID NO: 9609 - DNA, 201 bp, Methylobacterium sp.
atgtcgaggcctgctctctttctcgccgccttcgcgctcgcgacggccgcgttctggctgacgatcctgaccgatccgccgacctcggaggccgcgccgaaggacctcgccgccgacgccgagccggtatccgcctccgccctgcgggtccggttcgtgcccgaggaactgtgcggccgcttcggcgactgcccgcgctga

SEQ ID NO: 9610 - DNA, 360 bp, Methylobacterium sp.
atgcgtcacatgatcctcggcgccgccctcgcgctgctcctgcccgtcgccgcccaggcagagggcgatgctgcggccggcgagaaggcgttcgcgccgtgcaaggcctgccacaacttcgagaagaacggcgtgggcccggacctgaagggcgtcgtcggccgcaaggcgggcacctatgagggctacaactactcggccgccctgaagaactcgggcctgacctgggacgaggccaacctcaaggagtggctgaaggacccgaagggcaaggtgccgggcaacaagatggtctatccgggcctcaaggacgagaagaagctcgacgacgtgatcgcctacctcaagtccaagacctga

SEQ ID NO: 9611 - DNA, 1140 bp, Methylobacterium sp.
gtggagaaatccgtgtcagatccgggccggcgccccgacctcgaatggctgaaggcgctggcggcgctcgaggtggtggtgtgccactccgatctcgcggtgaagcacttctcgggatcgctgatcgcccggtcgtggtacctgccgctgagcgggatcggggtcgaggtgttcttcgtcgtctccggctatctcatctgcctccgggcgcccgcctacgcgaacgcgctgtccttcctgcgcgcccgcctcctcaggctcatgccgctctacgccctgttcacggggctcgcggtcgcggcgcgcctgatcaatccggcctgggcctggaaccgctgggacgtctcggccggcaccatcatcggttccttcctgatcctgccgcagccgcactaccccatcgtgggcgtcggctggtcgctggagcacgaggtcatcttctacgcgctggtggccctgctgatcctggcgacgcggctcgcgggggaagcgcccgtctggttcggcctcgcgctgttcggactgggctggtgcggcgcgctcgtcggcatcgccccgagcgacgccgcctggtacctgcaccccgtcagcgtgctgatgacgggcttcgcggcgggctggctctaccgctgccacgaggtggacggacgggtcggcgtggcctggctcctcatggcctgcctcgccgtgaccgtcaccctgagcctcggcaccgacccggccaacaccgagcgcagcctccggctcacgggcgcctccgccctcgtgatcctgttcgtcgcgctccgcgacacgatcctgcggctgcccttcgccgaccggatcctgttcccgctggggctggcgacctacagcatctacctctcgcactggttcacgatgtcggcgctcggcaaggccgtcggacggctccgcctgcccgaatccgcgcagttgccggtgcgcctcgccgtcatcgcggtcgcggtcggggtcggcctcctcgtctaccggctgctcgaacggcccctcgaccgctggctgcgcgccggcgtgccgatcggggaggccttccgccagcccttccggcgtcggcgcgcgatggggccggagcccccgccggaggcgggcatcgctcatcccatcggcgcccacgagtaa

SEQ ID NO: 9612 - DNA, 351 bp, Methylobacterium sp.
atgaccctgcgcccgttcccgaccctcgccgtcctcctcgccctcgtcggcccggcggccgcgcaggcgcccaagccgcccgcaccgccgacgctggagcagatcgagcgcctggaagccggcccgcggcggcgcgacttctatctgagcccggaggcggccgaatcggcgcgcgccgccgaggccaagatggaggcgatgcagcggaagatggacgcccgcgtccgccgcgcgacccgcagcatctgcgagggctgcgccggtcaggccgcgcgccgccgcgacgcctccgccgcaccgcgcgacgacgtgccgggcatggacgatcctgcccaggcgccgctggactga

SEQ ID NO: 9613 - DNA, 171 bp, Methylobacterium sp.
atgtcccccctcccccgtctcgctctcgcggcgctcgccgccgcggcactcgccgcgtgctcccaggcgcccgcggcaccaggccccgagctcagcccgccgcccccgcgcgtcgatgccaagacgcagctcgaatacggcggcccgccgccccgcggcccgcgctactga

SEQ ID NO: 9614 - DNA, 231 bp, Methylobacterium sp.
atgccgaaacccagggacggccgccgactgccggatcgccggtccggccgatcttgcgaacggggcgagagaccgctggccatcgcggccgaccgctgcatcgcggcctacgaggccgtgctcgaactggatgacccggatctgcgccgcctctccgagatgctgctgctcgccgtcggcaagcgcctcgcgcgcgaggacggcggcgcgctgcgacacctgatgaactga

SEQ ID NO: 9615 - DNA, 1005 bp, Methylobacterium sp.
atgacgaagccgatcgacctcgcggacgtgcgcgcgcgcctcgccgccccgatcctcgggcgggcgcggacggaccccttcacgctcgacgtgcaccaccgccacccgcgcatcgccgcgatcaccttcgcgccggggcagccgatcggctacgcgctcgccgcgcactacccggactggaccgaccgcacggcgctcgccaaccggctcgccgcgatgcggctgttcttcggccggctccgggacctggagccggacctcgcgggctcctgcgacctctggctcgccgacatcccggaggcgccggggctcgccttctcgggggcggggaccgcgaacatcctcgtgcccgacgccgagttcgtcgccgccgagggctaccgcgccttccgcgagcgggtcgaggccggcttcgtcgactggggcgcgcgcgacccggccctgttctggcgcgggaccatgctgggggacccgaggaagcgcctgccgagctggcgggagctgcagcgcgcccgcctctgcctcgccgccgcggcgccgggggagggcgtgccgctcgacgcgaagttcgtcggcctgccgggcgacgccgaccgggacgcgccgggccggcgcgaggcggaagggctcggcctcgtggccgggcgggtgccgctcgaggccttcatgggctaccggcacgccgtcgacatcgacggcaactcctccgcctggatggggctgttcaccaagctcctgatgggctgcaccgtggtgaaggtggattcgcccctgggccaccggcaatggtactacgaccggctcgtgccctggatccacctcgtgcccgtctcggccgatctccacgacctcgcgggcgtgcgcgcctggctcgctcgcgaaccgggggccgccgaggccgtcgcggcgcggggccgggcgctcgccgccgccatcaccctcgatcaggcgttgctggacgtcgctccgcgcgtgatcgcccatatccgagccccgaaggcctga

SEQ ID NO: 9616 - DNA, 1155 bp, Methylobacterium sp.
gtggcgctgctcgcctgggagctcggggccgggttcggccacgcgcggcgcctgctcaccgccgcgcgcgggctgatcgcggcgggcttccgggtccgcgtctgccagcgcgagctctgggcctgcgccgaggagtttttggacctgggcgttccgaattttcaggcgccgcaccaccgctcgcagctgccgccgggcaccgccttccgcgcgcggggctacgccgacatgatggcgatcgccggctaccagagcgtcgaggggctcctgcccaccgtgctcggctgggacgcgctgatcgacgcggtccagccggacgtcatcgtcgccgactacgcgccgatgctggcgctcgccgcccacggccgggtgcctctggtcgcgatcggcgacgggttcgtgctgccgccgacccatcgcgaccgtttcccggtgctgcgcgagggcacccgcatggccgacgaggcgaccatggcgagacacgcgggtttggtgctggtatcccgacggcaaacagcgggtttctcgctgcccgaactcatcggcggacaggcccgcgtggtctgcacctacccggagagcgacgtctatgcggggcagcgcgagacccccgccgcggggcccctgacggtgccgggggggccgctggcgccggcggcgggggggacggtcttcttctacctcgcggccgattttccccataccgccaaactcttacaggcgctctgcgattcccggctgccggccgagggttttgtccgcgacgcgcccgaatcgctccgcgcggcgctgcgcgccaacggaatccgcctgcacgaccggccgccgccgctttccgacgcgctggcccgggccgggctcgtggtgcatcacggcggcatcggcacgatcgaatcctgcctcgccgccggccgcccgcagctcctcctgccgcgccatttcgagcagacgctgaacgcggaagtgcttgtggctcaaggggttgcgcggcgcctgccggtgcccttcaccctcgccgaggcccgcgcgcagctcgccgagtcggcccattcgcccgacctcccggcccgcgcgcacgcgctcgccgacgccctcgccgggcgcctcgggagcctcgacaccctcgtcgcggcctgccgcgcgctcgccgcctga

SEQ ID NO: 9617 - DNA, 1203 bp, Methylobacterium sp.
atgcggaccgttcttctcacctatgagttcggtgccgggcttgggcacctcaatcgcctcatcgccgtcgcgcagcggctccagggctgccgcctcgtcttcgccttaccagatctccctctcggtgttcctctggtgcgccggacgttcggcgaggccgccgagatcgtgcagggggtggtctggacggcgccgaccgcccctgaatcgcgccaggttccgacccacaccttcgccgacgtgatcgcgctcttcggcttcgccgagatggcgcggctcgaagccctgactgccaaggcgacggccctgctcgacgcggtcaagccggatctcgtcgtcgccgacttcgccccgaccctgcgcctcgcatccgcgggccgcgtgccgacggtcgtggtgggtaacggctacacgattccgcccggcggccgtctcctgccgccgatgcgcccttgggaaacgatggtgggaccggcgagccgcgcgcaggagggacaccttctcggcgcggtcaacgccgtgcgggcacggcggcagggggcggcggtcgatttcttcgccgacctgttccagggcgagcacagtttcccctgcactatcgcggagttcgacccctacggtacggctcgcgccgagccggtggtctggcccttcaacgtcccggtgatccccgagggtccgccggtcgccgagcggcacgggccggccgccttctgctacttccagggcaatcatccggcgctggcgccgacgcttgcggcggcaggcagccttggcgcgcgcgcggaggtgtacgtgcagggcctcgatccgcaggcggtcgcggcgcgctgcgcgcgcaacgtcggcgttcaccggaagcccgccgacttcgccgtagcgctgccgggcacccgcgtgctggtgcaccatgccggcctcggcaccgcctatgcgggagtgctcgctggcacgccgcaactcgttatcccgcacaatctcgaacacgccatcacggcacgaggcctggagcgcttcggctcggtggtacgcgtcggcgtcagcccggtgccggagcctggaacgctgacgcgaatcatgaagggcatgctcgctgacggcgacctgcaggcccgagccgcgcgagccgcccgggatctcgccgcgcggcgtgtgccggatccggtcggaccgatcgcggcggcctgcgccggtttcctgtag

SEQ ID NO: 9618 - DNA, 345 bp, Methylobacterium sp.
ttgatcaagaggttctgtctcgccctggccctagcgggcgggctcgtggccgccgcgccggcggcgtcggccctgacgctgcccacggccgccggcctcgtgggcgccaccgacagcgcggtcgtcgaggtgcgctggcggcgacactggcggcgccatcaccgccaccgctggcaccggcaccaccatcgccgctggcaccaccatcggcgccaccgccacgccctgcggcatcaccggccgctgcgcttcagcgtcggacaggtccacgccccgcgggtccagccctggcgcgatccggtgcgccccgtcgcgggcgggcgcctgaccccgcggctggactga

SEQ ID NO: 9619 - DNA, 195 bp, Methylobacterium sp.
atggttgcggcgttgaaacgggcggtgcggttgcggcggacgatgcgcgagcgcgacacgcgggtcgaggcgagcggctgcgccaaggcacggcccctacccgtcggagaggcgacgatcctggccgagcgcggtctcaccgcccgcgagttgatccgcatggcgcaggcggcgcgtcgcgcccggcaggactag

SEQ ID NO: 9620 - DNA, 903 bp, Methylobacterium sp.
ttgaccccactcttcgttccggtcggtattcgctccgccgacaaggcggcactgttgggtcgtggcggccatatcttcctcgtcggaggcaccaacagactgctgacggagtatgtgcgcgccgacgaagatccagtggccacaggcaccgcgcaggcttggctcaccctgatcgagcggcgcagagctaccttcgagaggctgggtgttcggtatgtccaggcgatctttcccgagaagcttacggtgctgccggagttctttccggaaccggtccgcacgcctggcgccatcctgcgccgtatagaagcagggcttgcttccaagcccgatctgtccgcaagctatgtctcgacgcgacatgccctcgcgacccagcccgaccctgcagcgacacttctgaagaccgattcgcatttctcgcctctcggatgctgggtggtcttccgcgccatcttggagcatctcggcatcgtcccggggctgacgccagcctttggcacgatccgagcgggtacgggcgatctcgcagttcgcttcttcggtatccctatcctggatacgcgaacggaggctgacctagacggcttggatgcgaccttccgggcgcgggcaatacgcacgttcgaatacactccgccgggccgtttcgtgggatcggcgcaatcgtggcacaaccccgatgcaccgatcgatgccagcatcctcgtgttcggcaactcgtattgtggagcggcggaaggacatcagggacagatgtcctggtggtttgcgcgatggtttcgcacctaccacttcgtctggcgcgcagacgtgccgcccggcttggtagagaagctgaagccggacatcgtcctgtgtcacaccgtcgagcgtttcctcgtcgaggtgcccgagacttga

SEQ ID NO: 9621 - DNA, 300 bp, Methylobacterium sp.
atgcgcaagttcgccatcatctccgccgccgccctgacgctcggcaccctcgcgacgactgccgccgacgcgcgtccgcgcggctatcacggccatggctacgccccgcacgcgggttacggctacggccatcgcggccggcgcggcatcggaaccggcgcggccgtgggcctgggaatcgcgggccttgctgccggcgcgatcgcggcgggcgcggcacgcgatgcctacgcccgggatggatactacggtcgccccgcctacgggtacggcggccctggctatggctacggttactga

SEQ ID NO: 9622 - DNA, 1398 bp, Methylobacterium sp.
atggccggcatcggattcgagctgcggcgcctcagccgccgcgaccagctcctgggcccgatggcggccgtcgcgcacgccgccctgatcgcggccggcccctggctctacacgatcctggcgatcttcctgatcagcgcggtcgccgggccggtcgttggcgccgacgcgaccgcgaccttccgggtcctgctcatctacatcttctcgctctcgctcgtcgccacggcaccggtcatcatgatcggcacgcgcgtgctggccgacgcgctgcaccgccgccactacgccgatatccgcggcctctactgcgccaccctggtcggctgcgccgccgcgacgctggccctcgcggccctcgtcctcgtcggtctctccggggtccgggcggaggctgcgctcgtcggcatcgcgggcgcgcagctcgtcggcatgctctggaccgcgctcgccttctgcggcgcggtgcgcgactaccggcacatcacgttcgccttcgcgctgggcctcgcggccggggcggggctcgcgatcggcgcagcctacctcaggctcgggccggtcgcgatggcggccggcgtgtgctgcggcttcctgatcatcttcctctggctgacggcgcgcttcctggcgaccttccccgagccctgcgagagcctggggccggcacgcgccgcgctcctcgaccgcctgcgcgccagcccggcgctcgcggtcggcgcgctggcgagcgcggtcggcgtctgggcggacaagtggatcgtctggaacggccggttcggcgagcgcgtcgatgtcgggctcatccacgcgccgctctacgacagccccatgttcgtcgccagcctgacggtcatcccggcgctggcactcttcgtcacgagcctggagacgagcttcttcgagagctaccacgcctatttccgggcgatcgagcgccacgcgacgctgcggcggatcgaggagcacgtgcgcgcgatggaggcggagacgctgcgcaccctcgtcgggatcatgacggtgcagatcacgctctgcctgatcgtgctgcagaccgccccgatgctgatccaggtcttcaacctgcagttccagcagatcgacatcctgcgcatgggctcgatcggagccctgttccagttcctcttcatcgtctgcacgacgatcatcgccttcttcgacgcgacccgcctctacgtcgcgctccacctgctcttcacggcctgcctgatcggggcgaccgccctggtctcgtcctcgcggatggagacgctggcgctcggctacatgagcacctgcatcctgctcgggctcggctccgtcctcccgttcctgcacgtcctgcgcacggtgaacttccgcgtcttcgtcgggagcgccgttgggccgaagcgctga

SEQ ID NO: 9623 - DNA, 1539 bp, Methylobacterium sp.
atgtggtttgagggccttcggcaggccagccgccgtcttccgatcgcggttccggcaccgacggccgacatctgcctcgtcgtcgaggggtgctacccctacgtgccgggcggcgtctcgacctgggtcgattggctgatccggggcaatccggacctgaccttcgccatcgtcgcgctcgtggcggacccgtccccgcgcgagatccgctacgcgctccccgccaacgtcgtgcgcttcgagagcctgccgctgaccgtgccgctcgacgcactgcgctggcgggaccgcgcgccgccggccgtcgagatcgcgctggccgataccctcgtcgctctcgtgaacggcggcggcctggccgccctgcgcgacctcgtgcggctcatccgggacccggccaaccacctgtcgctcggtgccctgatggcctcgcagctctcctggcgcctggcctcggccacctacgagcgcctgatgccgcacgcctcgttcctgcacttcttctgggcctggcgcgcgctgttcggcggcctgttcgccgtcgtgacggccccgctgccgccggcccgggtctaccacacgatctcgaccggctatgccgggctcttcgccgcccgggcggccctcgagaccggagctccgacgctcatcaccgagcacggcatctacaccaacgagcgccgggtcgagatcctgatggcggagtggatctgcgacacggtcgataaggggatcagcctccaggacgagcgcgtcgacctccgcgacatctggatccggaccttcgaggcgcacgccctcgtctgctatcaggcctgctcccgcatcctcaccctgtacgaggacaatcagcggctccagcgtgccctgggggcgccgcaggagcgcctcgcggtgatcccgaacgggatcgacctggcccgcttcgcgagcgtcgcgcccgtcggggcgaacgcgccgcccaccgtcgccctgatcgggcgcgtcgtgccgatcaaggacgtcaaatccttcatcgacgcggtcgcgctcatccgccggagcgtgccgggactgcgcgcgctcgttctcgggccgacggacgaggatccgcaatacttcgaggagtgctgcctgcgcgtcgccgagcacgcgctggaggagaccctcaccttcaccggaccggtgaacatcgtcgcctacatgtcgcagatccacgtggtggtcctgacgagcctcagcgaggcgcagcccctcgtcatcctggaagcgggcgccgccggcatcccgaccgtcgcgaccgacgtcggggcctgccgcgagatgatcgagggccgcgccgacgaggcgccgcggctcgggccgggcggcgaggtcacgcgcctcgtcgatccgcagcagaccgccgaggccgtcgcgggcctgttgcagaacgagccccggcggcgcgcctgcggtgaggccatgcgggcccgggtccggcagtcgtacagctccgccgacgcgctcgcggcctacgcgcgaacctatgcggcgtttctggacgggagtgggagctag

SEQ ID NO: 9624 - DNA, 1371 bp, Methylobacterium sp.
atgacgaacgcacgcctcctgctcctcctcgtcctcggcgccgtcgtgacggccgcgtacctcctcagctcgggaccggaggagcggatcgccaagctcgtgcgcgacggtcgcatcggccgggcgatcatcgtcgcggagggcgtactcgcgcagggacgggcgacgccgcgcatgctgacgacgctcgccggcctctacgacgccgagggggatccggagcgcgccgccgacctgctcgagatccatgctctggtctggccgggggagccggacattctcgcctcgctcgctgccctctacggacgctccggcaacgcggaggggcatgtcgcggcgctcgagcgcctcgtcgctgtccggccgtcgcgcgagacgctcgcccggctggccgcgctccatcggctggccggccgcttcgacgcggagttcaccgttctcgatcgtgccggggacggtgatctgctcggcgcgggcgaccaggagcgactggcccagcttctggtccagcgcggccggccgcagcgcgccgccgagcttctggctcgggccgaggatcggccgggcggccagggcgagcggggccggatgctcctgttcgagatccttctggagacgggggcaaccgcggaggcgggccggcgggcggcggactggctggccgagtggcgcaagccctggctggcggacaccctgctcctgcgcctcgctcccgtggcttccgccgagacgaccctcgcgctggcccggacggccatccggctcttccccgacacccgcttctatctcgccaagcgcctcgcggagcagggacacggagcgctcgcgcacaccatcgtgcgcggctggccggcgcccgacgcggccgtcacggagcgcgagatcggcggctacgtcgcggtggtccacgcgagcggcgatccgggtctgctccggccggcgatcgctgcgctcggacaggccggcttcgaggagcaggcgatcctcgccgaggccattgaacagacccacggcctgcccgtcctggccgcggcctggcccgaccttccgcccgaggcgctgctgcgccgtcccctgctcggggttcgtctcgcacgtctggggcggcgggacgacctggtgctctggctcgtgcggagcgccgacctcggcgcactgcgccccggcgagcacgcggcctggctctcggtgctgcgcgccgcgtgcgggcctttcgcgaccttcgagatcctggaccggcaacgccgccgcggcgagcttccgggcggcttcatggccgcctaccggcagctcgccgcgcaggtcggtgcctcggaccggcagcggcgtgacctcgtgagcatcggcgatggcgacagacaagtccgctga

SEQ ID NO: 9625 - DNA, 3888 bp, Methylobacterium sp.
ttggagaaccgcgacgggtcgacggatccggcgaaagcctcctacgtcatcgcgtttcagagcgcggtcgcgctcgctgacggcgcgccgatcttctggctgaacacggaccagaacagcaacacgggctatcaatccttctccggtgccgcgacaggtgcggaatactacgtaaccctgtcgggcggtctgccctatctgtacgatccgtcgaccattccggccaccggaaacgccggctatgtcgggccgatcaccgactacaagatcgacgcggccacgaacacgatcgagttcgcgatcccgcgcacgctgatcacggatgatcgggcgggactcgacctgaaggtcttcgccaacagcggcgtttctctgccgagcgacttcgcggcaacgacgtaccggatcaacgatcccgcgacgctgcccgcgccgggcgcgaaggcgcagaagatcggcatcgtctactccgccaccaccgcgaaccagtatttcggcgggaccgaggccgggcagacggcctactcccagctcttcatggcggctcagaatcaggcgaccgccgcgggtgtgtccttcgacgtcctgtccgaggccgacctgaaggacgtcggcaagatctcgggctacgacgcactggtcttcccatcgttccggaacgtcgctgccggcgacgtggacgcgatccagagcgcgctcaccacggcggtcacgcagtacaatgtcggcctgatcacggccggcgacttcatgaccaacgatgcgaccggcgcgccgttgggtgccgatccctacatccggatgaagaccctgctcgacctgacgcgtgcgggcgggacgagcaccgcggagccggtcagtgtcaacgcgacaggatcgggcttcaccggctaccaggcgaacgagctcgtccgggactacgcgtcgatgagcacgtcctggtatggaagcgcggacggcacggcaccgaccgtgctcgcgacgcagaccgtgacaggggccacgcacgacgccgtcgtcgcgacgctcacgggcggcaagaacgtccacttcgccaacgagagcctgctcggcgacaacaacatgctgcagcaggcaatcgattacgtcgtcgatccggcaagcgggccgagcctcagcctgcgcatgagtcgcgggaacgccatcgtcgcctcgcggaccgacatggaccaggccaaggagctgagcgacgtccggccgccgagcgggcccggaatttacgacaagctcctgcccatcctggcgcagtggaaagccgactacaacttcgtcggctcctactacatcgataccggggacggcacagctgcgaacggctcgaccgactgggactacgccaagcagaagtactacgatccgctgctcgccatgggcaacgagatcgggtcccactcggtcacgcacccggaagacaccaatcttctgtcgtccgatcagatcaaggccgagttccagggctcgaagaacacgatcgaggcgaacctcaaggttccggtgacaggggccgcggtccccggcatgccggagtacctgaggacgtcgaaggacatccagcagtactacaactacatcactggcggcgcgacactcgtcggagcgggctatcccggcgcgatcgggcacctgaccccggacgacccgaaggtctacatagccccgaacatgtccttcgacttcaccctcgtcggcttcaagggcctcgacgcgacgcaggccggggcggtgtgggagagcgagtggaacacgaacaccgcccattccgagatgccggtcgtggtctggccctggcacgattacggtccgacgggttggccggtggatcccaccgcgtcgaactatacgacgcagatgttcaccgacttcatcgcccgcgcctaccagttcggctcggagttcgtgaccctgagcgacctggcgcagcgcgtcgcctcctacgacgcctcggacctgacctacacctacgacaccgccgcgaacgccgtcacggccaagctcagctcgccggattcgggcaagttcgccctcgatctcggcacgggctcgacgatcaagagcgtcgccagctggtacgcctacgacgcgaacagcgtgttcgccgaccgggatggcggcatcttcacgatcaatctcgggacgacggccgacgacgtcacgcatctgagcaagatcgccgaccgtgccgaactcgtcagcgcgacgggcgacggcacgaacctcgacttcacggtcgtcggcgagggaacctacatcgtcaacctgaaggattcgatcggccagaacgtcgaggtgacggacaaggccgggaccaagctcgcctacacccagagcggcgacgcgctgagcatcaatttgacgggactcggcagccacgacgtctcgatcaaacagaagacgaccccactgccgaacctgccgccgacggtcgctcaggcgctgacggcgagcgtcgccgaaggcgatcagcccaagacgctcgatctgcttcagggtgcgagcgaccctaacgcgggcgacgttctggcggtcagcggcctcgcctacaagctcggctccgcaacggtcgccgacgccgccgcagccggcctcagttacgatgccgccacgcacacgctcacgctcgacccgcggagcgcactcttcgatcatctggcggtgggcaccacggagacggtgacggcgagctacacgatcgctgacggccacggcggaagcgtgggccagagcgcgaccttcaccatcgccggcaccaacgatgcgccgaccgttgccaacgcgctcaccgccagcctcaccgagggtgctgcgccggcgcagttcttcctcctcgccggcgcgaccgatccggacgacggcgagacggccaagctcgcgctcaggaacctgacctacacgctgggaacgggtgcggcgagcgcgacgccgcccgccggggtgagctacgatcccaacgggtacatcctgctggtcgacccgggcaatgcggccttcaccccgctcgccgcgggcgcgacgcagacgatcatgctggcctacgacatcttcgatccggctggcctagctgtccggcagaccgaaaccctgaccatcacgggcatcgacacgcccgcaccgggcggcggaggcgggggcgggggcggctccgtgccccccggcccgaccgccggcagcgacgtgctctacgggacgggcggcggcgaccggctcagcctcggcgcgggcaacgataccttcatcggcgccggcggagccgacctgatctacggcaatcaggacgacgacagcctcgcgggcggcggcggcgcggacaccctttacggcggccagggcaacgacatcgtcgccggcggccagggggacgaccggctcttcggcaacagcgggaacgacgtcgtctacgggaatcagggcaacgacgtcgtctacggcaaccagggtgcggacacgctcttcggcggccagggcgacgatgtcgtcttcggcggccaggacgccgacgtcgtctacggcaatctcggcgccgacgtcgtctacggcaacaagggcgacgacgtgctctacggcggccagggcgacgacgtgctctacggaggccagggcaacgacatcctgatcggtggcctcggcaacaacatcctcgtcggcgggctgggcgcggatctctaccgcttcagcgcgaacgcggcccacgacctgatcctcgggttctccgaggcggacggcgaccggatcgacctgcagggtcagaccttcacgctgggcacggcgggcgacggcgacgccctgctcctgctctcgggcggcggcagcgtccaggtcgcgggcgtcagcaccgccacgttcggcaacggggccgggtacctcgcctag

SEQ ID NO: 9626 - DNA, 243 bp, Methylobacterium sp.
atgctgggcaggctgatcgcatccgctcggagcgtggcgacgggcacgggcgccgtgcgggcgctgctcccgagcgggcggccgcgcgcgccgggcgcggccatcgcgcccgctccggagacgatgcccgacttccccccgatgcgtcccctcgaaccgccgccggcccgcaacgacgacgtactgcagcccgttcacgaggcggtggagcgtgacctgcgggcgcgcggctacctgggctga

SEQ ID NO: 9627 - DNA, 300 bp, Methylobacterium sp.
atgcgccttggtgcacgatcgatcctgctcaaactcgccgccgtcttcctgctctgcgccggcctcggcgtcacggtcgcgccgcgcgtggccgaggccgcgccgctcgccgtcccgtcggcggtcgaggcacccgcctccggtctggagacggtgcagtaccgccatcatcaccggcaccacggcctgcaccgcggctggcaccatcgccgccacttccaccatcaccgccggcacttccggccccaccacttccaccgccaccaccaccatcaccgccgcggcttctaccgctactga

SEQ ID NO: 9628 - DNA, 1209 bp, Methylobacterium sp.
gtgttcggtccggtcgcggacatcctgctctgtggcgccctcgcctacgccgccgcgctcgtcgcggcgcgcggactcagtcgcgcgggatttccggtgcccgcgggcggcgagactgcgatcgacgggctgcgcggcctgctcgccctggcggtgctcgtccaccatgtcgcgatctggatcccggtggcgcgcgccggtgcggcctggacgacgcccgaatcgctgctcctgcacaatctcggcgcgggcagcgtcgggctgttcttcatggtgacgggctacgtcttctacccgcgcgtcctcggcggtctgcggggcctcgacctcggccgcctcgcgctcggccggctgttccgcctctacccggccctcatcgcctcgatcctgctgatcctcagcctgatcctctggcggaccggcggggcgcgggccagcaccttccacgcggaggcggcggctctgctgcgctggctcgcctgcgcgggcaccccgccgctgctcggcgaggccgactccgggcggatgaacgcccacgtgctctggtcgctgcgctatgagttgctgttctacatcctcgtcctgccggcctgctgcgcggcgatggaccgggtccggggccgggcgccgacctggtgggtgcccgcgggactcctcgtcggcgcgctgctcctgcggccgttcaagaacgccctgccgctgatcggctacctgccgctcttcgcggtgggcatgctggcctacgaggtgcggctgcgcgaggcgctcgccgcccggctgcgcgggcccgcggccgcctgccttggtcttgccgcgctcgccctcgccgcgaccacgcaggtggtgcccggcaaaccggcggcgctcgccctctacggcgccttcttcgtctgtgtcgcctgcggcaacgatctcggcggcctgatgcgcgcaaggagcgcccggctgctcggcgcctgctcctacggcgtctacctgctgcacggcgtggtgctgagcgcgctcttcgtcgatctcgcgcccctcaccggcgcgatcccgaccgggctgctgccgctgctgatcccggcggcggcgatggctgccgtcctgctggcggccctcgtccacctcgccgtcgagcggcccggcatccgggccggacaggccctggcgcaggcctgggcgcgcgcgcccgtcctcggccgcctgcgcgcgcgggcggcctga

SEQ ID NO: 9629 - DNA, 1245 bp, Methylobacterium sp.
ttgcgtctgctggggcctgcctatcggctgttctacagcgatccagtcgagatcagccgcggggaaggcgttatcctctacgactctgcgggcagagactacctcgacgcctataacaacgtcgtttcgatcggacatgcgcatccacgcgtcgtggaggcgatctcggctcagttgcggacgctgtgcacccacacccgctacatccaagagggcatcctgagatacgcggaggatctgctcgggatgcatcaaggccgcgtcggtcacgcgatgttcacctgcaccggatccgaagcgaacgacctcgcggttcggatcgccaagcatcacaccggacgcaacggcgtgatcgtgacatcagaggcctaccatgggaattccgatctgacggccggcttctctccatctctgggcgacggctcgccgctgggcacgtgggtccgacgcgtgcctgcgccggatccgtatcgcgtcgatgttgcggacatgggagcatggatggccgataacgtggccgctgcgatccacgatctggagcgccgcggcgagggcgtggccgcattcatcgccgactccctcttctcctccgacggcatcttctcccatcccgccggcgtcctcgcgccggtggcggaggtcgtgcgcaaggcgggtggcgtcttcatcgccgatgaggtccagtccggattcggacgatcgggcgaacggctctggggctacgagcggcatggcgtcgatcccgacatcgtctccatgggcaagcccatgggcaacggctacccggtcgctgggatctgcgtcgcgcccgaacttgtcgagagcttcggcagggaaacccgctacttcaacacgttcggcgggaacaccgtggcaatcgctgcggctcaggcgacgctggatgtcatacgcgatgaggatctgcaggccaacgcggacaggatcggccgccgcatccgcgagggcttggctgagctcgccaagcgcgatccgcgcatcggagacgttcggggagcgggcctctacattggcgtcgagctcgtgcgcgatcgcgacacgaaggagccggacgccgccacggcgctcggcgtggtgaacggccttcgccaacggcgggttctcatctcggcgacgggcttcaatgccaacaccctcaagatccgtccgccgctcgtgttcggcgaagatcatgtcgaccggctactgacggagctcgagggtgtcctcggatcgataccggcatga

SEQ ID NO: 9630 - DNA, 987 bp, Methylobacterium sp.
atgctcgaggaagaggccgccggactttgccgatcacgctacgggcttgacggtgatctgctgcgctttgcaaccgagaaggacgatacgttccgggtacgcaacggacgtggcgaagccttcattctgaagatcacgaatcccggcgaggccgagtcggaagtcaatttacagacggacctgcttcattaccttgcaaaatcttcgccgcacctgcgtgtgccgcggatcatcccggacctcgatggaaatcgctacgcggcctacgtcgacgcggcggggcagagacggctcctcaggatgatgacgtttctgccaggcactcccctgagcgagatcgagccgacctcggccgagcgcgagaaggtcggagaggtcctgggatctctccgcctggcgatgtccgacttctcgcaccctgccgactgccgcgagatcgcctgggacatccgtcatctcggcaagctgtcgcacctcgtcggccacgtggaggattctggccgtcgttccttgattgaaggtggcatgagacgttttcgcgaaatcgaaagcgatcttaccaagtgtcgcatgcagatgctgcacaacgatttctcccggtcgaacatcgtggtcgatcgcaagacgccggagttcgtgtctggaatcattgatttcggagacgcagtacgcaccgccgtggcggtcgacgtatcgacagccctcctaaaccagctgtctccaattccccgggaggacctgttcgccgatgcgaaggacgtgctgcgcggatacctccggatcgcagacctgacggaagacgagctcaggttgattcctcatctcgtcatgggacgtgtgatagcgcgcgcgctcctgacgacttggcgcgcgcggctctttccagacaacgctgcctacatcctgcgcaacacctaccagggttggcatcagctacagtggtttctcgatcgcccgttccgggaaatctcgaacaccctcgcctga

SEQ ID NO: 9631 - DNA, 135 bp, Methylobacterium sp.
atggagaccctggacgggcctctgcccggcacgctgctggtgcagctgagccgcctgcaccgctccgagcacgcgcggctggctgcggcggaagcgccatcggcccaggccaccggtggcccgcgcgacggctga

SEQ ID NO: 9632 - DNA, 1290 bp, Methylobacterium sp.
atggcgccgcccgaccgagccgcgtccgagcccgtcgtgggccgcgccatcctgctgctgctcgtgctgctgctctgcctcggcggggtggcgaacgccctgcgcaaggacatcgccaagggcttcgacgaggtcgcccacgtctcctacgtggcgcagatccagcgcgagggcgcgctctggccggacctccgggcgctccgcatgctggaccccgcgagcctcgcgccgacggccctgccgaactacctcaaccacccgccgccctactacaccgcgctcgcccggctcggccccgcgatcggcgcggatccgtcggcggtcctcgtgctccggctgatcaatgtcgggctggcgagcgccgcgatggccgcgctgctcctgctcgccgccgggctcgcccggagccggcgcgcgttctgggcctacgcgatcccgctcgtcaccatcccgaccgcgctcgccctgaacggcgcggtcaacaacgacaacctcgcggtcctgggtggcgcgctggcgatgctgggcctgcagcgcctgctctgtggcgatcgccgggcctggctcgccgcggtgctggcgggcgtggtcgcggccgggctcgcgaagttcaccgcgctcctgctcgtcggcggctgcgccgggccggtcctcctctggctcgtcctgcgcgggcggctgcccgccgcggtgctcgttcccgccgccctcgccctcgcgctcggcgccgcgccctacgcggtgctcctcgcgcagtacggcagcccggtgcccgaggtgccgggccatctcgcgatgatgcgcgacggcgcccgcgcggccggctgggacggcgcgcgcctcgacttccccgcctacctcctgaacttcgccgcgctgttcgccgtccagttcatgcccgtcctggcggagccgggccccgtcgaaaccgcggcgctcgccctgccgctcgcgctgatggggctcagcctcgcaggcggcgcggcggcgctcgcccgcctcggcaccgggcgcgcccatcccctcgatccgctcgcggtcgcgggctgggcggcgatcggtctcgtgctcgccgcccatgtgcggttcggctacctgaaccatctcgccaccggctggcggctcgacgcctatccccgctactacctgccgctcgccgggatcacggcggtcggctgcgcctgcctcatcgccggcctgcccgaaggccgggcgcggcgcgggatcctggccttcctggcgggcgcgcccctggccttcggcctgctcggcgcgccgctcggcggctga

SEQ ID NO: 9633 - DNA, 225 bp, Methylobacterium sp.
atgcagctctcgacctacctcgccccgcccccgacgccgctgcgcgccgccaacgaggccgtgcccggccccgagccgctgcgcgacgcccggcccgcgcggcccgacgccgcggtgctgccgttccggccgctcgcgcgccgccaccgccgccccgccgagacgcacgagcgccgcggcgagatcctgctcttcctcggcgtgcgctacagccgcgcctcctga

SEQ ID NO: 9634 - DNA, 276 bp, Methylobacterium sp.
atgccccccaagcccgcccgcttcctcctcgccgccctgctcgtcgggctcgcaccgctccccgccgcggccgctccgccgcccggcgtcagtcccggctccggcacggagaacatcggcgccggtccggctcccggcacgccctccggcgtcgtcggcttcgacgggccgcccggcggcggggtcaacaccaccggcggtcccggtgcgctgccaccgagcacgccgccgtccaacaccggcctgcccgccggcagcccggcctccccgcgctga

SEQ ID NO: 9635 - DNA, 192 bp, Methylobacterium sp.
atgaacctggacgcgcagcacgaccgcacagccctgccgcccgcccccctccccgcaacgacccacccgattcagcagcccacggacccggccgaacaaggccgcaccgacgagacggcggaccgctccgagggcgagcccgccgcgacgcccaccaacgccttcgaggcgttcggctccttctccggctag

SEQ ID NO: 9636 - DNA, 282 bp, Methylobacterium sp.
atgtcggtcatcgaatcacgcgggacatcgcgcgcggcagcgtcggtcaacgcgacgccgcgcgagcggcgcgccagggcggtcgcgcacgccaaccagttgcgggccctcgcatgggtcgccctgcgggacggcgcgccgcacggcgcgatgcgggcggcgaccgcccgcacggccgcccggcgcatcctgcagcacgagcggcgcgccgccgtgctcaaccgcgcgctcgcgcaggcgctcgaggccctcgtcgaggagcaggccgaccttgtcggctga

SEQ ID NO: 9637 - DNA, 195 bp, Methylobacterium sp.
atgccccgcacccccgagccggagccgtacggatcggtcgagccgctgccggtcccccgcctgcgcggccggaggaccggtgacgccgagccgccgaccaacgagccactggatccggacgaacgtcccgatgtcggcctgagccagtccggcagcggcgaggaggcgatcgtccgccgggagaccgagatctga

SEQ ID NO: 9638 - DNA, 1272 bp, Methylobacterium sp.
atgacgacgctgacccgccgccaggcgctcgcgggcctgggcaccgccacgctcgctggggccttcccggccccggccatcgcccagaacgcgccgatcaggatcggcgggctcaccaccctggaggggcccttcgccaccggcggccaggatgcgttccgctgcgtccagatggagctggagcggatcaaccacatggccggcggacggcgcatcgcgttcatccgcgagagctcgaacgcccgcgccgacgtggcgcttgcccgcgcccgcaagctcgtcgagcaggacggcgtcgacatcgtgctcgggccgctctcgggggcggagggcatcgcactgaaggactattccgcgacgctcaccggcaagaccatcgtcaacggctcctcggccgccgccgacaccaccctgcgcaacccgtccaagaacttcttccggttctcgaccgacggcacacagtggatggccggcgtcggcaaccacgtccgcaagacgatgggcatcgaggaggtctgcgtggtcgcgggcgactacgccttcccctacgcccaggtcttcggcttcagccttgaatattgccgtgcgggcggccgggcgacctacctgtggtcgccgctgggcaccaccgacttcgcctcgcagatcgcccagatcccgaagagcgccggcgccttggtggtggtccatggcggcaccgacggtctcgccttcatgacgcagtacgcgcaagctggcggcagcctgccgatcatcggcggctcgatcatggccgaccagaccatgatgtcggcccgcggcccgcaccgcaagctgatgctcggcatggtcagcggcggcccgatcgccgacgtcaacgaggatccgaactggaacgacttcgtcgcccgctaccgcaagcgctgggcgaacgagggcgggttccagtcgccgtcgatccacggggtgaactacaccaccaacctccagggcatcctcggcgcgctggaggaggtgcgcggcgacctctcgggcgaccagagggccttccaggcggcgctggccaagcaccgcttcaagaacccgatgggggccgaggtctatctcgatcacaaccggcaggccgtgtcggacatcttcctgaccaagatcgaggagcgagagggcaagccggtgaccgtggccttcgcccgcgcgcccgcgatcaaccaaaccctcggggtgcccgaggcgcgcttcctcgcccacggggcgccctcgcgcaacaacacgggctgcatcgccggcacctga

SEQ ID NO: 9639 - DNA, 192 bp, Methylobacterium sp.
atgacgaggctcctcgggccgcccccggcgcgcacggcgcttcggcgcggcctggcccatctctgccgcctcgccggggccgggctgttcctggcgacctgcggcgtcgcctcctacacggccggggcgcactaccgcccggagccggtccgggccgcggatccgggatccgccccggtctgtccacgctga

SEQ ID NO: 9640 - DNA, 414 bp, Methylobacterium sp.
atgagtcccacgcgaacgccgccgggccccgcctgcccccgggcggccctcgacgcgctcggccgcgaggtcgggcgcgccctgcccccgcccgcggacgggctcggcgagagcctcgtccggcgggcgctgcgcgagacgccgggcgacgagcccgacgaggaccgcctcgtcgtccgcttcggcacggagtggcgcggcttcatccggcgccagaacccggaccggctcgccgccctcgacgcgctgatcgacgcgcagatcgagcgccgggcactcgcccgcttctaccggcgggtgcgcaacgcggcggtcgcggtgaccatcgcgggcttcgcggtcgcccagttcgggatcgaccggttgccggtcgtgcgccagatctggcgcctgctgcggggggagctgcgatga

SEQ ID NO: 9641 - DNA, 726 bp, Methylobacterium sp.
atgtcggcagcggagccgcaaccgaaccaggccgccgcagctgaggatctcgccccggccgaggtcgaggtcctggacgccgctcccgtcgcggccgggtcgtcttccgaggtcgtgacggaggcggtaagcgagcctgaatccgacgagacggtcgaggcccttgatgcatcggcagccgaggtcgacggggtgaccgaaccccaggcgggagcgatcgctgcagagcccaaggagcctgctgccgtcgacgagccgaccggcgagacggccgcgcaggtcgtctcggaggagggcgtctcgcaggagcccgccgaggtggcggcatcggacgtggcgcgcgccgaggcgccggatccggattccatcggggccgaatccctcctgccggtgtccgccttcgcggcactggatgctgcggacgcgtccgaggcgggagcggcacgtcccgctgtggcacggaccaccgtccgcttcacgttcgcgccggtgcggatcgacgtcgaggggatcggcgtcgtgctggcgaactacatgcacaacgagagcgtggcgattctcagctacatgcgggcgctcggcgcggcacgctcccccgccgacatgatccgcctgaacgttaccgcgatgcagcgcgccgctgatgcctcgctgacctgctggagcgacatcgcgcggcgcacggcccagggcgtgccgtggcagcgggagaaggctgcggcctag

SEQ ID NO: 9642 - DNA, 213 bp, Methylobacterium sp.
atgggcaagctgaagccggtctatctctatcgcctgcggctcctctacgctgccccgcgctactacgccccgcagagcatcaaccattacctggagaagcgtggtctgatccggcgcaccgggcgcgcgcttccggcccggcggcacgaggagtacgagatcacggaggccggccgcacggccttcgatgcagcgctcgcggcgccggagtga

SEQ ID NO: 9643 - DNA, 618 bp, Methylobacterium sp.
atgatcgaggatgtgatcgacggtcgtacaattccggtttcggagcagatctcgacgatgatctcgcggatcgctgagcggcagcagtacgatgctgttttcatcgacagtcgcgccggcctcgccgaattggcggctccagccgtgctcgggctcggtgccactgttttgctttttgggacggcacagaagcagactatcgagggctatcgcgctctgtttgccgctctgcagctgctggcgcaacgtgaccgagcgcagggtagggatgccgagtggcggaccagactgcgtccggtcctcgcaaagacgagcctagccccaggtgcggtggaacgataccttgaagacatgtacgagatctactccgcacacatctacgatgcggagactgacggcgagcagccgcccgatagccttcgtttcgcccaaaacgacaagtcggctcctcattggcctttgatagttccatttagccagaacttcgtcgatttcgatccggggcggataccgggtcagcttgtccaaagcttctacgagcagacgttcggacccttcctcgcccagattcagttggcgatggtctcggatgagaatatcggcgggtcacagccgtga

SEQ ID NO: 9644 - DNA, 279 bp, Methylobacterium sp.
atgattcgggctgccgcgatggaaactgagtcgcatcagcgcatttttcgctgtcacctgatggtgacggtgcaagccgtgctctctgagtaccggccgggggccagcgcccagatggtaacggacctgctcgcgcgtctcgaagccctggaagcaaaggctatggcggagggtgcgccagtcgcaacgatagcggccatccgtggcgccaaagttttgatacagattccgcccgcaccgagaatgcgccattttcctatagtggtgagcgatctctga

SEQ ID NO: 9645 - DNA, 243 bp, Methylobacterium sp.
atggcactttattttttcgacgtccacaactcccagttctcagcgcgtgatgaggacggcaaagagtgcgaaaaccgcgactctatcagtgccgaagcgctccggcagctatgtgtcattgccaaagacgacccgcttctccacatgaacggcacgatcggagcggttgtccgtgacgaacacgatcacgtggttctcacggccaacctagtcctggccgtggtgtgggttggcgacgcttaa

SEQ ID NO: 9646 - DNA, 312 bp, Methylobacterium sp.
gtgtgcgcccccgtcctcagcggcctcgccgccgcgatccagctcccggccctcccggcgggccgctcgggtccggtccgcgcgggtccggttcatccggttccggctccctcgccttgcggcgtgccggccccgccacgaccgatcccgccgctcttcctgcacggcatccggccggccctcgaagccgccttcggcaccgaggatgcggagcttgcaccggacgcgatcgccgcgctggtggcccggctccacaccggcccgctcgggccggcccaggcggaggcgagcccggccgtcgcggtggcctga

SEQ ID NO: 9647 - DNA, 360 bp, Methylobacterium sp.
atgagcaagccggttacggacaacaagcagacgatcgaccgcacccgccgcctgatcgccgagatgcgcgaggtcatcgaggacgcccgcctctccgtgctcgccgcgcgggacctcctgaagcagttccccagccccgagggggtcggaccggcatcccccctggtcgagccgcccgccgacgacccgtcggaggatctgacggtgcgcctcgtcgacatcctgctcgacgcgcacagcgtcgccaacctggacgatgacgcggagacgcgggtgctgctggagacggccctcctgcgggtcgggcatcggctcgcgcgtcgggccggtccgcgggcggccggactggttctccagtag

SEQ ID NO: 9648 - DNA, 213 bp, Methylobacterium sp.
ttgaccgcacgcccgaggctgctcgccgcagccgccctcctcgctgccctcgtcctcgccttcgtgcgcaagtccccggagccgcaggacccgtgcgaggcccatccccaggcctatccgtgcgccctgttcgccacggcgccgaccgccgcggctccgccgcaggatccgatgccgcacgggaacgacccggcggcggacggcacgtcctag

SEQ ID NO: 9649 - DNA, 297 bp, Methylobacterium sp.
atgagcgcgcgacgcctactgcacacgagcccggagggcacgcgctggtcgctcgcccgcgcaggggcggaggtcttcgtcctgcgcgagggcggcggggcatccgagcggatcgggctcgtgcgtttcctcgacggcgacccggctgcgccggaacggcgcgccctcctcgacctcgtggcgaccctggcggaggtcggatccgcgaacgggcttgcggccggaccggtgacgggcgcgccgccggaggcgggcgcggccgcggccgagccctcgccgggcgagtcggcctcgtag

SEQ ID NO: 9650 - DNA, 162 bp, Methylobacterium sp.
atgcccgacacgtcccaggatcccgccaccccgcgcgccgtcgcctactcggagcgggccaagcggcaatccttccagaccatcgcgatcatcgccggcttgatcctgttcatcatggtcgtgttcggcttcctgttcggcgcgggccgcctgatcgcctga

SEQ ID NO: 9651 - DNA, 237 bp, Methylobacterium sp.
atgacccggcccgacgacaccggacccgagaccgatcccggcgaggcgccttccggggcgcgggcctacggggaccggcccgtgagcgggcggccgcagggcggccgggcgccgggcgcgagcgagcccgccgacatgggctcgcccgaagggaccgacgcggcggagaacgacccgggtgggcgcgagcggcccgatgaccggctcgagccggcgggcggctatcgcggccgctga

SEQ ID NO: 9652 - DNA, 156 bp, Methylobacterium sp.
atgggcctcttcgtcgtcatcgcctgcgccttcctggtggccgccgtgctggaggtgctggccttccggcggcgcaacgagctggaggcggaggggctcgtcaccgtggtgcgtccggagacctcgacctatctgaacccgccccggccgtactga

SEQ ID NO: 9653 - DNA, 408 bp, Methylobacterium sp.
atggacgcgctcggccctctcgtcgcgtccggtcggatcgtcgacctgatcctgatcctcgtggcggcggaggccgcgctcgtggcgctctcgccccgccggttcggcccgcgcgcgcccctgctcgccgggctcgccgcgggggcgggcctgctgctggcgctccgcgcgggcctcggcggcgcgccctggccctggatcgccggagcgctggcgctcgccggcggcgcccacctcaccgaactggccctgcggcgcccgaagacgcttcgccgcagggaaccatccgcaacatcggctgaggcgctggcgttgggttcggtctcgcgccgacacgaacgcatgaagcggcgtcgcccgccgcccctcccccgcccatgcgcgggcgagggagcgcgcggcgcttga

SEQ ID NO: 9654 - DNA, 339 bp, Methylobacterium sp.
gtgacgaccatcatccggcggggccgcctgcgcccggccctcgcggcggccgcgccgctcgccctgctggtcgccgcgacgctggtcgccgcgacggtgagcgcggcggcgcaggaatcctgccgggcgagcctcggcccgagccgcgcggcggccctggtggcgcgctgcgtcgcggtctcgcccgcgccggtgccgcccgctctcgtgccgcccgatctcctgccgccctgccacgccgccaatccctgcgccgtgatcgaggcggagatcgcccgcggctgcgacgacctcgacgaggacgcgccggatttctgcctggcctaccgccaccgctga

SEQ ID NO: 9655 - DNA, 204 bp, Methylobacterium sp.
atgaagatcgtcagcgagaattacgccgcgtgcttcgcgcgctcccatgaggtcgatacgaccgaacggctgatgctcgacgcgatcgcctgcaacctgcgcagcctctacggcgacgccgccgccgcggtgccggacgatctcctcgtcctcgcgggacgcctggaggctccgaccccgcctgcggacatccgcgcagcctga

SEQ ID NO: 9656 - DNA, 717 bp, Methylobacterium sp.
gtgctgatcgtgaacaagagctacctgatggagcacggtacggggacgctgggcgacctgcgccggaacggcaacgtggtcgcggtcgatcccgtcgacctgaagctcgcgccgggaacccggatcgatgccgatctcctgatcgccagctcgcgcatgcaggacgcgttcttccgcgagcacttcgccgatctgacgacgttctacgtcccgcaccacgccgatctgaggatcccgcctccgggcgaaccgccggcgcggttcgggttgggctatttcggcgcgctctacaacgcgcccttcagggaggagcttgccaccgcggggctgtgcgacttccacaaggccgacgatccggccgagaccggctggatggcgagcctgccgcactacgcctgccattacgccgcccgcagctggcagcccttcgacgggttcaagccgttcacgaaggggatcatcgcggcgcgctgcggcgcggtcgtgatggtcgatcgcaaccccgaggccgaagcggcgctgggcccggactacccgttctacatcgacgatacgagccttgccggcatccgcacgggcgtggagtgcgcccgttcgggcttcggttcgcccctctgggaaacggcacgcgctgcgatggcgcggctcgcggcatcggtgtccgaggaggctgtcgccgcctcggtcctcaacctgagccgccacgtcgggcgctga

SEQ ID NO: 9657 - DNA, 216 bp, Methylobacterium sp.
atggtgctgctgtacgtgtccgccgcttggacgggcgggatcctgaccctggccgccctgtggcagcccctcggtccggcgctcgcgctggtcgcggcgcccttgggcgcgagcgcggtcaccgccggtgcggcctgcctgatcggcctccgcgcgaacgttcggcgcggtccacctccgggcggcgtggccctcggttggccgctggcccgttga

SEQ ID NO: 9658 - DNA, 483 bp, Methylobacterium sp.
atgcagacgacgctcctcctcgctgccgccgcgggcctcgtgctgggggccggcgcgctcctgtacgcgggcatccgcatcgggcggccacggcccggcgaggtctcgccggcccctgggggcactccggtcgccgcgcgtcgcctcgtcggcacgtggcagggtcggcagggctacgccttcgccgtcgcgctctcccataccggcccgggcgacatcccgatcgacgggatcgcggttctggcgcccgcgggggcccggatcagcgtccagccggccgacgacgaccgctggacgcgcccgggacgccgccacgcggttcggtggcgcgccccggcggggaagcgggagacgatcgtccagtgccgcctccacctgcccgccgcggcggcccggacggggacgcgggtgcaattccgcctcaccggcgcaccggagaccgggaaccagggtatccacgtgatgctgacggtcgatctctga

SEQ ID NO: 9659 - DNA, 432 bp, Methylobacterium sp.
atgcgaacggtcaaactgcggccggaaccggtgttgatcgcgctccggtgggagaatccgggcgatgcaccggccgagaccgcgaccgacccgctggtccccgcgatccacccctggatcgccttcctgctcgaaccctggctccaggcgatcgagcaggccgggcccggcacgacccactggctgcaggagaccagcgcggcgatgagcgcgtgcctcggcgagtgggtcgacccgaccccggcgatcgagcgggcgctggatggtgcccgcaccgcctcggacctgctcgtcgcctgcatcaaccgggccggctgggcgaacgcggacgcgcagcggcaggtcgcccgcgcggcgatgggcgtcctgatcgaggccttgacccaggccgaggccagcgagagcaagaccgaactcggcctcggcttctga

SEQ ID NO: 9660 - DNA, 294 bp, Methylobacterium sp.
gtggattccgccgagatcgattccgccatgcagccggcccgatcggacccgggcgccgaaggccccgccaagatcctcaccggggacgcggtcctgccctgccgcctgcggcccgagggaagcgcggcggcgcgcctgtcgctgccgagcgccgtcggcatcccggagctcttcgtgctctcggacgaggcgagcggcgacgagcgcctcgcccgcgtcacctgccgcaggcagggcgcggacggcgcgcggctctgggtgcagttcctcggcccggcgcgcctcgcagcttga

SEQ ID NO: 9661 - DNA, 336 bp, Methylobacterium sp.
ttgagacggatcgttctggccggcctgctggtgctggcatccaccgccgccgacgcggcctgccgctgcgcctgcgtcagcgggcgggcggtggccgcctgctcctcgcagggcgagatggagccgatctgctcgcagatctgtcccgagggcctgacgcccggcgcgctcgtcgagccgctcgtgcccgcgggcgcgatccggctgcccggccccgccctctcggacgacgaactcggccgccgcggcgccgagacgaccgcgccgaacggcagcttcaaccccgcgcaggggctcgccctgccctccgtcggcggcaccagccagccgcaatag

SEQ ID NO: 9662 - DNA, 81 bp, Methylobacterium sp.
atgcccgaagaactcttggtgttcggcctgtcggccctgaccttcgcggcctacgccttctaccgcacggcgcggccctga

SEQ ID NO: 9663 - DNA, 1200 bp, Methylobacterium sp.
gtgagggcgctcgacctcgccgggcttcgcgccgacacgccgggcaccgcccacggcatccacctcaacaatgccggcgcgagcctgatgccgcggccggtcgtcgaggcggtgaaggcctatctcgatctcgaggcggcgtggtccgggcacggcgcggccgagcgggaggcggagcgcctcgcgggcgtctacgcgagcgtcgcccggctgatcggggcggagcccgacgagatcgcgctgacggagagcgcgacccgtgcgtggcagatggcgttctacgcgctcgcccgcggtttccggccgggcgaccgcctgctggtcgggcgccaggaatacggcgcgagtctcgtcgccctgcggcaggtcgcggcgacgaccggcgcgcgcgtcgagacgatcccctccgcgccggacggccgcatcgacgccgcggcgctggcggccatgctggacgatcgcgtccgcctcatcgccgccaccgcgatcccctcgaacggcggcctcgtgaaccccgtggccgcgatcggcgcgctcgcccgggcgcgcggcatcccgttcctgctcgatgcctgccagatggtcggccagcgcccggtcgacgtcgcggcgctcggctgcgacctgctggcggcgaccggccgcaagttcctgcgcgggccccgcggcaccggcttcctgtacgtgcggcgcgcctggctcgaccggctggagccggcaatgctcgaccatttcggcgcacccttcgacggggacggctaccggctgcgcgacgacgcgcgccgcttcgagacctacgagcacgaccacgccgcccggctcgggctcggcgtcgcggtcgattacgcgctgggcctcggcatcgaccggatcgcggcgcggatcggtacgctcgccgggatgctccggcagggcatcgccgccctgccgggcgcgacggtgcacgatctcggccccgatcccgccgggctcgtcaccctcacgctggccgggcaggattccgccactgtccgcgccgcgctcggcggggccggcatcagtgccggcctgtcgctgcacgccgccgcgccgctcgacgcggcggcgcgggccctgccgccgctcgtgcggctctcgccgcacgcctacaacagcgaggacgagatcgggcgcgcgctcgatgtcctcgccggtctcgcacagggaagagtacagccatga

SEQ ID NO: 9664 - DNA, 243 bp, Methylobacterium sp.
atgcgcctcgcacacgtcgccctcgccgccgccctggcgctcgcaaccgccggaccggccgccgcccaggttctgtcgaacccgagctcgaccaaccaggcgctcaccaaccagagcaacagccgagcgaaccagatcggcaccacgagccagaacaacgccgcccgcatggagatgcagcggagccagagcgctcagccgcccgccccgcccaccggcgtcgtcggcgtcccacggcgctag

SEQ ID NO: 9665 - DNA, 180 bp, Methylobacterium sp.
atggacaggatctcggctggcaggatcgggctcgggagcggcgcccccctgcgggccggcgcgacgcgcgatccgcgcttcgtcgccccccgcagcacgcatcccggcgccctctggctcgccgccgccgccccgctcgcggcgacgctgctgctcctcgccgcgcgcatctccggctga

SEQ ID NO: 9666 - DNA, 432 bp, Methylobacterium sp.
atggcgggcctcgaccggatccgcttcgccaagttcgtgaagtgccgggccctgatggagggcggcgcgacggcgggcgagcgggcggcgggcgcagcgggcgcggcccgcatcgccgcggccgcgggcctcagcctcgccgaggcgctgcggctgaccgggagcggccagccccgcgagacacgccgggatgcgccgccccgccggccccgcccctgggagacgccgccgctgcgcaccgacccgatcggccttgacgagatcctggcccagaaggcgcggacggaggcccatcgcaagcgcaaggccgcccgcgctgccgaggcgcggcgagcggacctcgccgccgaggcggccgagcgggcggcgctccgcgaggcgcaggaggcgcgcgaccgggcctgggccgaggcgcgggggaagacgggctga

SEQ ID NO: 9667 - DNA, 183 bp, Methylobacterium sp.
gtgctgcggcggatcctgatctccgcctccctctacctcttcgtcgccgctgccgtgatggcagcggccttcgtcctcgaccggctggagccggacgcggacggcgcggtggtggatctcggcgccgatccgggcgccgagatcctgacgacctccgttacgtcctggacgcaggcgcgctga

SEQ ID NO: 9668 - DNA, 249 bp, Methylobacterium sp.
atgcgcaagcttcagtacgacaccgggaccgcagcggagcctgcgggcgcggcgcacgcggatccgaacgcgcgggcggccctccgccggctcgccgagatctgtatcgaggcgcacggcatcgtcgcccgcgagggaccggaggaggttcgcctgccgctggaggagctgctcggccggatcggccgccagctcggcgcccagccggagaacgacgtggcggccgagacggccggggccggccgctga

SEQ ID NO: 9669 - DNA, 273 bp, Methylobacterium sp.
ttgcgcgtggaacacgtctcggaaggcgatccgcaagatcgccccagtcccgggcgcaccgcagagctcctggccgagatcgccgcgatcctgcgcgtcgacccggtgatcttcttcgacggcgagatccaggagcgcgtgagccgggacctcgccgcagatgaactcgccgaattgctcgccctgttccggtccatcgacacgcccaacctgtgcgaggcggcgcacgacctgatccgaaccctgaagcgggacaggaaaccggattcctga

SEQ ID NO: 9670 - DNA, 366 bp, Methylobacterium sp.
atgcgtaagcttgctgccatctcggccgcagccctgatcggtctcggcaccctggccagcaccggcgcagaggcgcgcggacgcggcggcgccgtcgccgcgggcgtcatcggcggcctggccgcgggtgccctcgtcggcgccgcggcctcgaacgcctacggctacggcgcgccggcctacggttacgactacgggtacggcggcggctatcccgcctacggctacggcggctacagcgatgttggctacgcgccgacctattcgcgccgcgtcgtgcgcagctacgattacggctacgccccggccggctacggctattccggctattcctggggcggtcccgcctacggctacggctggtaa

SEQ ID NO: 9671 - DNA, 291 bp, Methylobacterium sp.
atgcagatcaagacgatcgccgtcgccgcctcgctggttctcggcctctcgggcgccgctctcgcccagagcacgcagccgggcgcggccggtgcgagcgatccggccatgcgcagcggccatggcatggaccgctcgatgaaccggatggacccgaacaccagtccgggcagcaccggctcgaccggccgcgagggcggcatgggcaacatgggcggcggcagcggcgccagcagcaacaccggcgtcggcctgggcaaccagggcgccaaccagggcgcgcgccagtaa

SEQ ID NO: 9672 - DNA, 156 bp, Methylobacterium sp.
atgtctctcgtcaccattctgctgatcattctgatcattctcgccttcggtggcggcggcttcctgggcggcggcgcctatcgcggccccggcttcggcctcggcggcatcctgctcatcatcctgatcgtgctgctcgccaccgggcggctctga

SEQ ID NO: 9673 - DNA, 864 bp, Methylobacterium sp.
atggatcaggagcagagcagtcggcccgatctcgcggacgcccgtcatccgcacgcgggtgtcttcgcgcggaccgcatgcgtcgaggccgatgtccggcacgccgtgcgccacgccggcccatcgggtgcgcgcatgcccgcgatcgccaggtcgcccgccgcggaggcggggacgctcttcgcccgcgccccggatttcgcggccctgggccccgaggcccgcgcggcgctcgagaaggccgcgcacaagcggcgtcacgcgcataacggcttcatctaccttcaggacgacgaggccacgcacctgtacttcgtcgtctccggccacgtccgcatcgcgtcgctgatggaggacggatcggcggtcctgcacgccatcctgccgcccggcgagagtttcggtgagctcggcgtcttcgacgggtcgacctgttgcgacatggcgacggcgatcgggccgacggtcacggcggccatctcggtgcagagcctgagggtcctctccgagcgccatcccgagatcggtgcggcgctcggccgggtcgtcgcccgccgctaccgcggctacgtgctgctgacgcgcgacctcagcctcaagaccctcgccgcgcggctcgcccaggccgtgctccgcctcgcgggccatctcggcacgcgcacgcgctaccgcgaccgcgaggtcggcacgctgggcagcacggtgacgcagaccgatctcgggctgatggcgcgcggctcgcgcggaaacgtcaaccgcgtcctcaagacctgggagcgggccggctggatcgccgtcgccgaccggtgcatcctgatcctcgaccgcgggcgcctcgaaggcctcgcggcggaggattgctga

SEQ ID NO: 9674 - DNA, 240 bp, Methylobacterium sp.
atggacgcggatcgctccgggacggaggcgtccttcggcatgaccgacctcgaggaagccctgcaggggccggaccgcgcggccgtgcgcgccgaagccctggcgcgcctcgacggcgcgctcctccgggtcgaggcgcgcctgcgggagggcctcgacccgcgccagttcgcgtcggcggagagcatccgcgccgcgctcgtcaccgcgcgcgggctgctcgccgccgcgccgcgctga

SEQ ID NO: 9675 - DNA, 309 bp, Methylobacterium sp.
atggcgggagtgggaacctacggccagtacggcgcgacgcaggcgacgccgaccgatgccttcacgcagccctacaagagctacgacggcttcgacctgatctggcgccagaacaacctccagaagcagatgaaggacatcgagacggatatccgcaacatcgagcagaacgcgaacctctcggacaccgagaagatgttctcgatgcagatggccatgaactcgtggtcggccatcagcaacctgcgcaccaacatgctgaagacggtgtccgacacgctgaagtcggtcgcccgcaacgtcgcctga

SEQ ID NO: 9676 - DNA, 1185 bp, Methylobacterium sp.
atgtccggttcggccgagatcacccggcagagcgttgcggccttcaacgcgatctcgcccgtgggcgccgaggtcatggaggaggcgcgcggcagctaccgcggcgaggccgttaccctcgcctccgacgaggcgaagctcgccgacgcggccgaggagatcggcatgtcggtcgcgcaccgggccgacaagaaggcgctcggccagcgcagcgtgcgccagggacaggcggcctatccggaggcgctggcgcgcctgcgcgagtacctcgacgaactccccgacatgccgcgggaggccgaactcgtcgacctcatcgagcagctggaggccttccaggacctgctcgcggggacgggggagggcggcgcgggcgcgacgaaggaggacgtgctcgccgccctccacgccttcgaccccgacgtcacccaccagttcgccggcctggagatggcccgcgcccagttcgaggcgagcggggcggacccggtcttcctcgccctcctcgacgaggcccgcgcaacctacgagacgagcgaggtcgcccgcgacgtgcgcgcgggcttcgcggcggcgggcatcgccgcgcgcgcggccgagaccctggagaccgatccggcggccgtgcgcgaggtctaccgcgcgatgctgcgcgacacgctgcatctggggcagctcttcgacgcgctcggcaggttcgccctgctcacgaagttcgagacggcggtcgagactttcatggcggcggccggccgcgacctcggcagcgccggaccctcgacggacccgctcttcctgcacggcctgctcaccgaactcgccaagctgaagaagatgcagtcggccctcgacgggatgagcgacctcgtccggctgaccgagcgaagcctgcccgccgggcagcgcggcgccgacgtggtcgcgctcacgagccggatcctgaacttcgcggcgagcacgggcgtcggtgcggccgacgcgcgccggctgctggggtccttcgaggatcaggcgctgccggttcagctcgccttcgccaacgggctgcgcgggctccacggcgagctgcccgacgacgtgatgccctcgctgccggcgcgcctgcagcaggtcggggcgatcatggcgctcctcgacgggatcgtcgcggcggaggagcgcgccttcggcgagggccagcgatga

SEQ ID NO: 9677 - DNA, 378 bp, Methylobacterium sp.
atgagcttcgggagggcgagcctgggcgtcgtcgagggcttcgccgcgcagctcggcctgccgctgcggcccgcccgcgacggcagcgtcagcttcgccttcgcgacgaccggaacgctctcgctgacgccctccgcggacggaagccggatcctcgtcggcctcgcccgcccgttgcgcgcgcccgatagcgggcggctggagcgcgccctcgcctgcgcggggctccagccagcgacgggccgcgtggtccgggccggcctctccggcgacgacagcctccatctcgtgctggagctgccggaggcggcgttcgacctgcccgccctcgatgtctgcctgcaggaactcggggccctgcacgatcgggcggcgtga

SEQ ID NO: 9678 - DNA, 186 bp, Methylobacterium sp.
atgccgatcagcacgatcagcgattttattcagttgtactcgaccggcatcatctcgcgcgagtgcctcgaacatgagatccgctcctggaccgacgcggacgaggcgcaggaccggacgcccgagaccgagggctgcatcgtcctctatccggatgcctcgggcatctggcgcgcgccggcctga

SEQ ID NO: 9679 - DNA, 402 bp, Methylobacterium sp.
atgagatccatcggcagggccatcgcccccgcgctcgccctggcctgcgccgcaatctccgccgccgaggcgcggcaggcggctccgccgcgcaacctcgagtgccgcgacctccgccgcctgagcgacaacttcctgctcgacctgcgcatccggctggtcttctcgcggccgcggcacagctacgtccgcctggagaataccgggcgcggctggcagccggtggcggagcggcgctatctcgcgatcgagccgacccgcatcgtgctcgcggacaacgccgccttcaccacctacatcgagcggctgacgggcgattactaccacgtcgatcggacgcggacgggtctgtcggtctggggccgctgcgccctcgcgggcgggctgaaccgtctgttctag

SEQ ID NO: 9680 - DNA, 2064 bp, Methylobacterium sp.
gtggccgaagccgcctccgacaccgtcatcctcaagatcctcaccggcatgcaggccggcgtcgaggtcgcgctcgggcccggcgagtacgggctcggcaccggtcccgaggacgacatccagctcatcgacgtcagcatccgtcccggccatgcgcggctgcgggtctccggcggcgccgtgccgggcggccggatcgcgctggcgggggccgcaggcgcattgcggaccgccgcgggcctgcggatcgagcccggcagcggcttccacgagatcgagccgctcgacgtcgtcaccgccgggaccacgcgcttcgccctcggccatcccacctcgcaatgggcgaccgttctggaggatgccgacgcgccgcccccgagccggcaggccgcgccgctcggcggcgagcgcctgcgtctcctggcggtgcccctcggcgccctcgcgctgctcctcgccttcgcgggctggctggtgctcggcggcggcctgacccggatcgcgggccggatggagggcacgcgcgacgatctcgcgctcacgcgcgcggccctcgaccagttcccgttcggccggacggtcgcggcccggcaggaggtggacggcgcggtctacgtcaccggctacgtcgataccccggtcgagcgccgcgccctcgtgggcgcgctcgagaaggccggcgttcccgcgcggacccgcctctgggtgctgcagaccatccgggcggaggtggagagcctgatcgccgcccagaagctgccggtcgggttccggctctcggagggcggtgcgctcaccctcgacgggctgatcctcagcgaagcccgggcgaaccggttcgtcgagctggtcaaggaccgggtcgtcggcctcgcggaggtgcagtcccggatccgcacggcgcagaccctgctcggcgaggtcgagcgcctcgcccaggcggcgcaggtccagccctacgtgctgctgcgcgtcggcgacgacctgatcgaggcgacgggggcgatccccgccgagaagctcgacgccttcgtgggcttcctgcagagctacgcccgccgcttcgcccgcgagatcccgctgcgctccttcgtgcagctgcagggggcgggcgggagcgagcgggcgatcctcgtggggggcaccgccaccggctccgacgtcgcgctcgatccggaccagctcgcccagggcgggtaccgccccggcgacatcgtgccgggcgccggcggccgcgtcgcgggggcgcgcgcgacgaccgtggtggccgatgcgggcggggagggggcgctcgccgcccggcgcgacgcgcccgcgcgcgcccagccggacaccccgccggcgcgctccggcgccgccgcgaacgcggaccgggacgcggaccgggacgcggaccgggtcggggaccggacccgcgacctgctgcggcgctggcgggagggccgcctcggcaacgatccgaaggcccgcgccctgaaggaggcgctcgacgccctgcgggccaccgacccggcggcgggcaggggcgcgacgccgccgggctggtacctgccggtcctcgcggacgcgccggaggccgagggggcgccctgctgggccgagacccggctgcgcccgcgcgacgccgtggcggccctgttctggctcgatctcctcagcaccagcgaggccgtctccctcaccgatcaggagcgggggctgcagccggtgctcctcgaggtggcgctgaaccccgtccgggccgccgcctgcgcccgccggacgccggagggcgagcgggcggccgcgcactcggtctacctgcgcgagatcggccgcaacccggccttcctccgcttcatcacccgcgacctcgccccgttcgggctggatctgacgggggtcagcctcgtgccggcccgctacgtcctgacccgcggcgggcgccggctgcacgagggcgccgcacccgaccagaccagccgcgtcgcggccatcggcgagctcggcgtcgcggtgcagacgaaggccgggctctcggcggtggtgttcgagcccgatctgagctggaagatcacgcagtag

SEQ ID NO: 9681 - DNA, 459 bp, Methylobacterium sp.
atgcaggacgtacatcaggcggtccaggcgctcggcgcggcgatcgggatggagggcgtcgcgttcgacggggccggcaacctcaccctaatcttcgacggcgcgatggcgatcaacttccacgcgatcgaggccggcagcttcgagctgtgggccgacctgcccgacctcggcaacacccgcgatgccgagctgctcgcctcggtgctcgccgccaatcatctcggcgagggcaccggcgccgcgcgcctcgcgctgcgcccggaccgcagcggcttcgtcctctgccagcgcgtggggatcgccggcgccgacacgtcggcgctggtcgagacggtggcggccttcgtcgcctccgccagcgcctggaacgcgcgcgacgccggccgggcgttcgccggccgggacgccgccgcgaccgagccgggcgagcccggcttcagcatgatccgcgtctga

SEQ ID NO: 9682 - DNA, 1122 bp, Methylobacterium sp.
gtgagcgagggcggcgagaagaccgagctcccgaccccgaagaaggagcgcgacgcccgccagaaggggcaggtggcgcgcagccaggaggtggtctcggccggctccctgatggcggtgatcgcctatgtctggctcgcctggggcgacatcaaccggcggctcgccgccctgttcgacgtggtggcgcagctcgccctcggcgagttccgcgtcagcgccgccaacggcctctccatcgtcggcatggaatgcgtgaagatcctggcgccgatcgtcggcgtgacgatcgtggccggcatcagtacgaacgtgctgcagttcggcgtgctcttcgccttcgaatcgctggcgccgaagctggagaagatcagcccggcggccggcttcaagcgcatcttctcgatgaagcagatcgtcgagaccctgaaatcgatcctgaagatcgtgatcctgtcggtcctgctctggtacgtgctacgcgccgcgctcggccccttcgcggtctcgatcggctgcggcctgccctgccagatcaacctgacgcagacggtgctgctccagaccctgctctactcggggctggccttcctgatcgtggcgctcgccgacttcgcctaccagaagcgcagccacatcaagagcctgatgatgtcgaaggacgaggtgaagcgcgagtacaaggagagcgagggcgacccccacatcaagggcaagcgcaagcagctcgcccaggagctggtgatgagcgagggcggctcggccgcccgcaagggcacggccgtggtcgtcaacccgacccacttcgccgtcgtgctgcgctacgacgagacggacgccccggtgcccgtggtcaccgccaagggccgcaacctccaggccgtgcacctgcgcgccgaggccgaggggtcgggcgtgccgatcttccgcaacgcgccgctggcgcgccagctcttcgcggacacgggcgtaggcgagacgatcccggacgagctgttcgacgcggtggccgaggtgctggcctgggtcgcgcgcaaccgcgaccgcctctacgcgggccgcctctcccacggcgtgatcgacatggaggccggcgaccaccggccgccggggcagggctga

SEQ ID NO: 9683 - DNA, 186 bp, Methylobacterium sp.
gtggcggcgatgctcggacggatctgggaaggcacgaaggtgaccctcgcgctgctggcgatgatcgccgccgcgctgatctccgccaacaagctcgatcacggcaggcgggatgccgcccgcccgggggacgtcgcgcggcaggcggcggaaccggcggtgaccggctccgtcgggattcgctga

SEQ ID NO: 9684 - DNA, 318 bp, Methylobacterium sp.
atggtcgagaggatccgtgtggtcgccccgcccgcgctgccgcccctgcgggatatccgtccgccgcccgcctggcgcggccgaacccccgatgccgcgcgcctcgcacgcctcaccctgtgcctggccgccctcgccctgcccgttctcgggagcaaagccgcggacacggtccaccgcggcggcgcgccgggaccgcagcaggccgccgtcctgccgaccccctccggccggacggcggctccccaggcctcccgacgcgtcccggcgttccgggaggccgccctcgcccatccggacgcggagccgatccggtga

SEQ ID NO: 9685 - DNA, 153 bp, Methylobacterium sp.
gtgacgacccggacgacggctgccggacccgctcgatccggaccccgcacccccgacatcgcggagggttgcggcggtacccgggtcatcgacttcgcgatctgcctgatcctggcggtgagcgtggtcggcctgctgctcgcggcgctctga

SEQ ID NO: 9686 - DNA, 309 bp, Methylobacterium sp.
atgccacggtacttcttcgacgtccggtccggatccggcctcgtctgcctcgactaccagggcctcgattgtgccgacgacgcggcggccctcgagacggcgcgccacggtgcgggcttcacctcgcacgcggactgcgcccgcaacccgcagctcacccgctaccgcttcagcgtgcaggacgccgagcaccggccgctcttcaccgtacccttcaccgagctcgagcccgatgctccgccggcccgcaagcgaccccgcggagcggggcgcggccgcgccggccggagccgctccttcatgcactga

SEQ ID NO: 9687 - DNA, 279 bp, Methylobacterium sp.
atgatcgatgccgtacagagcgcggccggcggcatggctgccgcccaggcgcgcttcaccgaggccgccgtgcaggtcgcccgcatgcgggccggcccctccggcacagggcagcccaccgggcaagctcccggaaccgacctgccggccgcggcgcggatcgagctctcgcaggcggcccaggagatcgctgcgtcgcgggcggacttcgccgccaacgcggccgtcgcccgcgccgcggacgacacgacgcggcgcctgctcgacgtgagggcctga

SEQ ID NO: 9688 - DNA, 186 bp, Methylobacterium sp.
atgcaccggaccgtccagccgctcgagggagcccgccgccagggtgcctgcgccggcttcgccgcgagcttccgcacgcgctacagcgaagtcgccgccgagcccctgcccgcccggcacgtcgacctgatcctggtcctccggcggcaggagcgcgagcgcgcccggggcgcggatcgccactga

SEQ ID NO: 9689 - DNA, 294 bp, Methylobacterium sp.
atggcatggtgccgaatgatctctctcgaagactgcgcgcgcgatctccgcgcctacatccgagccggaaaccgcgaggacctcggcgcagcgcagaatctgctgctccgcttcgcgctggaccagaaggacctcgcagcacgggcggcggccctggacgacttgcagatagagctcacaggataccgcgtgcccgacatgacgaaccatcagcgggccttcgacacggctgtcgcgggcatgatcgagcagaccaggagcgtggtcgcgcggcagatcgggcccgtacggtaa

SEQ ID NO: 9690 - DNA, 129 bp, Methylobacterium sp.
atgccggatcgcgagacgtctccggaaggccgcgtggagcaccgggcgctcatcgacgacacgggagggcagatcgaacacccgcaggaacggctcgacgccgcgaccaggtcgcggaagcacgcctga

SEQ ID NO: 9691 - DNA, 114 bp, Methylobacterium sp.
atgatcgccgcctcccgcaccgtcatcctcgagcaccgcgagatcgcgggcgtgctcgcctcctccggcctgttcttcgccggcctgctggcgctggcctgcctggtcggctga

SEQ ID NO: 9692 - DNA, 132 bp, Methylobacterium sp.
atggttctggaagccgcggtcaacggtcgtgcggacgccatcgtgacgttcaaccaagcggatttcggcaccgtcccgacgtcgttcggcatcgcgttgctcggtccagcggacgttctgaggagatcctga

SEQ ID NO: 9693 - DNA, 258 bp, Methylobacterium sp.
atggcagccggcggccattacgcccttcgccttcccgcttccctgaagcaggccgccgagacggttgcgcgcgcggacggcacgagcctgaaccagttcatcgtgaccgcggtcgccgagaagctcgctgctctcaagacggccgattatttcgcggagcggtcgaagcgcggcgacccggtcgccttcgaccgcttcatgaacaggcaggggggtcagccgccagcgccggaggatcagtgggacccggccggctga

SEQ ID NO: 9694 - DNA, 267 bp, Methylobacterium sp.
atgcgttcgacagctctcgccttcgccgctacgctggccctcaccggcgcggccttcgcgcaggcgaccacgacgcccggcagcacggtcggcaacccggcaggcagtgccgagcggaacctcaacaacccgggcagcgtgaagagcaatgccgagaagggcatgccgggccgcgacatgccgggcgcgaccggcaccgtggcgccgggcagcaccggcaccggcacgacgatgccgcccgcgggcaccgcccccgcggcccgctga

SEQ ID NO: 9695 - DNA, 1221 bp, Methylobacterium sp.
gtggtcgcgatcatggtgtcggtcgcagcgatgatcatcatcctgtacagaagtgtcctgcacgtcgaatccgccgatgcgcactggtggtttctgccctggctgaggcatatcctcgatcacggcgtcgtccagacgctctcgatcaaccttccggtgctcgtgcccgaggccaataatgcgggaaactatacgcctccatacctgtatctgctatcggtcggcagttacgcgagcgcgttcgcggacgatctaaccgtcatcaagatcgtgtccatctcgggcgcgatgttctgtgccgcctcgctggcttacctgctctcgggctacgctcgccgcgagatcgcgctctgcggcgcgatcgcctacctgctgctcccgagcgtcgtctcgaatgcggcggcctggggccagatcgagtcgttctacaccgggttcgtcctcatcgcgatcgcccgggccggacgggacgatctcgtatcctgcatgatcgccttcggcgtcgcggtatccatcaagctgcaggcggtcttcatcgcaccgtttctgctctacctcgtcatatcgcgccgggcctcggtcggcctcctcgtcatacctccgatcgtctacgcgctgatgatggttccggcctggatggccggacgcccggccctcgacctggcgatgatctacgtcgagcaatcgcacgcctatccgtggctctcgatgaacgccccgaacccctggacgttcgtgcagtacttccgtctgatccctcagccgaccggcatggtcctggggatcggcgccggcttggtcgtcggcctgacgatcgccggactcggcttcgtgcgcagggattccgggcgcagggacgaggggcccgagcttctgctgatcgccctggcgagcgcgacgctgatcccctacgtcctgcccaagatgggggatcggtacttcttcatggccgataccctgtcctacgccctcgccatcgctcacacgcgccgctggtcggtcggcgcagcgctcgcgatccagatcggttccttcggcgcgtatctcacgcatttcacagggtatcgcgtcggaaccggcctgggtgtgctggcgatgacggtcgccgtcatcgtgatctgcaaccgagtgctcggcctctggcatcttcggcagggcgcgcgatcgttcggcatccggggccgcgtcggcgaagggcagccggtggtggagcgtatctga

SEQ ID NO: 9696 - DNA, 591 bp, Methylobacterium sp.
atgagggaggccgcggaacgccggatcgaaccggccctcggaacggcgcccgggacctctctcggattgacgccgctccagcgcctcgtcgccccgggcgatcacgagcggatcgtgcggatcttcggcgccgaggccgcacccgaggcgacgcccgaggtggcgcctgcggccacgttcgaggccgagacggaggtcgccgacccgtccgatccggaagccgacctcgactggccgtccgcgatccagctcatccgcgacgcgggcggacgcgtccggcaggtgcgcgcgggcgccgaggaggcgacgcgccgggcgcacgccctcgtcggccgcagcgctcaggaggccgaggccgccgagcagcgcgcccgcgcggcggaggccgcggccgcggcggcgcagcggcgggcggagcaggccgaggcggcgctggcggccgccgaggctcggatgcgccgggccgaggaggagaccgccgccgcccgcgccgccgaggccgaggtgcggctctggctccgtcgtctcgtcacctgcctgaagaccgagttcgcggagctggccgagggcccggacgccgcgcgggcctga

SEQ ID NO: 9697 - DNA, 102 bp, Methylobacterium sp.
atgctctcaaaggccttcacctacgcgatgatcggcgccttctcctgcggactgatcgcgaccattgtcggatcggccgacgtgctgatgagcgtgaactga

SEQ ID NO: 9698 - DNA, 267 bp, Methylobacterium sp.
gtgacgaagacccggacgatcgccctcgccctcgccctcgcccttccgtcgacctcggccctggccttcagcttcagctacgagaggccgcagcgccacgcggttccgtcgcccccctacggcagccccccctccgcgggcctgggcgtgcatgacggggcccattacgagcgctgcaccgcgagctcggcggccgagggcaatgccaaccagcagacccggcccgtgaagcagtacgggcagaccgccggcggctaccgctgctga

SEQ ID NO: 9699 - DNA, 162 bp, Methylobacterium sp.
atggccaccatgatcagtctcgcctgtctcgccggcggcgtgggtctcgccgccctgtcccttcgccgcccggaccgggcggccaccctggagcgctggagcggcgtctgcctgctggccgggctcggcctgctcggcttcgccctgcagggaggccgctga

SEQ ID NO: 9700 - DNA, 87 bp, Methylobacterium sp.
atgagcagattcgaagacctgaagttcctcgtgacgctgacgctggtcgtgctctgcggcagcggcctcgacgccctgctgcgctga

SEQ ID NO: 9701 - DNA, 282 bp, Methylobacterium sp.
atggcaccgggttacgagatcgcgctctggctcgaagggctgggccttgccggcctcgccgtcggtctctggcgcctgcgcgtcgaggaagcggcgcgggttcgcggcctgagaacggtattgcgcacgggatccgatgcgcgcatcgcggccggcgcccgccccagggcggaccggacccggatgattccacacgtgacgggccggggcggcacgcgcaccgggaccgtgcccagcgccgcggcccacgccctggcgcgcgccttcgcacgcggggcctga

SEQ ID NO: 9702 - DNA, 1317 bp, Methylobacterium sp.
atgcagtccgcgtccccgatccccgcaggctttgcaggcccgggctggcccgcgctggccgccgggcgcgcgagcgcggagtcgcgcctcgtgcatctgccgtattggctgatgctcacggcactgaccttcaacgccgcgctcgccttcgtcaacggcaacgtcaagccgctgacgcccagcgtcgtgatcgccctcgaagccgcgttgacgctcggctgtctccttgtcgcgctcctccatcagaagcgcgagatgaacctcgccctggcgttcatcgtctggctgttcctcttcatggccctgcgcagcgcggtcgttgacccggcgacgagcgtcaaatatttccgcgatctcttgatcgcgccgacattcttcatgctcggcctgtgcaccgatcgtcgatacctcaaccggtacgtcctgatcggccacacgatcgtattcctcatcggcgccctggaagctttccggacggacctttactccagcctgttccacgtcaaggactacttcatcgcgacgcgcgggctgagcgaggccgacttctggaatacggattccgatctcttcgtcagcgcgacgcgcccgaacgcccgcttcctgagcatcgcggacgcggtgatggctaaccatcgcgtttcctcgatcttcctggagcccgtctccctgggcacctactgcatcatcgtctcggcctatgtcttcgccctctggcgcagcctcggctggaagagccgggcctacctgctcttcaccaacctgttcctcatcgccgcctgcgacggacggctcgcgttcgtgaccttcttcgccacgctgttcgtctgcatgttctggcggcggtggtctcgctatctgcccgtactctaccttccgggcatcctcatcgcggcctttgccttcgtgtatgtcgccgatcccgtgcgcggcaatgatgacttcgtgggccgcgtcgcctggacgacggatctgctggaatcctacgacgtcgcggaatacctcggcatgtccgaagccttcatcgagaaggcggtcgacagcggcatcggctacatcatcacgacgcaatcgatcttcggcctgatcctgttctggatcctgtgctcgtgttgctcccgctacgagacccgcgagcagatctgctacaaccacgcactctgcctctacgtctgcttcaactcgctggtcagctacggcttcctgaccatcaagaccgccgcgctcctgtggctggtgaagggcatcctcgaagtcgggcagacgacgccgggcacgggcgatgcgcgcccggcggcccgatccctcgcacgatag

SEQ ID NO: 9703 - DNA, 282 bp, Methylobacterium sp.
atgctgctctttctcgttgctgtggcggtcgtcggcgcgggcttgagcattgcgatcctgtggttgccggtgctgttgctcggcatccttctgttcctggccgtgctcatctacatggcgccgaccgaggggatctggcccgcgctcggctccggtgcgttggcgctcctgaccctccagctcagctacatcgtcgcgggcttcgttctcggcaggtccgagcgcgccggcgcgacgtccggcctcttccggcgtgccaagcacgcgcattcgaagaagtag

SEQ ID NO: 9704 - DNA, 642 bp, Methylobacterium sp.
gtgacgggtgtcctgatcgtggacgatcacccggtgatcctgcagggcttccggcgggtggtcgaggatgctggcgtcgcgatgatcgtcgaggccggcgatccggtctcgggctaccgtctgttccaccggatccggccgctggtcgcggtggtcgatctggctttccggggcagcgggctcgcggggctcgcgctgatcaagcgcatgcgcgcgctcgagccgcgggcccgaatcctcgccttcagcatgcaccgtgatcccgtcatcgccgcgcgggcgctggaggccggcgccatcggctacgtcttcaaggattcgccggtccaggatttcctggcggccttcgacgccgttcgagaggggaaaccctacctgccccatctgctcgcaacgcagatcgcaggtcttggcgcggtgcccgagccgtcgcgctacgacgctctgaatgcccgcgagatccaggtctccatcctgctccgggaggggcgcgattaccggttcatcgccgacaacctgtcgatcggctaccggacggtggtcaacacctgcgcgtcgatccgcaagaagctcggtgcgcgcacgcaggccgagcttctgaggatgatcatcgcggtggagaaactggaatcgcacgggtga

SEQ ID NO: 9705 - DNA, 147 bp, Methylobacterium sp.
atgccccgctggttgttcgtcatcctcgccgccgccctcttcctgagcgtggccggcatcgtcctcaccttcctgcggaccggtccgacggatcatcagccgtccgccaagccgtccgcggcggccccgcgcggcgccgcgccctga

SEQ ID NO: 9706 - DNA, 246 bp, Methylobacterium sp.
atgggcaccgggaaacgatacggcacggatcccgccgcggacgcggccgagatcccgggcgtgacattgcagcggatcgccgccgctcttggcgttccgatcgcggtcttcatcgagggcgtcgcggtcgagccccgtctccatgagacgctcgagctgctgcgcttatggtccctggtgcgcgagccggagctcgcgcagcgcgtcctggccttcctcgcggccgtcattgccgagcagagctag

SEQ ID NO: 9707 - DNA, 510 bp, Methylobacterium sp.
atgcggatccggatcgcgctcgcctgcctcgccgccctcatggatctctcctggggcctcgcgacggccgcccaagcccgaccagctcaagccagacaggctcaaacccgacctgccaccagctacgtctccttccaaccccaggtccgcggcctcggctgcctgcagccgcgcacgcgcgcgatggtcgcccggctgaccgcccgcgtcggaccgatcgagatcacctccacctgcggcgggcgccacgcccacaactcgcagcactatcgcggggcggcgatcgatttccgcccccgcaccgcctcggtcgcgaggacgctcgcggtgctgcgcggcatgccggaggtcggcggcatcggttcctacgcgggcggcctgatccacgccgataccggcccgcgccgcctcgcctggcacgggagcgtccgccaccgcgtcgcccgcgcgcaccgctcctacgcccgctacgcggcgcggcgcggcgcgcaccggtcgggctccgtctga

SEQ ID NO: 9708 - DNA, 285 bp, Methylobacterium sp.
atgctcaacggaccgttccaaggcctcccgggctcgtccgagggctggaccgcgcacgaggcgtggctcctgccgatcacggacggcgtcgccgccaaggctccggccgcctcatcgcccgccgacacggtgcgcgccgccgcgcgcccgctcttcatggccgccaacgggctggccctggcgctggccctgctgctcgccgccgagacctcgacgggctggatgggcggacagcgcggcgtgcccgtcgccaaggccccggtcatcaccgcgagcgcctcgtaa

SEQ ID NO: 9709 - DNA, 189 bp, Methylobacterium sp.
atgacgaagaccgacgtcgatacgcgccacgcgagcctgcagcgcgccgagcgcgcggcgggcgaggccttcggttggccggagacgcctgtcgaggcagcgcgtcgctccctgctcttcaatcccacgacaatcgccgccgcaacggcggtgacgacggtcgcggcgacgctgacctacttcgtctga

SEQ ID NO: 9710 - DNA, 213 bp, Methylobacterium sp.
atgtacgcccccagcgagacccaggtcagcgcctccgagagcgagcgtcgccagatggaccagggcgagtcgctctacggtttccgccccctcgcgctgccggcgctcgccgccgcggcccgcccgaagaaacgggaatcccggcccgccgtacccgcgaccggacggcagggcatcctcagcctcgtccacgaggacgagccgctagcgtaa

SEQ ID NO: 9711 - DNA, 294 bp, Methylobacterium sp.
cgggagggcgccatgactgatgccgtggccaatccgcagcacgcccggatcagggcgtcgggggacgagcgcctcctgcggatcgcggaactcgtcggctgtcccgtcgaagcgttccgcacccctgagggcgacgcgctcagcgacgcgctcgaactggtgaagctctgggagcggatcgatggcacgggccgcgcccgtctgctcgcctgcgcccgcacggaggcggcgcgcacgggcgagttgcaaccgaccggacctgctggggcaggcttccacagtcccctgcgctga

SEQ ID NO: 9712 - DNA, 1050 bp, Methylobacterium sp.
atgccggccgacgcggtcggcgtctggaacgccctggtcggccggaccggcgtgcccctgccgctgcgcggccaggccgcggcggtggtggagctcgccgagccgcccccggccgatgccctctgcctcgacctgcggctcgggccggaccttcccctcgtgctgcggccggtcgcctacccgttcgcggccgccttcggcgccgacctcgaggtcgccgacctgccgctcctgccggacgcgctccgcgatgcgctgctggcgggcctggtcgcgacctacacggcggcgatgccggatcacgatctcggcccggtcacgacccgtgcgagcgggcctctcggcgacctcgtgcggccggaagcggccgagggcctgcgctggttccgcgccgcgctccacggcgtcgcgccggggccggtcgcgctggatgtcggcgcccgcctcgacacgctggcgcggatcttcggtcccctcgccccgaggccggtctggccgggcatccggcaggttctgacccgcgaggccgccgtcacgctcgggcgcctcgtcctgccgctcgggcacttgcgcgccctcgcgcccggcagcgtcgtggtgctcgatgcgcgcgtcggccccgagcgcgcgcgcctgcggctcggccctgccctgttcgcgttcgaggccgcgggcggaggctggacctgcacggccgtcaccgcggccgcagcaccgcccgatcgtccggacgacacccgccaggaaggccccatgaacacgcttgtcccgaccaccgagacgcgggaggccgacctcgacgttgcctccgacgttgcctccgacttggccctcgacgtggccctcgacctcgacatcggcagcatcaccgtgccgctcgccgagatcgagacctggcaggtcggcagcctcgtcgccctcgcccccgagacgccgcgcgacgggctggaggtggtgctgcgggtgaacggccgcgcggtcggcgcgggcgagctcgtgcggatcgacgaccgtttcgcggtgcgcctcgtgcgcctcgcgctgggctga

SEQ ID NO: 9713 - DNA, 741 bp, Methylobacterium sp.
atgatccggacgaacccgccgtcgaacccgcacgcaaccgccgacttaccgacgggatacccgagcgataacacgtcaaacccgcggcgcgacccgttccgccagcgcgatccccgcgagggggcgccgcgcgacggactcggccgcgaggaccggcccggcacggaggcgggcttcggccgctcgctggccttcggcgagcgcatgcgcgacgcgatgcgggatcccggctccggcgagggacaggaggacgggcgggagcggcggcgcgaggacgagccgcgcctgctcgccgccgtcgagcccgagccggtgggcgttccgttgggcgcgcccgtgcccgccccggcggcgtccgtgcgcgaggccgggccggcggagaccggcaccgccgagcgcgtggcgcgcctctccgagcggctggaggcggccatccgcgcggaactctcggcgggcgccggccggacgctcgccctgcgcgtgcccctcgacgggctggtcccgggcctcagcgccgtcacggtggcgctgacgccggcagggctcgacgtgacgctggtccgggcagccggtgccggttcggccgatctcgccgaggccgcccaggcgctcgccctccggctgcggaaccggttcggcggccggggcgtgcgcgtgctggagcggacggaggcggccgagcctccggccggcgacgcgctggcggcgatcggccgcctgctcgggcgctccggcccgtga

SEQ ID NO: 9714 - DNA, 489 bp, Methylobacterium sp.
atgatcggacagatgaccattctgctgcgcctgaagacgctcaaggaggagcaggccctgcgcgcccttcaggccaagcgccggcaggtcgccgagggcgaggcggtgctggacgaggcgcgcctcgcggtgagcgcgagcgccgcgacgctcggctcccgcgaggacgcgatctacgcgggcatcctggggcaggtggtcgatcccggcaccctcgacgagacgcgcggggccgtggtcgccctggagaagggccatgcccgcctcaccgattcggccgagcgcgccgcctacaccctgcaccgcctgaccggcgagtgcgaggcggcggccgaggggcacagggcggccacgcgggtgcgcgacaagtacacgatcctgcgcgacgacctccgcgcgcgcgccgccgaggaggcggaagcgcgggaggaaggcgaggtcgaggagctgttcggccggcgccggccgggtccgggagagcggccatga

SEQ ID NO: 9715 - DNA, 657 bp, Methylobacterium sp.
gtggtcgcctattatcgcctgagcgagctcggctaccgcctcgcgccgggcctacaggtgctgcccccggaggcgttcgagccggtcccggcggcggccgccctgctgcgcgacgccgaggcgcgcgctgcggcgatcgtggccgaggccgagcaggaatacgcgcgccgcagcgcgcagggctacgcggacggcctcgcccgggccgaactcgaatcggtcgagcggctgctgcgcgagggcgcccagctcgatgccggcctgaaggcggtcgaggccgagatggcgcgcatcgtcatggcctgcgtgcggcgcctcgtcgacagcttcgacgacgaggcccgcacggtcgcggccgtgcggggcgcgctgcgccagatgcgccgcgagcgccgggccgagctgcgcgtcgcgcccgcccactatgccgccatgcgcgaccggatcgccggcatcgtggcggatttccccgaggtcgagttcgtcgacgtggtcgaggacccggcgctcgtgcccccgcagatcgtgctcgaatcgagcatcggccgggtcgagaccgcggtcgatgccgggctcgacgccctggaggcgatcgtgcggggcgccgccgcggggcattccgacagctcggccgacccggccggggcggcggcgtga

SEQ ID NO: 9716 - DNA, 741 bp, Methylobacterium sp.
gtgatcccggccgtcgcgctcgacgccgatcccgcggccgaggtccgggcgctcggcctcgcggcgcagatcgcggcgcgactggtgcggccgatcggccatttcgcgcccggtgcctgcccgctgccgccgctggagccggacgcgctcgcggcgctcgctgcccatccggccttcggggttccggtccagcgggcggcttcgcacgctctggcggcggaagccgcggggatcgacgcgggcctgatccggcgcctgcgcgaggccgcgacgacccggctcgccgcgctcctcgtggtgcagccgttacccgttctgcacgaagccgcgcggctgctggccggcgccatcctgcaccggcgcatccttgccctggtgctgaaggccgaccgcgagcgcctgcaggccgcgctcggccccgccgctttccgggtcgccacccaggaggccgccctgctgcacgcgggcctcgccgaggccgccgagcccgccgcgcaggccgcctgcctcgcggcggggagcccggacgcgacgcggggcgccgtcgtcgctctcgggctcgggacgctcggccgcttcgccgcggcggccgagccggccctcggccggctcgtcgccctgcgcctcggcgccgagccagggatcctgaccggaccgcccccgctcggcccgggggcctgcgagcacgtcgtgaggctcctacggcggaggatggacgcgtggtcgcctattatcgcctga

SEQ ID NO: 9717 - DNA, 498 bp, Methylobacterium sp.
atgcccgcgttgagcatgcaccatctgggcgtcgggtcggccgccggcgcgctcggcgacgggctgcgcgaagtcggcggcgtacagcgcgcagcttttcgggatgcgatgacccgcaaatcggcgaccggcccggccctcgacggccccccgccgaccgagccggcatcggttgctcaacccgttgttccggtccagcgcgtcggctttgagaacgattctgccgcgcgcgaccgcgtccggcgtacccttgaactcgacggcgcagtacgaccgaacgacggcgacactatcttgggagggctgcagaagctgcgcggcgcctttgacgcccgacatgcgcgcgtcggcgagatcatggcctcgaagagcgtcgacaccaacgcgctgctcgccatgcagatggaggtcgcccagtacaccctgctggtcgacgtgtcctccaagctcaccggcaagaccacacaatccctcgacaccctgatgaagggtcagtga

SEQ ID NO: 9718 - DNA, 375 bp, Methylobacterium sp.
atgttcgaaaccggtcaacttctcgatgccggcgatgtgcgcctactggtcgagatgggtttcactgccctctcccgtgggcggctcgccgaggccgcgacgatcttcgcgggcgtcgaagcagcccggccccgtgaggaggctggcggcatcggccgtgccctcgtctgcctgcatcgcggcgcagtggacgaggcagtgcggatcctacgcgttctgccaccttcggatgctgcgcgggccttcctgggacttgccgtcgcgcgcagcggcgaccaagcggaggcccgcgcgatcctcaccgaagtcgtggagaatgcgtccggcaccgcctccgctgggttggccgcagatcttctggcaggtttgacgtga

SEQ ID NO: 9719 - DNA, 555 bp, Methylobacterium sp.
gtgcgcgacgtgctgacgctgcccgagagccggatgggcgtcctcgcggccggaggcgggtccgaggtcggacgcacgaccgtggccgccatcctgaaggccgtcggcgaggccgatgcggtggaggacgcgatcgcccggctcgtcgcccagcacggggcgcacgcctgcgaagtgaccgagctgggcgggtcgctctacgcgcgggccgccgcggcggtggcggagggccgcattaccgaagccctcgcccccctgtcagcgctcgcaggtacccccggacatcgggcggaggcgttgctcggcctcgcggtctgcgcgacccgtctcgcctgctacgaggacgccaagatcctcgcggaggcgagcagggggctcgggcccggtcatccgcgggcgagctgcgtggccggcctgtgcgaattggaactcggcaaccgccgcgccgcgcaggaacacctcgccaccgccgcgcgcctggcacggcgcgatgccgcttacggcgaagacctgcgcgttgctcagcgcgccctcctcctcatgcacctcgcctga

SEQ ID NO: 9720 - DNA, 399 bp, Methylobacterium sp.
atggctcattccggcgggcgcacgggcacggtgcgctggacctcgacacaggatgcaggcgatgcggccgaggtctcgtccgagatcgaggcatggctcgcccggcagcccgcggcggcggattgggcgggcgtcctcggtgcgctgcgcgacgggctgctgcgggccgggctcgagccgggactcgcccgcgacgccaccgcgcgagagatcatcgcgggcctagcggaggccgaggatctcgaggcgatcgatgccgctctggcgggcctctccgtacgggtggacgcgctcgttgcgccgcgagagcgagcgggccgcggccctgcgcgcccgctcgccgaactcatgaccgaagtacgcggcgccggccagcgccgcgaccggatccggctctga

SEQ ID NO: 9721 - DNA, 381 bp, Methylobacterium sp.
atgaagatccgcaacttcgacatcggcctggaagcctacacccgggttggtcccggggaggatccgcgcctgcccagcgagggcgcgccggggccgagcttcattcccgagccggctcatctcgacgccgtgctgcggcgcccctctctagacgagcggctgccgcaggtactccagcctcctgccctcgatgccgacctgctggagcccgcggtgctgagcgaggtccgccgcggcacgcgtgggctgttcgcggaggcggcgcgccgggccgtgggccagcgccgccgcatcctcgaggaggccgcgctcatcctcgacgaggacgccgtgctggacgcggacgtgcgcagcgcgctcgccgccctgctcaaggcctga

SEQ ID NO: 9722 - DNA, 426 bp, Methylobacterium sp.
atgagcacgctgccgcttcggccggattctggcctcccggtcgatcccggcgccccgaacctgcaccccgaccggcggcaacgcgacttcctgctcctgacgatcttcgtgttggcgcagcagggctatgtcgaccgcgccggcatcctggccgaatcgctgcacctcgtcggcgacgcctcggccgagacccagctggcgcgggcggtgttgcgcttcttcgcgggggatttcgctgccgcactcgcggtgctggaggacctcgaccgcctcgcgccgatcgagcgcttcggcagctaccgcctggacgagcgccagcgcatgcgccgctacctcaaggcgcgctgcctgcacgaggtcggcgagccgggccgcgcccgcgacgccgtcgagatctacctgcgtcaccgcgctgacagcgtctga

SEQ ID NO: 9723 - DNA, 564 bp, Methylobacterium sp.
atgccctcgatcctcgatggcctgcccaggacccaagccgaattgcagaaggcgcacctcgctagcgcgatccagttcggcgagatcgtcgcgcaggccgatctcaccgcccggtcgcgctcgatcatcgacgcaatgggggagggtctttccctcggcgatgtgctcgggatcactcgcgaggagcgcgacgcgctgttggtgcacggcttccggcaactccagcaaggcgacgcggccggagcccaggtcaccctgacgcagctctaccacatcgagccgatggacgagcgcgtgatctacgcgctcgccgccacctaccaggctcaggagcagtacgcggccgcggccaagctttacctttgcttcctggcctacgacgccaccaacccgcagggctacctgcgcatcgccgagtgcttcctggccgcgcgcgagtacccggaagcggaggcgtacatcgaggcggcacgggtgcaggccgccggctctgcgtgcgaggccgatgtcgatcgccacgctggcgccttgagcgctgcgatccccgcccgacctgctgcctga

SEQ ID NO: 9724 - DNA, 159 bp, Methylobacterium sp.
atgacgctgttgctcgtcgtccttctggccccgctggtcgccgcgatcgtcctcgcgggcggacggcccggcccgatcatcggctgcctctgcctgatggggatcggctgcctgatcgcctgctcgggcctgacgcgcctggttcgtcagcgcgcctga

SEQ ID NO: 9725 - DNA, 720 bp, Methylobacterium sp.
atgacggctacagggacagttctcaccgacctgtcggccaatctctttgcggcactgctactgatcctgctgatcctgcttcaggccggcgccgacaggtcggacgaggggccggcgcagccggtagaggcggcgcaactggcagcgcgggagcacacgccactggacgccggtgcactcgtcacggccctgtatgaccgcaggcctgaagcagccgggctctccatcgacctcaccgaagcggaacctccgccgctcgacgcggtcgtgcgcgggcttgatccggatctgccgatccgcctctatgtcttctcgcaccgtcactactccgcaaccgccgcgctcctcaggaagatgggccggcgctggcaggaaatctccgtaccgcccgtactcggcgatgcagcgacgggctggacgtcggctttttgcgccctgctggcccgcaggcccgccccaccgcagttccgcgcggacctcgcccacctgctcggcgccgctgccgggccaccgctccgaggttcaggtggcgcgtccgatccgcttacgtccagcatgctgaggaaccccttcggcggctggctcggcgcggttctcaccatcgcgaccctgctcctcggcttcgccgccgtgctggcgatcgagtggattgtgccgcgccggctgccttgctacgcttgtcggcttgacgccaagaggtatgagggcccccgaccgtga

SEQ ID NO: 9726 - DNA, 489 bp, Methylobacterium sp.
atgctgcctgagaccgcagtggaggagggacccgagatcgatcccttcgccgacctcctctttgccctgatcgcgacagtcctgccggcgatcctcgttctcttgcccgtgctccatctcgcgacaccgcgccggtccgcgccggcctcggcaggggtggctgtcgggggacgcgaggccgcaacgatcgtcgccgaggcggcaggcctgcgcctcgtctcggcggacaaccggcagatcgcgctgagcgcagtcccggttgatcctggcctacgcgaatcgctcatgtccctgcgcgcgacggagacgccgctgcttatcctgatcgagccggccggcctggaggctgccttcctgctggagccgatcgcggcgtcctacggcccggtccgaatcatgcagttgcgggctgcgacgcggtgtgtcgaagctcgagacccggcactggcccaggcttgcgccttgccggtcaggacgttcgtgcgatga

SEQ ID NO: 9727 - DNA, 1158 bp, Methylobacterium sp.
atgcggcctgagcgagcctcggtcctcacgcgggaagtaggacgctcgaccgagcggctgcgcgtcgtcgcctatgggatggctctctgcatcgcctttgggctctacctgctcgttcacggcgccgggcaggggccgaccttctggtcggcttcgcttttgtgcggtgcggccatcgccgcgggtcttgcgcgtggcggaccgagcgcccgagccttccgctggggtgctgccggcgcagctctcatcgccgccgctctgccgctgctgccggcgctggcggagggcgcaccgatggaagctgcggtgcgcgttcacccgctgtggccgcagatcctggtgactctgttcgccgcccgggcactcgaggaggtgaatgagcagcgcttcgcagcgttctggcgggcgcctctgcgcacccgcgaacccgtcgccagccagtccattgccgccgcgctctcgctcggagcgtgcttcgcgctcctgttctatcagggcttgacccttctggtgccggttcagcaggggggcggcaccggcctcaccgatctcgtggcgcatgcgcttgccggcgagagcgcgatccaccgggccatcgttgtgctgttctgcatcatcctggccttcctgtgcgaggctgtcctccagcataggcgcgatcgtgcggcacttgccgccctgcgacaggcattggcgcaggggcatcgcacgacgcctgaggatctgcacggcctgctcgctgggccgctcgccggcttcggccatacacgaaccgtgagggctctcgcgcagggtttacggagcggcggcggcgcgccagcggaggatgctttcacggcggccttcgcggcctttcatggcgcatcacgccgcttcgtgcgtggattgctgcccttcctcccgctgctcggattcttcggcaccgtcgtgggcctcgcgaccgcgatggccgcactgccgacggagggcggaggaggacggatcgacctctcgggcagtctctcaggcctcgccctgaagttcgagaccacgctgctcggcatcctggccagcatggtcgccgcgctcctccttgctctgctggagaagggggagcaggaactggccgcggaatgcgccctgctcgcagcagtcgcggagcgtggccatgctgcctga

SEQ ID NO: 9728 - DNA, 1188 bp, Methylobacterium sp.
atgatcggcgagacgttgggtgagataccggttgcggtaaccagcaccgcaggggttgcacccggcatcgcgttgacgtcggcggggctctcccgcagcttcggagccgtgctcttcacgggcggtgcctccgggctgcgccctccgcggaacgtcgaggacgcggcgatccttttagcggaggccgctcttatgattgacgcggcgcggcgtgcggcaagcgatgcccggatcactggggcgaccgcctccgtgcgaggcggactggggaccgccgcggcgcagatcgctgtcgcgaacgacgcgctctacggcgtcgacgaggccggtggcggcctgatcgatcagaaggccgcagcctcttccgatcgggataccgcggtggctcgggacgtcgtcctcggcagcgaggtcgcccggctggagggtaggatcgtaacccttgacggagagatggcggtggtgcggtcggaggccgacgcaaacatcgcgtcgctcacggacgacaaggatgcgaagacggcgcagctcgcctcccttgatacgcggatcgcggcggcgctcagtgccaatgacgcgggcaaggtcgcggcgctccgggcggagcgcgcgacaatcgccacggccatagcctcgatcaatgggcaaatccggacgacccgcgaggaagccaacacccggatcgccgcgctcgcagcgcagcgcagcgcggcgacggctgaactcgctcaggcgaaagccgaacgcgccgcggttcggtcgcagatcgtcgccctcgacgcgcgcatcgccgaattgggcatcgcgatcatcgaggtcgaaagcgagctcgccctcgggcggaccgcgctcgtgatcgccttcgcgcagatggcagtgctggtgcaggacagcggcggcgaccgggcgttggagaccatgcgcggcactgagctcgaccaccgtctcgacgagttggaggaggctgcgaaggatcttcgggcgcgcctgctggcgcatttcgaggcggatgcccgcttggccggcgatcgccgagacgcgcaagcggacgcgcgggtcatggcggttgtcctcggtcttttcaccgctctggtggacgtcacggatgtcctgcgccgtgaggccattccgtcctccgaagcggatgactccgcagggcgcgcccagcggcgccgactggccctctga

SEQ ID NO: 9729 - DNA, 594 bp, Methylobacterium sp.
atggttgggcgtcaactgtcggcgcagctcggtcgtgggggaccggagctgcgctcgaagctccccgcgctggaacgcgcgggcacggatagcgaacgcggcgctgcgcaacaggacgccggctctgcggccctggggagcgccgcacaggagcgatcactttcggacgcgcagggactgcccgccctcaacgcttggagccccgccatcggaatcgccgccgagcagcaggtcgagcgcgctggcatcatcgcttccttcatcctcaacgccgccacgatacctggctggccgccaccgcgacctttcgcggcgccagcgccggagtccgttcgtgcggctctcatcatgacgccgggcctgtccgaggccgggatcgaggcgcagatgcgccgggacggggtgcgccgcacgctgctcgcccgcatgcgggctctgctggcccgcttgacccattcgcgccgcctgcaggtgatgctgggtctcaccatcctgctcggagcgatcgcggcaatcgaggccgaactcggcgatgtcgcgcgcgatactgacacggatgatatagaggcgggacgccgcaagctcagcgtctga

SEQ ID NO: 9730 - DNA, 579 bp, Methylobacterium sp.
atggtggcttcagatccggcgcgccgagatccattcgggctcgacccggaagagagcgcacttctggcctcgctcttcgtggaggccgccgccgacctcggcctcgacggcgcccgcatctacgcggccctgcgtgcaggccagacgctcggcgcagcgctcggcctgccggacggcgtcgtcgaagtcctctatgcgcgcgctcacacttggttcgcggccgggcgcagcgaccgggcggagccactgtttcgcgtactctgcgcccttgatggagcctgcgccgatcactgggtcggccacggggtctgcctgcatctgcggggcgccgattccgaggcgaccatcgccttcgctactgccgcagcgctgcggccggactgggccgtgccgcacttccacgccgcgggtctcgcggtggcccaaggtggctgggacagggccgccgagcatctcttcgccttccgggagcggcaggaccgggacacgccggaggcgcttgtccgcgaagccggacggcttgcggcagccctggctcagcgtggagaccggagggtggcgaaccgggagcgcgcctga

SEQ ID NO: 9731 - DNA, 489 bp, Methylobacterium sp.
atggaagcactcagcccacccggctccggaaccgagaccgcagcgctcctgaacggccacctccgcgacgcgctcgggcttcggtcggcggatctcgcgatcggcctggaggtcgcccgcaaccttctgcaacgcggcgcgaacgcggaagcgctgcgggtctatgcaggcctgatcctgtgcgagccggcgaacgccgccttccagacggggctggcgaactgtgcgctggcagcagaggagtaccaccttgcccttcaggcggcttccgcggtggtcgcgctcacgccgcgcgacccgcgcggctatctgatttccggccgcgcctgtcttggactcggcgccctcgcagaggccggcgaggatctgcgggaggcggtcgcgcgcggccgagaggcgcgagatgccgtcgccgtggaggaagcgtgccggctgctcgacgcgctgccggaccctgctcgcgaagccgatctggccgagaccaactga

SEQ ID NO: 9732 - DNA, 456 bp, Methylobacterium sp.
gtgtcacgcgagaccttcgcgagcgtggcggcggccctgtgggcgagtctcgggctcgcgccgccgcccaactccggaacgccgaccctgcggatcgacgggcgggcggtgcggcttgcgccaagtccggacgggatgcaggcggtgatcgaggtggcggtcggcaccctcgcggtggttccgcaccggcgggaggcacagctgcgccagatgctgcgcgaggggctcgggctggtcctcgacaaccgagccgccctcacattcggcgcggacggcaccgtggtggccctagcggcgggcccctgccgggtaacggaggtggcgctgctgcgtgggctcatcgaggatgcgctccacctcgccgagatacacggcccgacgctcgccgacgcggccggacccgaaccggacggcgggcttccggaggatgctgggagcctgatctttcgactatga

SEQ ID NO: 9733 - DNA, 915 bp, Methylobacterium sp.
atggccatcggttccttcccgacggagctccgctcctacctcccggccagcctgctgcaggcggacggcgccacgctcaagcccggcatcgacttggcgcaggctgaggcgcttgccaagaacgtccaggcgcaggccagtgcgctgcccccggcggaggcccgcctcttcctggcgatggtgtcgcaggccgacctcgcgccgaacggccagatcccggccgatatcggcaagacactcgccgcgttcgagggcgcggcctcactgctcgcgcgctcgagcggcagcacgctcgactttttagcgcgggttatgatcgagcaggccgccgagcagcgcaagaacgccctcgacagccgcttgagcgcccgcgagcaggccaagagcgaactcatgaaccaagccgcgaagatggagaaggcagccgaggaatcgaagtcggcggcataccaagcgatgatcacgaccgtcgtgatgtcctcggtcgcgttggccgcctcgaccacgggcgcggttctgggtggcctttccgccgtgaagcagggctccgccttcaaggacgccatcgcgagcgggaagacgatcaaggaggcggcaacgagcgcctccaccggcctttccgccgggtggaccaaggtcggcaaggctgccgacggtctcggtggtgcccagcaaatgggccaactcggccaagcgggcgggggctacatcagcgcccagggcgaggccgtggcaaagacgctggacgccgagggccagcgcgaggcggctcgggcccaggacagccaaaccaaagccgacctgtcgaaagacagccaggaggcgctgaaccagatgatccagtcgatcatccagttcctgaaggacctgcaggaggccaaagccgagcagatgcgcgccctcacgcgggtctga

SEQ ID NO: 9734 - DNA, 945 bp, Methylobacterium sp.
atgagcggcgtgatggcgagcctctcggccatgatgccgaaggtcagcgctcaggataccgacgttttgctcctgcagatcacgaccaagctgaaggagacgaccgaggcgagcgagaaggacaagatccgggccgacacctcgaacaagaaggtccagatcgaagaaaaacagaggaagatggacgaggcccaggaaaaaatcaaagccgctgaagacaagatgaagaacctgtccatctgggacaaaatcaagatcggcttccagtttctcagcgccatcatgacgatcgccgcgggcgtcatcgccgcgctcgtcggcgcggcggcggtcgcgaccggcgccctctcgccagccggtgtcgccgcgatcgcgggcggcgtcatgatggtcactgcgggcgtgctgatgctctactcggccatcgacgcgtcggtcgcggcctcccgcgaggacgggctcggtatcgcgggcctcatcgagaaggacaagctcatggcgcggggcaagaccgaggaggaggcgatccaggggggcgccgagaaggacaagctttcccgcaccgtcatcggcgcggtcacggcggcgctggccattgcgggcgcgatcgcggcctttccagccggcggcggcgcggccatcctcgctcttgccagccgggtcacgggcgtcgtcagcgcgatcagcaccatggccaccagcgcgggcgacatcacgaccggcgtcctgaagtacaaggccacggaagagaagtccgagggtcaactgaagcaggccgatggcaagcggatggaagcgaccatccaagtgctcgatggcatgatcgaccaggcgatgacccgcctgaagggcgccggcgaccgcttcaacgcgatgctcgacagcctgaccgaggcgatccaggaccgcggcgacagcctgtcccgcgtcggtctgagaggttga

SEQ ID NO: 9735 - DNA, 396 bp, Methylobacterium sp.
atgtcgcgcctcccctcgccccaccgccggcgcaccttcgggctgctcgccctcgtgctcatcggcacttccgctcaggcggccgatttcgatggggcctaccggccgcgcccggatttcgggcggggcttcgaggaggattacgggcgccggccgcccccgcctccgccgccacgcttcccgcgcttctcggccggtcccgatctcgcgccctcgccgtgccgggtcttcgtgaagcgccgcttcgatgccgacggcgagccggtgatccgccgggtgcgggtctgcgacgagccggacgatctcggtcccccgcgccgcccgcgcttcgatccgcccccgccgcgcgagttccccgatgagccccggggccgctgggacggcccgcgctggtag

SEQ ID NO: 9736 - DNA, 120 bp, Methylobacterium sp.
atgctctcggttctcgtctcccagtgccccgcccccgagcaggaggcggtcgaccgcgatcccggcctgctgaccctcgccttcgcgctggcccgaagcctgcgccgccgcctgacctga

SEQ ID NO: 9737 - DNA, 1170 bp, Methylobacterium sp.
atgcgcgacgccggcggcgacaccccgctccccgacgagcccgccaccggcccgcacgtcctgctgatccagccgcaggcggagaatgccggcgcccaggccatcgcccgcatgctggcgacggccctggcggagcgcggctaccgcacgggccagatcttcttctaccgcaagaccggcgccttcgacgccgagccgggcatcgccttctgcgcggccgagcggccgcgcacgccgctggccttcgggcgcttcctcgtcgatctcgtgctgcgcctgcgccgcgcgcggccggacgcggtgctctgcttccagcactacggcaacatcgtcggcgcggccgccgcgcggctcgcgggcgtgcccgtggtgatcgccaaccagaactccgcccgcgacacgaccccgccccgcgcccggctggtcgaccgctggctcggcgggttcggcctctacggccggatcgtggtgaactcgcacgattcggcgggcgacctcgcggattacccggcgcgctaccgcgcccgcgtagtgcatatcgaccacggcttcgtcggccgcggcagcgacctcgccccggccgaggcgcgcgcccgcctcggcctcggcgtccccccgggcggccgcctgctcggctgcgtcgcccgcctgcacccgctgaagaacctggcggcggccgtgcggctgctccctcacgatcccgcctggcacctcgcgctggccggccagggcgcggagcgcgacacgctggcggccctcgccgaccggctcggctgcggcgcgcgcctgcatctcgtcggcgagttgccgccggaccgggtcggcgacttcctgcgcgccctcgacgccttcgtcttcccgtcgcgcgccgagaccttcggcctcgcggcggtcgaggcggcccaggccggcgtgccggtcgtcgccaacgccctgccggtgctgcgggaggtgctggcgacgggcgcgggtccctgcgcgctcttcgtcgataccgaggacgaggccgccttcgccgaggcggtgcgccgcctcgagcgcgagccggatctcgcggcccacctcgtgcgcagcggccgcgggctcgccggacgtttcccggtcgacgcgatggcgggggcctatgacgacctcctgcgcgcgcggatcgccgaggcgcgcggcgcgtag

SEQ ID NO: 9738 - DNA, 1362 bp, Methylobacterium sp.
gtgaggggcctcgccctgccgcggctgcgcgacctccgggcccgggcgggcctgcgcgacctcgccctggcgctcgtcctcaaggtcggcggctcgggcctcgccttcctgatgctgacgctcgccgcccgggccatggggctgcacgagttcggcgtgttcgcctactggttcagcgcgctctccttcgccgccgccgccgtcctgctcggccaggaggcggcgatcatgatcgactggcagcgggggctcgacgcgggcggccccgccgccgcccgggcggcgctgcggcgctccagcctcgtcgtgctgctcgcaggcctcgccgggggcgccgccaccgcctgcgccggtcatctggcgggggcgggctggctgttctccgggcttgccggtgccttcgcggcgctgctcgcgggcctcgtctacggcacccacgtggcccgggtcgtcgccggcatcgcgcagggcgacgggcagttcgagctgacctggcgcctgttcccgaccgcgggcgcggcgctggcgctcgtcgcgggcctgcccttccacgccgagaccttcttcgcctgggcggccggggggatcctggtggcgctggcgatccagggcgccgggatcgccgccgcgctgcggggcgtgcccgccggggcgggggccgccggcctcacgcgtgtgcgggcggcgcccgacgccacccgcgcctggatcgcccgctcggcccggctctggctcggcggcgtgctggacgcggcgaaccagtacgtggacgtcttcctgatcggcctcctgctgagcccggtcgaggcgggcctgtactacgcggccgcccgcctcgccgccctgttcgcgatcgtctcggcgggcctgcacgtcttctccagccgcgagatcgcgcgccacgccgccgaccccgccggccccggcatgcgcgcggccctgcgcctcgtgggtgccgcgacggcgctcgcggtcggcggcggcgtcctggtggtggcgacgggcggccagctgctcctcgacctgttcggcccggccttccacgcggcctacctgccgctggtgatcctgaccgtcggcgtggcggcgatggcgctcggcggcccggtcccggcggtgatgcggctcaccggccacgaggccgcctacgcgcggatcgccggcctcttcgttctcgtgcgctgcgcctgcgtcgccgccgccgcgctcgccgacggcctgatcggcgccacgctcgcgagcgccctctgctcgctcgcctgcgcggtcgtcctcaacgcgtcctgccgcaggcgggtcggcatcgacccctcggtgttcggcctcgtcggcgggacccgagcccgcggaacggtatcatga

SEQ ID NO: 9739 - DNA, 1548 bp, Methylobacterium sp.
ttgccgcaggaccggcatgcggtgccgcgggccgtgctcgagcatgcgctgttcctggcggtcgcggtcgcgctggtcggcgtgccgatcgtggcgcatctggccagccccgccgccgcgatcgtcctgtgcgccgcgggttccgtcgtcgcggcggtctacgtgcgggccgcgatacccgccctcctgatcgtcgccttccagttccagaacctgttcgtgtcgctggtctcgccctggctcgccgacacgccggccttcaacgccgcccgcggctacaacttcatcatcacggcgagcgtctggctgtggatcgtcggcggccactgcctcgccccccgtgcgcggagccggcagctcgacgccctgctccggccgagcgcgctcgcgctcggggtgatcggcctctatttcgggctcggcctcgcccgcgacccctacgcggcggtggtctacctgcggaacgccgtcacgcccttcctggtgttccagctcgcgctggtgatcgccgcggacgggccgggcgaccggctgcgcttcctgcgcgtgcccgtctacctgctcctcgcctacggtctcgccgagttcctggcgcgcgacgcgctcttcgagctgatccaggccaacggctacatgacgttcagcctcgccgacatcgcgcgctcgggcgagtggatcgagacgatgcgcaggacgggccgtgtgctgcgcgacctgcaggacacccagatcgtctccttcctcaacaccgacctgttcggcttctccgcgatccggatgtaccggatgctggggccgaacttccacgcgatcagcttcggctacggcctgctgctcgccgccttcctgctgctgcgctggcgccggcccgtcctgttctgcctcgcggtggcgctgctggtgctcgtcggcgccaagggggcgctggtctgcctcgccctctgctgcgcggcgctcctcctcgaccgcgtgcgcccggaggcgacgctgccggtcttcctcgcggtgctcgtcctctacgcctgcgcggtgatcgtgacggggcgcgcggggggcgactaccacgtcctcggcctgttcggcgggctgcacgccttcctgggcgcgccctggggagcgggcctcggggccggcgggaacctcgcgggcgacgccacccggatcgactgggagaaggcgcaggcgatcgggcgcaccgactggccggtggagagcgccttcggcgtcctgctctaccaggtcggccccggcgtgctcgcgctctgcgccgcgccggtctgcgccgcgctcgcggcctggcgcctgtccgggaccgtgccgggccgggacctgaggcggcatctccgcctcttcgccctcggtaccctcgcggtgacgctgaacggcctgttccaggaggaggccctattcgcgcccctcgccctcggcggcatgctgatcgccctggccgaccgcatgggcgagggcctgtcgcggcttcccgtcggcgcaccggaggtccgggccgcgcgcgctccggggcgctcggcgcaggggatcccggcgtga

SEQ ID NO: 9740 - DNA, 189 bp, Methylobacterium sp.
atgaacacggatttccaccgccccaccgccaagatctacaccttcccggtcgggggccgggccggccaggccgctcgcgcgacggcgcccgtccccgccccgcaggcctgcgccgccgacagcggcgggtaccacgaggccgcgatccaggaagaggccgagcgcaaccgcaccccgcgggggcggtga

SEQ ID NO: 9741 - DNA, 297 bp, Methylobacterium sp.
atggacgagcggcggcggcacgggcggaaccggacctatctgggcggcacgctcaccttcaaccacggccagcagaccctgccctgccacgtgcgcaacctcggcacggcgggcgcccggctcgatttcagcggcgccgtgccgctgccggacgaagtcgacctcgcgatcccgcggcgcggggagcaccaccgcgtgcgggtcgtctggcggcgcgaggacagcctcggcgtcgccttcctgccgcgcgccgccaacctgatcgccttcggcgacgcgcgccgcgcccggacctga

SEQ ID NO: 9742 - DNA, 216 bp, Methylobacterium sp.
atgtcggacgagttgtggcaacgcgcgatggccgccttccgcgagagccggcgcctgatgcaggaggcggagcgcacccgacgaagcggcgagtgcctgcgccacaccctcgccgacacgctgggggagatgcgcgatttcggagcgcgggcaacgatctggctccaggtcgaggcggcgcggccgagcgcaccctcgcccaaccggcgtctctga

SEQ ID NO: 9743 - DNA, 237 bp, Methylobacterium sp.
atgatgtcggccgctgacacactcgttgctaccttgtcgaagcaaagcggcactcgcgaggagctcgcaggcatcatcaccgggctcatggatcagtaccatatctcgccagatcgggcgcacatgctcatcgaccgcttcggccggactcagcctgctttggcgaatgctgggagcgagctcatggcaaggaagcagggctacagcgaaaggcagcctggctatatggcccagtga

SEQ ID NO: 9744 - DNA, 330 bp, Methylobacterium sp.
gtgatcacctgcttcatccgctacgccatcgatccgtgccggacggacgccttcgacgcctatgcccgccgctggggcgaggccatcccgcgctgcggggcggatctcgtcggctacttcggcccgcacgaaggctccgccacgacggcctacggcgtctaccatgtcgagaatctcgcggcctacgaggcctaccgggcgcgtctgcgcgacgacccgctcggccgggagaactacgccttcgcccggcgggagcgcttcatcctgaaggaggagcgtctgttcctgcgcctcgcctccgggccgcacgcggcgcgggtggcgccatga

SEQ ID NO: 9745 - DNA, 504 bp, Methylobacterium sp.
ttgttgcattttatgcgcctcccaaagggaaaatcctcatttgagctcgacagctacgatcttgccatcctgaagctcctgcagcaggacaacgcggtgccgcagcgtgccatcggcgaggcggtcaacttgtcggccgccgcggtccaacggcggatcacgcggctgcagcagagcggagtgattgagcggaacgtggcggtcctcaacccggcgcgggtgggccagcctatcaccctcatcgtcgccgtggagatcgagagcgagcgcctcgacctgctggaggcctctaaggccagcttcctggccgcggaggaggtgcagcagtgttactacgtgaccggggatacggacttcattcttgtcatcaccgtacagaacatgctagcctacgagcagcttacgcgacgactgttctttgaaaatcataacatcaagcatttcaagacgttcgtcgcaatggaccgcattaagacatcgacccatctggccctgccggagtga

SEQ ID NO: 9746 - DNA, 138 bp, Methylobacterium sp.
atgacggcacccgtgtcccccgaacccgcgcccctccgccacgcctcgctgttccgcagcggcctgggcgtccgcctcgccctcgcggccgggctcgtcctgccgctctggctcgccatcctgtgggcgaccgcgtga

SEQ ID NO: 9747 - DNA, 123 bp, Methylobacterium sp.
atggtgcgtaaagcagcgctcgccgcgctgacggccggcctcgtggccggatcctccggcttcctggccggctgctcggtcctgcccgcggcgggtccgaccgcgcgcgcggtcgtgtcgggg

SEQ ID NO: 9748 - DNA, 129 bp, Methylobacterium sp.
atggctggactgtttcaggcggaaacgatggcgttgagctgcgcggccctgaagctggccagttccgcgctcctggccgtgagcagcagagcgccgccactctgggcgttgctcagcctgcaacgctga

SEQ ID NO: 9749 - DNA, 291 bp, Methylobacterium sp.
gtgctgtcgctcctcctcctggccggcctgcccgccacggcggatgccgagatccggcccgtccgcccctgcgcggccgccaagctgcgcgatcccgcctgcccggcccagcgctacgccgttcaggtctcggccgatgccgacgagccggcgggcgagtcccgcacgctcgccccccgggcttcgacccggttgagcgccgaccgcaccccccgcttcgcgccgcgcaccgatccggtcccgccctcggccgccgcgcgcctgcccgagcgcccgcccaggcgcgcctga

SEQ ID NO: 9750 - DNA, 180 bp, Methylobacterium sp.
atgcaggaggtccccatgatcgccgtgacggcgcgacggattctcaccctgctggcgctcgtcgcccctgcgtccggctgggcctgccgggacgccggtccggcggacggccgcgcgaccggccgggaagcgggcggcacggccatccccgacgcggtcgtgttccggcattacctgtag

SEQ ID NO: 9751 - DNA, 192 bp, Methylobacterium sp.
atgtcgcggatcagcgtgaggctcgcgggtgacggcacgcacgcggtgatcgagggcaaggaccccgtggtgagcgggctgaccctcgacgaggccgagaactacctgaccttcatgcgcgcctcggcgcgggtacggcggacgcgccgcctgccggaggcgctgcgccgacggggcgagcgcccggtctga

SEQ ID NO: 9752 - DNA, 165 bp, Methylobacterium sp.
atgtccctgaagaccctgtccgccccgcttctcgccctggctctcgcggccggcagtctctcggccgcgcaggcccagagcagcaacgcgacccccggggctcctgccggcgacagcggcggcaatgcctcgaccggcagcaccgcggcgcctagcggcaaatag

SEQ ID NO: 9753 - DNA, 96 bp, Methylobacterium sp.
atgcgcaagctgctgctcgccttcctgctcccccgcgtcgtctcctggctgcgccgccgctacggctcgccgaaccaccgcacccgtccgtactga

SEQ ID NO: 9754 - DNA, 147 bp, Methylobacterium sp.
atgcatcacgtggcgatcgggctgggtgccctgtgctgcgcgggtggcgcggtcgcgcacttcatcgatacgacgcaccggcgcgagggcgcgctcggtctggcgggcctcggcttcctgctggccgggctgttcctcgaacggtag

SEQ ID NO: 9755 - DNA, 597 bp, Methylobacterium sp.
gtggccaacggggccgccgtgaagcggtcggtcgacgtgacggtcgcgctcaccgcgctgctcttcctggtcccgctcttcctcgccgtcgctctcctgatcaaggccgagacgagaggcccgatcttcttccggcagaagcgctacgggctgaaccggcagcccttcgagatcctcaagttccgcacgatgacggtactcgaatcgagcggtgccttcgagcaggcatgcgccaacgatcggcgggtcacccggatcggccggttcctgcggcgctcgagcctcgacgagatgccgcaactgctcaacgtcctcatgggtcacatgtccctcgtgggaccgcggccgcacgccacgatgatggacgacacctatgcggccgtggtctccgactacgacgaccgcttcctggttcggccgggactgaccgggctcgcgcagatcaccggataccgcggccccaccgacacctacgacaagatcgcccggcggatcggccgcgaccgcgtctacatccggcgctggtcgctcgccctcgacgtgatgatcgtcctgcagacgccgatccagctcgtgaaggatccgaacgcgctctga

SEQ ID NO: 9756 - DNA, 1005 bp, Methylobacterium sp.
atgaggctgatgcacgtggatcttacgcgacgacacgcactctcgggcctcgcgctctcggcggttgcgggcgcgatcgctggggcactcccgctccgcccggcacgggccgcggacctgacatatccgggcgtgaacctctcgggcggggagttcggcgatctcggccgcccgatggggcagggctacatctacccgcaggattcggccttcgcgtactacgcgagccgtgggatgcggctggtgcggctgccgttcaagatcgagcgcctgcaatccgagcccttcggtgcgctctcggagcgggacgtcgcggagctgcggcgctgcgcggcgacggccaagcgcctcggccagctgctggtgctcgacccgcacaattacggaaaacgcgacgaccggccgatggcggcggacgacctcgcggatttctggaagcgtatcgccgccctgttccgggacgatgccggcgtcgcctacggcctgatgaacgagcccgtcgcctacaagcctcccgagtggcggccgatcgtcgagcgcgtcgtcaagacgatccgggacctcggctcgacgcagctgatcatggtgccgggcgccggctggaccggggcacattcctggatctcagacggcaacgccgcggccttcgagggcttctcggacgccaacttcatgttcgaggtgcatcagtacctcgacgccaacagctccgggaccgatctgcagacctacgtgcccggcgccggagagggccgcctgcgcgatttcacggattgggcgcgcaagcgggcatgtcgcggcttcctcggcgagttcggcttcgcgctgcccgccggccggacggaggcctccgccctgctggcctacatggcggccaacagcgacgtctggaaggcctacgcctactgggcgggcggcccgtggtggggcgattacgccttcagcatcgagcccgacaagaacggcgacaaaccgcagatggcccttctgcgggaatacctgtga

SEQ ID NO: 9757 - DNA, 1527 bp, Methylobacterium sp.
ttgagcggcggcctcgcgcggcagtcggccgccaacgcggtcgccaccggctccattctgatcagcggcgccctgagcacgatcatcgtcgcgcggctgctcgggccggccgacctcggggtcgtgacctacgccgcctggttcgtcagcatcaccgtgatggtggccgacctcggcatcccggggtcgctcgcgcgctacctgccggaagtccgcgggtccggggacgcgagcgcctgcgacggcctcgccctctatctgttcaagcgcttcgtcctggtggtcgggctcgcggcctccctgctcttcgggctcgccctctggcatctggcggccggatcgacgttcgcgctccacatcgagccggggacctacaagacgtccccgctcttctggacgctgatcgccgcggccgtcctcgcccagagcagttccgccttcgcggtggggctcctgagggggcaccaggaattcggccggatggcgcgcatcatgctcgtctcggcggccgcccagatcggcgtcacggttctgggctcggtcgcgctcgggctcgtgggcgcgctgagcgccgcgatcgtcgtcggactcgcgccctcggtcttcctgctgcggaagctccgcggcggccgcgcggtggcgccggagctgcgcacccggctcgtccgttactgcggcgcgatctggctcgcctacctgctctccgccgtcacctgggcgcgcaccgagatcctgttcctggagcggagctggggcagtgaggcggtggccttcttctcggtggggctgacgctcgccaacctcgccgtccaggccccgctcctcctcacggggccgctgctgccggtcctggctcagaacatcgccgcgaagcagcacgcgacggcggtggagatctaccggacgggtatgcgctatctcgcgatgctcgtcttcccggcctgcttcgggctggccgcgatcgcctcggtcttcgtgcccctcgtctacggcccggccttcgcgaaagccgtggcaccggccgtgatgctcgtcgtcgcggccgccttctacgccctgacggcggtgacgcagatctacatgaacgcggccgagcgcaaccgcttcaacatcgtcgtcgggatcatcggtgcggtgagcatcatcgcgtccggcctgatcatcataccgacccacggcctgatggcggctgccgcgacacgcacgaccgttcaggtgctcaccgccgcggcgtcgatctggtacgtgcatcgtcatctgcgcgcaccggctcccatcggacagatcctccgcatcgtcggcgcggccgcgctgtgcgggctcgccgccttcgccgtgctgcgcgcctttccgggccccgtcgcgctcgcgccggcgatcgccgccggcgccctggtctacggaatcgccctgaagctcttcgggtgcgtcctgcctcaggatctcgaacgggcgcgcgcgatcggttccaggctgttcgcgcccctggccgccgctctgtccggcgccgccagggcctcccgatga

SEQ ID NO: 9758 - DNA, 561 bp, Methylobacterium sp.
gtggtgcgggcgggcgccgggccggtgcgggatcgctggctcgacgccctgcgggccgggctcgacgcccggcaggacgcgctgagggcccgccccctgcgccgcctgccgccggggaccggcgacgaccggctgatcggcgggctcgacctgcccgcgaccctggcgctcggccgtccggtgctcgggcgcggcctgctggcggaggccgatggcggcgtgctggtggtgccgatggccgagcgcctgagcccggcgaccgccgcccgcctcgcggccgcgctcgacaccggcacggtcgcggtcgagcgcgacgggatcggcgcgcgccaccccgcccggatcgggctggtgctgctcgacgaggggcagggggacgaggcggtgccggaggggctggccgaccgattggccttccggatcgatctcgacgggatcgggctgggggatctggacgcggggcgggcattgccctcgggcgatcgcgttccagcctctccggcggacggcccgcgcgctctccctcccccctctgcgggggagggtggcccctgcgtcagc

SEQ ID NO: 9759 - DNA, 618 bp, Methylobacterium sp.
accctggtgttcttcggcatgccggccccgcgcatcgccaagatgctgccgctggggagccaccgctacgtctcgggcaagatcgagctctgggacgggcaccgccagatggtccaccccgcccgcatcatggacgcggagggcttggccgccctccccccggtcgagccgatctacggcgcgacggaaggcctgacctcgcgcgccatcggcaagctggcgatcgccgccctggagcgcctgccggtcctgcccgagtggcaggaccccgcctggctcgcccggaacaactggccgcccttcgccgaggcgctgacggcggagcaccggccgagggaagcgccgcccaaggccaccgacccgctccagccgcccccctccacgccgacccggcggcggctcgcctacgacgagctgctggcctcgcagctggcgctggccctgctgcgcgcccgccagcgccgcaaggccggccgcgtcaacgcgggcgacggcaccttgagcgccgcgatcgaggccggcctgcccttcaggctcaccggggcgcaggcccgcgcggtggccgagatccgcgcggatctggccgccgaccgacgcatgctgcgcctgctccgggtt

SEQ ID NO: 9760 - DNA, 360 bp, Methylobacterium sp.
atggctgagacccgcaaacccgccatcgtgcgccagcccagccggaagtactggcgcgggcacgtcgcgatgtaccgcaactcggtctcgttctgcgtcggcctgccgagcggcgagcggcgatgcgtcgtcctgccgacagctcggttctggtcgcgcgagcgccgcgaggcgcgggcggagagcttggcgcacctccacctgcccggcacgaaggtcccgcgcccggcgaaccactcctactggcttacggtgagcgtgccgttggtcctggccgaggtcgagtgccgcctatggcgctcgcggcagccggtgcggcgctaccctccgcggccgatccgggaggtacggcatgggtga

SEQ ID NO: 9761 - DNA, 309 bp, Methylobacterium sp.
atgatccagtcaatcctgaccagcgggcggcgcgcccgcaccggcgggcggcgcgcccgcaccctcttgatcctggccgcgctcgccgcgccgaccggtgcctgggcgcaggcccagacgggcaccggcggcggcccgacctcgacggtcacggcgcccaacgcctcctcggtcggccgcgtgatgccgcgccccggagcgggtggtgccggggccgacgcgcagctcgaccgcaccgagcggacgccgcagatgaaggccgacgacaagatccagaagggcatctgcatcggctgcggcgcgaaatag

SEQ ID NO: 9762 - DNA, 360 bp, Methylobacterium sp.
tcctcgcccgtgaacggccgctcctgcgcctgccagagcccctggcggcacagcctcgcgatctacctcgtgcatcagccgctgttgctgggcgtcctgaccggcgtggcggcgctcaccgggccgcatccgcgtgcgggcgagcggacgttccgcgcggagtacgtggagacctgcacgcggaccggcggcgggcgcgaagcctgccggatcgcggcccgctgcaccggccaagtgctccgccgcgaggggctctggcaggcgcaggagcggccgttcacgggcgaggagcgcctgcgggcgcaggcgctgtcgcaggcctgctacgaggccgcggagggcacgcgggggccgccctga

SEQ ID NO: 9763 - DNA, 963 bp, Methylobacterium sp.
atgctgtcgcttcgaccggccgccgcccgcctgggcgcggctttcgccgccgtgctcgcgctgtcgggcgcgccgcgggcccacgagggccacgaccacggcccgccgcccccgccgccggagcgcgccgccccgcgggccgccgcggtctcggaggatctcgagctggtcgcaatcgcccgcgccggcaccctgacgctccatctcgaccgcttcgccagcaacgaaccggtgacgggcgcgaccgtcgaggtcgaggcgccggacggcccgcgcgccgcccgggagacggaggccggcatctacgccctgcccgcgccctggctcgacgcacccggccggcacgatctcgtggtcacggtgacggccgggtccgatgccgccgtgatgagcctcgcgctcacagtcccggtcccggagaagccggcgccggccgggggcttcggccagaccctgggccaaaccttcgcccccgtcctcgacggcctgcgccggcacctcgcccggcaggacccgaccctgccggcgaccgccggtgcggccttcctgctcggggcgctggcggcggggctgctgcgcggccggcgcgcgggcatcgccgtgctggtcgggctcgccgcgaccctggcgctcgccctcggcggcggcgccctggcgcacgaggcggccggccgccacggcgggcgcgtcgccgatgccggctcctaccatgtcgagctggtgacgcggggcccggaggtcgtggtctacgtctcggacgggatgcagaagcccgtgccggcagacggtttccgcgggacggcgatcctcgtggtccagggcaagccggcccgtgtgccgctggagccgctgacgggcgaccgcctcgccggccgcgccgcgagcgatctcggcgccgccccgaagggcgtggtgcagatcaccgcgccggacggtgcgcgggcgagcgggcgattcgagtga

SEQ ID NO: 9764 - DNA, 393 bp, Methylobacterium sp.
gtgctcgaccgcaacgtctctcaacagaagctgctggtgacgctcgatgccgtgatgatgggggcggtcgtgcgcgacgcccccttctttcgccccaaccgggagccgggcgatatcctgttcccgccatcggcgccccgaccgcgctcgtccgtcaagcttccgctgcctttgtccggatcggacgcgcgcatctgtcccttctcgatacgggagcaggaaatcctttccgtgcttgccgagggcgtgtcgaacaagcacatcgctcgcaagttcgacatcgccgaatcgacagtcaaagttcatgtcaagcacatcttgcggaagctcaacatgaacaatcgcacgcaggccgcgatctgggccaagagttacaggccgattccggcctga

SEQ ID NO: 9765 - DNA, 240 bp, Methylobacterium sp.
ttgttcgatgcgctgaggctgaggatgttggaccgtgcgaccgaaactgagccgacggaggcagaacgcatcgctcacgcgtatcgggttgcaagcggcggcaacgcctgggccgcgctcgtgcgggtcgtcgaggatgcgctcacggatctggcggaggctgagcggcgctcgctgcgccgtgaccggctgatctcgcatgggtacgttcgtggtcgccacgacggcggcggtcgctaa

SEQ ID NO: 9766 - DNA, 1029 bp, Methylobacterium sp.
atgacccgccttgccctctggctcgccctcgcgggcgccctcctcttcggcggcctgaccgcaccggcccgggcgcaaggccccgagaggctgccgatccggatcggcttccagtccggcgaggtgaacgtcctgctctcgcacgccgtcgccgccggcctgttcgagcgcgcggggctcgccgtgaccctcgcgcagttccccgcggggcccgcgatgctgccggcgctcgccgcgggcgaggtcgatctggcctggatgggcgagttcccggcggtgacgggctacgccaacggcctgccgatcgagatcctgttcatggagcggatcgacgccaccaacgtccggctggtgggaaaccccgccgccggcatcgcggcgcccgccgacctgaagggcaagcgggtcggcgtcgcggtcggctcgaccagccactaccacctgctgcgcgcccttgcgcaggcagggttgagggcggacgaggtgcgcctcgtgaacctcacccccgccaacatgccgcccgcctacgcggcgggccagatcgacgccgccttcgtctgggaaccgaatgtcggtgcgctggagcgtcagggcgcccggccgatcgcctcgacgcggagcctcggcatgatcaccggcggcgtctgggtggcgcgcaagcccttcgtggcgggctcgcccgagacgctgcagcgcttcctcaaggcctgggacgccgcgcaagccgcctacgccgcggaccctgcgggcgtgcgggccgcggaggccaggcgcatcggcatgagcggggcggacttcgatgccctggtggccggccagagcgtggcccatccgagcttccgccagacgctgaccgcggatttcctcggcgcgccgggccaggaggagacgtcgcggctgatgaggcacctgcacggcatcgcggccttcctggtcgccgagaagcgcatccaggccccgcccgccgactggtccggcctcatcgacacccggccgatccagacctacctcgcgggcgcctcgcagtga

SEQ ID NO: 9767 - DNA, 915 bp, Methylobacterium sp.
atggcccgcgcatacgcctccaccatcatcgatgctccggtcgagaccgtgtggtcgctcatccgcgacttcaacggcctgccgtcctgggtgccgggcatcaccgacggtgagattgaggacgggctcgacgccgacgtggtcggctgcgtgcgcgccttccgcctccccggcggcatcttggtacgcgagcggctgctctcccttgacgaccatcgctacagcttcagctacaacttcgagacgcccgccttcccggtgacggactacctcgcccgcgtcacgctgattccggtcaccaacggcgacggcaccttcgccgagtgggaggccaccttcgacgaacggcccgaggatgccggcaagtacgccagcatcatcgctgagggggtcttcaaggcgggatgggatgccctgaaggcgaagatcgcccgcgagcggcccccgacacctgcgggcgccgtgcgctggcggggcctgccgccccacaaggtgttctgctcctcggtggtcgacgcaccggtcgcggccgtctgggcgacgatgcgcgacttcgccggcatggcggactggcacgaggacatcgcgcgcatgcacatgctgggcggcgtgcgcccggacaaagtgtcgggcgtgcgcgactttctattcggcgaggggcacctcaacgaggagctgatccagctctgcgaccgaacgcgctcctacacctaccgcatcaccaagagtccgatgccgtggctgcactacgtctccggactgcgcctgcggccggtaacggacagcgaccgcaccttcgcaacttggttcggcgactggacggccgcgcccgccgacgacctcgtgctgatcccgcaggttcatcacggcgtctaccagaaggcgttcgacaccgtggctgcgcggctcgcctga

SEQ ID NO: 9768 - DNA, 639 bp, Methylobacterium sp.
atggacgccgtctatgtcgggatcgatgtgtcgaaggatcggctggacgtgcatgtcctgccgagcggtgaagcctttggggtgacccgggacgggtccggcttggccgacctctgcggccgactgcggccgctggcgccggtcgcgatcgtgctggaggcgaccggcggcttcgagaccgtggtggcggccggtctggccggggccggtctgccggtggtcgtggtcaaccccgcccaggtgcgcgccttcgcccaggccatcggccagcgcgccaagaccgatccgatcgatgcggccgtgatcgcccgcacgctcctggccgagctgcccgaactgggccgcctcgaccggcgccagatcgccgcgctggccggccacgcgccctggccccgccagtccggccagtggcgcggcaagagcttcatcggcggcggccgggccagcgtgcgcgccgccctgttcatgggcgcgctggtggcagcccgccacaaccccaccctcaaggccttccgcgacaggctcgtgggcagcggaaagcccaagctcgtcgccgtcgtcgcgaccgcccgacagctcctcaccatcctcaacgccatgctcaggagcaaaaccccatggcagctgcaaaacgcttga

SEQ ID NO: 9769 - DNA, 2304 bp, Methylobacterium sp.
atgggacgcgggcagggcgcacaggcggggcagggcgcgcaggcgaccggcccggggcgccgtccggcggccctggcgcaggtcgcacacggcctgcgccagcaccaggccggcgacatcgccgcggccgaggcggcctaccgggaggcgatccggctcgcgccgggcgaggccgccgcgcaccacctgctcggcctctgcctgaagcggaccggccggatcgcggaggccggcgccgcgctgggccgggccgccgcggccagcccgcgcgaccccgacatcctggccgacctcggactcgccctgcgcgcggcgggcgaccgcgacggcgcccgcaccgccttccggcgcgcgctgaagatccggggcgaccatccgaaggcctggggcggcctcctcgatctcggaggcgtcggcacggacgcggtgggcccgctgcgccgcctcgtcgccgcgcagccggcgcggccggaaggctacctgagcctcgcgggcgtgctctcggcgctgggcgaggcggccggggcgcgcgacatcctggccgacggcctgacggccggggcgctcaccgaggcggcgctgcagagccacggcgccgaagcccacgcggccggccggcacgcggaggcgctcgcggtcttcgcgctccttgccgagcgtcggccgcaggatccccacgcccagatcgtccacggctgcgccctgttcgaccggggccggatcgacgccgcccacgccgccttccggagcgccctcgcggccgatcccgacaacgtgaccgcccacgtgaacctcggcgcgatcttctcggagatccggcgcccgaacgaggccctggagcattaccggcgggcggtcgccctcgatcccggctcgacgctcgctcgccacggcctcgtcgaccagcagcaccacgcctgcgagtgggccgacatcgcggagaacgagcgggtcctgctccgcctgctcgacgagaccggcacgcgggtcacgcccttcaagctcctggtggccgagcaggcctcacccgccgcgatcctgcgcgccgcccgcatctgggccgcggggatcagcgttcccccggccgacatcctcccgccgccccgcccggcctcccccggccgccggatccgggtcggctacctctcgaacgacttcttcgagcacgcggtctcgatgctggccatccgcctgttcgagcggcacgaccgggcccgcttcgaggtcttcgcctactcgcacgtccgggacgacggctccgccctgcgccgacgcctggaggccgccttcgagcacttcgtggacatcacggacctcaccgacgcggaggccgcgcgccggatccgggcggacgggatcgacatcctggtcgacctcaagggctacacgctgcgggcccgtaccgagatcttcgcgctccggcccgcccccgtgcaggtgaactacctgggctatccgggcacgatgggcgcgcccttcatcgattacctgctgggtgatgcgatcatcacgcccgaggcgcaccagcccgattacagcgagcgcctcgtccggctgcccgattgctaccagccgaacgacgaccgccgcccgatcgcggccgagcgcccgagccgcgccgcgtgcgggctgccggacgacgccttcgtgttctgctgcttcaacaacagctccaagatcgcgcccgcggtcttcgcgatctggatgcgcatcctggcgcgggtcccggattccgtgctctggctcctggaggccaacccggccgcgcaggacaacctgcagtacgaggcgggcgcgcagggcatcgatccggggcgcctcgtcttcgcgccacactggcgcaccgaccgccacctcgcgcgcatcggccacgccgacctcgtgctcgacacgctgccctacaacgcccacaccaccgcgagcgacgcgctctgggccggggtgccggtgctgacctgcctcggcgcgacgatggcgggccgcgtcgcggcgagcatcctgcacgcggccgggctgcccgacctcgtcaccacgagcctcgacgcctacgagtcccaggccgcggcgctcgctgccgaccggccgcgcctcgacgcgctccgggcgcggctcgccgccaaccgggcgcgggcgcccctgttcgactccgcgcgctacgcccgcggcatcgaggcggcctacgcgcagatgcacgacctgcgctgcgctggccggccgccggaggccttcacggtcccgcgcgagccgttccaggacggcttcgatcccggtttcgatcccggccccgattccggccgcccctga

SEQ ID NO: 9770 - DNA, 372 bp, Methylobacterium sp.
ttggctacaaagaagattgtcttcgtcgcattcgcgatggaggacgaacgacagcgggattttctcaaaggtcagtccctgcaccctcgggcaccatatgagttcatcgacctatccgtgaaggaagcctacgagacggattggaaggacaaagtccgcacccggatacggcgttgccatggggtgatcgcgttggtgagcagaaactcgccgcagtcgaccggccagaagtgggagatcgcctgcgcgagggaggaaggcaagaagatcatcggcgtctgggcctacgctggcgaccggaccgagatcgccggcgtgaggactgtcgcctggagcgatgccaacatcgccgcattcattgactctctgtga

SEQ ID NO: 9771 - DNA, 822 bp, Methylobacterium sp.
atgattgcgtttatcgtcgccttcattctctgcctagaggggtcggcccaggcacgaaaggagttcctcgccgatgagtactggattggcaagccgcattcgccgaaggagaagaacctgacgcggctagctgcgatgtacatgctcggggtgaagcagagctatggcgccctgtacgtgcaagcccttcagtacacgaaggtgaccgagtacttcctggaaagagacatagaaccggaagagattcccgattggctgcgccgcacgccgatctacaagctccttgataagcttgacccgccgcagaaggtagcgtgcgatgatgacggcccggctacggccccctcacgggtacagccgaaagctgcgctggccgatacgacagtcaatacccgcgaaaagcaggataagcgcgacttacacggcgtcgatgatgacgccgatgaggcggtggggcacgacgccgatgactgcgacgacgaaggtgactgctccgacgaaaacgatgacgacaatgacgccagcgggtccgggagcaccgacaaccattctgatggtcccaacagggtgggtcgccgcgaccgtaccgctagccccgaaggcacgcgcacgaagaacgccaagcgttacccgttcaagcaggatcgtgagttagccgttatggcagaaggctaccagaagcgattcttcgatgacatgaaacccaacgaagaggttccagtgatgatccgccggttgcctgatgaggatggctgggcgaagtttgagatctgtggcctgcttagcccccgggagtaccgtaccacccggaccgccgattga

SEQ ID NO: 9772 - DNA, 1194 bp, Methylobacterium sp.
gtgaccgccctgccgaaccgccggaccctcgcgaccgggcgggagccgcgcccggaaacggccatccggccctccttcgacggtcaggatcccgcggctctcctggagcaaattccgcgtcacgagacaatcctgccgcgggtcgatgtcttcacccttcccggcggctatatctggttcggcgacggcgtcgacgggatcgccctcaccgccgatggccagctggccctggaaacggcaaccttcgcccgcggttaccagtctcttccgccggaggcgttgcgggcgcgcgcccgcgagatcgacgaagactgggtcacgatcgtcgattgcggatgtcacaattactaccacctcctgatgctggcgatgccgcggctcacctatgcccgggcgcatctgcccgaggcctgggcggccgtgccagcccaccgcccatcccccgacggccgcccgccgctgctcgatcagctcatcgccctcagcggggaaggtcaccggattcgacgcgtcgaagacgggctctaccgcccgcgcaacctccacgtcatctggacgaatttcatcaacccgcccgcgctacacttggtcgacgaaaccttcgcctgcttcgacatcctggcccggaacgtccccccggcaccggagcggcgattcccgaagcgtatcttcatcgagcgcgtgggcgacatgcgcctgagcgacccgaacgcctgccgcagcctcgaccgttacctggctacccacggtttcgggaaggtgcggctggagacgctcgacataggcgatcagatccggctcttcgcaggggcgagccacgtggtcgcggcccatggcgcgggcctgagcaacatcgtgttcggctcgccgcaactgcgggtgctcgaactgaatctcgacctcgacgggcggggtacgctgcggccttggttcctgctgctcgccgccgcccgggggcagcactaccagtacctgaatacctcggcctgcgaactggccgacctgccgatgggcctcgcgttcgaccggctgatggggacccgtcggcaggctctgcgactgcggctcgcccggctgcggggccgcctggatcgtcacctcgtccgcgcggcaattctggcgcgccgcctcagatccggccgagcactgcggggaagccgatttcccgggcgcgctcccccacctcattcctaa

SEQ ID NO: 9773 - DNA, 648 bp, Methylobacterium sp.
atgtccgacggcgccgctctcctggccatcctgggggccgtgctgctcggcgcgatgagcccggggccgagcttcctcctgatcagccggatctcggccgcccgctcgcgctccgaagggctcgcggccgcgctcggcatgggtctgggcgccgccctgttcggaacgctcgcgctcgtcgggctcggcggcctgctctccgccgtggactggctcgccgcgctcctgcagggcgccggcgggctctacctgctctatctgggcctgcgcatctggcgcggggccgccgcgcccctgccggaggccggccgggcgggtggtccgcccgcgggcggatccctggcgcgcgccttcggcgcggccctgctgacccagctcggcaacccgaagaccgccctggtctacggcagcctgttcgcggccctgctccccgccgcgcccgcgccctggctgccgctcgtcctgcccctgctgatcctcgcggtggagaccgcgtggtacgggctcgtcgccctcgggttctcggcgccgcgcccgcgggcggtctatcggcgcgcccggatctggatcgaccgcgccgcgggcgccgggctcgggctgatcggcgcgcggctcgtccacgaggcgctgagcgggcgccgcgcctga

SEQ ID NO: 9774 - DNA, 504 bp, Methylobacterium sp.
atgtccgcctccgaccgcgccaatatcaccctgcccttgccccgcttccaacaactcggcgccatcgccgagcggcgcggcttgcctagcgcatccgccgtcatcgaggcgtggatcggccgcgcgatcgaggaaggcgagattccggcgagcccgccgggctttatggccttcaaggacgacgacggcttcctcatcgaaatttgcggacacatgcttccgctgatgaagcccgaccgggcgcgcatgctcgcggccgtgctctcggcggccgccggcgacaccgaccccgatttgccgatgcagttcccggccggacgcccggtcgtgctggaccttggcgaggtggcgctggtggtcgggaaggctgggcggggcatccggttcatcgtgaagaccaagggcgccgccgagggcgagggcatccacctcgccacgtcaccgaccttcgttgccggcctcgcgcgcgagatccgcgccgagttcaccccggccgccgcctaa

SEQ ID NO: 9775 - DNA, 102 bp, Methylobacterium sp.
gtgagcatcgcggagatcgccgaggcaggcggcttcgtggccgaccgcaatcagacggtgcggccgtcaccgtggcggctcggccgtcgcgatctggcctga

SEQ ID NO: 9776 - DNA, 219 bp, Methylobacterium sp.
atgagccacattctcagtctggcatcggcgagcgccgcgctcaccactgttctgagcctgctcgccgcagtcgcttcggagcccgtgcccgcggcttcggccgcgcggtccccgcaggccccggccgtcgtggccgccgaagcggtccccgtccgcacgatcaggacgatccccatcgacggtcgctacgactccaccgtccgtccgaccctgcgctga

SEQ ID NO: 9777 - DNA, 210 bp, Methylobacterium sp.
atgcacatctcgcccgacggcctcgacaagctcgaggatctcgccctgctccgagccgtgctgcggacgaacgctcgctccgccggcaccgccgaacgggcgctgccgacgctcgcggaccgcttcggcgtcgcgccgacgggatcgggacgccggaaggctgaggtgcgcctcgatcacgcacctcgaaagatcgcgacggggtcctga

SEQ ID NO: 9778 - DNA, 93 bp, Methylobacterium sp.
atgtttcccgggcgaagtccggccgagttgcgcgtcggctcccggttcatgatcgcccgcaccgcgatttcgagcttcgggttccgctcgtag

SEQ ID NO: 9779 - DNA, 135 bp, Methylobacterium sp.
atgatggcgaccacgacgaggactcgagacatgatcccgaccgatcgcatcatcgtctgggcattgatggcggggctggcgatcgccctcctgcaatatgccgagtccgcggccctgcccgcgcacttcgtctga

SEQ ID NO: 9780 - DNA, 591 bp, Methylobacterium sp.
atgactgagcatctggctgcaggcgacgcgccgatgccggggtcgacgcacgctggatccaggcgagatcgcgagacggacgaacctgctggcgcacgacgccacgatcaagcggcgcgggccggcggggccggctgcggctacgcggcggtggctcgggaggtcacgcagtcggccgagcgggccggcataaccgcggagcaggccatcggggcgattcagggcacgatccgcaccctccaccaatcagcggcggcgatcgcctcgaccgtggaggagcagtccgcagtgacccacggcatgttggccttgatgcagaccgcggcgcccgcacggctatcgccgggccggcaccaccgacccgttcgccgctctcgacgtccaatccggccgcgtgatcggacgcggcaaaaggcgccatcgccccaacgcggcgtgttcgagaccattgtcgatctggagcgggcgatctacgcctccattgatgagaccgacgccgagccggagccgttcgtctggacgaagtccgccgacaatatcctcgccggcatcagacacttctgccaacgaaattcccactcgaaccactag

SEQ ID NO: 9781 - DNA, 144 bp, Methylobacterium sp.
gtgcgcttcagcgtctggaccagcctggccgcgcacccgcccctcggcaacatcaaccgcgcccgcaacgctccctgcgggcattcggcggcgttccgacagcgcttcgacggctgcccgatccacgagccttcaggcggctga

SEQ ID NO: 9782 - DNA, 90 bp, Methylobacterium sp.
atgcacgcgcgcggcctcgtcgaggcggtgctggcgatccgcgccggccgcctcgcgcccgaggcctacgccgccgccctcgacgcatag

SEQ ID NO: 9783 - DNA, 105 bp, Methylobacterium sp.
atggcggcgctgatcctggccatgattctgatcggcgtggcgatggtgaccacgctggccgacgaccaggtgctggtctcgctccatcggccccgggcatcgtaa

SEQ ID NO: 9784 - DNA, 195 bp, Methylobacterium sp.
atgagagagaagccgctggagcaccgcggcatctacgtcaagccgatcaacgacccgcccgtgccgcgcggcggcgagcggctgagcatcaccccgactccgctccataccgaggagcacatgcgaccgctcatggaggcgctcgtcgaggttcgcactcgccaggcctggggagaggtctcgcgggcgacatga

SEQ ID NO: 9785 - DNA, 378 bp, Methylobacterium sp.
atggccgtcatcccaagggatgccgtccagaggatgccacgcgtggcatccccagggctcccgcccgtggacccgatgacacggcccgccgcgttcgatggggcgcgggacgcccggatgctggcctcggtacgccaggcaggggcgggcggaggggcccgcacggacggggactcgatgccggccgggagcgccggaccggtcgatggcggcgacctgcacggggctaccagttcatggagatcacctaggacctgccacggccggagaaggcccgaggcattcattctggacggcttggcctctggagccccggcgccggtcatcggcgagaccttcaagctcgatgagatcgtggaggctcaccggcccatgtag

SEQ ID NO: 9786 - DNA, 1095 bp, Methylobacterium sp.
atgaccagcgtcctcacgaacaccgcggcggccgtcgcgctgcagaccttgcgcgcgaccggccggaatctcgacgcgaccgcgcggcaggtctcgaccggcctgcgcatcggctcggccggggacggggcggcctactgggccatcgcctcgacgctgcgcgcggacaacgggtcgctcgccgccgcgcgcgacgcgatcggcctcgaccgcaacaccgtcgaggccacggcccgggggttggaccgggtcatcaatcaactcggcgccatcggccggacgctggtctcggccgcgagcgcccagaccgaccggaccaagctccagggtgacctgcgcaccgccctcgacgccatccggatcaccgcggacaacaccgtgatgaacggcgcgaactggctctcggtcgattcggacgcccccagcttctccgcgacccggaacctcgtcacggccttctcgcgccaggacggcagcgtgtcggtcggcaccaccgccctcgatacgtccggcatcgtgctgttcgacaccagggcccgggagggcggcgggagcgccttcagcctcacgccggcgaccggttcgatcccgtccctgacccgggacatagcccgcgccgcatcggtggcatcacccgacggctaccagatccagacctgggacgggccgagccagcgtggcggcgagaccctctacctgacctggaaccagggcctgctcgacacgcagtattacgtccgggacgcgagcttcgggcaccagcccttctcgatcgcctcgatggacctgacctcgcggtacacggacgccaagatggtccaagcctatgtcaaggtcgtggatgcgacgcggcagatcctgctcgacggggcggcgaatcttggcgtgatttccgccctcctcacggcccagcaggatttcgcgggccggttgatggacatcaacgcctcctcgatcggcgctctggtcgacgccgacatggaggaggccgcgacccggctgaaggcgctgcagacccagcagcaactcgggctccaggcgctgagcctcgccaacggtgcctcgcaggccgtcctcgctctcttccggcagtag

SEQ ID NO: 9787 - DNA, 180 bp, Methylobacterium sp.
atgaagcccgccgagcgtgccgccctgaaatcggcgatcaagcgctacacccgagccaagacggcctcgaaagccatcgccctcgcgaccctcgtcaaggagggtacgcacacgcccaagggtcagatcaccgtgcagtatggcggacagcgcaagaagaagtcgggttcggcgcaataa

SEQ ID NO: 9788 - DNA, 567 bp, Methylobacterium sp.
gtgggtctcaaggcactgatccgcggcttgccgctggagccctcggacaaggatttcgactggctcggccccggcgtgtacttctgggagaacgacgcgcgccgagcctacgaatgggcgcaggccaaggtggcgcaggggcgctacaaagatcccttcgtgatcggagcgatcatcgatctcgggaactgtctcgatcttctgcaacgcgagaatatcgacctgctcacggatgcctacgggagcctacgggagatcaaccggaaagccggcacgaagatgccgaagaacaaggacccgagggcagtcaacaagggcgacaagctcctgaggttccgcgattgtgcggtcatacggcacgtgcacgaagtcatcgaggacgaagagttgaacgatccggacggcgagcattacatcgcgcctttcgacacggttcgggggctgttcgtagagggtgcgcgcgcttatcccggcggtggcttcttctcgaaaacgcatacccagatcgccgtgagaaacccttgctccatcagaggcgtgttcctgcctcgcgacgcctcggcctga

SEQ ID NO: 9789 - DNA, 243 bp, Methylobacterium sp.
atggctctcgacgctgtgcccacgtgctgcccgttcatccagaagctcatcatgcttgttctggactgctcatccagaacgggagcggccaggaagcaggctctgttcagcgaaacacttcgtcttgagatggacgctgttcgtgcgcgagcgcccgagggttcgctgaaggtcatccgaaccatcagggagatcgccgagggagccctgaacctgccgcgacctctgcaggggcggctgtag

SEQ ID NO: 9790 - DNA, 285 bp, Methylobacterium sp.
atgagcacgcgccagcactcccgccgcctcatcgacgaggacaccaccgactacgaatggtccgccacgaagctcgacgagctactggctgatccggaggtcgaaggacttgctgcggacatgctgtcctacggcttcaggaacggcgagttcgaccccgatccggtctaccgccagtgccgggaggagtaccggcgcaaggagccggccgcgctgctgttctttctggccgcccgtctgttcgagcggcttctcgcaacgcaagcagcgaggcgtctgtcatga

SEQ ID NO: 9791 - DNA, 207 bp, Methylobacterium sp.
atgcaggtcgctctgcgtcggatcgaagccccctacggcgatgagcttcaggtgaccgtcgatgccgaggcgctctccgtccctcgtgtggtggccgtcgtgctcgcgaatgccgccggtgaggacgaggcggaccgcatcggcaaggccgtgctgaaggcactccagtacgcggagagcctgacgaccagcacaccgggaatgtga

SEQ ID NO: 9792 - DNA, 225 bp, Methylobacterium sp.
atgctcggtgccgtcctcggcgcagcgctgccggccctcgtgcgcccggcccaagccgagggctacgtggcccggacgcgcccttgcgcgcccgccccgtgccgccgcccgcctccgccccccgggttcggctacggcccgccgcggatcgtcagcggctacctgccgcgcaacaacaccctgccgatgtacaacgagcccccggcgcgcccgccggcctggtga

SEQ ID NO: 9793 - DNA, 1161 bp, Methylobacterium sp.
gtgatcggtgcccacacgccgcagggcgtgcccttcgtggtcggatcgcaccacctgcatcgggaattcggcgccctgggttacgcggccacgcacgttcccgtccccctcggtgccgaggacgtcttcaccgccgatcacctcaacttcaagcgcatccgggccgtgtcctggcaacggaccatgacccggcggcgcgatgcgcattccgatcgctcggtcgtctcactcgtgccctgggcggccgtcaggcggttcggcatggcgcggggctaccgtctcgggtacggcaggatgctgctgcccggtttcggagaggacgaccggtcgcctgaacttctgatcgtggatcatccgcggcaattttggctcgtccggcagttgaagccgaaaaccctgctctacagacccaccgacgcctactctcatgccggccacaaggaccatcgcgtcacgctggagatcgagggatggctgctcgagcgggccgacgggctcgtgctcaccgcgcggcagatcgaggaacggatgcggcagatcgggggcggacgcctgcccctgcccatgatcgtcgaggagaacggggtcgatctctcgatcttccgcgcgaagcgggccgtgacgtcccggacgtcggcgagggacggcggcacccgcctgttctacgtcgggtctctcgatgcgcgcttcgaccacgccttcgtggccgaggccgcgcgccggaaccccgattgcacgttcacgatcgcgggaccgccccacgccgatcacggcgcgacatacgaggaaatcccgaacgtccacctgctcgggcccgtccgccaccaggatctcccggatctgatgggccgtgcggatgtgggtctgctcccgctgagcgaccatccgttcaacgccacccggagcccgatgaagctctacgagtacgcggcggccggcctgccggtcgtctaccgggcgagtccggaactgtgccggcgcggcctcccgttcgcctttccctaccggggaccggacgatttcggcgcggcagtccgggcagccgccctgtatcgggagacgggcggcgccgagatgcgggcattcgccgaggcgaagtcgtggagaggtattgccgagcggatcctggatttcgcgcgccgggtcggagcgcgggtctga

SEQ ID NO: 9794 - DNA, 294 bp, Methylobacterium sp.
gtgctggtgcgctcggcgttcctctacgcgtcgcatacgagcgcgctggcgagtttgggtaaggttgccctgctgctcctcgtggaactgccggtcgtgacgctcctcgtcgccttcgtggtcaacgggttcgtcctgcacatcatcggcggccgcttgcggcggatgcgaccggggcggatgcccgtgggactcttcgcgcgccacaggtccgaacgggcggacgagctcgagcattatccgtcgcaccccggcggcgagccatcgagccggcagcccgatcacgagcgctga

SEQ ID NO: 9795 - DNA, 279 bp, Methylobacterium sp.
atgagaacggcaacgctgatcctcgacctcgcctcagcgatgctcgccgttggcggcgccgcgcaggcacaaggcatcttccgcgcggcggagcagggcgccgcccgcggcaacgcggtcgcgaggcctatcggcggcctcgtcggcgctggcgtcgggggcgtgaacggcgcacttggcatccatccgagataccggcgggtccacgccttgcgcggctatcacggttaccggcatcggcactgctaccggcatcggcatcactatcactgccgctga

SEQ ID NO: 9796 - DNA, 219 bp, Methylobacterium sp.
atgtcggctcgcaccttaccgagtgtctgggtcgcggcgacgcttgcgattggcctgatcggcgtcacgcaggctgcgcccctgggcgctgcccaacccaacgttgacgtgacccagctgtccactggcttgatcgtgaagagcgtgaccgcggtcgggatggcgcatcgatcggcccgccggacggcacgacgcgttggccggcgacacggctattaa

SEQ ID NO: 9797 - DNA, 276 bp, Methylobacterium sp.
atgttcggtctgaccgcacagatccgccgcgctgcgacctccgtcgccgcgaacatcgcggaaggccacgggcgtgagaccggcggagccttcgtccagttcctgcgcatcgcacagggctcgctcaaggagttggagacgcacatcatcctgtcgggacgtgtgggtctcctggcatccacgccggtcgccctgctgctggggcgctgcgaggagatcggaaagatgctgcgcgcgctgatccgcgcgcttcagaaacccgagggaggccgatag

SEQ ID NO: 9798 - DNA, 717 bp, Methylobacterium sp.
atgctccgtctcagacgttcggacccgcggggccgggcctcgctgctctgggtgctgatcacctgcgcgctgctggcgctcgtcgccgtcctcgtgctcaggctcggcaacgagcgccggagctacgccgaggcgatccgcaccctggagaccggccgggccgcgctccggcaggagatagcggaacggcaggcggcctccggctccctggcagacctcaaggccgagatcggacgggccgagacgcgggagcggacggtggcgcaatcggcgcgcgagaccgaggcgcaggtcgcggggctggaggcgcgccgcagggccgccgaggaggccatcgcggcagcggcgacgctccggaccgatctctcgcaggcgcgcgccaaggtggatggcgccctgcgcgagagcgacgacctccagcagcaactcgccgcctcgcgcgccgaccgcgatcagctgtccgccgcgatcgcggcgctccagcagaagcgcgccgaactcgcggccgaggtctccgcgctcgacgccgagcgggccgggcgcgtggcggaattggcgaagctcgacggtcttctggagaggacccgccgggaagtctcccaggcgcaggcgcgcgcggcggacggccaccgcaaggctctcgggcaggtcgaaccgtcggcgaccgatccgcccgatgcgtcgggcgaggaaccgggtgcgcccggcacccggtag

SEQ ID NO: 9799 - DNA, 132 bp, Methylobacterium sp.
atgcgcgcgtacgccggctcgaccggcggtgcctctgcccagctgctgcgtgctgcgcgggaactctcgcaccattcggagaacctgcaccgggaggtgggcgtgttcccggccggcgtgaaggcggcctga

SEQ ID NO: 9800 - DNA, 324 bp, Methylobacterium sp.
atgcgtctcgtcccgttgttctccgcgattggccttgcggccattgccgcggtgactgttcagcccgcgccggccaaggccggcccgctcgacgggctggccggggcggcggtcggtttcgcgctcggcgcgatggtggctggccagcgcccggcctacgccgccccgcgcgggcgccgcgtcgtctaccggcaagccccgcggcgccacgtcgcccagcgcagccgaccggtcagcccgcgcggcgcggcgatcagcactgtgtccgacccgtttgccggtgctggcggcggtgcgaaaccgatcccggtcgcaggcaactga

SEQ ID NO: 9801 - DNA, 438 bp, Methylobacterium sp.
atgtcgcgcttcatgactctcgctctggccggcgccacggcactcgggacctcggtcggcgccgtgcagaccgcgcaggcggccccgctcccggccctgtcgggcaaccaagtgggcggcgccaacaccgcggtcgaccatgtcggctggcggcgcggctattacggcggcggctacggctaccgcggcgggtacggcggatacggctacaggggctacggctatcgtcgcaacgtcggtggtgcgctcgcggccggtgcggccctcggcctgatcggcggcgccatcgcggcgagcgcggccccgcgctacggctattacggcggcggctacgggggttacggcggctacggctaccccgcctacggttatgcgccggtcggctacgggtacggttatccggcctatggcggctattacggatacggcggctggtaa

SEQ ID NO: 9802 - DNA, 108 bp, Methylobacterium sp.
gtggcgcagctgatggcgggtgcggacccgacgctgctgccgtcgcggatggagcgggcccggcgggccgccgcgctctacgcggaggcggcgcggcgggtcgcctga

SEQ ID NO: 9803 - DNA, 1386 bp, Methylobacterium sp.
gtgaagtcgatgtcggagtctttcgagagcgtacgcgatccggtgctgtcccttttccagtcggcggtggcggaggtcgccgaacgcatcgacgccaagccctccggaccgggtgcacggcggctggaacggtcggcctcggcgacgttcaacgatgaggcgaccgcaatcgcgcgacgggagtgcgggcgcgacgcgggtatcgggtccggggtacggccttcctcgccggcggcgcgggatctgtccccggtcgatatgggaaaggtgtgcgtcgaactggccttgcgctacgttagggccctcgccagtgggaaccagactgcgctcgccgagatcgaggacgaatacaggaccgggacctgcgacgtggaatgggtgacgaccctgcgcgcctacgcggggtatttcggtccggacgggaagcggaagccgatcccgtacgtccggccggcgtcggccggtccgggaacgcacgagatcaaggccggttcgcgccttgcgctcgtaagcgattggggcaccggcgcacggccggccatagaggtcttgaggtccatcgcaggggtgcacccggacgtactggttcacctcggggacatctattattcgggaaccgagaaggagtgcgaggacaacttcctccgcccgataacgcgggagttgcggaccaagcgaccgaccctggtgtacacgctgtccggaaaccacgacatgtactgcggcggggtcggatattacgacctgctgccgaagctgaacgaggaatccctccgacagcgcgcgagtttcttctgcctgcgctcgacggacgagaggtggcagttcctcgccatggataccggcctgcacgacgacaatccccgctcgattgccgatgccctgacccacctcgaagacgacgagctggaatggcattgccagcggatcgaggagtttggaggtcggaccatactcctgtcgcatcaccagccgttctccgcgttctcggctatcggcgccaagccggcgcaaggcaagcggaaggcgagcaacccccacctgatgcgtgccttcgagcgcatgaaccgagagggccgcgtggcggcttggttctggggccacgagcactcgctggggatctacgagccgttctcggggataaaagtcggtcggtgcatcggtcacggcgccgtcccggtatccgtcctcgacgacatctacaagcctctcgacgacctggagcagacgcccgccatcatagagggcacgaggcttcagacgcgcggcggggtcttcgcccatggctacgccgtcatcgacgtcggggtcggctcatgtcgggcccgatacctgcaggtcaccgatgccggcacggaggaaatattctccgaagagatctcatga

SEQ ID NO: 9804 - DNA, 285 bp, Methylobacterium sp.
atggctcgcgaccgtgcggatgatgacgcgctcatcgaggaactggcggccatcgagcacgagcggtggtcccactggcagcgttacgtccacggcaaggcggcccgccagccggacggctcgctggtcctccccgccgaattggtcgagcgatgggagcgccaattcgactcgcagtacgaggatctgcccgaggacgagaaggagagcgaccgggagcaggtccgacgatatctcccggtgctgaagcgctggtcccaggatgacgaaaaaaggagcgggtga

SEQ ID NO: 9805 - DNA, 984 bp, Methylobacterium sp.
atgcggaaggccttgatcatcggcatcgaccactacgaccgcctcaagccactgaagggctgcgtcgccgatgcgaccgccgtcgccgacgtcctcgaaaccaatttcgaccagtcggtgaacttcaccacgcccaggctcctgacggcgacggacaggggcaacccgctcgaccgtcggcaactgcgcacggaggtcgaggccgtcttcgcgagcgatcccgaggtagccctgttctacttcgctggccacggtttcgtcgacgagacgggcggcttcctctgtgccagcgacagccaggacggcaacgacggcctcccgcttagcgaaatcatgacgttcgccaggcagtcgaaggcgaagaacaggatcatcatcctcgatagttgctacggtggcatagccgggaaccgggccggcggcggcggcgtcgccgagatagccgagggtatgaccctccttaccgcttcgaccgagaaggagtacgcgtacgaaggcgggaacggcgcccccggtgtgttcactaacttgctagtccacgcgctcgacggagcggccgcgaacctcgtcggggatgtgacgccgggcagcgtctacgcccacatcgaccagtcgctcgggccgtggggcgggcagcgaccggtgttcaagaccaacgtgaagtcgttcgtgtcgctgcggagggcgaagccccctatatccctcgcagacctgaagaagctggccacgctcttcccgaccccaggtcacaggatcaggctcgatccatcgttcgagcctgaaagggaacggccagatacgggggtggcgcccgatcccgcaaatactgagatctttgcggtgctccaaagctttgtgaaggtgaacttagtccggccggtcggggcgccccacatgtggcatgccgcgatggacagccaaagttgcgaactgaccgtgctcggcgagcactacaggcgactggtggccgagaagctgatctga

SEQ ID NO: 9806 - DNA, 213 bp, Methylobacterium sp.
atgacgaagatcaaaggtcgaaacgacggccccggggggcgtaacgagcattacgacatcgggtcgcgcaagaacgtgcctcgccgcaatgtcgtggctgagatcaagcgcggcgaacaccccggcgcgcacgtcgtgacggtcaatggccgggagtacgcgcgggacaatcccgacggctcgacccgggacaacgtgaacagggatccgtaa

SEQ ID NO: 9807 - DNA, 396 bp, Methylobacterium sp.
atgaagcgcccgcggatcgaggcggtccccaagcaggtcgatgtcgtcaccctcgcggatggccggttcgcgaccaagccgggcattgagctggagcggttcctcgacaacatcctcgacatccgcgaccacatcgtggccggccggccgctgcccgagcattactatcggcgcagcaccggacgcgactacctgctcgagacacggggatggctgcacctgcacgtcgggcacgacatcgacgacgatgtcctcctcatcgtcgagcagacccccgagagggtgatcttcatcggcctcaccgatcacggtatcttccgggagcgcccggccggcaaatctttcgcccggctcggcagccgcatcgcgaaggccaagctgccagccaaacggtga

SEQ ID NO: 9808 - DNA, 198 bp, Methylobacterium sp.
atggcactgccgaaatccgatcgcgagccggcagcacggccggagcgtccccgcgacggcgatctgatcccgaacgagacgtcggaatccttccgcttcgtcaggcgcgcgctccgccagggccgggtcgtgagcacgcagggtctctcggatgcggaggttcgagccgttctgctcggtcagcgcaaggacgcatga

SEQ ID NO: 9809 - DNA, 225 bp, Methylobacterium sp.
atgaagctccgcatcgcaggtctggccgccgctgccctggtgctgctccccggcgccgcctccgcgcagtggtacgagcgcgagccgcgccatcatcaccatcaccactgggaccaccaccatcaccatggcgaccgccacggtgacgagcggcatcaccgccacggctacgaccgccccatccacttcgaccgaggccaccatcatcaccatcacgggtactga

SEQ ID NO: 9810 - DNA, 552 bp, Methylobacterium sp.
atgacctaccttcgctacgcccccgacatcgagcggcctgccccggacgagcaggagaccatacacggcatcatcgagacagcccatccggtagccacgctccgcctgccgcgccaggacgcctacgggccggaccgggttcgcgacttcgacgaggtgatgaccttccgcctcgatggccgagcggtcgctgaggccccggtcgttgccctgccggttcggggtggtcgggtcgtggatctggaagaagaactccaagatgcgccggtaactcgtcctggccggatcgaagacgatctcgatgccttcggcatgcgtcccgtggtttcgataggtggcatccggcacgtcgccacccgtgtgccgctgagcccaattgcgagtgacggtttcgtgcggcattggccgacattggcgtcggcaggcctggatcgcagctctcgaccctttgaggacctagcgtcgcaagtcatccggatactcgttgacagcgatcatagcctgatctgcgagaccgccctgtgcctccacatactgatgacccgcggctga

SEQ ID NO: 9811 - DNA, 114 bp, Methylobacterium sp.
gtgacctgcccgcacctgcaaagcacggagaccttgatcgccctcgatctcaaagatgggacgctcaccccggcgaagttccaacaggccatcactcagacgtgccatgtctga

SEQ ID NO: 9812 - DNA, 432 bp, Methylobacterium sp.
atgaccaaggccccgactcaggccatgcgcgggatggcgctcgctctggcgctcgccctgttgccggcgcccgccgtcgcccacggcgacgccgcgccccaacccatcgacacgaagggtctgccggagcttggcgacgacatccgcacggcgaatccctacgcgggcaacgcgctcgcgatcgagatcggcgccaatggctacaaccagaactgtgcccgctgccacgggctcgacgccaagtccggcggcatggcgccggacctgcgcgaggtcgaggcgggcgaggccggcgacggctggttcatcacccgcgtcctacacggcgccaagaaagacgaccgttaccgaatgccccccttcgaggggatcctgagccaggaggcgatctgggcgattcggacttacgtcgagagccagccgaagagctga

SEQ ID NO: 9813 - DNA, 258 bp, Methylobacterium sp.
gtgtccggggccgtctcctcgttgaggtacggcttcaccgcgggcttgccgggcttcaacgtgtccgacccgaccgacggtgcggattgcgggccgggcgccgcggtctcgggcggcgcggcgggcttcggtggctcggagcgggccggtcccggtgccagcacggacgccgtcccgagtacgagggccagaagcgccggcgcggcgcgcgtagaggaggggcggagcatcgggttctgcagcgtcacgatcctgtaa

SEQ ID NO: 9814 - DNA, 225 bp, Methylobacterium sp.
gtgagggcgccgatctcgcgtcccgcacagggcgagaccgcctccggcaccgacacgctggcccgggcgatgcgtctggcgacgcaggccgccgatgacacccagggcgcggcgggctcgatgcttgccgtgtccgacggcctcgggcgtcagagccgcgcgatcgagcagcaggtgcgcggctctgacgccctgcgcgagccgcgcccgcgcgcggcggcctga

SEQ ID NO: 9815 - DNA, 1194 bp, Methylobacterium sp.
gtgatcgagcaggcgttccgcgtcgacgagcgcgaccgtcgccgccgggagaccgtcttcggcctagcgcttgggaccttcttctacgtcgccgtgctctcgatcgactggatcacggtaccggacgtctgcgagctgaacctcgtcgtgcgcctctgcatcggcgtgccggtcaacttggcgatgatcgggctcgtcgcacgccgcgactgcggcgatgccgcccggcaatgggccgcctgcattgtcggtctcgcctgcagcctgaccatatccgcggtgatggcgctctcggtctcgccgggggcgatcgtctacgtcagcgtcaacctcgtcatcctcggctttaccatcaatctggtcgcgctgcgcccgggcgtggccgcgctcctctgcgtcgtgatcacggcgatcatggtcgccgccgctgcggcctcgccgttcgggacccccggggtggtgctgatctacgtcgtcctcggaaccatggtgacgatcgtgtgcgtcttcgcgaattggagcctccagaacgagcgccgccgcaccttcctgacgctgcggcgggacaagatccggctgcgtcagatctcagcgcagcgcgatctgctcgaacggctcgccgcgatcgaccccctcacggggctcgccaaccgccgcggcttcgacgcgatgctcgacggcgatatcgcgcgggcgagcgccggcatgggcatcggcgtggcgatgatcgacatcgactgcttcaaagccttcaacgacacctacggacatccgcgcggcgacgcggtgctgcgcgcggtggccgccgcgctcgcggaggcctgcggcccgggcgtgcggctcggacgcatgggcggcgaggagttcgcggcggtcgcggtgggggccgaaccggccgccctgcgcgccctcggcgagcggctgcgcctgggcgtggagacgctcgccctgccgcaccggcgcaactcggccgggcgcgtggtcacggtcagcgtcggcctcgcctggacctgttcggcgggcaccgccgaccgggccgcgctgttcggggccgcggacacggcgctctaccgggccaagggcgcaggccgcaactgctcggttggggcggccgatgagctgtgcgcggcatccccccgcggacctggagatgcccggacttgcacggagcccgtggtgcgaaaagccttctag

SEQ ID NO: 9816 - DNA, 477 bp, Methylobacterium sp.
atgaagcgggttcttctcgcatccagcctcgcgctcggtgcgctcgcgatgatccccgccgccgccgacgcgcgcgggttcggcggcttccacggcggcggtttccacggtggtggcttcggcggtttccgcggcggcggcttcggcggctggcggggtggcggcttcggataccggggcgtcggtttcggcggcggctggcgagggggctacggcggctggcgcggcggctattacggcggtggctggcgccgcggttacggctacggtctcggcgggctcggcctgggcgtcgggctcggcctcgcggctggcgggctctacggtggctacggatatccgggttacggatacggctacgcccccgtcggctacggcgcctacgattacggctacggcggcggctgctacaccgtcccgcgcgtgcgctggacgccctacggctaccgcagggttctggtcgagcgctgctactga

SEQ ID NO: 9817 - DNA, 351 bp, Methylobacterium sp.
ttgaacgcggcgattcagcgggaatggaccgtcaacctcggacgccgcacggccctggaacgcctggcacatctgttctgcgaactgttcatccggttgcgcgccatcggccacacggacggcaattcctgcacgttcccgatcacgcagatcgaattggcggacgcgacggggctgacgagcgttcacgtgaaccgcaccctcagggaaatgcgcgccgctgggctgatcatcctcaagggacggcaactcacggttccggacctcgcggccttgcggaaggcgggcctgttcaaccccaactacctccacctcgaatgcgacggcgcgcatctcagcgcgaatgcctag

SEQ ID NO: 9818 - DNA, 117 bp, Methylobacterium sp.
gtgccggtccatcagatcgagcagcacctcccggggaacctgcgcgaggcgcacgggcgtgatcgcggcgatcacgtgatccatctcgcgcaggatgaagacgtgcaggtcgcatag

SEQ ID NO: 9819 - DNA, 111 bp, Methylobacterium sp.
atgacccgcctgaagacccgtctgaccgccgtcgccgttgctggcctcgccgccgccgtcgccctggccgcctacgcgcagactctcgccctgccgacgcatttcatctga

SEQ ID NO: 9820 - DNA, 348 bp, Methylobacterium sp.
atggctctgccactctgcgttgtacggtggctgcgctccgcccgtacctggatcgccctgggcatcttcgcgccgctccgcatgctcgtcatgtcgtggacgatgctgaatgaggcgatcacccaggaggccgcgtgcggtgtccgggtcgatgcggtacgcttggaacgcgtggagggggttctcggcggctctgccgcggcatcatgcgcgggacactcaagggcgttctcagcctacaacctgcatatgctgcgccgccgcactcatctgagcctctgcatcgcggtcggttcgacgctgattctgactacggtcgcggccgttgcgctgtgctggccatcgtag

SEQ ID NO: 9821 - DNA, 504 bp, Methylobacterium sp.
gtgccgagccgggctaagcccgcgccggtcgccaacggcccgcgccggagtgtctgcggccgatcgcggcggcggtcacatcctcgttttccgcttcgggcctcaacccgtcggccctctcacggatcggcgtggcctctagagcgctctccgccgaagtggacgccggttcggcgcaagagagcgcgttacaacaacggctctgagcggatcgacgcgatcatcgaccggctgctcgaggtcaccgagcaggcgcgggcgctgacggatccatcggccatcgaggcgctcaacgtcgagatcgaccgtctcgccacggaggtcgtgcgctatgcccgggagcgggagcgggagccggacgggcggacgatggcgagcgtatcgatcgccatcgatacggccaaggcgacggtcgccgactgccgcaacctcgtcggcagtcccaaggaacagagcccgcttcggatcctccggcccgtccgcgcgcccggaccggacgcctga

SEQ ID NO: 9822 - DNA, 90 bp, Methylobacterium sp.
atgccgggctgcgggcacttcccgcaccgggagaagccggacgccgcggcgcaggggatcgcccggttcctcgggcaggtgacgggatag

SEQ ID NO: 9823 - DNA, 963 bp, Methylobacterium sp.
atgttggcgctggctgccgtcctcggcgccctgctgcccgcggcagcgcagacgagctatcccacgcggacgatcacgctcgtcgtcccgttcgcggcgggtggaacgacggacatcatcgcgcgcatgatggccgaccatatgagccggacgctcgggcagtcgctcgtggtcgagaacgtgacgggagccggcggcaccacgggcgccgcccgggtcgcgaaggcggatcccgacgggtataccctgctgatgggcaacctcggcacgcaagccgccagcgtcggcctctatccgcggctgtcctacgacccgcgcaccgacttcgcgccgatcatgaactccgcctcgacgccgatgctggtcgtcgccaagaaagacctgccggtaaaggacttccgcgagttcgtcgcctacgccaaggcgaacgcggccaagctgaactacggctccggcgggcacggctcgacctcgcacctgacctgcctgttcctggacacgctgatcggggcgagcccgcagcacgtcccgttccgcggatcggggccggcgctcaacgcgctgctcggcggccagatcgactacgtctgcgaccagacggtcgccatcgtaccgaccgtgcaggcccgggaggccaaggccctggtcgtcgccgtgaagaaccgacttccggtcatccccgacgtgccgacctccggggagcagggcctgccggagttccaggcgacgggctggaacgcgttgttcgcgcccaagagcacgcccaaggcgatgatcgacacgctcaacgccgcggcacgcgccgcgctcaaggacccgacgacccgcaagcggttcctcgaactcggcgccgagttgcccgaggaggcggagcagaccccggaggcgctcggcaacctcgtccgcaccgagatcgacaaatgggtcccgatcatccgcaaggccggggtgaccgtgaaatag

SEQ ID NO: 9824 - DNA, 324 bp, Methylobacterium sp.
atgtcgaacgaacagcaccagggcctacctgtcgccggctaccaagcgcagacctcggacaaggtcacggtcgtgaacgcgaacaaggaactcgaggagcgctgcatccgcgcggccgagagcatccgcgacacccccggcatggacggccgcatggccgccctcgcgatcaccaacctgcagcaggccttcatgtggctgaaccgggcggtgttccagcccggccgggtggccctgccggaggacgccgccgagccccgcgtcccgcgccacgatcccgaggccgcgcccgccaccgcgctcggcggtcgcccgcacccctga

SEQ ID NO: 9825 - DNA, 939 bp, Methylobacterium sp.
atggagatgatcgccaacgccggcaccaatccggccgaccccttcgactggtaccgcgccgcgctcgccggccagatccacgagctgcgactgggccacgcgccctgcggcttcttccggttgcgccgccgcgacggcacgctggagccggtcgcggtgtggcccgacgagggcggcttccgctgggccaaggtcggccgtgcgggcgagcccgagtgcttggtcgaaccggaggcggaggccgcgttctgcgagcgcgtcatcgcgcattgctggcgctcgcccgtcccggaggaggtctacttctccgtcgtcgagaacgacgcgccctggcccgacatgccgccggagcgcacgaccgattacgccaacatgccgagcgacccgctcgaggccctgcgcgtcgagctggagggcgagcgcgccgaggccgaggcgtggctggccgcaggcccgatcgccgatcaggctgccgctgaccgcgccgcgaactgggcgctccgcttcgccgacatggaaaagcgcgcccaggacgggcgccgcgccgagaaggtgccgcatgagaaggccgccaaggcggtcgatgcgcgttggcgcccggtgcaggacgatgccgccgccctgaaggctcgcctgaaggacgcgcagacgccgttcctcgtcgagaagcgccggcaggaagccgaggcccgcgctgccgcggcccggaccggtgatgcgctcccggccgccagcaacgcctcggccggcaccgccggacggaagaccagcctgcgcaccgtccgcaccgccgtcattgaggacttcgacgccgcgctgatggcgctgcgcgagaaccccgagcttcgcgagctcgtccagaagctcgccaaccgcgtcgccaccagcggaggggccctgccgggctgccgcatcgtcaccaccgacaaagccgcctga

SEQ ID NO: 9826 - DNA, 225 bp, Methylobacterium sp.
atgaggcatgatgcagtcccgacggctcgctacgtcatcaccgccacagcgcgcgaaggcatcgttcagcagacgcgggtgatggccgcgagcgccgtcgtcctggctcggtcctggcaggatcgcggctacgccgatgtgaaggtgatcgacccgaagggcgatccgctcagtcccgaggcgttcaggatcaagttcatggacggcgtcaaacgcttccgttga

SEQ ID NO: 9827 - DNA, 177 bp, Methylobacterium sp.
ttggacgtgcggaagtatttcgggaccgacggcatccggggtcgggccaacggcgtgatcacgcccgaactggcgctgaaggtcggtcaggcggcgggcctcgtcttccagcggggcgagcatcgccaccgggtcgtcatcggcaaggacacgcggctctccggctacatgatcgag

SEQ ID NO: 9828 - DNA, 201 bp, Methylobacterium sp.
gtggaacgccgacacgccgagcggggcatccgggtgaactgcgtcgcgccgggcccgatctggacgccgccgatggtgccgatgaagcgtcccggccagccgagggggctcgcccccgtctacgtgatgctggcctgcgaggcggcgagttgcgtctcgggcgcgaccgtcgcggtcacgggcggcaagccgatcatctga

SEQ ID NO: 9829 - DNA, 180 bp, Methylobacterium sp.
atggaacgcctctatcgcggcctcgagaccggcctgctcggtctcggcctctgcctcggtctggcagccttcgcggcgatgtccaccccgcgcgacgccctgatgccgcgcgaggcggcgatgccgctcgccgtgacgctgccgatgctcacggtcgtcacagagcgcacgccgcggtga

SEQ ID NO: 9830 - DNA, 276 bp, Methylobacterium sp.
atgccgagccttcgccacctcctcgtcgatgccgcggccgtcgcgctggtgggcatcggcctgaccgccgccgccagcgggtacctgcacaacctccccgacccggcggcggcgagccctcccgcctgggacgagccgctcacgaccggctcgatcgccccacgcggcgcggcggtcgagaccgaggcgtcggcgcccgcggaggccgagagcccgcccgcctggatcgatccgccgctgcgcgcgtcccggctcagccgccatcgcccgtcctga

SEQ ID NO: 9831 - DNA, 96 bp, Methylobacterium sp.
atgttcgcgtgcgccttctgtcacgtctcaccgcagagcccagggcacggggacttcgccgggctcaggctctcgacgcaggagcgccagatgtag

SEQ ID NO: 9832 - DNA, 522 bp, Methylobacterium sp.
atgctggtggatgacacgcagcgcgccgctgagccgcttgcccgggtgatccgcaagctcggcgtcgtgtcgttccacgacgagcagcctggcgacgtgcattggtgcgctgaggcgcagcgcttcgagtaccgcgaccgggccgacccgagcagggtgctgttggagtacgaggagggtgggttcatctactatctgccggtcgatgcctcctcgcttcgccctggcgagactccagcccgggtgcgcgcgccgacgacgctgatgacggctggcgaagccagcgagtggctcaacgctaccagagacaacggggacggcgccgacgtgggtcctgactggaagccgctggacatcatctgcgatgcctgcggcgtggctcagctccaggcgcgcagtacggctggccgcgtggattgccgctgccctgcctgcgaggacagcacagcggcgcggcggccggttgcggcgggggcgagaggatcgggtttcggcgggatagagggttcgcgtggtgagtga

SEQ ID NO: 9833 - DNA, 135 bp, Methylobacterium sp.
gtgggcaaaggcccgcgcttcatcaagatcggcggccgagtgatctacaagctgagcgacattgagcagtgggagcgggaccgccgcgtcaaaagcacgtcagagtatgagggtgagacgtttcagggcgcctga

SEQ ID NO: 9834 - DNA, 1104 bp, Methylobacterium sp.
atgcacgttccgctgagccaccagagcgcaatggaccagctgctggcggcaatggctgctcaaggcatcgagccgacacatccgctcctcgccaatggcaagcttgagcgattccacgtcgaaggcgatcacaagggcagccgcaacggttgggcatgcatccacttggatgccgccccggccggccaatttggctgcaaaaaacgtcacggggagcacaagttctcctggcgtgcggctggcatcacgaagccgatgaccgctgccgagcgcagggcgcaacaggccgagtgggatcgcaagaaggccgagaaggcggcggccgagcgcaagcgccatgctgatgcagctgagcaggccaatgccaagtgggtcgccgccgccgaggccactgatgaccacccgtacctggtacgcaagcgcgtcaaggctcacggcttgaaggtcgggacgtgggaattcacgaacaccgacactggcgagatcttcacgctcaccgacaacgctctgctggtgccgatctgcgacaagagccggaaaatccacagtttgcaggccatcttccccgacaagatcctgggccagggcaagggggcgcgcgacaaagacttcaccaagggcgggcggaaagctggcctgttccatgtgatcggccgcccgcagcaggttgacggtcgtgccgtctacattctggcggaaggctacgcgactggcgccaccatccatgagctcactgggaattgcgtcctggtgtgcttcgatgcgggcaacctgctgccggtggccgaggcgatccggtcgagcaagcccgacgcaatcatcgtcctcgcggccgacaacgatcagtggaccattaccccgatcgagaaccctggcgtgcaccatgccacccgggctgctgccgccgtcggcggtctgctggccatcccgccattcgcctgggaggacggcaagcaggacgacgagggcaagtggtctggcccgtccgacttcaacgacctgcgcgcactcgacggcgtagaggcggtgcgcagggcaaggtcgcagccatcaagcagcgtcgtgctgctggcgacaagcgcgatgacgacgccggggcgatga

SEQ ID NO: 9835 - DNA, 132 bp, Methylobacterium sp.
gtgagcgcgctggcggctctgcgccgcgacctccgcacccttacccctccgcaggtcctcctcgtcgccctgactccgctaggcgcctttgcgctgggcatgctgatcgtgttccccgccagcttcgcctga

SEQ ID NO: 9836 - DNA, 120 bp, Methylobacterium sp.
atgacgaagctcgacgcgaagaccctgaaggccgtcaccggcggcaccgcctgccctccggccaaggacccctgcgcccccgcctgcaaggacagcggcggcaagtccaagaagtgctga

SEQ ID NO: 9837 - DNA, 117 bp, Methylobacterium sp.
atgacgaagctcgacgcgaagaccctgaaggctgtgaccggcggcaccgccaagtgcgacccgaccccggcctgccccccggccaaggacaacggcggcaagtccaagaagtgctga

SEQ ID NO: 9838 - DNA, 252 bp, Methylobacterium sp.
atgaacgacgatccgctcctcgcacggctggacgccgctctccgagaagccgagcatctgcgcctcgaggcgctgcgggtgcagcgggaggccgccgtgcgcctggccgagatccgctggtcgggcatgggcctgagcgacgcgatggaccgcagcctcgcgctccgcttggggccgcgcccggcgcgcccgggcggcgagaccgcgccgacgagatcggcgatcccggccgggctcctcccgcacgcgtga

SEQ ID NO: 9839 - DNA, 99 bp, Methylobacterium sp.
atggaagacatacccgaatcccgcatcgagcacgtcgcgatgatggagggcatcctcatctcgcgggcgaccggtggctcgcccgacaggcatgcctaa

SEQ ID NO: 9840 - DNA, 864 bp, Methylobacterium sp.
gtgacggtggagatccagaccttctcggatgctgctgagcttgaggccgatccgctctggcaggaggcgcccatcacgaagagggtccggccgatgctgttggcccgccccttccgcgggacgcgcatccgaccggtcatcacgaacggcggagacgcgctagtcctgcattttgctacgcccgacccggcgtttggcaaaggcaccgtggtatcggcctcaccgacacgacagatcatgaggcgccaggatcgcatcctcatcgtatgggcggaccgggtggaggtcatccatcgcggcggctccgttgacttcgccaagcgacgtgcagtggacgaggcagccaaggatctcctggcacacatgtactcggcgacggcccgggccaacgaggtgcgacagcaggttgcagtcgaacgcatcagaagggctcgagtccgtctaactgcctcagaaagccttctgcgggcggctgtcgaggcggtcgacgaaatggagccgggcgatccgtttctcggcgtcgccgtcgaccacttcgtggcatgtgcccggcacttggaggtcgaccgacagatgctcggggagatctgcgaccgcgtggccattgagccggggatgccagacgatgtcgtggtcgagatgttggggcggcgcctcgaagtgatgacgccggaagtatggtgcgggctggcggctgcggctggcgccggagcattcgaaccggtgcggatcgagcaacatgtgaacaggcttatggaggggcctgacgagctctgcctgtatgaacaagtccgcgtagcagccgagatggtggatgcgcatacgaacgacgcagccgctggatttccggcgcgaggcagttga

SEQ ID NO: 9841 - DNA, 657 bp, Methylobacterium sp.
atggcccgaggccgcgccgtcccgcacgccgtccgggagcgtgcgctcgacctctgggccttgaccaccggcatgtccggcgtcggcatcgccctcgccgtcggcatccgccatggcaccctctccaccatcgtcgcccgggccagggcagcgggcgacgcccgtgcgatccaccggcaggccgggcccatcctcggctcgaagaaccgcgcggctaagcccaggccggaacgggccctgaacctctggtcgaccgatcccggcatgtcggcgccggagatagccgcggcggcggggatgaagctcgccggcttcctcagcctgctgaaccgcgcccgcaaggccggcgacccgcgcgccgtctaccgggacggcaagccgatgcggacgccgcgcgagccaggggcggcgtcgacccgcaggcagccggcgttcaggcgcgggccctaccggacgcgcagcgtcgcccgggcgctccgggacgacatcctgacctcgtgggccgagggcctcgacggcgagacctgcggcgcccggtacggcgtcaccccggactacgtcctccaggtcgtggcacgcgcccgcgaatccgacgacccccgcgccctctggcgccggggcatgtcgcctacccttcgagctctgacgccggcatga

SEQ ID NO: 9842 - DNA, 99 bp, Methylobacterium sp.
atgaccctcctctccgttgaactcctgcccatctggctgctccccctcgccgtcatcgccttcgcgatgttcgacttcgaggagggcatggacccctga

SEQ ID NO: 9843 - DNA, 87 bp, Methylobacterium sp.
atggcggacgtctgcctcgcgtacgggcgggaagtcctcatcgcgcggccgacgacgcgggcgtgcccccgggccgatgccagctag

SEQ ID NO: 9844 - DNA, 171 bp, Methylobacterium sp.
atgcgcgacctgctgaagatcctcgccgccggcagcctgctgacggtctacgccctcgcggtgccggcgctgatcggtgacatctccgccgcgccccggcgtcccgggacggcgatggtcgcggaggcgcccgagccgttcctgccggccggtgcgccgcgatccctgtag

SEQ ID NO: 9845 - DNA, 495 bp, Methylobacterium sp.
atgggagaggggggttggcgcggttcaccccccacggacgaaccaatcaaccggagaccgtccatcaagggcgaagacggtcgtgtcgtcttcgacggcctcttcgatttcagcggggcgaacgaggcggccttcacgctcgagacgaagctcgacggggacaccacgcgcacgggcacgatcgtgctcaacgccgagaccctgggccgcctgcaggcgaggctcggcttcgccgacctgtcgaagctcacgggcccggatctcgtgcggtcgatcaacgcccagatcgaggccacgggcgagaccgggctgaggggcacgctcgcggcctccctcgatcccggggcagcggcacggcttccgccgacgcgacccgcctcgtcggcgcccgcaccttcgcgccgaccgacacgttcgatttcagcggccccctcgacgcgagcaccgcccgggagctcgactatatcggcgcccaagagatcagcttcgatctga

SEQ ID NO: 9846 - DNA, 1197 bp, Methylobacterium sp.
gtgacgccgcgcaccggccggatcaccctcaacgcggagatcctcgacgccttgaagacgcgcacgaaggtcgaggcgctcgcctcgatgacgttgtccagggtgacgccggacgagctcgtcgccgcgatcaacgcgcagatcgaggccacgggcgacgcggggctgaagggcaccgtgcgcgccgccctcgacgcgacggggcggatcaccttcacgaccggcgactatggcctgtcgggagccgcggacgggacgggcgcccgcaccgaccgggtctacgcggcgtccggctcggaacggacgatcgaggtccggagcgccgacacgagccggctcttcacctccggcttcgacatcggcttcggcatcgaccggaagcgcgacgcgagcggacagggaagctggcgcgacggaacggcggccctggtcgccggatcgcgcgcctacaaggccagcgacacgatcgacttcagcggcacgaacgaggtcgccttccggctcgcgacgcgcctcgacgcggcgacggagcgcgcggggcgaaccggactgcagggaaccgtccgggcctcgctcagcgcgaccgggcgcatcgtcatccggacgaccgactctctcgatctcggtgcggacgggacgttcggcggcttcggcaaggacggcgacaccgcctattccggggtcgggagcggacggacgctgtcgctccagaacatcgaccggacggccgcgacgcagaccgggatcgatatcggcttcggcatcgacaacggtcccgatgcgaccgcgcggaacgcgacgcgggcgtacctgcgcgaagccctggaagcggatgcgggcgaggacgatgccggcgtgcgtctcgccctctatttcagccgcatcggtccgagcatcaggtcgggcttcgacatcctggccgacaaggcgttgtcccaggtcatcgcgacggttctgaacctgcccgagaccaccggctcgtcgagcgaggcggtcacggcccgcgccaggctgatcgagcgccggatcgacatcaaggcgttccaggaccccaggaagctcgaagcgttcgtcggccgcttctccgtgatgtgggacatcaggaatcgcgcgccatcgccggccctgtcgctcttcggcggcaccggcggagccgaaccgctctacagcgcgatgagccgacgaagctggttctga

SEQ ID NO: 9847 - DNA, 99 bp, Methylobacterium sp.
atggtgcggacgggcggcatcgacgggcaggccatgacttcgctcgagctccggagcgtgcgcgggccccggccggaccgctcggccgatcggggatga

SEQ ID NO: 9848 - DNA, 939 bp, Methylobacterium sp.
atgatcgagtatggaaagttcctgacgggcggcggtcgcatggccatcaagatcatggagcacgactggggagcctcggcactgggtctcgtcgaggcgtggccccgtgccttgcggtacaccttgagcggcatgctcaactccgcctttccgacctatctcgcctggggccccgaactcatcagcttctacaacgacgcgtatcgccccatccttggcatcaagcccgaggcgctcgggcgccccttccccgaagtctggagcgaggcatgggagcagatcgggccgctgaccgaccgcgcgttgggcggggaggccagttacctggaggattacaccgtcacggtggatcgccatggagcaagggaacggaccctctggacctttgcctactcgcccgtccgggacgaaggcggcagcgtgcgcggcgtgctctgccacgtgcacgagacgacggggcgagcccgcacggaggagcggctccgatccgctctgcgggagatcgaggtgcaacaggcacgcttcggcgccctgatcgagcatcttcctttcgcagccggcctcttcggggccgacggaagagcattgctcgccaatccgctttgccgacggttcttgccgagcggcaaggcgccctccgtcgatccggacgcgcggacgcagtggaccggcttcgacgcagagggccgcatcgtgagcccggacgactacccgctcgcgcaggcgatccggggcgaggtcgtgcgggacatgagttttctgcaccgcaccagggacggtgacgcgtgctggatgcgggtcagcggcatcccggtccggcaaggcaatggcggtatccagcaggccatcgtggtgctgcgggacgtcgaccgcgagacccgcgccgaggcggccctgcgcgagagcgaggagcgcttccggcgcttcgccgagcattcg

SEQ ID NO: 9849 - DNA, 87 bp, Methylobacterium sp.
atggccaccgtcgcccccgccgtcagcagcgcagcagtcatcgtactccggatgagtttgttcatggggcgcttcctcgtcctgtga

SEQ ID NO: 9850 - DNA, 354 bp, Methylobacterium sp.
atgccgagatcgcgctggctgccgggtctcctcctgtgttccctgaccctgtcggccgcgcacgcggcaccgtccggcgggccggtggcggagcatgaccggacgatcgcggacgccgccctgaggcggcagatgaaggccccccggctcggcgagatctggtatcgccgcgaagggcggacgctgtgcgggttggtacggaacacgccggggaccgacgaggccggctggcgcatgttcatggtcgtgctggagtccggccagagcctcgtcgagccgtcgcgcgaggaggagcgccgcgacaagcgtctcgtgctcgagaaactgaagcttctgagtgccgagtgcgactga

SEQ ID NO: 9851 - DNA, 816 bp, Methylobacterium sp.
gtgatcgccgcggcgctccgggtggcgcgggcggcggagccggaggccgtgcgccaggcgccggcgccaccggtcctgagcttcgaccgggtcggcttcgcctacgacgggcggacggtgatgcgcgacgtctccttcgggatccgtcccggcgagatcgtcgcgctactcggtccctccggctgcggcaagacgacgatcctgaacctcgtcgcgggcttcctcgcgccgaccgaggggcaagcgctcctcgatgggcggccgatcgccgggccggggccggaccggggcgtggtgttccaggccgccgccctgttcgactggatgagcgtcgcggagaacatcgccttcagcctgcgctgcgcgggcgcgggccggcgcgcccggcggcgggccgccgaggagatggccgcgctcgtcgggctcgcggggcgcgaggatgcctacccgtacgagctctcgggcggcatgcgccagcgcgtcggcctcggccgggtgctcgcggcccgcccgcgggtgatgctgatggacgagcccttctccgccctcgacgtgcagacccgtgagggcctgcaggaggaggtgctgcgcatccgcgaccgcaccggctgcaccatcctgttcgtcacccacagcatcgacgaggccgtgttcctgggcgaccggatcttcctgctggaggacgtctcggccggccgcttcgagaccttcggcgtcgacctgccggggccgcgcgagcgcaccgagaaccgcctcgcgccgggcttcctgcgcctgcgcgagacgatctaccgccgcatgcgcgccccgcgctga

SEQ ID NO: 9852 - DNA, 1389 bp, Methylobacterium sp.
atgagtctcgaacgtatccatctcgacttcgcgacgatccgcaccgccctcgcggcaggcgtgtcggcattggctctcgtcgcggaaagccaccgccgcgccgcggctagcgccgatgacggcatcttcaccgcgctcgtcccggccgacgcggccctggcgcaggccgagcgccagcaagcccgcgcggcggcaggcgagagcctgccgctcctcggcctgaccttcagcgtcaaggacaacctgcacgtcgccgggatggtgacgacctgcaactgcccgggtttcgcgatccaccccgacgagagcgcaccggcggtcacccggctggagcgggccggcgcggtgctcgtgggcaagaacacgatggaccagttcgccacgggcctgaacgggacgcgcagcccggagccgctctgccgcaacgccgtcgatccggcctacatccccggcgggtcgagttccggctcggcggtcgcggtcgcgcgcgacctcgtcgccttctcgctcggcagcgatacgggcggctcgggccgggttccggcagcctgcaacggcatcgttgggctcaaacccacgctggggcttgtcagcacccgcggcctcgtgctcaacagccgcctgctcgactgcatcccggtcttcgcccggacctgccgggatgcctgggagatcctcgacctcatccgcggccacgacccgcaggatcccggcagccgccccgacgctgacgcgatcgcccgcggaccggtctccgcggaaccgtccgtcctcgcggtgttccggcctgccgagatgccgttcttcggcgacgatcacgcccgcgccgcctacgaggccggtctcgcggtgctcgcgcgcctcggccatacctttcgcgagatcccgttcggtcccttcgccgaggcgggccgcctcgtgttccagtcggcgctggtggcggagcgcctcgtgtcctacggcacgatcctggccgagcgtccggaggcgatccatccggccgtgcgctcggcgatcgcggcgggcacggcctattcggcgcgcgacgcgttcgaggccctcgacgcgctccgggcgcttcggcgccgcgcggccctcgaactggcgggcaccgccaccctcgtggtgccgaccgttccgacgatcttcaccatcgccgagatgctggccgagccgatggcccgcaacacgcagatgggcacctacacctacttcgtgaacccgctcgatctctgcgccgtcacggtgcccggacggcgccgccccgacgggctgccctccgccctctgcttcgtcggacaggccggcaccgatcacgtcgtgagcgcgctcgccaccgctttcgaggacgcctcgcgcgccgggtcggtgctgggccgcgcgctctga

SEQ ID NO: 9853 - DNA, 171 bp, Methylobacterium sp.
atgagccccgccgataccccagagccgaatggcgagccgacaccgatcggcgatccctcgccggagccgcagacgcccgagggcgatccgccgccgaacccgcccgccccgcagccgcccgggccgatccccgagagcgatctcgagcaggtcgaggagcagccgagctga

SEQ ID NO: 9854 - DNA, 1341 bp, Methylobacterium sp.
atgccgacgccccgcccgcgccccttcttccctgccctcgttgcctttgagagcgggcgcgacaccccccgtgccttcctggaaggctgcctggaggaactgacgcgctgggagccgacggtcggcgccttcacgcatacggacctagagggggcccgccgcgccgccgacgccgccacctcacgctggaaggcgggccggccgctctcgcgcatcgatgggatgccggtgggcgtgaaggacaacatcgacaccgacgacatgcccaccggcaacggctcgccgctgtacgacggctaccgaccgcgtttcagcgccgcctccgcccaggctctgcgagaggccggagcggtgattctcggcaagaccgtgacgaccgagttcgcctccacccaaccgcgcggcacgcgcaacccctgggatctcgcgcgtacgccgggtggcagcagcagcggctcggccgcagcggtcgcagcagggatggtcgcgggagcactcggcacccaggtggtgggttccatcatccggcctgccggcttctgcggcgtgtacggcttcaagccgagcttcggcgggatcaaccgcggcggcagcctcgacttcctcagccagagctgcacgggctctatcgctgcgagcctggaggatgcctggatcctcgctcgcgccgtcgcggccgaggtgggtggcgacccgggctatcccggcctcggcggcccgttgctgccgcccgcagcccgcgcaccgcgccgcctcggcctgctgcgcaccgccggctggcccgtcgcgagcgaggaagcccgcgccgcactggaagcggcggctggcgtgctgcgtcgggcgggtgtcgcggtctcgacgccggagacgagcacgtcgctcgccgcgctggaaggggccgtggcggaagcgttaccggaaaccctgcatatgctcgcttgggagtggcgctggccgctgaacgccttcgtcgcgcggaatgccgaagccctcagcccctcctcacgcgagcgcgcggcggtcgcccgggcggtgacgcgggaggcatacgtgtccctgctccaacgccgccgcaaggcgcgcgcgctcttcgccacggtgatggacgatcatgacgccctcatcggcctcactgctccgggcgctgcgcccgtaggtctggagacaacgggcaatcccatctgcgtcgtgcccggctcgtaccttggcggaccggtggttgccatgccgctgttgcgggacggagggctgccgctcggcttgcaggtgctgggcaagtctgacgaggacgaggtgctttttacgcacgcctcgtggatccgcaacactcttcggagttga

SEQ ID NO: 9855 - DNA, 129 bp, Methylobacterium sp.
ttgatcaatgctctggccgcggtcttcaccgttctcgccgtgctcctcctgagagccgtgctgaagctggcgatccttcccttccgtgccctgcgtagcctgtggcggcgacagacggcaccggtctga

SEQ ID NO: 9856 - DNA, 237 bp, Methylobacterium sp.
atgcgcaccatccagcgtctcgcccttgccgctctcgcctccgctgccgctgccggctccgcgatggccgaggaccggatcgacctgacgcccccgctctaccgtgagcaggctcgcgttacggcggctgtgcggccggcttccgagctgaccaccacgccgaacctgaccgctgccgccccggccgctccgcaggccccgcgcttcgtcgccgaggccggtgcgctgacccgctag

SEQ ID NO: 9857 - DNA, 84 bp, Methylobacterium sp.
atggtctcctcgaccgggccgacccgggtggtcatcatcgtcgcctacgccctgatgaaggggtggggccaaggggagtcctga

SEQ ID NO: 9858 - DNA, 1062 bp, Methylobacterium sp.
atgctcgacgaacgcacgcgcaagagctttcccatcgcggacccggaaccgtccgccttcggggccgcggcggggacgcgcgactgggtcgcggagttccggcgcgagcaggcgcacctgatccggacggcgcccggcgacggcgcgtcccggctcctcccctacggcgtcggcggggcgctggccctggcgctcaccgtcgcgctcaccaccgttctgcccacgcgcttccccggagccgcggcaccgggggacagggccgcgtccgccccggccgtgccgcgcatgccggcaagcgagctcgccgaggcgcgggaggaagggctgaccttcgatctcgcccgcgcacggcaggaggccgaggcggcccgggcggcgcacgcgcaggatgccgagacgctccgcgcggcccatgcccgggagatcgaggcgcttcgggcggcggccgccgaggcggaggccgccgccgaggcgaagggtggcctgctcgcgcgcgacctcgagagcgcgcgcgccgggctcgccgcagctcggcgacaggccgcggacgccgacgcgcaggccgcggagagccggggccggtccgagcgcctcgccgggcagctcgccgaggtggaagcgcgggcgcgtgcggaacgcgcgggcagcgaggccgcgctcgcgcaggcggcgcgggagcgggacgaggcgcgcacccgtctcgccgaaacggcccgggcgaccccgccacccgacacggacgccacgacggtggagcccgcggccacgccgcagcccgtcgactggaccctcttcagcctgcgcctcgcgccggccgaggaggcctcggcgaccgcacccctcgtgcgggatccgcagcgggcgggctccgatcagaaggggcccgagcggaaggccgcccggcgggcacgggcgagcacgcccgtgcggaccgattcggccccgcgcgcggaccggcccggccggaccagggccggcacggcgcgggcacccgccgcgaccggcggcccggagccggcgccgccccttcccggtgtcgggctcgccgaacccgacgcgtga

SEQ ID NO: 9859 - DNA, 246 bp, Methylobacterium sp.
atgcccgatctcctgatcaaagatctcgatgacgcgaccttccggacgatcgctttccaggcggaggcgatgaaccgatccgtcgaggatgtcttgcgcgagctgatccggatcggcctgctgcacgacgtcgaggggcgtgtcgccgttgcggacagaatccggtcgatgtcgcggccgcccccgcctggaaccgtcatcgaggacagcacggagatcatccgggccctgcggggacggatttga

SEQ ID NO: 9860 - DNA, 1032 bp, Methylobacterium sp.
atggagggcttctgggcccgtgagggcgagggggaatggccgatgcggtcggtgccggtccgggcggtgacgctgctctgccccgcgatggtgacgggcggcccgcaggccctgcaccagctcgccttcgcgctgaaccggcgcggcctgcccacgcggctggcctactacgccaacggcggtcggctggtgcgcgagggcgacgcggtccgctgcgtggccccgccgcagaacccctgcctcgtggcctacgacaagtactgcccggtgccggccgagcgcttcgccctcacgcccgaccacctcgtggtgctgccggaggtgctggcccacctgcaccgcgactacgcgccggcccaggcggcggtctggtggctctcggtggacaacgccttccacgagcgctccgccctgcgggacgcgggcgtgcgcgcggccctgttcgcgaaccgcgagttgcggcactgggcgccgaccttctacgcccgcgagttcctgcgccgcgagggcgtgctggagatcgcgatgctctccgaccatgtggacgaccagttcaccacctggcggccggaggggccggggcccgacgcggtggtcgcctacaacccgcgcaagggcggcgcgctggccgaggccttcttcgcccgccacccagacctgacaccgcgcccgatcaccggtctcaaccgccgcggcgtctgggaggcgttccgcagggcgcgggtctatctggatttcagccacttcccgggccgggagttcatgccgcgcgaggcagcgggttccggagccgtcatcttcgtgcgcaacgtaggcgcggcgcagcacttcgacgattaccccctacccgatgcctaccgtttcctcgatgccgctctcgaggacggtacgctgcacgcgaaggtgatgtccgccctcgccgagccagagccgcactgggcggttcaggcaagcctgcgccagaacgtgcgttgggaggcagagacgttcgatcgtcaggcggatcgactggtcgagcaactcagcgcctag

SEQ ID NO: 9861 - DNA, 1338 bp, Methylobacterium sp.
gtgatcggctacgggttgaatgaagtcgagggtaagagtcaccgcctgttcgttgacgcggcaacggtcacggaggcggaatacgcgatgttctgggagaacctccgcgcgggtaattacgtgtccggtgaatttatgcgtgtcgcgaaaggcggccggaaagtttggctcgaagccagctacaatcccgtccgggacgcggacggacagccctacaaaatcatcaaattcgcatccgacatcacaagtcggaagaacgaaaacatcagacagagcatgatgatcgacgaggtcccggtcggcgtcatgacggccgatccgagcgatgatttcaaaatcaactttatcaacaaaacttcgctcagtactctggagacgattgaggaacatctgccgatcaaggcctctgaattgattgggagatcttttgatatattccataagaaccctggacaccagcgcaggatgctcgccgatgcaagccgtctgccgcatcgggcaaagatcaaggttggacccgagacactcgacctgaaggtctccgcgatccgggatgcggaagggcgctacgtcggcccgatgctgacgtggtccgtggtgacggcccaggtcgcgatggtggcggaggtcacgcgcgtcgtcgatgcgctccggcaggcgatcgaggaaatgcggagttcggccaagggtctcaacacctcggccgatcagtcgagtgagctcgccgcctcggctgccgccggttccgagcagatggccagttccctccaggagatctcgagccaggtcggccgggtgtcggagcgggccaaccagatcgccgaccaagccaacgcgactgtggggacggtgcggatcctcgccgagaacgccgtcaagatcgatgcggtcgtcggcatgatcaagttgattgccgatcagaccaacctgctcgccctcaacgccacgatagaagcggcgcgcgccggtgcggctggtcgcggcttcgccgtcgtcgcggccgaagtgaaagaactcgctggccagaccgcccgggcgaccgaggagatcactcggcaggttcaggccatccagggcatcacgcagcaggcggtctccgcaatcgacacgatcacggccgcggtcgacgagctatcgagactgacgctgaccatggcgagttcggtggaggagcaggcggcctcgtcccaggagatggcgtccaacatccacggcgtctcctcggccgctggcgcgaccggccaactcgcggagagtgtccgccagatctcggagcggctcgcagactacccggccggtcttacgcagagcgtagagaccttcctgaaggcgagctga

SEQ ID NO: 9862 - DNA, 846 bp, Methylobacterium sp.
atgacgaaaatcacttctctctcagcacttctcgcagttctcgcatcgggcaccgcgctcgccgccgatctgccgcgccgcgtcgcgccgccgccgagcttcaatcccatcccggtcttcacctggacgggcttctatctcggcggaaacgccggctacgccttcaccacccgcgagagccgcaaccgcaacgcggccttcctgatcgacgatcgggacatcggcacggtcgggggcacgttcggcttcaacaaccggggccagaacggcttcagcggcggtctgcagatcggcgccaactaccagttcacgccgggctcgggcttcgtcgtgggcgtcgaggccgacgcgcagtacctcgatgccggccgccgccgctcgggcgtcgtcgcgggcgccggcaccgtgctgaacccgaacgccgtcttcttcgacccccgcgccaccgccgggctcgagtatttcggcaccgtgcgcggccgcctcggctacgccttcgaccgcacgctcgtctacgccaccggcggctacgcctacggcggcggcagcgagcagcgctacttcggcgcgaccgacaacgcgcagatgcgcacgggctggacggcgggcgccggcctcgaatacgcgctgccgaccgagtccttcctgaacttcttccgcgcctcggcggtgacgatgaaggtggaaggcctctacgtgaacctggagcggaacaagggcctcgccctgctcgccgtcaacacggtgacgggcgacgtcttcctgcgcacccccgaccgccgctcgctgggcgacgacttcgcggtggtgcgggccggcgtgaactacaagttcggcagctactag

SEQ ID NO: 9863 - DNA, 96 bp, Methylobacterium sp.
ttgatcaacgcgaagatcgagagtgaactcttgtcgatgtcgatccttaccgcgaggcgggtgtggagggtctccatcgtcccgatggacgactga

SEQ ID NO: 9864 - DNA, 1680 bp, Methylobacterium sp.
gtgcgtcagatcatcctggccctcgtcgtcagcgtggtgatcgtggccggtggcctcctcgcgggggtcagccagtacgccggcgcgcggcgcgcgctcgtcgacgacgcgcggacccgggcgctgcgcttcgacgccgtctatcgcgaggcctcggaggcgcggctgcaggcgctgcgcctcgccgccgagatcgtggcgcgcgacacgctcgtgatcgaccccctcgcccggcgcgaccgggccgagctcgcccgccgcgcggtgccgctcttcgagcaggtcctgaagccccgcttcggcgtcaccctgctggggttccagggcacggacgagaccaccttcctgcgggcccaccggcccgagcagttcggcgacagcgtcgcgggccgcgcgatgggggccgccgtcgccaggggccgaagcacggtggcgggcctggagatcgggcgcgcgagcgggccggagctgcgcgcgatgagccccgtcgtctccggggagaccctcgtcggaaccgtggagctcggcagctcgctcttcgaggcgctgcagatcgccgcccaggcgaccggcctcgatttcggcttcgccatggagcgccgcgccgccgaggcgctcgaccgtccgccggggccggaggcgctgcagaagggcgatgcggtctatatccgcttctcccgcccggaggtccgggacctgctcgccgccgccccggtcgacctcgccgagcaggccccccaagtggtcgacggcgcgggccgggagatcttcgcccgcacggccccggtcctcgacgtgagccgccagccggtggtccgcatcacgctggtggaggacctcaccgacccgctcgccgagcgccgggggcgaatcgtcctctacaccgcgctcggcaccgcgctcctgctcgccctggtccttgccggactgctccagttccgcgccctgcggacccggctggagcgcagcttctccggacgcctgcgggaggtccacgccaaggcgcaggcctacgaccggatcagccagtcgctgcgcgacctcaccgcctggaagctcgggctgctgggcgagctggtcctgctgatccgcgatcccctcaccgccgtccagggcgcgctggagaccgccgggcgcgcgggcgagccgtcggcgggcgcggccctcgccttcgcggccggcgaggtccggcgcctcaacgcggccgtggccgaccacacgaccatgctggcgatgcgcgaccgtctgcggcgggtcgaggcggggcccgtcgatctggccgcgctcgcggaggcggtcgcggccgatgccggcggggcgcccgcgatccgggccgccgtgccggcggacctgcgtccggtccaggccaacgcggccctgctgcgggcggcgctgcgcaccctcgtcctgacgcttcagcgcggctcggacgcggcgcccatcgtgatcgaggcggcgaccgagggcgaggggatcgtcgggcgcatcgcgggctccggcgggtggagcgccgggccgccggggctcgaggaggtggtggccttcggcagcgccatgcaccagccggcgggcagtcccctgatcctggcgcgcctcaccgtcgagcatttcggcggcacgctcgcgttgctcgacgagccgggcctggccggcttccgcctcacgctgaaggccgcatga

SEQ ID NO: 9865 - DNA, 1467 bp, Methylobacterium sp.
atgggcgcgcgcggcgtctcgcggccctcgcccgccctggtcctgcccttcctgacggtcgccggcctcctcctgttcgaggatctgttcaacgcccccctggccttcctcacgggcatcgacccggagacgatccggcgctgcgaggcggcgcttctggtggcgatcgcggcgctcctggccgcccgcttcgtccggcgcgacctgatccacggcctgctggaggcccgcgccggcaaggcgctgccccacctcctcggggacgtcgccggcctcctggtcctcgtcctgggcggtaccgtgatcctgaccggggtgtacggccgggacatcggcaccgtcctggcggcgggcggcctcagcctggcgatcctcggcctcgccctcaaggacgtgatcctggccgtcttcaacggggcggcactcagcgccgagaacgccttcacggtcggcgaccgcatccgggtcggcgaggtcgacggggtcgtggtgcagtcgacctggcgcagcaccaccatcctgaccaaggcgcgccgcctcgtctcgatccccaacgtcgccctgggcaccgccgcgatcaccaatttcgaccggccggacaggagcgagcagcgcatcctcgagatctgcctcgactacgacgtcaccgccgagagcgcggagcggatcctgctcgcgggcgtgatcggcgcggcgggcgtggtcctcgtcgacgcgccccgggtgcacgcgatccggctggagcgcgacggcgtgctctacgccatccgctacgtcatcgccgaccacgacaacggcctgtcctcggaccacgcggtgatccgcagcatcctgtcccatctgcgcgatgccgggatcggggtggcctacccgaagcaggaggtggtcgccgccgagcgccgggtccgcgtcgccgaccggaccttcgaccggcgcgtcctcgtccagcaatgcgcgctgttccgcggcctggagccggccgcccaggcgcggatcgccgaggcgctgatcgagcggaatctgcaggcgggcgccctgttcatcgcggccggcgaggtgcgcccgtccgtcttcatcgtcggcgaggggctgatccggcgcacgcgcgtccggcccgatcaggtcggtttcgtcgaggagcgctacgtcgcgacccagaccttcgggcgccgcgcgctgctctccggcctgccccaccccgcgcccgtccgcgccgtgacccagagcctcgtcctcgaactgacccgggaggcgctggccgcggtgctgcgggcgcatccggagatccgggcgccgctcgcgggcaacctcgcgcgcgcgccgctgcacgacgtcgcgcacgcgacggaggtcagcgcgctggagagccgcacggagcggccggtggcgttctacctgggccttctggaggccgtcgctcccgaggcgcccccgccggacggcggcgcggggcccggccgatcctga

SEQ ID NO: 9866 - DNA, 162 bp, Methylobacterium sp.
atggccgagatcggccgcgggccgcccgcggccgagcggccgaacggatacggacatcccatgctcgacatcgtcttccttgcgggcggcctcgccgtcttcgcgctcgccgccggctacgccgcgctctgcgagcgccccgcgctctgcgagcgcctctga

SEQ ID NO: 9867 - DNA, 240 bp, Methylobacterium sp.
atgacgctggccctggccataccggtcgtcgaggctgccgccttcacggcggggtgcgtgctcatccacggccatcgccacaggccggaaccggtgaccttcgccctgctgggcctgctctgcctcgtcgcgctcggcggtttcgcgctggtcctcgcgcatgtcggccctgacgacccgatggcggcgaccgcacagctccccttcgagaaccatgcggcgggagccatccgctactga

SEQ ID NO: 9868 - DNA, 270 bp, Methylobacterium sp.
gtggctgcctggttctccgaagaggcgcaccgccagcaagcgcggaatcttgccagtcagcgggctgcggccctggtcaggtccaaggctggctccatggccataagggccatggcggacgccctcatgcagaagggggaaattaaagcggacgagatcgcagggctctgccgtgaggcctatggcggccgtcagtgcgagttcggcgcctggaacgctcactggccgcctacgctggaacagctgcgatcaggctacatccccgactga

SEQ ID NO: 9869 - DNA, 231 bp, Methylobacterium sp.
atgtcctcaagcgtgttgctgcgactggtgcgtaccgagatcaccgcagcggaaggtcgcgcgtcggctcttgccgacgcgatcagggggcgcctgaaagccggcgccgacagcactgacgtggagcaggccctgttccacgttctggacagcctgacgctcctgcgtgccaagcaacaggccttgcatcgggtcgcgatcgaacagcagcaaggttccgcagcggcctga

SEQ ID NO: 9870 - DNA, 177 bp, Methylobacterium sp.
atggccgttgttctcgatattgcgaagagcctccataatcgtcacgcgatgatcttctgtgggcatgggtccctcctcggagcccggctcgctgccgcgctccggcgcggggccgaccggcgctacgcggagcagcgcgatcgcatcgagcgcaccgggtgcgcgggaatcttctga

SEQ ID NO: 9871 - DNA, 216 bp, Methylobacterium sp.
atgggcggcggggggcatgcgggagatgcggcggccgaggccgagcccttcgtcgcgcgtggcgacgatcctccacagcacctcgatcgtcgtgccatgccgctcgacgccgtcatcgccggcgccatggcggtgctggccacggaggccgagagacgctgcccggggccgatgaccgggtgggcgacaatcccggcgcgaacgggcacgcgatga

SEQ ID NO: 9872 - DNA, 174 bp, Methylobacterium sp.
gtgaggccaatcctggacgagcccgtccctgcgggcagcgcgcgcacgcggcatcgcctcatcgtgcccgggccggaggagccgacgtcgaagcgtcgtcagcggacgagcgcggagccggccgtgctcaagctgcgccagatcgaggtgcagatggcgcaggcgaggcgctga

SEQ ID NO: 9873 - DNA, 1569 bp, Methylobacterium sp.
atgatcgacacgcccgcacttcccaacgccataacgatcacgtggatttcccgaggtcttctcgttcttgccctgaccgccttcggcgactggctgttctacgatcgcatcgtaggcctgtcgctggccctcttcctgatcgcgcttgccgccacggttccgctcaccaacacggtgcagacggattggcgcgcccgcggtctcgccttcgccgtcctgatcctcggcctcctgccgctcttggaggatgtcggtgtcctcgccgtcctgttcggcatcggcggtctgctcggatccatggtcctgatgaccggcggcctcgctcccggccggctggcgaccctcggggccgtacggcggatgctggttgccggaccgttccagatcgtaacggatctcacggccggcatgtcccggcagcttgccgccggtgcgccgcgctggcgctggcagccgatcatcggttgggtcacgcccatcctgctcggcgcgctcttcgccctgctgttcgccgcggccaatccggtgatcgacgcgtggctttccgcggtctcgtggtcgagcctccagcctcgaatcagtgtcgggcgggccctgacctggctcattctggccgccctcgcctggcccttcgtcacggtccggcgccgctaccccgcacggacagcatcgccggaggccgacgcgccgtccgctgtcccagtcggcatcgcggcggccctcggcctcggtcccgcggtcatcctgcgctgcctcgtgctgttcaacctgctcttcgcgctccagagcacgctcgacatcctgttcctctggggcggcctcgccctgccggccggcgtcacctacgcggcctacgcccatcggggggcctatccgctgatcgtcacggccctcctcgcggccgccttcgtcctgaccgtgatgagcccgggcggccccggcgagcgcttgcccttgatccgccgtctcgtctatctctggatcggccagaacgtcctcttggtgatctcggcgatcctgcgcctcgacctctacgtcgcggcctactccctgacgctcgtgcgcgcggccgccctcatctggatggggctcgtcgcgggcggcctcatgctgatcgtcgcgcgcatcgccctgcgccggtccaacggctggctcctggccgccaacgccgccttgctcaccctcgtcctctacgcctgtgccttcgcgaacctcgcggctctgattagcgactacaacgtcgcgcacagccgtgaactcggtggcggaggcggatcgttcgatctcgcctacgcgatgaggctcgggccggacgcgctaccggccgtcgaccgctacatcgcggtcgccaccggcccgaaccgggccgccgcgatccactggcgcgtgcgggccgcccgcgagaccgcccggacgatgcaggactggcgcggatggacgttccgcaactggcgtttggcgcgctacctcgccgcgacccccgcacctcccccggccccgacgcccgatgtcgccctcccgggtggggacggcgcgctgccggacggtggcgcagccggcccgcgctga

SEQ ID NO: 9874 - DNA, 1038 bp, Methylobacterium sp.
gtgccggagcgggcgcatcccggaggccgcggcatgcgcccgctgaagccgatcccccggctgcacggcctgaggccgttcgggctcttcatcgccgcggagacggccggcctcgccaccgcgatggccggctcgctcgacatggcctggcttccgatcgggcacgggctctgtctcgccgccaccgccgcagccgtccgcgcggagcggagcggcgagtgcaccttcgcggtcctcctgctgctgctggccgcctgcacgggcccgatcggcccagcgggcctgcttctggttcagtcggtcctgacgcggacccggatctgcacgaacgagctcgacgcatggtaccgccgcctcgccggcgacacggcaaccgatccgtcggtcaccctctacgaccggcttctcgatgggcgcgcgcgccggacagggcggggcgggcccgaccatttcccgaccgtcctgcacggggacctcgtccgccagcaggcgctgctcggcctgatcggcctggcctaccacccggattaccgcccgatcctggctcaggccctgtgcagccaggaaccatccatccgcgtccacgctgcggcggtctccgtcaagctccgggcccgggccctggccgaattcaagcgcgcgcaggaggccgaggcggacgggccggccgcggagtgcgccgggctggcgctgcggctgctcgaccttgccgacggcggcttcctcgacgccgagaaggcgggcgtggccaggacccaggccctcgctctcgtggtgggcgccggccggcccgacgtggccgcgtgcgatgtggccgcgcgcgacccgatcgggcgccgggccctggcgggactggagcgctgggaggaggcggtcgcggatccggaagcagccggccccgtgcgcgaccccgaggatctccggctgcggatgctctgtctgatgcggtgcgggcaggcgcgcgcgctccacgcccttctcggggcgcgagatgcccgcgccccgacgaaacgcggagggctgcaccatgtggtttga

SEQ ID NO: 9875 - DNA, 1086 bp, Methylobacterium sp.
atggcgacagacaagtccgctgaggcggtacggccccgacggttccggctgcacggcctgcacgagaccgcgctgatcttcctcgtgctgctcggtatcgagtggatcgcgccggggccggccttcctcgcgcggctctcgccgcacccgttctggatcccggtgatcctggtgagcgtgcagtacggccgtgtcagcggtctggccgcggcggcgctggcgaccgccctggccagcctcgcgggttggcccgcccagacgccgcaggaagatttctacacctactcgctgcgcatctggcgcgagcccgccctctggattatcggggcgctcgtcatcggcggattgcgcagccgccagatccgcgaccggcaagccctcgaggcggatctccaatcggccgaggtccagcggaacgcgctcggcgctttctgcgaggccctgcaggcggagctcagccagttcgagcgcgctgcggcgaccacgacggccggatcagtcgcggccgcgctggaggccctgcacgcattgcgcagcggcggcgcctccgcggccgtcgaccgcctgccggccgctctcgcggcctggctgggcgagacgcgctggtcccttcaccttgcccgagaaggatccctgcaccgggccgccccgacgccgcgagagggcggctgcgaggtgacaggtgccctggccctggcgcgcctctacggcatcgcccgccgcacgccgcgcacgctcagcgtgttcgaggaacgcgacgcggaggttctggacggcatcgggatcttcgcctgcgcgatccgatgccggtacccggccggcaccctcggccttctcgtcgtcgagagcgtcgagccgggccggctcagccccgcgctcggtctggcaaccagtctcctggcggacacgctcgggatggtgctcgatccggcccgggcaccggcagcatcgcccgtggaggtgccgcccgtggatgcgctgctcgcggacgcgccgtcctcgggtggcgagatgatggccttcgcggcgatcgaccccgcgtgccggagcgggcgcatcccggaggccgcggcatgcgcccgctga

SEQ ID NO: 9876 - DNA, 2289 bp, Methylobacterium sp.
atggcgggatcgatgcgcaccggcccggatcagcgcccagccccctcgccccaccgccttgccttcgtgctggcggtcattggctctctctgtgccgccgcaccgtggccgttgccggcgctgtcggctgagaacgggagcgaggagcccatcccgcgcacgctcctcgtcctctacgacggtgcgcgcgagcccgagccggccgatacccgcgtccaccgctacgcggaagccgtcctcaaccatctcggctttgtcgttgcctatcgcgacatccgcgggccgctgcccgatcccgaggccgtgcgcgcctatgcgggcctcctcacctggttcgccgcgcccccggcggcgcgtgggcgctacctcgcctgggccgagaccgcggtccggtccgcccggaagctcatcgtgctcggcgcgacgggcggcgagttctggggcacggacgcgcgcgggatccaggcgattctgggcgagatcggcctgacgcacgatcgacgggcggtcgaggtgacgctcggtacccgcgtcgtcgcggagcagcgcggtctcacccgtttcgagcgcgccccggacccggtcgtgccgggctacgacgtcgtgcatgccgccatccgggcggaggtggatgtctggctggaactcggcgtgccggaccgggccggcggcggcaccagcatcgccgtggcggtgacgcggcgcggcggctacgcggcggccggcttcgagttcgccgaggatcggggtctcgacaaggcgcgctggctgatcgaccccttcgccttcttcggccggatcctctcacccgattcctggcccgttcccgacgtcaccaccgtgtcgggccgccgcctctatgtcagccatgtcgagggcgacggcctcaacgacgtcgtcggcgaggggcggaaccggatgctcgtcgcgcagcgcttcctctccgacatcgtggaagcctatcccgatctgcccttgaccttcggcctgacgccgggcgacctcgacccgcgcctcgggggcaacgagacgccgcgcgcgctcgtcgcccagatctggggggccgcgcaggtcgagccggccatcgcatcgtacacgcggccgttcgactggcccttcttcgcgcattacagccgcgagcgggagatcgcgcgcgccgccgcggtccggcacgacctgcccgcggacatcctccgcaccggggatccggacccggccgtgcaggcgcgctggagcgtgagccggggccgcgagttcccgcgccagtacctcgcccgtcccttcgacctcggcacggaggtcgacacggcggcggacgccgccggggtcctgctgcccgacggcaaggccctgcgcctctatctgtggaccgggaacgccaagcccttcgaggcggcggtggcggccacgcgccggcggcatctcctcaacatgaacggcggcgagagccggctcgacgcggactacgcctcggtcgcgcatctcgcgccgctcgcgcgcccggtcggaacggaacggcagatctacgccgtcgccgcggacgaggtgccggtcgagaaggcttggcgcccgatccggacgggactgcggggcttcgcccccacgctcgcgaacaccggatggccgcgccgtctcaagggctacaacctgcgctaccatctcgcctccctggccgatccggaggcgctccggatcgtgcgcggatacctggacgaggcgcggacagccgcgctcgccccggttccggccagcacctacgcggccatggtggagggcttcttcgagaccgcggtcacgcggatcggccccggccgctggcgcgtcgcgggacggggcgccgtccggacgctgcgcctcgacggccccggcgaccgccgggtcgacctcgaccgctcgcgcggggtgatcgggcagacccgctacgcggacgcgctctatctcgcgctcgacccggccgtcgaggcggtcgaggtcgtgctggcggcaggccccccggcgatagccgcgccggccggtctcgtggagagccgctggcagctcgcgcatctgcggcgggacgcgcacggctggcgcttcgaggcccaggggttcggagccgggacgtttcgctgggagaacgtggccgccggacgctacggcgtgacggcgcgccgtggcggcgcgacggcctggcacggtatcgcggaggcggacggcggcggcctcaccttcacgatcccggacgaagcgggcacgaccctcgacgttgaggtcgcgcgcctcccccccacaggccggggcgcggaatga

SEQ ID NO: 9877 - DNA, 162 bp, Methylobacterium sp.
atgatcaccgtgacgatccccctgacgacgatccccctgacgacgatctccccggctctgagcttcgccgccgtcgtgctgacctgcctggttctgcatgcggcgtgccgcgcggcagccctccggccgcagctgaggccggtgcgggtgcgcaggcgctga

SEQ ID NO: 9878 - DNA, 396 bp, Methylobacterium sp.
atggagatgatcaccgagcagcaggtgcgcgagcgcgcctactacatctgggagggcgagggccggatccacggccgcgccgaggcccactggctgcgcgccgagaccgagctgaaccgcccggtcgcggcgatcgaggcgccgaaggccgcccggaagagccgtgccagggccgcggcgcccgtcgtcgagaccgtcgcggcgccgctcgcggccaagcccgcagcccgcaagaccgtcgaagcggctccgaccaaggccgccaagccggttgccaagccggttaccaagccggccgccaaggcggccgggaagaccgccgcgaagaccccggccgtgcccgccggcctcgccgccaagaaggccgcccggcccgccgcgatcgccctgcactga

SEQ ID NO: 9879 - DNA, 159 bp, Methylobacterium sp.
atgagaaacgcctccgcgctcgccgcacgcctcgccgagacggtcaccgatgccctgacgcgcgcgagcgagcggctgctcgacctcgtggggccgcagcggcaggcacagctcattccggtccgggtgcgccgtggcccgcaacgcgcgcgccgttga

SEQ ID NO: 9880 - DNA, 237 bp, Methylobacterium sp.
atggacctctgcctcacttggtttgcccgggcctggatcggcctcgtcctcctgctcagcctcgccgacatcgccgtgatggcccttcagagcggcggcggcgcagcggccgcgatgtacaaccccttcgacctcgcgaacttcctgatggaggcgatcctgctctcgcccgccctcgccgtgctgatctggcgcgaccgccgccgcctgcgcggggcgtgcgagacggccctctga

SEQ ID NO: 9881 - DNA, 216 bp, Methylobacterium sp.
gtgggcgggggcgccctgcccgccggagggctagcggccgccgcgctcgcgccggcgatgggcctgctctcggggctcgtcaccaccctgccctaccgcctggaggacctgttcgaacgcccgccgctgcacgggatgtggtggccggcgctcggcggcctcgcggcggccatcgacctgatgctcttcgccgcccaggcgcgcggctcgccgtga

SEQ ID NO: 9882 - DNA, 393 bp, Methylobacterium sp.
atgccgcccggcagcaaggatatcaaacccgacgtgaaatggcaggccggcgcgccttacggcgatcccacgaagtccgatgcgctcttcatccgggatctcgctctttcgagcatcacgatggattcggcaggctggccacccgagatcggtcgagctctcgaacaggcgatcagaagcgggtccgtcaagatccagaaggcatccgaggtcgaaggcctgaacttcaaatcgtggcacacctttaccccgaaccggaacaatggtgccgggtacgattcgatgggcggcacgacgcagaatccggtcggagcggtgaagacggcgatcgattccggccggggcctggcgatgtggaccgcagaccggggcgatgtctatctgagctggtga

SEQ ID NO: 9883 - DNA, 657 bp, Methylobacterium sp.
atggtcaagaatgctctcctgttcgcgtcggcgctcgccggcgcgctcaccctggttccggccgcttccgaggcccagaacatctcgggcttccgtggcggcaacgcgctcgcgggcggcttcagcggtccggccccaggcggcggcttcggcggcggcatcggcggcggcggcttcaatcgcggcggtgtcggcatcggcggcggcgggttcaaccgcggcggcgtcgggatcggcggtgggggcttcaatcgtggcggcttcgggggtgccggcctggccggccgcggctacggcttcaaccggggctatgggttcaaccggggctattacggccaccgctacgggtacggctacggccggcgcggctacggcctcggtggcctcggcgtcggtgtcggactcggcctcgcgggcggccttgccgccggcagcctctacggcggctacggctatccgggctacggctacgacgatggctattacggcggctacgcgcccgcgggctacggctacgccccggtgaactacggctacgccgagaccgtcacctccgacagctcggccgaggaggcctgcgcccgccgcttccgcacctacgacccgcggacgggcacctacgtcgccaagggcggtgtgcgccgcgcctgcccctga

SEQ ID NO: 9884 - DNA, 366 bp, Methylobacterium sp.
atggaggttctgactctccgcgccaccatgcttcgcgcatcatggacatcgggggcctcgatcgagacgatgctggaactgtgggcgtcgtcgctgcgggaggtgaaggggcgcatgcgacctctgttcacccacgagcgggtcgccgcctcggcgggagcattcctggatgggttgctcggtgcggagcggcgcaagaccggctggatgcgggcggaagctgcgggcgaccccggcccctggcgccagcaggccgtgctcgggcgcggacgctgggaggccgacgccctgcgcgacgtggtacgggactacgagcgcctaacagaacgggcacggaccgctcggtcaggcgttggtgtgaatggc

SEQ ID NO: 9885 - DNA, 513 bp, Methylobacterium sp.
gtggtgatccgctccagcgactgtcatctgctccttccgaccggaccgcaggcggatcgcgagcgggtgcgtgaacttctcgacgttgcgggcgtctcgcattgggtcgagccggccaagggaccgggagcaccgacgcaggtcgacggcatcacggttgagggctatgatgcccctgccatcgccgcccctcttcgaacggcgcactacccggcggtcgccgatctggcccaggtcgacacggtcatggttaccccgatcctgttcatcatggtgctgttcgtctgcatcacctacggaccggtggcgatctacctcgtggaactgttcctggcccgcatccgcgctcccgcactcggcatgccctatcatattgggacgggcaacttcggcgactgcatggtgtacttcgcgacgccgatatcgacgaccgcgggcaacatctacgatggcctctggtacgccgtcttcgctttcgcatgtacggccatcgatctctggaaactgccctga

SEQ ID NO: 9886 - DNA, 225 bp, Methylobacterium sp.
gtgacgctgggtgccatcctcaccgtcattctcgtcgcggcctatttcggcttcgtcgggatgggcgccttcgctcccgcactcctggccaagcccgtgctggccggcggcacggtgacctgggccttcgcctacggcctgttcgtcatcgctctcggtgtcgtgctgacgggcctctacgtgctcctcgtcaaccgcgccgaagcgcgcctctcgggggagtga

SEQ ID NO: 9887 - DNA, 150 bp, Methylobacterium sp.
ttgacctacgaccgctggcgcaaggagttcggcggtctgaagacggatcgggtccggcgggtgaaggatctcgaggtcgacaaccagcggctccgcaagacggtggccgatctgacgctggacaagctgaccctgcaggaggcggcttga

SEQ ID NO: 9888 - DNA, 891 bp, Methylobacterium sp.
atgatcgttgccgtgctcatgggcggcatgtcccgcgaacgggaggtgtctcttgccaccggccgtgcctgtgcggcgggcctcatgaaggccggttacgaggtggtcgagctcgacgtcgaccgccgggtagcggagcacctcgcccacctgtcgccgaacgtttgcttcaatgctctccacgggccgctcggcgaagatgggtccatccagggcatgctcaacattctcggcatcccctacacccattcaggagtggccgcctctgcgttggcgatggacaagctccggaccaaggcggtcgcatctgcactcggcttcgccaccccccgaggcggcaggatcgggcgtcgaacgttcgaggcgacgcttccaacctcaccctacgttctgaagccggtagccgacggctcgagcatcgacaccttcgtcgttcgggatccgacgaaagctccgtttcccacagggtgctggccgttctccgccgatccactcttggaggacctcgtcgaagggatcgaggtgactgcaaccgtcctaggcgacagagcgctgaccgtcaccgagatcctcccacgatctaatttctacgactacgccgcgaagtacacgggcggtggttccgagcacgtcctgcccgcccggcttccggccgccactttcgacctttgcctggaacgttcgctcgcgatgcaccgggccatcggatgccgcgggatctcccgaagcgacttcatcatctccgcctcgaccggcgagcccattttcctcgagattaacacacagcctggaatgacgccgacgtcgctcgcccccgaacaggcggcgcatgtcggcatctcgtttccagaactcatgcacctcttggtcgaggccgcatcgatcgattga

SEQ ID NO: 9889 - DNA, 165 bp, Methylobacterium sp.
atgcaggtgcttcaggatcctggccggaccggcgctccggccgaggcgcgcgacgtgcagcacgccgagctcatgccgcgccttcaggatgatcttcaggaacgtgtcccggcccggcgcgtagggcaggcccagcgcccgcccgtgggtggccagctcttgtag

SEQ ID NO: 9890 - DNA, 171 bp, Methylobacterium sp.
gtgcgggcggtggtggtgatggtggccccagccgtactgcacgggggtgaggccgtccgctgcctcgatcggcgcggcggcgagcggcgcggcctgggcggcgggcgccgccgcgaggagcccgccggcgagcgcgagggccgccagcgcgcggcggccgagggaacgtga

SEQ ID NO: 9891 - DNA, 201 bp, Methylobacterium sp.
gtgatcgaattcagcgagcgggatcgtgatctgatcgaggatttcctcaaccacgtcctggatcgctacaaggccgggtcgatcggacggccgatggcgcgcgcggagctgagcgaggccatggcgctcgccgccgccgatgctgggccgctgcgccgccacatgcgcgagaccctgcatcgcccgggcgaggacgagtag

SEQ ID NO: 9892 - DNA, 507 bp, Methylobacterium sp.
ttgcgggcgacgctcaatggcctcgcgccgagcgagcgggcccagacgctgttcctgccggcgcttgccggggcacccgaggcgctgttcgacctcttggccctgctcccggtctgcgacgtgaacggcgccctgaccgcgtgtctggcggccggggggatcggcgatggcccggcgcccgtcgccgcgctgttctgcgtcgatcccttcctgcgcgtccccgaccttgccgaggccgtgctcgccgccggcctgcggcgggtcgccaactatccgagcatccaggctgtcgatggggagaccggccggaccatcgcggcggtgggatacgggccggaggaggagatcgccacgctgctgcgtctgcgggctgcgggccttgagcctgttggctgcgccgcctcggcggattttgcggccgcgctcgccgccgccggcatcgcgccggtcctcgccatcccggcgctgggctcgggcagccggaccttcgcgcccttcactcggtaa

SEQ ID NO: 9893 - DNA, 1701 bp, Methylobacterium sp.
atgccagcgccggccctcttctatggacgacctgccaacgacctgctgatcggtgcggcaatcgggctcggcatgactgcgcgggcgagtgtccagggcggggccgatttcctgcttgtcctcaatgccgggcgcctgcgggtgatgggcgcggcctcgatagcggccctctttccgatccgtgaggcgaacggcttcacggacgccttcgctcgcggcgagatcctcggccgggtgccggtgccggtgttcttcggtgcggccgcctttgatccgcggctcgacatcccggcgctcgccgcgcagctcgcccgggcgggctacgccggcatcgccaacttcccgaccgcgatccatttcgaggggcggttccgcgcgacgctggagaagtccggcctcggctacgcgagggagatcgccctcctgcgagccgcccgcgcggccggcctcgccaccttcggctacgccaagacccgcgaggagatcgaggggctgctcggcgccgaggtcgacatcctgtgcctcaacttcggctggaacgcgggcggctcgctcggcatcgacggcgtgcctctggacgaggctgccgaccgggcgcggcgggtcttccaatgggtccggcaggccaggcccgggacgatctgcgtggtcgagggcggcccgatcgtcgattccgccagcatgatccgggtctgcgacgaggcgaaggcggacggctacgtcggcggctcgaccctcgaccggctgccgctcgagatgtcggtgatgcagacggcctccgccttcaagaccgcgagcctgctgcggccggcccgggacgaggcgcagcgcgagcacgcccgcatcacggctctggccggcctcgtcggccagtccgaggcgatcacccgcatggtcgagcggatcgcccgcctcgtcgccaccgacctcgccgtgctggtgcgcggcgagccgggatcgggccgcacgacggtcgcccgcgccgtccacgtggcgagccggcggcccggaccgttcttcgtgctcgatgcggccgatccggagatcggcgaggcgctgttcggcgatggcgccggacggcgcggcgcgctcgaggcgggcgacgcgacggtggtggtggaggcgatcgggcatctctcggtcgcactgcaggagcgtctcgcccgggtggtcgagcaggcgatcgtcggccggttcgggcgcgaggagcagcggcgcgcccgcctcgtcgtcaccgcccacgaccaggccggcatcgtcccggcgctgctcgcgcggatcgaggccgggcaagtcgacgtcccgcccctgcgcgaccgcccggaggacatcccgcttctggcgcgggcgatgctccggggcctcgggcggcgcgaggcgcggccggcgcccgccgccatcgagcccgccgtctaccgcctgctgatgacccgggactggccgggcaacctgcgcgaactgcgctcgttcctcgcccgcgccgccgccgagagcccggacgggacgatccggagcgactgcgtcgcccggctctgccaagcggccgccgagatccggcgggggccggtggccgacgagcgcgcctggatcgtcgacgccctgcgccgcaaccgctttcgccgcaccgagaccgccgccttcctcggcctctcccgaaaaaccctctacaacaagatgcgccgctacggccttaccgagtga

SEQ ID NO: 9894 - DNA, 138 bp, Methylobacterium sp.
gtgcgggtaccggccggactggctgagcggatcgagaagcggcgccaggcgctgcagaaggtatttggcctgccggtcagcaaggccaccgccgtgatcgacgtgctagccgctgggctggaccagctggagaagtag

SEQ ID NO: 9895 - DNA, 381 bp, Methylobacterium sp.
atgaacgcagcacccctgtacggccgcggcctggatgagatgactggcctcgacgccgctgcccttgagcgcggaatggacgggctgacccaggagctggcgagcgggccggcctacactgccaaggaccgagcgcagcttgaggagaacgcccaggcgtatgccgccgagttctccgccgcccgggtgcgagaggcacgccggatcgccaagctacacggttgctcgatgaggggcgggcgcggcatcccgggctttcaattgacgaagaaggcgactggcgaggtggtgggcggcccccgctccaaggcagccatgctgacgcctggcgacgtggccagggtcttcggtgggcgcctgtcgaccaaggatgtgctgtga

SEQ ID NO: 9896 - DNA, 327 bp, Methylobacterium sp.
atgcaaggccgtgatagcgcagtacgtcgcaattctatcgaccaagtcagcgacgccgagttcctggccgaggtggtcgaagcattcgccggcgaagagctggggcggtgcgtcctcgaaggcccggacggcgtctccttccaggtctgcggcgctgccaagccgctgatcgagcagctgaccacatggtccggcccctctgaccaggacggcatcgaggtccacttctgcgacgtcagccgccgcggtcgcgcctatcccctgcaggggcttctgcacctcgtggacgtgtgcgccgctgcccgcgctcaggcggtgccagcatga

SEQ ID NO: 9897 - DNA, 2925 bp, Methylobacterium sp.
atgagccagcgccattatcagtccgagagcccggagcgcgtggcctcggccctggccttcgttgatccgaccgaccgcgaaacctgggtcaagatggccatggccaccaaggccgccttgggcgacctgggcttcgacatctggaacagctggagcgagggttccgacagctactctcagtccgatgcccgcgacgtgtggcgctccgccaaggaaaacggaggcaccggtgccgctacgctgttttggcatgcccgcaacaacggctggaaggatgacggctcgttccaggctcccccggctctgacggctgagcaggttgccgaacgtgaagcccagcgcgctcacaaggccgccgaagacgccgctcgccggaccgctgccgccaacctggcgaagacgctacgcgatgccggatcgaaggagattagcgaccacccgtacatcaagcgcaaggggtccggcctgaagtacggcgccggcatccgtcgcggcagcttccctcagcgtggctgggacgacgcactgctggttccgatctatggtgccgaccagaaggtcatgagcctcgaagcgatcagcccagacggcgagaagatcggcctgaaggacggcgctcgctccggcggcttctatcccgtcggccagttcatggcagcggagaccaaccccagccgcatcgtcatcatcgccgaaggcctcgccaccgctacagcttgccaggcagccactgggtacccggctgtggtggcgttcagtgtgggcaacctccgcggtgccggcgagaccgtgaagcgcatgtgccccgacgcccgcctggtggttgcggccgacctgggcgctgaggtcaaggcacgcgccgcagcggtcgctcttggcgcctgcttggtcgttccgcagggcgaaggtctggagaagggcaacgacttctgggacgctcgcgacatcctgggcggtaaggtggttgccgcccagttcgaggacgcgatcgctgccggcccagtcgaggccgaggcgcctgtcagtgagcgggcggtgcgctctgaggcagcctatcaagacgcagcagttcagacccagaccgctcaggcggcgcctgtcgcctatgccgaggccgaagaggtgcccgacgagctggccgcgcagctcctgccgaagttcgaggagcgctcggcccagccggtggcagtccagcctgccagcagcgtgacgagcgaagccactggcgaggagcccgacttcgacaagcacttcgcggtcctgggcttcgatcgcagcaccatcttcgtctacagccacagccggacgcaggtgctgacaacgtccgcctcggctcttagcaaggcgtcagggctgatcgagctggctccgctcaactggtgggagttctacttccagaaggcgggcaaaggcggatcgggcctggacgctgccgcggctgccgactggctggtgcgcctggccgaaaggcgcggcatctacgacgacagccgcgtgcgcggtcggggcgtctggctcgatgacggccggcttgtcttccaccacggcaacttcctgaccgtggacggcgtccagaccgagctgagcaacatccgcagccggcacgtgtacgagggcgctgccgctatctcgttggccgccgatacccccatgaccgccacggaaggcgaggctctgaccgcgaccgcctgccggttccgctggtcgcactctgggtccgggctgctgatggcgggctgggccttcctggctcccgtgtgcggcgctctgaactggcgctcgcacatctgggtcaccggtgccgctggctccggcaagtcgaccctgctggacaagttcctggccaagctgatgccgagcgactggctgctctccctgcagggcagcagcaccgaggccggcgtgcgtcagaagctcaagggcgacgcccgccccgtgctgatcgatgagttcgagtgcaacaccgaagccgacgtgaagcgcatcgagtccattctgaccctgatccgccagtcgtcctccgagaccggcgccgaggtcgcccgtggcacgatcagcggtcacgccatgagcttccggatccgcagcgccttctgcctggcttcggtcggtgtgtccctaagccggcagaccgacgaggaccgcctgacccgccttgagctggcggcagaggcggtcggtgattgggacaccctggagcgtgagctggaggtgatcgccgcggaccacacctacggacagcgcatgttcgcccgggccttgaagatgctgccggtgatccgcgagtcggccgccgtcatcagccgcgtggccggcaagcacttcggccgtcagcgcgacggcgaccagtttggcactctgctggcgggcgcctggtgcctgcagcgggatcgtgctccgaccgagaccgaggccaaggtgctcatcgagggacaggactgggcgagcctcggtgccggtgcgtcggttcaggtgaacgacagccgtcaggcgctcgacgcgatcctcagctctccggttcgggtcgatcagcgcaccttcagtgtcgcccagctcatcgaggtcgcggctggcggtgcgatggcggcgaccggatcacagccggccttcgaccaggcggttcacaccctgggcctgcacgggatccgcatctccgacggtgaggatccccggcgcctgatgttcgccatggcgcgccgcgagctggtgaagctggttgagggcactgacttcgaaaccgatctgatcggccgcctggcacgcctcccgggcgcctggaagtcgaaggtcaagaagcccggcgaggccggtccgccggagaaaacgcgctttgccggtgcaaccagccgctacgtctccatcccgttgagcctgtgcagtagcggggacgatgtcgctggggccaatgagagccatccattctga

SEQ ID NO: 9898 - DNA, 444 bp, Methylobacterium sp.
atgtacgaaacgaccgacctttccttcgacgccgtagcggcagaggtaggcgtggcgcgccggacggtgctgaagtggtccagccaagacggctattggcagaagaggaacgtacccaccagcaccgcagagcgcgctcgcatcatggctgagctggcgtcggatctgcagcctgatcaggcgcccgacgcagcgccggcggaggctgtagccgagcctgatccccgcgaggtggaagccaagctgatggaaaagcatcagcggatgtggcgcgttgttgacgggctatcagctgaggccgtgcgcagccgagacgatcgcactgcgcgtgtagctcacaccctggcgcgcaccttcgcgattgcgcaacgctccgagcgcatcgcctacggcctcggctccggcgaaacgccgtcctcgaccgtcgtgcttgagcgggagtga

SEQ ID NO: 9899 - DNA, 309 bp, Methylobacterium sp.
gtgaccgctcaagccccgaccctgttctccagtcccttagccctgcaccgcgccgccatcctggcgtgccccgccctactgcagctggtgctcaacctacaccacccgatcgccttcagcctggagcccagcgcagacgccagcatgaccgacgtgcagcgcgccatcgccgcggagctggtcgcctcccacgcccgctatggggataccgatgccggctttgtcctgctggccaccgcggcggagacggctctggctaacgcggagcgcgagtacggggctatggactgggcagcactggcaagctga

SEQ ID NO: 9900 - DNA, 267 bp, Methylobacterium sp.
atggccgccatcatgcccgcccccgcgccgatccccgatcgtccgccgcagcgcgcggtgaatccaggcatcccgacgccgcccaatccgggcgagatgccgccgccgaacctgcctccgcccccggaggaccccgatacggggccgaccggcccgcgcgtgccgggtcccgacccggacgtggacgagccgccggacccggcccaggtgccggaccggctcccgggcatcccgaccggccccggcacccgtcacgcggcgccctga

SEQ ID NO: 9901 - DNA, 243 bp, Methylobacterium sp.
atgtcccaccacctcgcaaccgccgcgctcaccatcgttctcgcggcaccggccggcgccgccctcgcccaggggccgacgcccttcgccggcagctcggccgcggcctccctcggctacaccgcggccccggccgcgatggcgctcacgctgccggaactcagcgtccgcatcccgccggccgatcccaccacgaccggctcgatccgcccacaccacggccacgcccgcaccggacattga

SEQ ID NO: 9902 - DNA, 459 bp, Methylobacterium sp.
gtggacgtgttcccgaaggagccgggctcgaacgccgagcgcttcgtctccccgctgcagggtctgccgaacgtgatcctgaccccgcatatcggcggctcgacgcaggaggcgcaggagcgcatcggctccgaggtcgcccgcaagctcgtggactacgccgataccggcgcgacggtcggcaccgtgaacttcccgcaggccttcatcagcacccgccccggcggcgcccgcttcgcccacctgcaccgcaacctgccgggcgtgctcggccgcctcaacgacgtcttcgcgcgctccggcatcaacatcgccggccagatcctgcagaccgacggcgatctcggctacgtggtgatcgacaccgacgccggcctcgccgaccccgacgcggtgctgcgggagctggccgccatcgagggcacggtgcgggcgcgcctcctctacgagcgggcctga

SEQ ID NO: 9903 - DNA, 381 bp, Methylobacterium sp.
gtgacggccctctacgcgggcctgttcgcgatcctgtactgcgcgctctcgctgcgggtggttcgggcgcgccgggcggcccgggtcctcatcggagtcgcggggcaacccgcactggagcgccgggtgcgggtccacgcgaacttcgccgaatacgtcccgctcgcgctggtgctgatgctcctcgccgagctctcggggtatccgcgctggacactgcacgggatcgggctcgtcctgctcgcgggccgctgcgtgcacgccgtcggtgtctcgcaggtgcgcgagaagatccgcctgcgggtcggcggcatgctggccacgctcgtgccgatcctggctctcggcctcatgctgctcgcggccacagcacgggtctga

SEQ ID NO: 9904 - DNA, 2436 bp, Methylobacterium sp.
atgatcgtcgaagaacttatcgggcgcctgaccctacagaccaaaggcctggacaaggccaagcaggcaacgaaggagcttgagaacttccgcaaggggctgaaggctctggccggttcggcccggatgcggctcgacgggccagcgcagatcgcgaaggcgttcagggcagcgcagaaggaggccgagaagctggcgcaggtccagaagcggcttgggtcgggcgcagggttcgaccgagcggatgcatcggccaagaagcacctctccacggtccagaagctgcgagctgcctacgtcgatacggcgaaggctcgggccctcttcgaccgcagaccgacgagctccgggcgatcctggatccagaacgagcttgaagcgctgcggcagtaccagcgcaccctcaaacaggtgcatgccgaagccgcgaagctcggcgtcccgcgtggccgcaccgaccaactgagccggatccgctacggcgaccggaacgggttcggcgaggccgtggcggccggcaccatcgcgaacaatgccggccgggcgactcagtacgcaatcgagcagggcgctgtcacgcagcaggaaaccaaccgccagatcaacgcgggcatggaagctgagcagatcgcggccctggacaggcgtgcgaccgagttgagcgcgcagttcccgagcgtcgatgcgaccaagatccggaccatggggcgcgacgcgcgcaacatgttcccgtccttcgagatggcgatgaaggcattgcccgagatggtgcgggcccgggtcatgctgcaggccgccaagggcgtcgatgcggccgacaacgagatgggcgacttcctgaagggcgcggacatcctcggcaagaccgaggacgtgggcagcctccgggaattgctcgacagctacgtgaaggctgtacaggtcgaggggcgacaacttcctctcaaagaatacaaggagcttgcaaaatactcgaaggccggaggcgtcaacctatccaatgagttcatgggttctgtcgcgccgaccttcatgcagtcggaaggcggcggacgcttcggcactcagctcgcggccggtatcaggtccctgatctccggcaagcgcacgaagaagtcgacggcggccctgatggaactcggcttgctcgacaagaagggccagctcaagaacgccgagaagtttcaggacaacccctatcagtatgcgatggaggatatgatccccgcccttcggcggaagggggtcaatcctgacgatgacaaagccgtacaggcgagaatggcgaacatcttctccgacaacatgacggagaaccttttcacgaaaatgatcacgcagcgcgctcaggtcgagcgcaacatcaagacctatcgcagcgcgaagggcctggacgcggcgggcgggcagacccgcggtgacccctatgtggcgtgggaaggcgtcgtttcgcagttccgcaatctgctcggcacgacgcagaaggagaacattggtctagcgggcaaggtcggcgcggccgtcgccgagagcatggctgacgtgaacaagtcgctgagtgcggatcctgccaaggcccaggctatcggcgcgggaacgattgcggggaccggtctcctcaccggcgcggccggtctaaagctctggcgagtcctgagcaattggtacggcgtcggcaagcaaggtgcgatcggcagcggaggcgcggccgggaccggagctggcgcggctggcgctgcgggtgccgctgccgagggcgctgccgcagcaggcgcgggctcgacggctgcgaccagcacgggcgtcgcggcggtagcaggtggcctcctccgcgggctgatgcgcctgataccggccgccgccgcgccattgaccatgggccccgacaaggccgatatggaccagatgacactccggctcggcaagctggccgcggaccgggaaaaggctaaggcaggcacccgcgcggatgctggcgagagcgatcgcgagaaccgcagggccgcggagatgacccgccgcgatcgagaggcgccgttcggtcagcaagccagcaggaccgcatggcaggaccctccgaagcgctacagcttcgccgagagcgatcgcgagaaccggcgaggcgccgagatggtgcgccgagaccaggcatttccgctcggtgatacgaccaaactcgccagcctgaacatcgacggggacgccgtgaagtcgcgcctcgccgagatccagaccgcctcgcagaaggtcatcgacaccctcggtactcaggtgacgatcaaggtggactcgtcgcagatcgatgcggctcaggccaaggcggacaagctcaaagccacggtggcgggtatcggaagcgtatcgggcggggtcggaggcgccggcctagcaaaaggatcaaacagcttcaccagctcaggagcgaccgcaccttga

SEQ ID NO: 9905 - DNA, 198 bp, Methylobacterium sp.
atgccgaagcccgtatcccccgaccggccgatctggccgccgctcccggccgagacggacgggcagcccgagtccgatgtcggcgcggcggaacgcgccccggcggatggcgcggcctcggagccggccggcggcctcgccggaccggggacgcggccggaccccgcggggcccgtcatgtcggcggtcctggcctga

SEQ ID NO: 9906 - DNA, 204 bp, Methylobacterium sp.
atggagcgtgacgccgccgcggactcgagccgcaccacggagcccccggcgcccgccttcgcggtgcgcctcaggccgaagttccgcgaggtcgtcctgccgccgcggccgccgccggtaccgcgcgggtgcgaggcggccgggagcggcggacgcccggacgcgactccggacgatccggacgacccggcgcgctcggcctga

SEQ ID NO: 9907 - DNA, 261 bp, Methylobacterium sp.
gtgaggaaactgaccttcgccttcgccgtagccgccgcgatgggggccgccgccctcgccggcccggcctccgcggctcccggcctgcccgcgggcgtcaccgcccccgacgccgtgacccatgtccagatgtcgccgatggagcgccgcatggagcgccgcgcgatgcgccggcacatggagcgccgcatggagcgccgggcgatgcgccgccatatggagcgccgcatgatgcgccggcacatgatgcgcaacatgtga

SEQ ID NO: 9908 - DNA, 699 bp, Methylobacterium sp.
atgagcgttcgagaccaattgtttcagatgttgcacacggtcgccggggctctcggcaccgatctccggggtcgacttgtgttcgttggaggttgcacgacagctctctttattaccgatgccgtcacccttgaagacgtaagggccacggacgacgtggacctgattgtcgatctcgccggctatgcagcatgggccgaattacaagcgcagctgcgtcggagaggtttcgtggaggcgtacgacgatacggtcatatgccggatgaaactcggagacctcaaagtcgatttcatgcccgacgatccagaaattcttggatttagcaaccgttggtatacgaaggggatcgagacagcagtcacctacccgctaaccgaagacgttaccatcagacgcctgacaccagaactatttattgccacgaaattggaggcctatctcggccgtggagacggagatcttcttggcagccgcgatctggaggacgtcctcctgatcttggatggccgcgcggaaatcatagaagaagtccggcgcgcagacgccgatatccggcagttcgttgccgagcaattcagggggctgctcaaggaccgggacttcgaccatcttctggacggcaacatccgaggcccggaagggcgggtcgatatcgtacgtgaacgcatcgtggccttgagtgacgacggcgcttga

SEQ ID NO: 9909 - DNA, 897 bp, Methylobacterium sp.
atgtacgggcttctggggctggaggccgagcccgcaagaccgggctacgagctgctgcgctccctcatgcatccggacgaccgctgtctcatgcccgatggcagggcggtgcggcagggcctgcttcccgcccgggagcggttccggatcatccatccccgtggcgtcacgcgcacgctcgcgacgcggaatgagatcttcttcgctccggacggcaggccgatggccgccgccggcctcgtcctcgacgtcacggatgtggttcgcctgaaccaggtgcggcttcgcgaccgccagcgcttcgaagccctggcgcgggatcacttcatcgtcaattaccagtcgccgggccatgattccgggatcgtctggttcgattatccggccgccttccagccgagcctcggcgagatgcgggacgatccctacagcatcatctccgtgcgggatcgggccagggccagggaggcgcgcgagtccgcccgggcgctgggccggatcgcgcaggggacgtttcgcttccgcaaggcggacggttccgacgtcgcttgccgggccgtcgaggttccgatcttcgacgaggcccgtcgcatcgtggagtggagcggcctcatcgctccgctcagcgagttcgtctcctcgtcgagcggcttctgccgggcgatcaacgaggccgtcagaggtcaccacctccgggcggcccgcgcgatgctcgactgctccctggcgcagttctccgagatcagcgggctgtcggtctcctcgctgagacgcctggaggaagacgccgcctgctccagcgcccgcatgcggcagagggcgatcgcggcgttccacgcgatgggcatcgacttcatctgcgccgacgacggcagcatcgcggtcatcaaggcctga

SEQ ID NO: 9910 - DNA, 87 bp, Methylobacterium sp.
atgaagtggacccggcagcgctgtcaggtggcgctcatcaccttggcgacggaggccttgatgccctcctgggccgttatcaggtag

SEQ ID NO: 9911 - DNA, 990 bp, Methylobacterium sp.
atgacggttctggtgacgggcggcgccggctatatcggcagccacatggtgctcgccctcctcgatgcaggagaggaggtggtggtcctcgacgatctgtcgaccggcttccattgggcgctgccccccgaagtgccgttcgtgcgcggtgacatcgccgataccgcactggtgcagcgggtcgctcgcgaacacggcgtgcggtccctggcgcatttcgccgccaggatcgtggtgcccgattccgtcgcggatccgctcggatactatctgtccaacaccgtgaagtcgcgcgcgctcatcgaggcggccgtcggggtggggatcgaacacatcatcttctcatcgaccgccgccgtctacggcgagcccgcacgcgtgcccgtgccggaagacctgccaccggatccaatcaatccctacggccgctccaagctgatgaccgagtggatgctgggcgacgcagcccgggcgcacgacctgcgctatgtcgttctgcgctatttcaacgtcgcgggtgcggatccgcgaggacgttcaggccagtccacccgcaatgccacgcatctgatcaaggccgccactcagacggcgctggggcagcgaccaggcctcgaagtgttcggcacggattaccccacgccggacggcacctgtctgcgcgactacatccaggtctccgatctggccgacgcccacatgatggccctgcgccacctgcgccgaggcggtggaagcctgaccctcaattgcggttacggccggggtttctcggttctcgaagtgctcgacacggtccggcagatttcgggacgggattttcccattcatttcgggccgcggcggatcggagatcccgcgcgcgtcattgcccaggctggccgtatccgtgacgaactcggctggcagccgaagcacgacgaccttcgggcgatcgtagcacaggctttcgcctgggaacgcgcgctgccttaccgtaatcagatctga

SEQ ID NO: 9912 - DNA, 324 bp, Methylobacterium sp.
atgctggccagtggcttggcgagcgttccagcggcggccgagagcctgtcggactgggcgcggcgagcggccctggagatcaggcagcacctgcgctggccgaccggctacggtcgggcggcgacgccgcgcacggccctcgtccgcttcaccatcgaccgggccggcagcgtgagcgggatcgcgctggagcggacgagcggcgtcggcggcttcgatgcggccgcgctggacgccgtgcgcaacgcgcgtccgcttcggccgccgccgcttccgccgggccgcgacagcatcacggcgcagctgccgatcgcgttccagtag

SEQ ID NO: 9913 - DNA, 252 bp, Methylobacterium sp.
atgcccatcgtgctcgccgttctcgccgccgcgctccttgccggtcccgccctcgctcaggtcgaccgcaccgggaccggaggtggtccgcgcacgacggagcgcgccggcaacgtgacggcgaccggccagaccaagccgccgggacgcgccgcgagcccgaccgcgcaggacgatccggagcaggtcccggacgggcagacccgtggcgggatcagcaccggcatatgcatcggctgcaacgcgaagtga

SEQ ID NO: 9914 - DNA, 207 bp, Methylobacterium sp.
atgcgcgagtgcggaatcctgagcccgaaccgatcgggcgtcaccggcgatccacggctgcacgggatcggccacgccctggagcagctctacgcgccggtgctggccgagggcgtgccggaggtctggctgcacctgctcggacgggcgggcgcgccgcgcgacccggagcgggaggggaacgaggcgggcgagccggcggagtga

SEQ ID NO: 9915 - DNA, 93 bp, Methylobacterium sp.
gtgggcctcgtcttcgccttgctgctgatcctgccgccgctggggatcgccgtcctcgacctgctccgcacgcgccggtcgcatccgtactga

SEQ ID NO: 9916 - DNA, 270 bp, Methylobacterium sp.
ttgccccatcagatcatcggcctcgcggcgatctccctgaccgtggcggtgctgctgcgcggctggggcgtgtcgcgccggacggcgttcgcgctcggtggcctcggccttgccgccaccgcgctcatcgccctcggtgatagcgggcgtcgcgtcgagcccggcctagcggggccgagcgagaccgagacgatgcggcccctgcagagcgtggtggttccgcagcgtccgggcggggcgaccgccggagtcgaggccttctttccgtaa

SEQ ID NO: 9917 - DNA, 195 bp, Methylobacterium sp.
gtggacgaaggggcgtccgaggctgagcggattgccgcggcctacgcgtgcgcggccggcggcgacacctgggcggccctcgtccgggccgtgtccgacgcgctcgcggacctggccgaggcggagcgccgctcgctccgccgcgaccggctgctatcgcgcggctacgtgcgggcgcggccgatcgaccggtga

SEQ ID NO: 9918 - DNA, 123 bp, Methylobacterium sp.
gtgagcgccgatcagatcttcgtcaccttcgggattccggccatcgccgtcgccctggcctatgcggccatgcgggcgaacgagtgggcggtgcgccgcggccggcagcatcccagcgagtaa

SEQ ID NO: 9919 - DNA, 237 bp, Methylobacterium sp.
atgatccagacgaaaacgatgctcctcccgctcctcgccctgggattggctctcggtctcggcaccgccccggcggaggccaagggctgcctgaagggcgccgtggtgggcggcgtcgcgggccacatggccggccacggcaaggcgggcgcggcggccggctgcgcgatcgggcatcacgaggccggcaaaaagagccgtcagcctgcgcagggcggtcagccccagggccaatga

SEQ ID NO: 9920 - DNA, 231 bp, Methylobacterium sp.
atgcaagcccacgtccatgctccccagagcccgtcacatccggacgccgacccgcatccctggttcggcgtcgaacctgaggcgctggaggatgccgcccgcgctctgtgcgcggttcgtccgggcagccacgccgccgagcgtctgatggagcgtgccgcctatctacgcgtgacgcgcagccgtcatgcggacgacaggcagcgggcgagcgcgctgttcctcggttga

SEQ ID NO: 9921 - DNA, 843 bp, Methylobacterium sp.
atggccgatgccgagcacaagcgccgccagcaggacctgctgacccaggaaggcgggcgggacgaggtcgtccagcggatcgcacagcgccagaaccagctcgtcgaggcgcgggcgaacctcgagcaactgcccacggtccatggaggccgcttgcagaacctgcgcaacgacctcgcctgggtcgagcaacgcgccgccgagacggaggcccggcaggcctacgtcgtcgtcgcgcccgcgagcgggacggtcgccacgctccaagccgcccccggccagccggccgatccgcgccagctgcagatgacgatcgtgccacagacgagtgacctgtcggccgaactcttcgtgccgagccgggcggtcggcttcatcgtgccgggccagccggtccggctcctctacgaagcctttccctatcagaagtacggggcctatggcgggcgggtcgcgcgcgtttcggggtcggtggtgcgccccggtgagaccggcggaccgctgaccctcgccgaaccggcctacaaggtcgaggtcaccctcgacagccccttcgtgcgggtcgacggacgctccgtcgccctgaagcccgacatggcgctgcgggccgatatcgtgctggagaagcgcagcctcatgcgctggctgctcggtccgttcctcgacatccgcaacgccatcgatgcggatccgctggttcgctggctgcgcgacgagctgccggcggccgccgccgggatgctgtcggaggcgcgggccctgcctgaaacgatcttcggcgccctcgcgcgccgggccgcgcgctcgccggagccggagccgcggcggacggcggagcgctga

SEQ ID NO: 9922 - DNA, 2130 bp, Methylobacterium sp.
atgggcggcggaagcctgcccttgatcctccagacggaggcggccgagtgcggcttggcctgtctcgcgatggtggccgggtttcacggccaccgcatcgacatgaacactctccggcggcggcacccggtctccctgcagggcgtgaccctgcggggcctgatcgaggtcgccaaggcgctcgacctcgcctgccgcccgctgcgctacgaggtggagcacatccgtcacctcgcgctcccggccgtcgtgcactgggacatgaaccacttcgtggtcctcaaatcggtctcgggccgccgcatcgtcgtccatgatccggcccgcggcgaacggcgcctcacctatgccgaggcctcgaaccatctcaccggcatcgccctggagatcgtgcccgccgcggggttccgcaggcgggacgagcgggcccggctgccgctctccaccttctggcagcacagcaccggcctgcggcgcagcatcgtcgaggtgatcgtgctctcgctggtgctggaagccctggtcctggccggccccttctacatgcaggtcacggtcgatgaggtcgtcgctcgcggcgaccgggacctgatggccgccctcgccatcggcttcgccctgctgacggcgctgcgggtggcggtgggagcgctgcgggcgcgcatcatcctgatcgtccagaacgtgctgcactatcagatcggagcgcggctgttccggcacctgctgcggctgccggtcgcctatttcgagaagcgccatgtcggcgatgtgatatcccgcttcggctcgatcgacccgatccgcaacctgctggcgcagggcctcatcgcggcgctcatcgacggcgtgctggccgtgctcacgctggggatgatcctcgcctacagccccacgctcgccctcgtggtgctcgtcggtctcaccctctgcgtcggcctgcgtctcaccctcttcgcgcgcttccgccgcctgaacgaggaggcgattcgggttggggcccgagaggacagcaccttcatcgagaccctgcgggccgtgcagagcgtcaagctcaacaaccgcgaggccgagcgggaggggcagtggctgaaccgcttcgccgagaccgtgaacgcgaacctcgcgctcgggcgcgccaagatcggcttcctcgccatcgatcaggcgctcaccggcgccgagtacgtcgtcaccgtctacgtcgccgcggcgctgacactcgacggcatcctcaccgtcggcatgatcttcgctttcatgagctaccgcgagcagttcgtggagaagtcgctcctcctgctccagacggcgctcgacctcagcctggtgcgcctgcacctcgaacggctctccgacatcgccgtgacgcccgaggagcccggccacgagcggccgctcgtccccaaggcgccgctgcgcggcgagatcaccctgcagggcgtctgtttccgttacgccgagggcgaacgggagatcctgcaggacgtgaccctgacgatccccgcgggccgtttcacgacgatcaccggcccgtcgggcgggggcaagacgaccctcgtgaagatcatgctcggcttgctggaaccgacggccgggcaggttctgatcgatggcgtgccgctccggacctacggcgtgcgcgattaccgcgaacaggtggcggccgtgatgcaggaggaccatctcctctccgggtcgatcgccgacaacatcggcttcctcgaccccgtcctcgatgagcgtcgcatggtcgagagcgccgtgcaggccggtgtgcacgaggagatcctggcgatgccgatgggctacgacagcctgatcggcgacatgggatcctcactctcgggcggccagaagcagcgcatcctgctcgcgcgcgcgctctaccggcagccccgcctgctgttcctcgacgagggaacggcccatctcgacatccgcaatgagcggctggtcaaccagagcctgcgcgccctggcgatgacgcgggtaagcgtcgcgcacaggcccgagatctcctgtggggccgacatgctggtccatgtcgacgggcgctgccgggcggtcgagggcccggaggcctccgaggcgctggcgcggatcggtcatccggccgaggctcagtag

SEQ ID NO: 9923 - DNA, 681 bp, Methylobacterium sp.
gtgggacgcgagatcgagatgctgttccgcgaggccgggtacaaggttgatcaggtgccggcctgcaaggatctcctcgcaggcagaggcgcgggcgtcgatctcgtcatcatcgacgccacccgggacggcagacgcgggctctgcctcgccagttcctatcgcagcgcatccagcgtcggaatcgtcgtcatccaccacgccgattcggagccggacccggtccaggccctggaagtcggcgccgacgacgtcctggtgcagccattccggcaccgcgaactgctcgcccgggtgaacagcctgctgcgtcgcatggatctggacaagggtgggccggtcgcagcgaagacgcggcgcggcatccggttcaagggttggctgctcgacctggagcggcgccaactggtctgcgaggcgaccggctgctgcgtgccgctgacgacggccgagtacaacatgctgacggtcttcgcacagaacccgtgccgggtcctcagtcgtgacgacctgtcgatccttgcgctggggcgccctcactcgatggacgtccgctccctcgatgcccaggtcgctcgcctgcgcaagcgcctgtcgacgaacaagcccaacatcgcctacatcaagtcggtgcgcagcgtgggctacatcttctgcaaccgaacgcacgacgtctactga

SEQ ID NO: 9924 - DNA, 276 bp, Methylobacterium sp.
atggcgcgcgatgatgggcctgagacggcggtggaccgccttgccttcaatctgctgggtgaagccttccgcaaactgagcgccgagttcatccgcacggatcgagccgcgggtatcaggcatctgcaagccatccatgacgagatcgccgcggcggcgcgccacgtcgagatggctcggccggatttggtgcgggagggcattgtcgaaggcgcaacgcaccgggtctgtacggtcttgcaatcggctggcgcctggccgcgcaccttcagctga

SEQ ID NO: 9925 - DNA, 165 bp, Methylobacterium sp.
atggcctatctcgccctgatcaccgcggcgctggcactgggaaccggcatcgcccaggccgcgacccggcgccccctcgccgccgagcgcctggagatggcggccggcacgctgttgctgacgggcctcgcccttctcggcaccggcctcccgctcttccgctga

SEQ ID NO: 9926 - DNA, 675 bp, Methylobacterium sp.
atgaccgcatcggccagcaagtggacgcgcgaccagatcgccgcgcgcgtcgcccgggacatccaggacggcatggtggtcaatctcggcatcggcctgccgacgctcgtcgccaaccacctgccggacgaccgcgagatcgtcctgcacagcgagaacgggatcatcggcatggggccggcacccgccgagggcgaggcggatcccgacctcaccaacgccggcaagcagccggtcacgctgctgccgggcggcgccttcttccaccacgccgacagcttcgcgatgatgcgcggcgggcatctcgacatctgcgtcctgggcgccttccaggtcagcgccgcgggcgatctcgcgaactggcacaccggcgcgcccgacgcgatcccggcggtcggcggcgcgatggacctcgcgatcggtgccaagcgcaccttcgtgatgatggagcacctgacccgccagggcgagagcaagctggtggcgcgctgcacctacccgctgaccgcgccggcctgcgtgtcgcgcatctacacggatctcgcggtgatcgagcgtgtcccgggcaccgcggagctgcgcgtcgtcgacatcgtcgagggcctgtccttcgcggacctgcaggccgtcaccgccgtccccctcggcgacgcgcgcgccgacgcgaacgcctga

SEQ ID NO: 9927 - DNA, 720 bp, Methylobacterium sp.
atgatcgacaagatttcggcttccacggaacaggcgctgcagggcgtccgggacggcgcgacggtgctgatcggcggcttcgggcatgcgggcctgccggtcgccctgatcgacgccctgatcgaccagggcgcccgcgacctcgtgatcgtcagcaacaacgccggcaacggcgaggccggcgtcgccgcgctgctcaaggccggtcgcgtccggaaaatggtctgctccttcccgcgccagtccgattcctacgtcttcgacgcgctgtaccgtgcgggcaaggtcgagctcgagctggttccccagggcaatctggccgagcgcctccgcgcggccggcgccggcatcggcgcgttcttctcgcccaccggctacgggaccgatctggccggcgaccgcgagacccgcgagatcgacggccgcaactacgtgctcgaatacccgatccgcggcgatgtcgcgctcatccaggccgagcgcgcggaccgctggggcaatctcacctaccgcaagaccgcgcgcaatttcggccccgtcatggcgaccgcggccacgctcaccatcgcggcggtccacgagatcgtcgagctcggcgcgctggaccccgaggcggtgatcaccccgggactgttcgtgcagcgcgtcgtccaagttcccatgcaagtccccatgcaagtccccgcgccgggaccggcgtccctccgcgcccccacgtaa

SEQ ID NO: 9928 - DNA, 1839 bp, Methylobacterium sp.
atgtgggtcttcatcgagggtcggttgcagatcgatctcggtggtgcccatggtccggaaacggcgacgctggatctcagcgcgaccggtaccgctgccgcacggctcggacttgtggtcggaggaacctacgacatcgcgatcttccacgcggaccgtcatacatcgggcctggatttcgggatccagattccgacgcaggcggcgatgtccgtcgactcgaccgccgacggcatcatcgaccgaacggaagcccgcgcgacggcctttacggtcaccgggttcgacgggttgtccggcgacgccgtcttcacggacggcatccgcaccacccaggcttccgtgagcggcaacggcacccacacgatcgacctgaccggcttttccggtgccgtcagttccaggcttgctgtcggcagccagacttcgggggtcggcaacaccgtaaccgcacgggccgtgaacggagcgcccgcgatcggaggtgcggctgccggacaggccatcgacgacaccgtgacggcgagacccttctcggtcgtcaccgtcacggatcccgacgccaacgcttccgcggccgcaaccatcaccatcacggtcggcggtacggccagcgatgccggcgggacgctctccggcaccggcctgaccaagaccggcacgggtacctacacgctcgcgatcggatcgccggccgcgaccgagtccgccctgcggaacctcgtcttcacgccggttgccaaccaagtcacgccgggcggaacggtcacgacggggttcagcctcgccgtcagtgatggtgaggcaacgacaaccgacagcaccacgacggtggtcgccacctcgatcaacgatgcgcccggcatcggcggagatgggcggatcgacctctcccagggtggaactgcggcggtcacgaccggagatctcacggccggtgatccggatgtcggacagagcctgacctacacgctgaccggcacgacgcgcgggcaggtgctggtcaatggcacggcgctgtcgtccaacggcaccttcacgcagacgcaactcgcggccggccagatcgccttccggcaggacggcagcgccgacccggtcgcgggcttccgtgtcacggtgagcgacggcatcgtcacgtcgagtccggcgacggttctcgcaagcgtcgccctgacgcccccgccctccgatccgggcgcggccggcccgagcgcgggcgacgacaacctcacgggcacggccggccccgacacgatcggcctcgggctcggcaacgacaccttcacgggcggcgccggcaacgacctcgtctacggcaacccgggcaacgacctgatctacggcaacccggatgccgacacgctctacggcggccagggcgacgaccgcgcgtacggcggccagggcgacgaccggctctacggcaacatcggcgacgacgtgctgttcggcaacctcggggccgacatcgcctacggcaaccagggcaacgacatcgtctacgggaatcaaggcgcggacgtgctctacggcgggcagggcaacgacgtgctctacggcgggcagggtgccgacacgctggtgggcgggatcggcgacgacacgctcgtcggcgggctcggggcggacctctaccgcttcgatccgaactcggcccgcgacctgatcctgggcttcgaccggggcgcgggcgaccggatcgccctgggtgggcagacctacacggtctcctcggcgcagaacggggacgcggtgctcctgctctcgggcggcggcgtggtcgatctcgccggcatccgggccgatcaggtcgacgcgagcgtcttcgcggcctga

SEQ ID NO: 9929 - DNA, 147 bp, Methylobacterium sp.
atggcccttccgaaagacgagaagccggcgccggtgcggacgaaccgcttcggcctgatcgccgccgccatcctcttcgcggcgctcgtcgcctacacgatctacttcctcaccgttccggccacgccgccgccgacgccgcactga

SEQ ID NO: 9930 - DNA, 312 bp, Methylobacterium sp.
gtggacctgggagcgacgccacggaaccgggcggcggcgcgcgcccgccggatcgccctcctcgtcgtcctgtgggccggcccgggaacgcgggcggatgcgcaggacagcccgatcctgcgggagcttcagcgccgcgagcaggagctgatcctccagatgcgcgagcggcaacggcgcggcgacatccgggaggacgagcggcgggatctcgcgcggcgggaggatctgcgccgcgaggaagcgcgcgagatggaccgccgccgcctgatcgaggcggaggagcggcgcgccctcgacaggcggcgatga

SEQ ID NO: 9931 - DNA, 369 bp, Methylobacterium sp.
gtggggatcgacgacgtgatgtcccgcctcgtcctgaacggactgatcggcctgtgcctcgcggccggcgcgccggccttcgcggccgatccggtcctgccgcgcgtccgagccgatcccgtgcacgcttatcccgttccggtcgagccgcctccgcccgcgacgatcctgcccgtgctggcgccgctggtgaacgcggtcgacccgcgcaccgggcgctgcctcgcgggcttcgcgcccgacaggcacgggttctgccgacgccacgacgatcccccgatcgtctgcccggagccggacttctgcggggccggagcgccgagcctcgcgccctacggcatcggccccgccctgcgcctcaactactag

SEQ ID NO: 9932 - DNA, 1251 bp, Methylobacterium sp.
atgagactggacgtgatgaaccagatcggatcggccttgaacaggctcttgtccggctccgcggagacgagcgcgcccggtggaaccggcaacctgcgcggcgcgaccgtgcagatggccgcgacggcccagcagccggcgcattcggcgggcatcggagagaggctgaagaccctcctggctccgctggccggcgcgctgaaggacgcgaaggcgtggctccaggccaagatgcagccggcccccgccccgcaggtgccggtctcgcagccccggatcgacaccaaccggacggccacgcagatccagggccggatcgagtacgcggccctcaccaaatcgggatccgagttcagggccggcgacggcgccctgacccccaagatccggaacgcgatcacgcatgccttcgggtacgagctgatggagagcttcgccaacagctccgatcaggtgcaggcgtcgcagtccttcatgcgcgacaacaacaccatctcgaagatcgcgtcgaacaccgcactgagatccccgcagatggacgccgtcgccagcagcgtgcgcgccatcatcggcgacacgccggtgatcctgagccggaagtcgctcggcctcacggcccaggacgaaggcgggcccacccagccggcgcatccggcgctcgcggcggggagccagcccgtggaccggcaggcggcggccgacgcctccgtggccacgatcgaccgcgtcatggtggagctgttcggcgatcccgacgatcccgccagcatcgaggcggccctcgaccgccttccgcgggagctctgcgaccagctcggcacgatgaacgccctgatcgacggcaccggggcccgcgtcgacgacgccctgaagaaggaactcaagacgacagccggccgcgacatcttcgcgctgcgggcgatcaacccggctctgctcgcgaggcccgggatcgcgaccaacgattcgcgcgcgctgagcagctcggtcatgtccgtcgccaaggccgtccagaacctcgtgaacggtcacggcatcgctctcgacggcaaggaggccgccccggaggtctccgcggccggcgcgaaggcgaacatgcaggcgcggtgggccgacggtttcgagaagttcctcgcggccgcctccgcgcgggcggatcagggacatctcgcgcaggcggcggccgacgctccgcagctcctcgcgacccgggaccgtctcgtcgccgaactcgaccggctcaggtcctag

SEQ ID NO: 9933 - DNA, 300 bp, Methylobacterium sp.
ggcttccagggcgccgggttccggggcggcgggttccacggcgtccgggcgggcggatatcgcggggttcgggccggtgggtatcgcggcgcggtggcgggcggctaccgcggcgcctacggccgcggcgcctacggatacggccgctacggctacgggtaccgaccctacggcgtcggggtcgcggccgcgggcgtcggtgccgccgccgcggcggcgggctactacggagcgacccgcggcgggtgcggtcccgacgcctattacgacagctatgcgggcgtctgccgcgcctactga

SEQ ID NO: 9934 - DNA, 330 bp, Methylobacterium sp.
atgtccgcgcggcaccgaaggcctgttcaggaggcttgggacagcgcgcaccagggccgcgatgtcatcgggccgagggatatcgaatcccgacgggaggtcatggtggacaagaacgatgtattgtcgggctttcgccgctacgtgccgcatccgagcttcgaggatgtggcctggtgggtgcaagcctttccgcactgcgccgacgacattcgcgcgcttgcgcgggccgcgatcggcattcaggctctcggctccctcgccgcccgagaagaggattttgcgcagccaagtctgcggcgagaagaccgggataatccgccgccctga

SEQ ID NO: 9935 - DNA, 849 bp, Methylobacterium sp.
atgttgatacccgctctgccgccccagccgacccgcgacgagcgggcacggcgcatcgccacgccggcccggcgggccgccgccttggccgctctcctgctggccgcggcccttccgtggggaagcgccgcgcaacaggcggttccacagggctctgatcggaccccgccgcagagcgcaccagccctggagccggacgcgctcgcccgcctgcgcgagaccggcgcggcgctcgcggcggcgcgcagcctgcgcttcaccgcgagcgcgctccacgacgttccgaccgcggagggccagtccgtgctctacgccgtccggagccgcgtgacgctccgccgccccgatcacctgcggatcgacacgggcggggacgaggccccggccgccttcgtgagcgacgggcgcaccatgacgctctaccggccgagtgccggcacggtcgcgacggcgccggcgccggccggcctggaggccgtcctgagggccgagatcgcggcggccgggcaggcgcaggccttcgccgacatgctgctggacgatccgggacgcaccttcacggacggcctgacccgggccttcgtggtcggccgctccgcgctcgtgggcggcgtcgagacggaggtggtcgccttcgcgagcccggacgcgcaggggcagatctggatcggcgcgcaggaccggctgccgcggcagctctgggtgaccgagaccgccgcgccgggccgcccgcgcagcggcgtgaccttcagcgactggcagctcgacccgatcctcgacgaccggaccttctcggtcgccggcgcggacggcgcgaggccggtgcccttcaccaagcccgaactctga

SEQ ID NO: 9936 - DNA, 570 bp, Methylobacterium sp.
atgagacggatcggtttcggcctgctggccctcggactgggcgtcgcggcggcgggcccggcggaggcgttctgggtcgcgcgcggctggcgcggcgtcgccgtcggcggcatccacgcgccgctcgtcgcgcgcgaggccgtgatgggccggtgctggcgctgcgcgccgctggcggccggggccgcgctggcgatcggggcgggggccgccacggcgcccgcggccgccatgccggtcgccatgccggtcgccgcgccggccgccgcgaccgtggccgcggcgcccgcaccggcggatgcggccacggccccggcggcgagacacgcggccggcacccaggtcgcccaggcgaacaccgcctcgacccactgcgcggcgggcctgccggcggattcgaagatgatctacgacgcgtccctgcggaacatgaagagcctggagaccctgcgcgacaccgtcgtgtcggagacccgctccctggtcgaggccggccggatcaccgaggccgatgcccgccccgccgccgagaaggccggaacctgcctgaggatgctcgcccacccgtga

SEQ ID NO: 9937 - DNA, 318 bp, Methylobacterium sp.
atgaccgaacggtatggcgcggaggcgaacgggcacgtgctggtggcggggcgcgccgggcggcgccggcacatcgcccatctcgcccgcgagccgcgcttcgacctgatcgaggcggacgtcaccgggctgctgccgccgctgccgcggatggggcaggtcttcaaccgcgcctgcgcggcctcgccgccgcacgaccaggccgacccgctccacacgatgatgacgagcgtgctgggcacgatcgcgtggttctcccgcgaggtcgcgccccgcgaacgggcccggcccgagccgctcgccgcagcggcggtgtga

SEQ ID NO: 9938 - DNA, 1275 bp, Methylobacterium sp.
atgaccgacaccaagaccgacgcgacgctcagcctctgcatcgccgcgggcgcgcggccggacttcctcgaccgcctgctcgggcgcgtcgcggccgatggcggcctgcccgccccctacgagatcgtggtctcggacgcctccgcggacgggacgatcaaggagatcgtggagcgccgcgccgcggaggggctgccggtcgtgcgcttccggcacgccggggccgcgcaccggccgggcgacgccgcgagcctgctcgccgccctgcggcgggggcgcggccgctaccgcgtcgccctcgccgaggacgagcttcccgtacccgcggccctgtgcgaggcggtggccttcctcgacgcgcatccggaggtgctcgcctgctacgcgccctgggagctgcacgacgaggcgcccggcgcggtcgcgaccgcgcagtacgccctggaggccgacgccgtcttcgggccgggcgaggcgatggagctgttcggcttcctcgtgcgccacggcgccgccccggaggcggccctctaccgcgccgaggctctgcgggccctgccgccgccaagccaccactgccacgcgggcttcgtcggcctcgcccggctgatcgccgagggcgcggtcgccttccggagccggccgttccgccgcatcgccacgcaggaccccttcacgggccggcgccacgagagcgcgaccgcgggggcggcggactgggacctgcaccgcggcggtctcgaattctacgtccgcgccctgctggcacggaccggcaccgccccagacccggcccaccgcccggtcttccgggacgcgatcgacgcctatgtcgagacccggatgcggcaggccttccgggtcgccacgggccggggcgacttcctggccgcccacgagatccacaaccggctgagcctgctcagcctcggcgaggcccgaccgccggtcgagggcctggagcggctgccgctcctcgtggcggtgcagacgctggcgcggctcgccaacgagaccgccgaggtggagcgcgtggtgctggtcggcgtcgaggacgggccctcgatcagcagcctgctgcgcgagctcggcctggagcggcgcatcctggtggccccgcccctggaagcgccgggcgagaaggcgatccgcgggagcctcgtcttcctcggcgagaaggccgcggacgcgcgcgcgcgcttcatcgagcagggctacgcgccgagcctcgtggtggacgagcgcgacctcatcgccggcatctgcctgccctga

SEQ ID NO: 9939 - DNA, 144 bp, Methylobacterium sp.
gaggacatcatcgagccctacctgatccagcagggcttcgtgcagcgcacgccgcgcggacgcgtcctcaccccgcaggccttccgccacatgggactggccgtgccaagcgcggagatcgccccggaggcggcggaggcctga

SEQ ID NO: 9940 - DNA, 279 bp, Methylobacterium sp.
atgaagtggatcctgccggtctgcgccctcgtgctgtgcgtggccgatccagccttcgcccgcggcgtgccgcatcggcccgcacccgacccgtccggcgccgaagcgcgggtgcagccgaacgataccggcgctccaggcagcctgatcatcccccgcggcagtacgggcgcggacacgatcttcctgaactccgccgcgggcggcaatgccggtcagccggagcgcgcgatcccactgggcagtggcggcggaggcgacagcggcggcagcccgtag

SEQ ID NO: 9941 - DNA, 285 bp, Methylobacterium sp.
atgcgcctgacgctctccctcatcctcatcgcggccgtcgcgctctacggcgcctccttcctgcaggccgcccaatccggcgccttggcggaagcgggcgcgcaccctgtgcgcgacggggcgccccggtcgatctgcatcggctgcggcggccccgtcgtgccgttcgaccccagcggcggggtccaggccggacaggcgccggatgccgccggcaagccgcggccggcggtcgggcccccggcaagcggcggcgccccgcaccgcccggggcgggcgccctag

SEQ ID NO: 9942 - DNA, 195 bp, Methylobacterium sp.
atggtggtcctcgacccgcgtaccggtcggctggtctcgatcagcctgggcatccagcccgacacgcgcaccggtcccgccgcaccccggcccgcccggccgccgagggagtggccgccgcaccatccggaagcgcaccaggagccgccgggtgccccgccggcccgcctgcggatccgccgcgaggagagctga

SEQ ID NO: 9943 - DNA, 345 bp, Methylobacterium sp.
atgacctacgcgttcgataccctcaagttcacgcagcggctggaacaggtcggtgtcggacgcgatcaggccgtagcgcatgccgagctcgctcgcgacatgatcctcgccgacacggcgacgaaggccgatctggctgcgttggagaccgctctcaaggcagagatcacgggggtccggacggatacccgcgctgatgtttcgaatttgagaacggacatccagacgatgaagcgagagttcgagggatcgctccgcgaactcgaacttcggatcaccgtgaagctcggcgcgatcatcgctgcggcagtcgccgcgatcgcggccctgcaaaagtttctctga

SEQ ID NO: 9944 - DNA, 795 bp, Methylobacterium sp.
atgccgccagcttccagcctggaagacctgatcctcgccctgctgccgaccgacagcacgcccgtgctcaaccgggtgatgcgggtgatgctgacccgcgagcgccaggagccggtcggccaggacgcctatttcgccgcccgcgaccggttgctcgccgcgcgccggatcggccggctgcgggggcagggcggccagatcttcctgatgcccgagcaggccccggtcgaggcggaggcgcccgccccggagagctggcccgaggccgccctgatggcgccgctgcggcgctatctcgaagggcccttcgcgaaggggctcgacgtcggcgagggctgcaccctcgtgcaggacacctcgacgctcgggccccgccagggcgtctgggcccggccggacttcatctgcgtcacggccatgcgcttccggctgctgccgggcgtccaggtcgacgtgcacgccttcgagctgaagaccgagagcggcggcaccgtgcaggcggtgcacgaggccctggcgcagacgcgcttcacccatttcggccacctcgtctggcacctgcccgagggctcgcgggccgaggcgcggctcgccgagatcgaggcgcattgcgccgcacacggcatcggcctgatccgcctgcgcgatccgcgggcgccggaggcggccgagatcctggtcgatccccgccggacggcgacgcggccggcgatgatcgacgggttcttggaatcgcggctgaacgcggagaacagggcccgcctcgaagcggtgctgagggaggtgcgggcgtga

SEQ ID NO: 9945 - DNA, 210 bp, Methylobacterium sp.
atggctcacatcagcctcgcagatctgatgaagcatccgcccgccgtcgatgcggcgaagctcgacgcgctgacggaggcggatctccgggcgcagcggatcgcggacggctacgatccggaggcgggtcctccggacgacacggagatcgtgctgcctttgcagcaggtccggtcgcgccttgggatgactcatactgtttccggttga

SEQ ID NO: 9946 - DNA, 111 bp, Methylobacterium sp.
atgatcgccgcatcgcgaaccctcatcctccggcaccgcgagatcgcgggcgcgctcgcctcctcgggcctgttcgtcgccagcctcttgatgctcacagccctgctctga

SEQ ID NO: 9947 - DNA, 105 bp, Methylobacterium sp.
atgtcgccgcaagccgacgacggcatcatacgctggaacaccccgaacaaggacggcaatctgggtggccccggcgcgggcggcagcggcggcggcggcggttga

SEQ ID NO: 9948 - DNA, 495 bp, Methylobacterium sp.
atgaaggcccttgttctggctggcgcggcgctcggcgccggcctgatgatgacgccgagcgccgaggccggcccctacggctacggcggctatcgtggcggttacggcgggggcttcgcgggccaccgcggcgactacggcgggcgtgggttcggctaccgcggctacgcgggtcggggcttcggctacggcgggtatggcgggcgcgggttcggctaccgcgcggccggctacggctatcgcggcggcttctacggcggccgcggctacggccggggtctcggcctcggtctcgcgggcgcggggatcggcctgggcgtgggcctggcggcgggcacgctcgcggccggctcctacggctacgccgcaccctattacggcacgaacggctacggctcctacggctacgccccggtcggctacagctacccgtcctacggctacgccgcccccgcctacggctacagctacggcgccggttgcggctgctggtag

SEQ ID NO: 9949 - DNA, 693 bp, Methylobacterium sp.
atgccgagcgtgcgcgagctcggagaactcaagtacaagatcacgcggctccggatggtggacgcgcgctacgtcaccggcatcgaggccgtcggcgacctgaacaagacgtccgatcagcgtctcaaggaggtcgaggcggttgctgcgcgctacgagccgctgatcgcgagcacggaggagcgggcactctgggatgaattccggcggaactggaccgactatctcgctcagagagcgaacatcgcggcctccgccgatacgaagagccagaccgcgctggatgatctgttccagctctcgcgcaaacacttcaacgcagccctcgatgcgctcgatcgcgatacggccttgaacatcgccggcggtgagcgcgcacgctccaccgcgagcgccacctatcagttcggcatccagctcacgatcctgttctgcggcctcgcgctgatcaccgcgctggccggcatcctgtacacgctcgtcggcgtcacgcggccgatcgatcgcctgatccggcgcatgcacgctctcgcggccggggacgtcgagggccgcatcccgcacatcgaccgcaccaacgagatcggcgccatcgccgccgcagtcgaagcgtcccggggcaacctcgtgcgcacccgccagctcgaggcggagacggcgctggcgcgggcctcggcggaggagcagcgcaag

SEQ ID NO: 9950 - DNA, 594 bp, Methylobacterium sp.
atgcgcggcatgagcgcgttgaagacgcattatcggccctatgtctgcccgcttcacgcggtcctcgaacagatcccgccggaagcgcgggtgtacgatatcggatgcgggtccggctcgttcctctatctgatccgaaggctgagatccgcgatccgcgcccaggggcacgatgtctcggccgaggcgatcgcggcagggcagcagctcgccaagatcgagccgagcatctcggtctccctgcgaggcgccgattatgtcccggatctgagcgatgtcgatgtcgtgacgatgatcgatgtcctgcatcatgttcccaagcgggagcaggccgggttcgtcggacggatcgtctcgaagatgcgcgtcgggtcgcggatcgtcattctcgatatcgatgccgcgcggcgatggcgggcctgggccaatcaggttcacgatctcctgctcgcgcgcgagtgggtcaatccccgcacggcggcatcgacgatgcggttgctgcaggatgcgggaatacaggccgagatgccgcgtctgtactcgaccttgtggtacggacattacctgatttccggaatcaagaccaaacattga

SEQ ID NO: 9951 - DNA, 345 bp, Methylobacterium sp.
ttgcgcaactccctgcagggcctgaccgtggcggcgcgctccgagcgcgccgtacggcaggagctggtcgttctcgccgttgccgtgcctgcagccttcctgattgccgatcagatctacgattggatcgctctgatcggcagtctcgcgctcgtgctcatcgtcgaacttctgaacacggcgatcgagaagctctgcgaccacctgcatccggggcgccacccagcgatcggcaccgtgaaggatttcggatcggctgccgtgttctgcgcactgatcttcgcgctcatcgtctgggtcagcctggcaaccatgaatattcttcttccccacgacagcctgtga

SEQ ID NO: 9952 - DNA, 1626 bp, Methylobacterium sp.
atgttcggggggatgctgccggttctcgccgtggctctcacgtttgccgacggcacggcgattgccacaagcagcgacagacttctggcgtctttcgccttcaacgcgatcctgttcgggctccttgtccactccgcagcccacctgctgaaaagatcgatctttctattgatttatgccatctttgcaatctactcttctctctatgtgttgttctatgtctatcattttaacatatttggtcagatatttggcgaatcatccatcaacgcggtgatcgacagcaatccccaggaagccggcgagttcttgagctgggccttcaggcttgagcatctgcctcttccactcctggcaggcctcaccgtcgcagccgctttcgccgtccgggcgcccgccgtgccggccatccgctcgcggcgcgtgggcttcgccgccctgactgcggcgctgctgatgctgccgatcgcggccgtgaagaccaatgtgattctatacaatccgatcttcttcccgggccatgcgacgtacaaagctctcgcaaatcgttctgcggtcgccgaaatccaaagcaagatcgacacgattcgaatcggatccgtcgatggccccggagagaaagccgttacgcacatcctcatcatcggagagtcgacgacgagacgacacatgtcgctctatgactatccacgggacaccacgccgcgcttgcgcaaactcgcgcccgaactcgaggtcgccacggatgcgtgttcgtcacgcggcgctaccgttccggctcttcaggagatgctgacctttgccacccgcgagaactcggcgcccctcttcgagaagccgagcctgctccagatcatcaaggcggcgggcttccgctcttggtggctctccaaccatgccttctacggggacttcgacaattggtcgatggttctgtcgcggccagccgatgcgcgtcatttcgtcaaccgcgtcggtgaagggacgagcttcgacgaacagctcctgccctatctgaaggatgcgctcgccgatccgtcgccgcgcaagttcatcgtgctccacctgctcggtgctcattcagattatacgctgcgttatccggtcggctttgataaatttaccgacgcgccattgccgccgactccccggacgctcacaagccgggatgctcaactcttcaacgcatacgacaatgccatcctctacaacgatcatatcgtcggggagatcatcgctgcggcccgagcggccgatgcacatgcgaccgtcaccttcgtgtccgaccatggcgaggcgctcggcgagatctcggacttcttcacgcatatcgatggtcgcgcgccgcggcaggtctacgagatcccgctcaccttctggatgtccccggcctttcgggcacgtgccacgccgcgcatcaaccaactgcgaggcaacctcgggaagcccttccagacggacgcgatgatccacacgctcctcgatctttacgacatccggcacgacgcgcatgcgcctcaacggagtctgttcgccgccgactacagcgtaccgtcgcgcttctgcgacaagatgccggggctgccggcatcggcgaccaaccctctgatggtcacagcgcagtga

SEQ ID NO: 9953 - DNA, 156 bp, Methylobacterium sp.
atgcgcgcgttcggcccaagccggtcgagcgggatctcactggcctggagcgcgccgagcccggcgtcgatgaaagcgtcgctcgcctcgttgaagtcggacgagagcttcttgcggtcgttcagggtgtcattccccgcggttatgcgcagctga

SEQ ID NO: 9954 - DNA, 975 bp, Methylobacterium sp.
atggatcgtcgccagtttctcggatgcggcgtcgccttcgccgcagctggcaatgcgctcgctccgcgcagggccatcgcacaagccttcccggtgcgacctgtgcgggtcgtcgtacccttcaccgctggcggcacaacggatttcacggcccgcgtcgtctgtgagacgatgagccgggccgccggacataacttcgtcgtcgagaacaagccgggcgccgcgggggtcataggcgtcaaggacgtggccgcctccgagcccgacggctacgccctgctgttcagcgactcgtcgctcgccgtgacgccgacgaccaaccccggcgccaagctcgaacctttgaagatgctgcagccgatcgggctggccggcatcttcccctctgtactcgtggtgcatccgagcgtgcccgcgaggaccgtgcaggaacttatcgactacacgaaggccaatgccggcaaggtcaacttcggctctggcggaatcggtacagttcctcatcttcaggccgagcagttcaagctcgtgaccggcgccgtcatcacccacgtgccttacagaggcgccgcggccgcgcttcaggatgttgtcgccggacagatccagatgctgttcacggccgctccgactgcgctcgccttcatccagtcgggcgacctcaagctgatcgcaacaacgggcgccgaaaggctgccggtcgtcgcggacgctccgacactagcggaagtcggcttcaaggatctcgtttcggcgcagtggttcggaatgctcgcccccgccaagacccccgcggacatcgtcaaacggcttaccgaactgatgtccggcgcactcaacgatggtccgacagcgaagaagctcaccgaccagggtggcataatgaagcgaggaacgccggaggatttcgcaagatttatcgagagcgagatcgcaaagtggcgtgacgtgattgccgcatccaagcagaaatag

SEQ ID NO: 9955 - DNA, 1230 bp, Methylobacterium sp.
ttggctggccccttctgcggctaccatctggcgcgcatgggcgccgaagtcgtcaaggtcgagaatcccaagggtggcgacctcgcgcgccggctcggcgccgatccgacgatggccgagcgcctgatgggcctgtcgttcgtggccgtgaacgccggcaagcagtcggtcgccatcgatttcaaatcggccgacgggaaggagatcttcctgcgcctcgtcgagcaggccgacgtggtgctggagaacttccggccgaaggtcatggatcgccttggcctgggctacgacgtgctcgccgggcgcaatccgcgcttggtctactgcgccatctcggggttcgggcagaacgggccctggctcggacgcccggcctacgaccagatcgttcaggggctgtccggcgcgatgagcgtgacgggggatgcggccaccgcaccgctgcgcaccggctttccgatctccgacaccatcgccggcatcaccgcagccttcgcgatttcgtcggcgctcgtcgagcagcgcaccaccgggcggggtcgccggatcgacgtttccttgctggaagcgaccctggccgcgatgggctgggtcgtctccaaccatctcaatggcagcgtcgatccgcagcccatgggcaacgagaacttcaccgccgcaccctccgggacgttccagaccggcagcggtcccctcaacatcgctgccaacgagcagaagcagtacgaaactctctgcgacctcgttggccgtcctgatctcaaggccgatgtgcgctttgccgaccggcaatcccgcaaggtcaaccgtccagccctctcgaacgagctgaacgcggccctgcaggctcggaccgccaaggagtgggaggcgttgttcaacgcccacggtgtgcccgccggtagcgtgctcagcgtgccggaaatcctgcaggaagagcaggtcacgggccgccgcttcgttgaaaccattgacgcgacggtgcgtggtggccagccgatgcgcgtcactcggccgggcttcctgctcgatgaggactacccggtgccgacgccgccgccgcagctcggtcaggacaccgaacgctggctcgaggtactcggctacgggccggagcaggtcgccagcctgaaggggaacggcaccgtcgccgcggtcgatcggccaacgagcgggccgtccgcaaagccccccgagctgcagccccgcgcagacagcccccgtcgttga

SEQ ID NO: 9956 - DNA, 870 bp, Methylobacterium sp.
atgagcgacaaggatcctgccgccgtcctcgcggatgccgaggcctggtggtcgacggcgatcatcgacatgaagcccggtgttatccgcttcgccggctttccgatcgagcaactgatcggttcggtcagcttcccgcagatgatctggctgatgctgcgcggcggcatgcccacaccggccgagggcgcgctgctggaggcggctctggtggccggagtggatcacggtccgcaggcgccctccatcgcgatcagccgcatgtccgtcacctgcggcctgcccctgaacggggcgatggcttcggcgatcaacgtcttggatgacatccacggcggcgcgggcgagcagtgcatggagctgtacaccgacatcgcgcggcggatggacgaaggccagacgctcgacgtagcggtggagggggggctcgatgcgttcatagccgcgcgcggcaagatcatcgctgggttcggacaccgcttccacccgatcgatccccgggcgccccgcctgctcgccctggtcgatgcggcgcgcgagcagggcgtggtgaacggccgcttcgccgagatcggccgcgcggtcgaagcggcgctcggtcggcgcaagggccggggcatcccgatgaacatcgacggcgcgacggccgtcatcttcgccgaactcggcttcgcctcgccgctcggtcgcggtcttttcatcctgtcgcgctcggtcggcatcctggcccatgcctgggagcagaccctgcagggtggccgcatcaaggggccgatgccccgcgggatcccctacacctacacgggaccggcccagcgcgacttcccgggcgacgcggcggctccggaagctggggtactgcggtcatga

SEQ ID NO: 9957 - DNA, 972 bp, Methylobacterium sp.
atggacctcagggacctcgcgttcttcgaagtcattgcggattacggacatctcggccgtgcagcagagcgcctcgggcgcacgcagccggcgctgaccaagtgcatccaaaggctggaggcttcggtcggggccgagctgttcgcccgctcggggcggggcttggtgttgacccaggtcggggaggtgctgctgacgcgcgcgcgcctgatgcgcaccgcgatggacgaggcgatccgggaggtcagcgagtttgccgccggcaccgcgggccatgtgcgggtcgggaccggcgccacgatggcggagtacctgctgccgcacgtctgtcgccgactcatcgccgcagcgcacggggtcacggtggacctgcagatcggcatgagcggggttctgcgcgctgccctgcgcgaaagtcgcctcgatctcgtaatcgggcccgtcctgccgggcgacgccgatgaattcgctcatgagagcttcggcaccgacgaggtggtggtcgtggccgccaaaggccatccgctctgcggtcgaccgctcgagatcgaggcgctgagcgcctggaagtgggtcctgcccgcccgcaccgtcgccatgcgccagtggctcgatacagtgttccaggcccacgatatcactggcccgcacgtgcagatcgagaccaactcgatcaccatgctcccgcgtctgatcggcgaaaccgacctgctcagcttcacctcgacccgcaacctgttgccggaacgcctgggcggctgggtcgaacgcttggacatcgacgtgacgaccctgcggcgcccgctcggttgcgtccatcgccgcggcagctacctgtcgccagccgcctcgcgcgtcgtcgcgctgctgcgcgaccacggcgcggcgctgctggcggaaggcggtgtcggcaccggtgccctggcaccaccctccgggcggacccctcaagaccgggttggcaccgcatag

SEQ ID NO: 9958 - DNA, 1218 bp, Methylobacterium sp.
ttggtgcccatcctcggactggcctacctcttcaactacctcgatcgcacgagcgtgggcttcgctgccctgcagatgaatcaggcgatcggcctcaccgcctcgcagttcggctggggcgccggcatcctgttcttcagctactgcctgctcgaagtcccgagcaacgtgatgatgtatcgctacggcgcccgccgttggctcgcccgcatcatgatcacctgggggttggccgccgcagcgaccgccttcgcggtcggtccgatgagcttctacgtcattcgctttctcctcggcgccttcgaggccggcttcttcccgggcgtgatctggtacatctcgatctggttcccggcgcgctaccgaacgcgcgtcctggcgctcttcatggcctcgacaccgctctcatccctgctcggcagcccgatctcggccgcgctgctcagcatggacggcatcctcggcctcggtggctggcagtggatgttcatcatcgagggcctgccggcctgccttctcggcctcgcctgcctgtggatgctcgcagacaccccgaaggacgcgacttggctcagcgccgacgagcgcaacgcgctggtcaccgaactcgccaacgagaggtacgagaagccgaagaaggatctctgggcagcgatgaaggacgtgcgggtggtcatgctcaccaccatcacgttcgccttcacgatcggctcctacggcatcggcatctggctgccgcagatcctgaaggggcacggcctgtcgaccctcacgatcggctgggtcacggcgatcccctacctcttcgccaccatcggcatgctggtctgggcgcagtacgtcgaccgcacgggcaagaagatctacaacctcatcgcggccctggtgctcggcgcggcgggcttggctgcctccgtcctgttcacctcgctcatcccggggctcatctgcctgacgctggcgctgattggcacgatttcggcccgcaccgtgttctacacgatcccgcagagcttcctcaccggagcggcggcggccggcggcctggcgttcatcaactctgtcggcgccttcggcgggttcgtgggaccttaccttgtgggctatctcaaggatgcaaccggctcgttcgatgcggggatgctcggcatggcggcgaccctgctggtgtcggtcttcatcgccgcctcgctcaagctcgtcattaagaacgcctga

SEQ ID NO: 9959 - DNA, 300 bp, Methylobacterium sp.
gtggcggcgcaggcgctcgccgagcggatcggcgacgcctccgtgacgtgcgagccgcgcccggcgtcggaggagggcgccgcgacggcgctctgccgcgtcggcgacgaggatctcggcgcctggatggtcggccggggctacgccgtggccatgcggcagggcccgcacccctatgccgaggccggcgcccgcgcccggggccggcggctcgggttgtggtccggcgtcttccaggaccccgatgcgtggcgccgatcccaccgggcgccggtcgcccggctggccgggggatcctga

SEQ ID NO: 9960 - DNA, 555 bp, Methylobacterium sp.
gtgccggaatcggcgcgtctcatcgacggtggcggcgagatccgcgtcgaggattgccggccggtctcccgggatgggccggctgacgcggcggatgagatcggcgtggtaggcgccgccgaccggcttctcctcgccgagcatctccaagatgcgctccagcgcggcttccagcgacgtgtgcccggcctgcatcgcctgcatcagggccatccgggccttgtaggcctccagatgctcaccctcgaagccgccggcccggtcgatctcgaccgcccgggagaaatgctcgaccgaccaagccacgtcgtcgaggatctcgatccagcgcgcgtcgctcatgcgagaacccgcgctcctggcatcacctgcgcgcggaacccctcggtgcaccacgtgagcgggcggatgtcggccgccagcccgtgcgccgcgcaggcctcctcggcgaagcgccaggcctccgcctcagccgccacaggcacatcgatgagcagatcgacgtcgctgtcgtggcgcatcgccccgcgcgccgccgagccgtacaggaggtag

SEQ ID NO: 9961 - DNA, 375 bp, Methylobacterium sp.
atggttccgtcagaggccgagatcgaggcgcggctcgccgagctgcgccgccgccgcgaggcgatcgaccgcgagatcgccgaccacctgctctatctggagctcggccggcgcctgcgggccggcaccgcggaggcgggtgcggcgtcggcgggtgacgacgccgatccggacgcggccgatccgcccgggccggtgttcccggggcccgcggaggccggcgggacggggccggacggcggagccccgccgcggcggtggccggcgcgggagcccgccgccggaccggccgtgccgccctccgtgccgccgcccctgtcccccgccgccgcgtcgggcgcggcacggggctgggccgcccgcgcggccgaggcc

SEQ ID NO: 9962 - DNA, 1776 bp, Methylobacterium sp.
atgtcggggccaggaacagaccgcgcgccagcgcgagccggcggcgcggagtcgggttgcggcgacgcggtttcgtccgccctcatccacgcggtcgggctgctggagcgcggcgatccccgggcggcgctggaggcggcgagcgaggcctgcttcgacgcgcccggacgccccgagccgcactacgtctacggccaggccctggccgccctgggcgagcatgctctggccgagcgcgccttcgccgaggcggtccggctgcggcccggctggcccgacgcctgggtcaattacggcctcgcccgctaccgccggggggcgctcggcgatgccgtgacggccatgcgcgcggcgctcgcccacgcgcccggccacgccgccgcgaccgccaacctcgccgccttcctgcgcatctccggcggcgccgaggaggccgccgacctcgtgcggcaggcgctcgagcgcgagcccgctcaggcgggcgtgcggctgaaccgcgtcgcggacctcctgcaggaggagcgcgccgccgaggcgctggcgctcctcgatgccggcgcgccgccggccgctgcgcccgccgacctgccgatcctgcgccactggcacctgcagcgcgccctcgccctgctgcagctcggccggggcgcggaggcccgcgcggcgctggccgcgctcgacgcgctcggccccctgccgccggcgttggcgccgctgcgcctctggcgcgcggtgctgctcgcgcggggcgaggggcgtgacgaggcggcccgcgccgccgccgaggccatggcggcctccctcgacgcgatggggccggacgcgatccctgagcaccgtatcatgggccactacgacctcgccaagttctggtccggccggggcgagcacccccgtgccttcgcgcactggcgcgagggccaccggctcctcgccccgagccagcccttctcgcgggcggaccatctcggcttcgtcgagggctgcatggcccatctcggcgccgcgcgcctcgcccgggggccgcgggcggcgaaccgggaccccgcgccggtcttcatcgtcggcatgccgcgctcgggcacgacgctctgcgagcagatcctggcggcgcaccgggacgtgcacggggcgggcgagcgcggcgcgctggccgaggccggggcctgcctcgcgggcggtgcggcggacgggcccggggcgccggcccggctggcggcgctcgacgcgcccgccctcgacgccgcggccgggcgctacctggccgagctgcgggcgctggcgccggacaaggcgcgcatcgtcgacaagatgccgggcaactacctccatctcggcctggtcgggctgatgctgcccggggcgcgggtgatccactgcacgcgcgacccgcgcgacatcggcctgtcgatcttcaccttccgcttccacggccggcacggctacgcgcacgatctcggcgacctcggctggaccatccgccagcagacccggctgatggcgcactggagcgcggcgctgccgaacccggttctgagcgtggcgctgtcggactgggtcacggatttcgacggcacgctggcgcgggtgctcgcccatctcgacctgccgccggacccggcctgcgcgcgcttccacgagcgcaccgaccccgtgcgcacggtgagccgcgcccaggtgcgccagcccatcaacgcgcgcggcctcggccgctggagaacctacgcggccgagctcgccccgctgatcgcggaactcgcgccggccgaggactga

SEQ ID NO: 9963 - DNA, 153 bp, Methylobacterium sp.
cgcccctacggccccgccgcgtacggccgcccgcgcgtggtctacgaggagcccgtctacgagacccgccgggtgatctcctacgagcgcgtgcccgtcggctacgccccggtccggcgcgggtgggacggtccctacggcgagcggtggtag

SEQ ID NO: 9964 - DNA, 306 bp, Methylobacterium sp.
atgcgccagatcctcaccctcgccgtcgccggcgcccttgccgggaccgcgctcgcggttctcgcgggccccgccgcggcccagatgcggccggtcgcctgcccggagggccggctcgtggatggaagctgcgtcaacccgcggctcgccttcctggcccgccagcaggcggtctgcttcacccaggtgaagctctcctacatcgcctgccccggcacgctgccgggcgtcgacacgcgctacaagttccccttcaacgtcgtgaccgagcgccagcgcgagctgaacttcgtcgtggagcgctga

SEQ ID NO: 9965 - DNA, 1278 bp, Methylobacterium sp.
atgagacttctacgatgggccggcgcgctcggcctgctctgcggcgcggcggaggccgccgacctggcggcgcccgtgccgttggctccagccgccttcgagccggtctggacgacgacggtcaacaccgagttccggtacttcagcttcggcggcaccaaggggcagccgaccggcatcgcgccgctcggcgcgcgcggccgcggcagccagttctacctgccgttcggcctcgccatctcgggccagccgacacccgacctgaagatcgacctcacggcccgcggcggctacgtcgattcgcgccaggagacgcaaggcctgatgggtgcggtgcgcaccaccctcgacacgcagctctcggcgaccgcgacctatctggggctcgatggggtgcagcccttcgcctcgctgaacctcaacctgccgaccggcacctcctatctggcgggcacgcgcttcctcgcccgcctcgattcggacctcgtggacgtgccgaccttcggcgagggcttcaacatcggcccgagcgtcggcgtgaacgtgcccatcggccagacgatgctgttcaacctgacgctgggctacacggcccgcggccagtacttccgcgagggcgcgccggacccgatcacgggcatcgacgccttcgtcgacacgcgctcgggcgacaccgtctcggtcaacggctcgctcgcctacgaggacggcccctggagcggcaacgtggccgtggtctactcccaggacggcaccaccttcatcaaccggctggcggccatccgctcgggctcgcgcgtcggcctgtcggggcaggtgggctacgcgtggtcggaggcctggggcaccacgctcagcgcctcgttcaaccactcggagcgcaacttcgtgccgaacgcgccgctgccgggcctcatcgcggagccgcgcaactcgaacagcaacctctaccgggtcgggctcgacacgctctaccgcaccggcgccttcgcgctgggtccgacgctgagcttcctctaccgcgacgtgaattcctacgacccgatcaccttccagttcctgcccgctcgcgagcgctacggggcgggcggcacgttcacgtacgccatcaccgacgccgtctcgctgagcctgcgcggcgagcgcatcctcgtgcacgaggccgcaaaccccgataaggagttctttcccggcagcggcatcgttcccggaaccgggcagccccgtctctcctacgccggctggtcgatcagcggcggcgccacgatcaagttctga

SEQ ID NO: 9966 - DNA, 1089 bp, Methylobacterium sp.
ttggacgatgttctgtcgcccgcgcaaatttccgagatttacgaggccgcgatcgaggatgacggcctcgcgagacttgtcgagatcgtgggccggatcgccgatgtcgacagtgccggcatctggctccggcagggctccgagatcatcgatctcacggtgagcgaggcgatcgcggcctcgatggtgccctacctcgcctactacgcccgaattgacccctgggccgcggcgatgatggcgtcgagccgcgtgacgctcggcaacgagatcgtcgacgaagcgcagctcgtgcagggcgagttctacaccgacttcgcccggcatttcggcatgctgcggccgatgggcgcgacgctcggcatcgcgccgggggtcgtggcctccgtctcgaccaaccgcgcgagccgcgcccacctcctcgacgggacggacaaggcgcgcttcgcggtgctggccgtccacctgcagggcgcattgcggctgcgccaccggctcggcggcgagcgcgtgctgcgccgcgacctcgccgccgccttcgacgggctgcagttcggagcgatcatctgcggcccggacggaacggtcctgttcgccaacgacgcggcgcgcgccctcgaagcggcgcgcctcctgcaactgcgcggcccgggcggcgtgctcacggcagccacctcggagcagacggcgcggctgcgcggcgcgatcgcggccgccgcgggcagcgggcagcccggagggatccagcttgccggggcggagggctcggacatccacgccctcgtcacgccgctgccgggagcggctccggacgcccgccgggggcgcgcgctcgtcacgctgcgccgggcggacgccgtggccggccctgcggagggccggctgcgccagctcttcggcctcagcccggcccaggcggcgctctgcgtgcagctcgcacggggcctgaccttcgaagcggcggccgatgagcgcggcgtcgcgctcagcaccgcgcgcacgcatttcctcggcgtcctgcagaagaccggggccgcgaacctgcgcgacctgctgcgcctcctcggcacgctgccgcaggcccattga

SEQ ID NO: 9967 - DNA, 81 bp, Methylobacterium sp.
ctcggcgcccacacccttccccaggccgtcctcatcgcgaccgcggccggcgtgcgccccgtcgatcaggacggcgcgtag

SEQ ID NO: 9968 - DNA, 270 bp, Methylobacterium sp.
atgcgctcgggtctcgagcgcacggcgcatctcctgtgcgaactgctcgagcgcctgggatcgatcggcgccgtgtcggacggccagttcgaactgccgttgacacaggtggatctggccgaaacgctcggcctgtcgagcgtccacgtcaaccgtgtgctgcaagccctgcggcgcgacgggctgatctcgctgcgggcgcaccgcctccggatcctggcgccgcggcggctgagtcagctcgcggagttcgaggccgggtacctgtag

SEQ ID NO: 9969 - DNA, 453 bp, Methylobacterium sp.
atggtgaccccgatccggaatggctcatccagcttggtcgaactcgctggcatcgtcgtctcggcctatgtctcgaacaacccggtgccgctgtcggagcttccgaagcttatcgaccgggtccatacggctctcaacgagatcatgaacgcggatgcggtggacaggaccaccgagctcgaagagaaggcgacgcctgagcaaatcaaaagctcgatcacgccggatgcgctgatcagcttcatcgacggaaagccttacaagacgctcaagaggctcctggccggacatggcctcgacccattcagctaccgtaagcgcttcggcctgcccgcagactaccctatggtggcgctgaactatgctcagcggcgctccgagatcgcgaggggaatcaccctcggcatctacggagggcgtggcaatcagcacaggagcggcgcgcgccactga

SEQ ID NO: 9970 - DNA, 141 bp, Methylobacterium sp.
atggcgaaccgctcgcgctcgctcgagatcacctcggcgtcgtcccggcggactgcctcgacgcgcagcctgcggcccttgacggagaccggctccacctcggccgtcacgctcatgccgaccagcgcggccgcgccgtag

SEQ ID NO: 9971 - DNA, 1425 bp, Methylobacterium sp.
atgacgtctatcctgcgccccgtcgacggtgcgcaccgcaaggtgctggtcctgggaggggacgggttctgcggttggccgacgagcctgtacctgtcgcggatcggctacgacgtgacgatcgtggacgatctctcgcgccgtgggatcgacaggacgctcgggaccgactcgctcacgccgatccgtccgatcggcgagcggctggcggcttgggaggcggtcgccgggaggcgcatccgcttcgtcgagctgcgcgtcggcgaggcctacgcggccttccgcgacctcgtcgcggagatcgggcccgacacgatcgtgcacttcgccgagcagcgctcggccccgttctcgatgcgctccgcccgcgagaagcgcctcaccgtcgagggcaacgtctgcgcgacccacgacgtggtctgcgcgctcgccgagacggggctcgacgcgcatctcgtccatctcggctcggtcggcgtctacggctacggctcgaccggatttccgcggccggagggttacctgaaggttgcggcccaggccccgggcggcaccgtcgagaaggagatcctgtacccggccgatccggagagcatctaccacctgaccaaggcgctcgatcagctcgtcctgcagtactacgccaagaacgatcgcctgcgcatcaccgacctgcaccagggtatcgtctggggtacgcagaccgaggagaccgcccgcgacgagcgcctgatcaaccgcttcgactacgatggcgattacggtacggtgatcaaccgcttcctcgtccaggcggcgctcggctacccgctcaccgtgcacggcagcgggcgccagacccgggccttcatccacatccgcgacacggtgcgctgcgtggcgctcgccatcggcgacccgccacggcgaggcgagcgcgtgcgcatcctcaaccaagtcaccgagacccaccgggtcatcgatctcgcccggatgatcgcgcggctcagcggcacgccgttccagcacgtcgccaacccgcgcctggagcccgaggagaacgagctcgacgtgagcaaccgcggcctgatcggcctcggcctcgtgccgacccatctggaggatgcgctgctcgccgagatctccgcgatcgccggccgatacgcccaccgctgcgatcgggcgacgatcccgagccgcacccgctggtgcgccgccccggagccgtcgccgatcgcgccgggcgcgggggcggctccgagccctggctccgcggcgcgaacctgcgccgagccggcgtccccttcgacggagtgcgctctagcgggcggagccgcgcccgctccgccgctcccccaggcggacgcggacgagctggaagccggcccgccacaggaagcctggtacgatccggagatagcggcgccagagccggcgcggctctga

SEQ ID NO: 9972 - DNA, 144 bp, Methylobacterium sp.
atgatcgcctcgctcccggacgcggaccttcgcgccggggatccggaaagcggccttgtcggagagccggcgatgggccgcacggggcgtgagatttccgtgtacctcgaaattctcctgccgagcccgtcggcgttgcgttag

SEQ ID NO: 9973 - DNA, 120 bp, Methylobacterium sp.
ttgctgcccggcttcctcgcggacgccgggctgagcggcctaagcaccgggctggccggcggggtgcacgccggccgcggtcgcgatgaggacggcctggggaagggtgtgggcgccgag

SEQ ID NO: 9974 - DNA, 180 bp, Methylobacterium sp.
atggccgagatccggatcgtcctgagccgcctcacgcccgccgaacgcgccgccttctggaatgccgtggacctcctctaccgcgtaccctctggatctccgatgagcatgaaggaagaccggtcgatccagtacggcgttgcgcagggtctcgaagccttgcttccgccggtccggtaa

SEQ ID NO: 9975 - DNA, 345 bp, Methylobacterium sp.
atgcactcgtcaccgtgctgcggccggtgcgggatcgtgtgccggtcggaccttcggctcgtctcggcgcgcagcttccgccgggacgatctggacgacaggcgggagatttcatcgatgctgtcggaaatagcgcgtgagatcctggcgtacttgcacggcacgcaccggctgcccggggcacgactgcgcatcacgacgctggacgaacggttcgggaccgaccctgcgattgcagcggcgatctccgaactcgcacgcaccggatatgttgcgacgccggacgctggcacgatcgaactgaccgcgcgaggatacggggcgtcgatgagcgaacagctctga

SEQ ID NO: 9976 - DNA, 300 bp, Methylobacterium sp.
atgccgatgaacatgtatgatggcgaggaaggacgtccactgcttgatctgatcatcgaaggcatggaggtcgtcgacagcgacggtacgcggatcggatccgtcgacaaagtcgagggcggccacttgaagatctgccgtgccgatcagaagccccgaaaccagccccagtacgtcaccccggactggatcgctgctgtcgatgatcgagtcaggctgaaccggacgtttgatgaagcgcggcgcttgtgggcgagcgaaccctacgcaaggcggcatcatctccaacgcgcgatctga

SEQ ID NO: 9977 - DNA, 123 bp, Methylobacterium sp.
atgcctcatgatcagacgcacgccaacgtcggcttgacgggcctgcgcttcgccccgacggtcgcgagcctgcgcgagaccgcggcagcgctgctgcgccaccgcatgagacccacgccgtaa

SEQ ID NO: 9978 - DNA, 90 bp, Methylobacterium sp.
gtggccgacccagaaggcaacacgatcgagttcgtcgagccggacaagggcatcttcgccgaaggcccgctcgaggcgcgggacgcgtag

SEQ ID NO: 9979 - DNA, 135 bp, Methylobacterium sp.
atgagcatcctgacccaagccgtcaccggtttcccggccgccgaggcccccgcccgcggctggttcgcgcgcatgatccagctctggctggagcaccacgcccgcgtcctcgagatgggcggcgagccgctctag

SEQ ID NO: 9980 - DNA, 198 bp, Methylobacterium sp.
atgacgagactccccgcgctcgcggccgccgccctcatcggcgtcggcgccctctcctccaccgcggccgaggcgcgcgggcgcggcggcgcgctcgccgccgggctgatcggcggcctcgccgccggcgcccttctcggcgcggccgcctccgcccatgccgagccggcctacgggtacggctacgccccgcccccg

SEQ ID NO: 9981 - DNA, 555 bp, Methylobacterium sp.
atggcgacgacgttcacggtcggcaacagcaacggcgcggtcttcgccgacgccggcacgacctccgccggtcaaacggacggaacgaacagcttgagcctcgccctcgcgcaagccaatgccaccggcgactcggtcatcatcaacctgacttcgaacatcacgctcaccggtccgctctcgccgatcttcaacgccaacgtcacgatcaacggcaacggcttctcgatcacctcgaccagccagcgcatcttcttcgtcggcaccagcgccgggttgggcggcggcggcctcggtgccgggggtgcgctcttcgtgaaccagaccggggatgtcgtcctcgacaggatcgacgtgacgaacaatcgcgcgaccggcggggccggcggtccgggtcccggtggcgggagcggcggcatcgcggagctgaccaagagcggcacgggcacgccgaccctcggggacatcgacaccaccgcgggccgggcaacgacctcgtctacggcaaccagggcgcggacgtgctctacggcggccagggcgacgacacgctga

SEQ ID NO: 9982 - DNA, 738 bp, Methylobacterium sp.
atgcaggatcggccgcaaccccggacggtcggcaccgcggggtccgaaccggccgacgactcaccccacgccgcccgcctgcagcccagcgacggcaacccgcacggggtcaccggccccgtcctgttcgaggcctaccgcaccgcctcgctggcccgctcgagcgccgcgccccagatcctcacccgcacgccccggcacgtcgcgggcggcaccgacgagatcatgctctaccggcaggaggccggcacgctggagggcgaggcggacgggcggtccttccgcctggagcccggcgacctcgccctgttcgactacgcgcagcccctggtcagccggacgagcgccttcaccaacctcgtgctgacgacgtcccgcgccagcgtgcccgccgccctggtcgggccggacctgcacgggcacctcatcccgggcgggagcggcccgggccgcctgctcgccacggaggtctccgacccggtcgcgacgcgaccgggcgcggtatcagggccggccggtctgcttcaggcgcgtcatgaccgcctcgggcgaggcgtaggcctcctggcgggcggcgctccagtagcgcagggcgtcgagctggatcgcctcgccggtcaccgcgcagcgcacgaagctgccgggcttgaccacccgcatggtgccgtcgccgtactcgacgacggcctccccgctcgcaccccgctcgaagcgtcccagcatcgcagatgtccctga

SEQ ID NO: 9983 - DNA, 249 bp, Methylobacterium sp.
gtgcggcgcctggcccggctggatcccgaagttctgcagcgcttcatcgacgccctcgccgccggcgagatcgttcagccggtcggcgtccggaccggatctagcgttgtggtgatgacggggccgttcgcgagcattccggcggccgtagaggcaatcctgcccggcgatcggctgcgcgtggcggtcagcatcttcggccgtccgccgcacgcagtcctcaggatggcggatgtacaggcaatctaa

SEQ ID NO: 9984 - DNA, 213 bp, Methylobacterium sp.
atgacccaacccctccgcctcatccgcttggccgcggtcgaatcgatggtcggcctcaagcgggcctgtctctacgatcggatgagtcgtggcctcttccccaagcccgtccgactcggcgacgccagaaactcccctgttgcttggcccgagcatgaggtgcaggccttcatcgcgcagaagatcgcggcccgcgatcaggcggcggcgtag

SEQ ID NO: 9985 - DNA, 216 bp, Methylobacterium sp.
atggcaggatcggcggaagagcggctcgacgccctgaatagcgagatcgcagacctggaggaaaagcaggatgcttatgtctcggtcatcgcggctttgaccgatcaggggctggacactgccgcggccaaggccgcgctcaaaaggatcgaggatcagctcgtggcgcttcgggtccgcacggcaactttcgagggtgacgcgaggcacgtttga

SEQ ID NO: 9986 - DNA, 396 bp, Methylobacterium sp.
gtgccgaacgcgttcaacccgtcctttctgtcattcaacctgccgtccggaaacgtcagccagtccttcgcccccttcttcacccagcaggtcggcatgacctacgcgggcaaccgggagatcgaggagcgcgtcgtcgccgacgtcgcgagcttcggccggcagatcggccggctgctcgacggcgtcctcctgctcgcgcgggacagacccgagccggaattcgcgacgctgcggacgatggccgccgagatcaaacgcgtgaaggaggagacccggtcgagcgcgctgcgcgacgcgcgggcggcgctcgacgcgctcgcgcgggcggaccccaagggactcgcggtcctgctggagggctacgcgccgcccgtgccccggggcagcccgtga

SEQ ID NO: 9987 - DNA, 273 bp, Methylobacterium sp.
gtggagtgcgtcttcggcatcccgggcgaggaaagcctcgacatcgtcgagagcttgcgtacctcgaagatcgagctcgtcctgacccgccacgagcaggccgccgctttcatggccgccacctgcggccggctcaccggcaagcccggcgtatgcctggccaccctggggcccggcgcactcacatgccgtccgcgtgctcgcgcgagcatggctgcgtgttctctggcgcgcgtggttggacggaaggcccaacgatcctcagcgacatag

SEQ ID NO: 9988 - DNA, 1428 bp, Methylobacterium sp.
gtggaccgtgagaccgctatcgccagggctgtagaggcattgaggtcgggagccttccgcgaggacctggcacgtcgcgtcgctatacccacggagagtcagaaccccgcacgggcggccgagctcgaccgctacatcgagcaggagatgcggcctgccttcgagcggatgggcttctcctgccgcgtgctgcacgccccctccgcaccgacgcccttcctgtacgctgagcggatcgaggcgccgggcctgacgaccgtgctcggctacgggcacggcgacgtcattcacggcatggacgagggctggcgccaggggctctcgccttggaggctgctcgagcgggacggactctggtatgggcgcggcatcgccgacaacaaggcgcagcacagcatcaacatggcggctctgggcgcggtgctggagacccgcggccggcttggcttcaacgctaagtggctgatcgagatgggcgaggaggtgggatcgcctggactccacgccatctgcgccgtgcacaaggacctcctcgccgccgacctactgatcgcctccgacggcccgcggcttaaccgggatcgcccgaccgtgttcctcggctctcgcggcgagttcaacttcaacgtctggatcgacgcgcgcgcggacgaccaccactctgggaactggggcggcctgctctccaatcccgccatccagttgacccacgccttagcgacgctggtcagcccgaccgggcagatccgggtatcaggtctcgttcccgaggcgggcatcccggagaatgtccggtcggcgctgtccgactgcatccttgaggcggcgcccgatgccccgagcatcgaccccggctggggcgaacccggcctgaccggaccggagaaggtgttcggttggtgctcgttcgagatcctggcgttggaggtcggcaacccgcgggcgccggtcaacgctattccatcgcgggcatgggcccgctgccacgtccgccttgtggtgggcgtagactgcgacgccgtcctccccgcggtccggcggcatctcgaccggcatggcttccactacgtgcagatcgaggctgcggaggaggctcccccgttcccgccaactcgcctcgacccgaacaaccgatgggtgggctgggccctcgattccatcgcacgcagcacaggcaagaaacccgcattgctaccgaacttcggcggctcgattccgaatgccgccttctccgagatcctcgacctgccgacgctgtgggtgccgcactcgtatccgggatgttcccagcacgccccggacgagcatctgcccgtggcaattgtggaggagggattgaggctcatgacaggcctgtactgggaccttcacgcgaccgacggccacggctcggagggagcgacggctaggaatgggcaggacgcatag

SEQ ID NO: 9989 - DNA, 909 bp, Methylobacterium sp.
atgcgacttatcgtggccctgacctgtgcgaccctgctcacctcaacgacctgccccgttgaggccgaggaattgagcggcacgctcaagaagatcaaggagcggggtgcgatctcgctcggtttccgagactcctcggtgccattcagctacttggataaccagcagaagcccgtcggcatggccatggatttctgcctcgccattgcggatgccgtgagggagaagctcaacgacaagagcatcaagatcgacctgctcgccgtcgccccggcctcgcgcatcgccttgctgacgaacggcaccaccgatttggattgcggcgccaacacgaacaacccggagaggcagaaggtcctcgggttcacgaacacgattttcctaacagcgtcgaaatatgtttcgaagaaaaacaagaacctccacaccgttgaggacttgaggggccgcaccatcgtatccacctccgggtcctcgaacatgaggcagatcgtgcagttgaatgcgcagcgcaagctcggcctgacgatcctcactgcgaaggaccacgccgaaggtttcttgctggtcgaaaacggtcgggcggatgccttcgtgatggacgacattctgctcgcgagcttcattgccgcgtcgaaggacccgagtgcctacgaaatctcgtccgaggggatgtcaaaggccgagccctactcaatcatgctgcgcaaagacgatgccccgttcaaagcacttgccgacgaggccgtggcgtccattcttacgagtccgcgcatggccacgctctacgacaagtggtttacgaagccgatcccgccccacggcatcaacctaaattttccgatgagcgcgcagatgaagcaggccttcgcccacccgaccgatagtccggacccggacgcgtactga

SEQ ID NO: 9990 - DNA, 234 bp, Methylobacterium sp.
gcggcggcggtggaggagcagggcgcggcgacccaggagatcgtgcgcaacgtcgccgaagcctcgaccggcacgggcgcggtgacccggaacgtcgcgggcgtggcgcgggctgccgagaagaccggatcttccgccgcgcaggtgctggcctcggcctccgagctgtcgcgccagtccgagcacctctcgggggaggtcggccgcttcctcgcgagcgtccgcgccgcctga

SEQ ID NO: 9991 - DNA, 1104 bp, Methylobacterium sp.
ttgcgtatccgggctctcacgatgacgagtattctgaccaacgcacgggcgctcaccgcgctcaggactctcggagcggccggcgacggcctcgacaccgccaaccggcgcgtctccacgggcgcacggatcggcagcgccgccgacggggcggcctactggtcgatcgccacgaccctgaaggccgacaacgcctccctcgacgcgctgaaggacgccatcggcctcgacaagaccgccgtcgacgcggcggcgctcggcctgacccggacggtcgaccagctcaggatcatcagccaggccctggtctcggcccagggcgagcaggcggaccgggcgaagatccagctcgacatcggcaatgcccagcgcgtcatgcgcagcatcgcggagagcagcgcggtcggcgggtcgaactggctctcggtgcagtccgacgcacccggcaccttcgccacccggcacctcgtcatggcctattcgcgccgggacgggaccgcgcacctcacccgcagcgcgctcgacgcgtcgcagttcgtcctgttcgacgcgaaggcgcgcatcgacccgccggactgggccgaggtgagcgcggcgcccgcgctcgggacgctcgccgcgacgacggccgccatcgccgcgcgggcgaacccgacgatcgtcgggggctacacggtctcgaccttcgacgcgccgggccatacccacgtcaacgggctgctcgacacgggctacaggatcgacggcgtgcccgcgctcacgccggtgcagacctctttctcggtcgccacgatcgacgtctcgcagggccacgtgaatcgcgggatgatcgaggcctatgcccgggtggtcgacgccacgctgcagaaggtcatggacggcgccgccctgctcggatccacctcgaccctgctcacggcccagcgcgacttcgcccggcagatgacggcgatcaacgggaacgcgatcggcatcctcgtggacgccgacatcgaggtggaatcgacgcggctgagggcgctgcaggcccagcagatgctgggcctgcgcgccctctcgatcgccaacgcggcgcccgacacggtgctggccctcttcaactga

SEQ ID NO: 9992 - DNA, 234 bp, Methylobacterium sp.
atggccggcgagaagccgcacggcgacaagacccacgcccagcagcagcgcatcatcgagcacaaggacgggccgaacgtgcccgcgggcggcggcgcgaagatccgcaacagcccgccgcgggagccgcggagcgcctcgcagcaggagagccgcgaccaccacaagcacaacaatcccggccaggaggggcaccggccgcagaagcacggcccggccgaggagaagcactga

SEQ ID NO: 9993 - DNA, 354 bp, Methylobacterium sp.
gtgagcggccggcgcggcatcgccgcccttccgccggcgcgcgcctccggtgtaccctggtggccgatgaccctcggatggcccctcccgcgcctgctggcggcgatgatcctcgcgatcctcgccggcgcggccctggccgcgacgccgtcggcggcccacgctcacgagggccacggccgtcacgggccgcgcgccgccgcgcacgcgccggcggccgcccgcccggctgcgcccgtccgcctcaagaccgggcccgacatcccccggatcgccgtcctcaccgcggcagagcacgcgccggcggccggtcgaagcgacagcatggattttcctcacgttcggacatcggcc

SEQ ID NO: 9994 - DNA, 171 bp, Methylobacterium sp.
atgcgcgaccccaacagcctgttcaccacccaggccttccggatgcgcaaccgtgacctgatctacgtctccaacgccccctacaccgagctacagaaggtgctcggcgtcttctcaagcgtcacgggacccgtcgcatccgccgcggccgtctacgcctactcgaagtag

SEQ ID NO: 9995 - DNA, 231 bp, Methylobacterium sp.
gtgctgatccgcaataggacgaacctcgcaattattgcgtcgatctcgttcgacgcccccctccttccgcgcattgcggagggcgtcgcgctgctctcggcattgtggacgcgcggcctctcggcctacgtcgcttggcagagtctcacctcggcacggtcgatcgagcaacgtccgcgcatcgatacagctcgtgcggcgtcgttcgccggctccgtcgctgagttttga

SEQ ID NO: 9996 - DNA, 96 bp, Methylobacterium sp.
ccgagcagggagctcttcaagagcttcatcgatatctccaaaagcttcgagacccacaagacgccagatcgccagctcagcgcttggtcgttttga

SEQ ID NO: 9997 - DNA, 144 bp, Methylobacterium sp.
gtgcgcgggcgcgccaacggtgcgctgacaccggaactggcgctgaaggtcggtcaggcggcgggtctggtcttccagcggggcgagcaccgccaccgggtcgtcatcggcaaggacacgcggctctccggctacatgatcgag

SEQ ID NO: 9998 - DNA, 189 bp, Methylobacterium sp.
gtgagcgcgccgccggtcacgccggacgggcgctacatcgtggtgcgcgggcggctgtggcggcgcgccgatccgggcctcgacgaggccgcgcgggcgcgggcggtgtcggcgctgatggaggcgcggcgggccgtgcgggccgccaaggcggcggagcgggcgggcgatccgggggcgggcgaggcc

SEQ ID NO: 9999 - DNA, 336 bp, Methylobacterium sp.
atgatctctgagccatccagccgagtgctcggggcacagagcatcaagcggaacgctgccgctcacctccggttggtcctccatcgatccgaggaggcgatcatgaaggccctactagcatcctcgctgctcacagttggtctgctcgccactgacccagcgtccggccagcgtcttgagatcggccccgatggcccctcggtcgacatgcgctcacgcggtcagcgggagcgggacatcgaacggcgggagatgcgccgtgacatgcgacgggacgaggtgccgcgcgatcggcgggacagatctgtcgatcccgacgacgatgatgaggactag

SEQ ID NO: 10000 - DNA, 249 bp, Methylobacterium sp.
cgccccgccggcaccgccctgccccgctcggtcgagcagatgaccgagctcgtcggccgcgtctcgatgaagaccctggtgcgcgagaccaccgacctgatcgagaagctctgcatcgaggccgctctgcgcatcacccgcgacaaccgcgcctcggccgccgagatgctcggcctcagccgccagggcctctacgccaagatgcgccgctacggcatcggcgacctcgacgggccggacgaggcctga

SEQ ID NO: 10001 - DNA, 795 bp, Methylobacterium sp.
atgtttgctgacgcgatccgccgacaggcggaggacgcgccgcgcgccgcgctgccggccgtggccgctgcgctatggcgtgcgctcgccaacgggcaggtgagcgaggccgaggccgagacgctgtccgcgctgatcgacgcgaggcgggaggccagcggcccacaacgccacccgaccagcccgaccagttcgagcgacggggccgcggacgtacgaggtgataccctctcaggttctacaggatgcgccaggacgggcgttggcagtcggccgcgcaccgatgccagtctggagcgccgccgccgctgggcggcctccggtaggcttcccccggccattgctgcgcggtttacggctggggagcaggcggtgctcgctctggtggcagccgagactgcccgccggaaggactgccgccttgcgatcgagcacatggcggcgattgccggcgtcggccgatcgaccgtgaagaacgccctgcgggaggcccggcggctcggcctcatcaccgtggaggaacggaaggtcacgggctggcgcaacgacacgaacatcgtccgcatcgtctcggccgagtggacggcttggctgcggctgacgcggcgctcgcccaccccggggagcgagacaccctcctctgcggaggggggaggggtcaaaaccgcgaccggcacgcctactcaggttcaaatccggggaaaaccgaggccagcggaaccgtccaagatgctgccggcaggcagcgggcgacctctgccgatgcggcctcgtgagaattctcgcgggcggtaa

SEQ ID NO: 10002 - DNA, 1659 bp, Methylobacterium sp.
atgtctctggcggcctcgccgatctcctccgcgccgtcgatggaagaacccgaggcattccatcgcggggttgagctgttcggcgactggcgctggcggctcaacaacctgtactggatcaccaacaaggaagggcggcgcgtccagtttcagatgaactgggcgcaggaagcgctcttccgggagatgcactacctcaacgtgatcctaaaggctcggcagctcgggttcacgacgttcattgccctgttcgggctcgaccagtgcctcttcaatgcggactttcgggccggcttcatcgccgacacgttggagaacgcgaaggccctgttcgcggacaagatccggttcccctacgagaacctgccggacgggctgcgggccgcgcggccagtgcggaaggcctccgagacgcaggtcctcttcgacaacaacagcggcgtgcgcgtgggcgtgtcgctgcgcggcggcacgatgaacctgctccacgtgtcggagtacgggaagatctgcgcgaagtcggcgcccaaggcccgagagatccggaccggcgcgctgaacacgctgcaggccggtcaggtcgccttcatcgaatccacggccgagggtcaggaagggcacttcttcgacctgaccgaggccgcgcaggcgaccgcgcgcgccgggcggcccctctcgctcctcgactggaagttccacttcgcgccctggtggaaggagccggcctacgtcctcgacccgaccggcgtgccgatcgcggacgggtaccggcgctacttcgccaagctggaggccgagcagggaatcgtcctctcgcccgctcagcaggcttggtacgcgaagaaggccgaggtccagctcggcgacatgaagcgggagtacccgtcgaccccggcggaggcgttcgaggccgcggtcgaaggcgcctactacggcgagtggatggccaaggccgagctggacggtcggatcgggacgttcccggccgagcccggcttcctcgtgcacacggcctgggacatcgggcgctcggattacaccgcgatctggttctttcagatcatcggtggtcgcctccgcatcgtcgggtactaccagaacacgggcgagggcctgcccttctacgcggcgaagctcgaggagatggccgccgagcggggttggacctacggcgaccacttctggccgcacgatggtcgggtcacggaatggggctcggggcgctcgcggatcgagcaggccctgacagaccacaagctcaagatccggatcgcgacggcgctcagcctgcacgacggcatcaacgccgtgcggaccacgctgccgctgtgcaccttcgacgctggaccgaccgccgagggcgcgaaggtcttgaaatcctaccgcaaggagtgggacgacgagcacggcatctggaaggaccggccctgccacgactgggccagccacggtgccgacgccttccgctacctcgccgggtcctggcgcgcggtcaccgagaccgtcgcacccgagacccgcaccatccacacaccccgcggcgcgatcgtgcgcccggcccttgagcccgtgaagagcctgaccggcgcgacgcccggcaacggctattcgatgaacgagctctgggagatggaccagcccgccgacacgagggtctga

SEQ ID NO: 10003 - DNA, 297 bp, Methylobacterium sp.
atgaagggacgggcccgcctcgcgtggaatgttcggcagatccgcgccgcgcgcggcctgtcgcaggagacgctcgccgtcgatgccggcgtcgccgcgccctacctgagcggcatcgagcgcggcactgtgaaccccacggtcgacgtgctggaccgtctggccacggcgcttggcgtggagatcgacaccctgctgcgcgcctatgacaccgccagcacccccccccagcccttgcgggccggccgcaagccgcgacagggccgtgaggggcccgcgaccaaggcaggcgcctga

SEQ ID NO: 10004 - DNA, 195 bp, Methylobacterium sp.
atggaagcgcgatcagtgcagctgatcgcgctccagacctgggccaaaggcatgtcgccgaacaaggccgcccggcagctcggcacaaccacggcgcgtgtgcaggaactacggggcgggcggttcaacaggttcacccttggcgagctgcaggacctgaccagccgtgcaggcttggcctatcaggcgccctga

SEQ ID NO: 10005 - DNA, 1152 bp, Methylobacterium sp.
atgattgaggcattgggttcgaacgctttgacttggccgtccgtcaggccgaccgaagtcagtgtctggcacgggcacgtcgcgttcgcgcactggctcgtcgaggcgctcaggccgaggctcgtcgtggagctcgggacccataacggggtgtcctatttcgcgttctgcaacgcgatcaagaggctcggccttgatgcgcgcgccgtcgcggtcgatacctgggagggcgaccatcaggccggtctgtacgacgagtcggtttacgagcgggtccgccggttcaacggccagttctcggatttctcgacgctgaagcggaactacttcgatgacgtcgtcgaaagcttcgaggatggttcaatcgatctcctgcatatagacgggctgcacacctacgaggccgtcaggcacgattacgagacctggagggccaaactcagcccacgcgccgtcgtgctgttccacgacacgcgggccttcatcgaggggtacggcgtccacaccttctgggacgagctgatgcgcgaggggaagggcttcaacttccaccattcggcgggcttgggcgttctagtccacgggacggacgtaccggaggccgtcgaggcgctgtgctccgtccccgatcagtccgccgaggcgacgcggatacggcagtccttcgaagtgttctcccggatcgctcagacgctcggccaggaggcggtcgtgcacgcgctcgcgcaccagggcgagaacatcgctctgcactgtcgcgccagccagagcagctactactcgacgaacgcggagacgccgcagggcgccgtaaacgggatcaggaccgggcatttcgggtttcataccgacaacgaggatcggccctggtggcgcctggacctgggtgggcggcggaccttcgacgagatccgcatcttcaatcgtctcgacccggactgcgcggtccggagccggaccatcgagatctcgatctccgacgacggcctgatctgggacacggtgtattcccatgacggatcggtcttcggcgggatcgacggtcaccctctatcgttcgtgcgcgggggcatggaggcgcgctacatcctgctgcgcttgcgcgaaacgaacttcttccatctcgacgaggtcgaggtttacaggcactga

SEQ ID NO: 10006 - DNA, 3804 bp, Methylobacterium sp.
atgttcgagatcaccggcgctgatatcggtgcgctgagcgacggggacctccgcacgctgattattctgctctgcgaggcggacctacgacgccgaggcctgtcgactgcggcggttaccgcgggcgggaatcaagatgcggcggatggcggtgtcgatgtccgcgttgcgcttccgccaggaacgtcgaccgagaccttagactacgttcctcggcctgccaccgtcttccagtccaaggcgtcggacatgccgcggaaggcgatccttaaggagatgcggcccggcgacacgctgcgcccggccatcgttgcgctggccgaggaaggcggcgcctacatcatggtaagcccaggcgccgacctgacggacacgatgctcacgagccgcaagtcagcgatgaaggaggcgctacgcggcctccccaccgccgctgcccttactctcgacttctacgaccggacgcgcatcgcaacttgggtccgagatcacccgggccttattccctgggttcgtgagcggatcggtagggcgctgcggggctggcggtcgttcgggcgatggtcgtcacgccccgcggacgctgacgctggttaccttatcgacgacgcggtccgcatcaggatgcccggcgaggacgagggcgatggcctcggcgcagctgacggcattgaccggatccgcgccgagctacgtgagcccggcaaggctgtgcgcctcgtcggtctatcgggcgttggtaagacgcggcttgcggaggccctgtttgaccctgctgtgggccacaatagcctggatccatcgctggcgatttacgccgacaccgccgacgagccggctccttcaccgggcggtctcgcgagcgatctaatcgcggggcggacccgcgctatcctggtggtcgacaactgcccgccggagacgcaccgacggcttaccgagatcgtcaccgcgcctggcggcacggtcagcctgctcacgatcgagtacgacattcaggacggcgagcccgaagagacggcggtgttcgaactcaccacgtcctcgctagcggtgatcgaacagttggtcgctcggcgctatccgaccctatccgaggtcgacacccgcaacatcgcagagttttccggtggcaacgcgcgcatcgcgctagctttggcaagccgcgacccccggcgcggctcattcgctggtctcgacgacaaactgctgttcgagcggctgttctggcagcgcaacgacccagatacttccctactgacaatcgcccaggtctgcgcgctgctctactcgttcgatggcgagacactggagggcgacgccgctgaactgccgatcctaagcggcctgagcggtcgaacggtcgatgcggtgtatgctgccgcagctgaacttaagcggcggcaactcctgcaagcgcgcacgcgttggcgcgcggtgctgccgcacgccgttgccaatcgcctcgcggcaatcgcgctccaggacatcccccgccaacggctcgcggcagcgctggtagagggcgcccctgaccgtgtcctacgctccttctcccgacgtctcagctacctcgacgccagcccagaagctcgggagatcgttcaagcttggctcgtgccgggcggcctccttgccgacatccggcatctgaatgaccttgggatcacggtgctgacgaatgttgccccagttgcgccgaaggcggtgctgtctgccctggaggtcgcgatgcacggggcggacgatcttgcgctccgcgactttacccctctcgctcggctaatgcgcgcgctggcctacgagccagcgcagttcgagcgtgccgttgcgctcctcgtcaggctggctcggttgccaaaggaaaaccgtttgcacggcgacgccgctgaaatcttggagtcactcttcccgatccggctgtcgggcacgcttgcccctattgacctgcggctggctgtcgtcagtcagctactgcgctccgcggacggggccgagcagcgcgttggcgtccagctactgggggccgtcttgcgaacggacgggttctcgtcgtggcacggttttgagttcggggcgcgctcccgcggctacggtctctacccgcgcaacggtcaggaggtgcgggattggtacgccgccgtgctcgaatgcgccgaaccatttctgacggcggaaggcgcagtggctgatggcgtacgaagcgcggttgcgcaggcgttccgcggcctatggctacgggggggccaggctgccgcgctgacgcggcttgctcacgctgtgatcggcgcacgcgggctatggcgcgatggttggggagcggtgcgtcagacgcgcatctatggcggtgagcagcttactccagacggtctggcggaactcggtgccctcgaggatgtgctccgcccacagacggttgccgacaaggtccgcagcgttgtcttgcaagggggccgaagcctcgatctcgacgacgttgacgaccccaaggaagacttcgctctcgcgatggatcgccaagcagccaccatcgcacgcctcgcgcgagaagtgattgccgacgaggctatttggcgagcgctgctccccgatgtggcggcaggcgatggctacaaggtcgtactcttcggcgatggcttggcgacggcagccgaggcaccgcgtgccgtatgggctgccctggtcgagcaaacggccgctctaccagtgcccgggatctccgttctatgcgggttcctgcagggcatcgagcgccgagaccgcgcgctcgcctgcgcgcttctcgatgaggtgctcgaagatccgatccttgccccatggctgccggtccttcaggcgggcaccacgcccgatgaagcggcactggcccggctgcaccgcgtactggcaagcggcgtggcgccaatcggacggttctcgcgcctcgcgcatggcgatgcttcgagcgccataccaggcgctgaactggcgcgcctcctacttcgaattgccgaatcccagggaggtggcacggtcgcacgggacattctccacatgcgcatctacgcagaccgaggcgcggggcgggcaattgacccggacctcgtcgaggctggccgcacactcctcttgggcttccggttcgcgaaaggacccggctcgcgagaagattacgaattggcctcgatagcccgcgtgtcgctagcaggagaaggggggcggccggctatccaggagctaggccgagcactcgcgctcgcgatgagccgatacgaggttggcctctacgattacaaccatctcatccacgcactctttgaggctcacccgaccgagatgctcgacgcgctcttcgcgggagatggttcatcgccccggcggatcgtcaacctactgactgagctcccccactcgggtaagcccccgatgggcgcggtgtcggacgacctcttgctcgcatggtgcgagtgcgcgcccgcggaacggtacccccttgccgcaagcttcgcgatgctatttgcgcaatccgacgaagggacatcaccgcaatggaccagcttagcggggtgcctgctggcacaagcccccgaccccgtgtcggtcttcgaggccatcatcggccgactccacccaatgagttggagcgggtcattggcggaagtgctctcgtcccgccaagatcttctcgaccggctcgacatcgctggcctgccaacgttggcagagccaatgggccgggcacgggaggcgctgagggtcatggtggaccgcgagcgccagcgtgagcgggatgaagatcgggagcgcgatggccggttcgagtga

SEQ ID NO: 10007 - DNA, 597 bp, Methylobacterium sp.
gtgctgatgaagctggtgagcgagcagtccgacgccgacatcgccaagcgtcgggccttggagcagctcgcccagcacctacgggccctggccgccaacctgatgcggacctcgcgcggtgccggcgcgccctaccacctcgaagagcagatggtcggctgcctcgaggcgctggcggctcaccgcgcggcggttgggcacggtgtgtccacctatgagtaccaagccatgctggatccccacgaggcgcaggccgaggctaggccgtgggctggcggcacggaggaggatcaggcgcgctgggaggcggacggaacggtggcctgcgctgacgccatcgacgacatccgccgtgccagcctgcagatgacggcgtccatgctcgtcgaccagctgacgcagatgcgccgcggcgagagcgacatctacgaaggtgtcagacgcctggaggcggctcgggagaagcggcgggcctatcatcagccaaggctcagccagctcgcaagccgcgggtgcggccaaacggtcgctgaagtggttgcttggcgacgtcctcgcagatgtcggctgactatctttgtgcccaccgaggtatga

SEQ ID NO: 10008 - DNA, 453 bp, Methylobacterium sp.
atggcgacggcgctcaacgacatacttttgggcgtcatagcgacgatccgtcggcggaccctcgcggccttcgggggcctgcccaacggatggtggcgggcacatcagcggcccgccacctcgggatctctatcgtcagaggtaggtgtcgagggtgtcctccacatcgacggtgaggacgcccaagcccagcgcatgggccacttcgcgaaacagcttcatcggtctacctggatcgggttgtcggggatcgagcgctgggcgctccttctgaccgattacggtccgcagcccggtctgttccttcgccccttcatcacactccatggccttggcacatggaacacgttcatgggcggctcttggctgcgcctcatgatgacggccagggcggaccgctcccgcgacactgccagcgcctcctggcaccgtcgtgtccagaggtgggcatga

SEQ ID NO: 10009 - DNA, 129 bp, Methylobacterium sp.
atgaagacctgcgcgattccctgctctgccggctacctctggatggcggggctggccagcttcatcctggcggtggccgtcatcgcggtgctgcgggagatcgagcaccgccgcgggccaccgggatga

SEQ ID NO: 10010 - DNA, 390 bp, Methylobacterium sp.
atgaagccgatgccttggaagaatgggggcaagaccctcacgctcgacgctgacccgtcgtccgaggaggagatgcagatcttcacctcaccggaggagcgcatgcagcaacgcgccctcaaccacgatcgggctctccgcgcttcagaactaggctggctcggcaagctcatcggcagtgagactaattcggcgcggaacctcgcggccttctttctcacgttttcgctgctgatcggcgtaggctgcctgatcgccgcatggtggcagaaagagcagggcgagttctggagccggagcgcggagcgatcattcagcgcagcagcggcggccctggcctacgtctttggacagggctccaagggatcgtctagccaagggccgccttga

SEQ ID NO: 10011 - DNA, 507 bp, Methylobacterium sp.
atgcagttccacagcacactctccctgcccgcgatccgcgcggcgcaactccgccacgtagcgaacgaaaagaacgccacgtccgcagatatcattgacagcttcatccgcgccgcctggacggatgttggcggcggtgtagtgttgccgggcttcgacttcgtcgcgtgcctcgatgacgacagcggcgaaccagtcgtgaccttcgtctgtacgggctctctgccggttctcctcaagcccgagcaggcacatggagtcgccaacgggatccgggacttgctggccgctgttgcggctcggttcgaggtcgatgcgatctgcgaagggtcccgggcgcgcttcatcggcactaggaaggggcggggcttcacaatccagcttctcgacgatctggacgatccgggtcggaagcccgtgacgctgctcggcctcaccgccagcatcgcggccgacctcgccgacacattcgagaccttcgccaagcgcgcggaggcgctccggtga

SEQ ID NO: 10012 - DNA, 945 bp, Methylobacterium sp.
atgatcacgcccacgaccttggccctggcggccctcatgcgcttgcggggagtgggccggaagcaggcccttcgcatggtcccgggggagttccccgcaggcgtggacgtcgaagccaaggtccacgacctggtcgccggagcgggtcgtgcaggcgacgtcggggagattgtctcgtcggcccggacgatgctcgccgacagcgtggatgcgggcatcaatgtcctcgggttccacgatggggaatatccggtccggctgagggacacccccgatccgccggccatcctgtacgtgaagggcaacgtctcgcccttgcacgcccctcgtgcggtcgcggtcgtcgggacgcgtgaacccaccgagtacggtggcaaggtcgcaaggaagctcgccctgagggtcgctgaggccggctacgtcgtcgtcagcggcttggcccatggatgcgacaccctcggccatgagggatgcctcgatgccggcggggtcgggatagcggtcatggcccatgggctcgacaaggtctatccggccgccaaccgcggcttggcgcagcgccttgtcgagaacggtggctgcctggtgtccgagtacccgctgggtgtcacgccgatgcgcaacgcgttcgcggagcgcgaccgcatccagagcggcctgagcgacgcggtgcttgtcatcgagaccgacgtgaagggcggcacgatgcacacggtgcggttcgcccgcgagcagcaccgacccctcgcatgcatcgaccacccgcagaagtggctggaagaggacaagacgagggggaaccagaagatgatcaaggacgggtgggcgacggccatcccgcacggggaggcgctcctggcgttcctcgcgggtgtcccgcatggggcgggccgccccggagacgtggcgtcgtcgccggaccgtcagcatgtgctggggttctga

SEQ ID NO: 10013 - DNA, 519 bp, Methylobacterium sp.
atggtgatcttcgacttcgaccagacgctggtcgacacgagccctgtcgagaacctgcgggctaaccgggactggcgtggcgtgatgagccgggcgtcgagccttcaggtgtacgatggcatgacgtctctgcttcgcgacctgcgcgcggccggagagaccgtcgccatcgtcaccaagagcccggacatggtggccaaggccttcatccgggagcatgcctggcccatcgacatcgtcgtcggcttccatcaggtgaagcgtcgcaagcccgatcccgaagggctcctgctcgccgtgaggcaggctggcgcatccgcagccgatagttgccatgtcggtgacagaccggaggatacggaggcagcccatgccgccgggatgccggccatcggcgcggcctgggggctagacgatgcggcggcgctccgtgcgtccggccccgaccatctcttcgagaccgtcgcggacctccggacgttccttttccgccggcgtcgacaggacacggcgcgatag

SEQ ID NO: 10014 - DNA, 1476 bp, Methylobacterium sp.
atgctggcttgggtcagggaggttgtgatcagcggcgcgaccgattaccggcgctatcaggccgacgcgatgaagacccggtacgccttgcgcttcaccggcctttcggtccgtcgatccaagggcggcctggtcctgctcaatgcggctaggcacagccgtcttgcggatgccccggcacgtctgcgcgacgagatgggcgagttgcttcggttcaagaccgcgacgttggccgagcgcgggctgaagcgcagcgggacctggaacgcggagaccgctgcacagaaggtcgagcacttcgctctgatgttcggcgccctcgccgccgatccggacggcgaggtcgagggcttcggcacggaccccggcgccctgacgctggcgctgctagccatccctgccgtgtgggactggtacctgtcctggcgggagcgccgacgcggcttcttcaccaagtgggaggccaacatgctgagcatcgcgctctcgttggtccgggccgagacgggctggctgcgccagacgccgggcatcgccgggcatctcatccccattccagggctggtatcgacggcggacgtggctgcggcccgggcggactgggacgcaacctgcgaggcgatgtaccggcacggtcgtgcccgcatccgggagatcgagcgtgtcgcccgcgtgcaccgcgaccccttcgagccgatcctggccatccttgaggccgacagtccggtcggcgagtaccggaagatcaccgacgagatccttcggctcatgccgaacgagaacctctatcctcgggccgcagccgaggccattcgggggttcctgatgctgcgcttcggcctccatctcgggctgcggcagcggaacctgcgagagctcctcctctgcccgcgcggccggatgcccaccccggagcgaaggcttgaggagctgcggcgcggcgagatccgctgggccccgcgcgaaggcggctgggaggtgctgatcccgtccgtggcgttcaagaacgccaactcgtccttcttcggccgaaagccgttccgcctcgtcctgcccgacctgggcggtctctatgagaagatcgaagcgtgggtcgggcgccaccgcgccgtgctccttggaccggcgcaggatcccgacaccttcttcgtcaagacggtgaagcgcaccagcgccagcgccgcatacgaccagaacactttctacgaggcctggcgcctgaccatccagcgctacggcatccgcaacccgtacaccggccgaggcgccatagaggggctgctgccgcacggcccgcacaacatccgcgacgtgctcgcgacccacatcctgaaacggaccggctcctacgagcaggcgagctacgccatccaagatacgcccgagatggtgatgcagcactacgggcgcttccttccgcaggacaaggctgccatcgcggcgcggatcctgaaccaggtctgggaggcggcgtaa

SEQ ID NO: 10015 - DNA, 504 bp, Methylobacterium sp.
atgcccgaagacgcaccctcgcggttgccggccgagacgcccccgggcggcgcccgcctctacgcctggatattcctggccttttccgtcgtcggcctcctgacgggaggcctcgaaaggctcgcgctcctgcccgacgccgccgcgaaggcttgccgcgcgttctacctgtgcggaccccgcccgctgaacacgctcccgccgttcgaggtggtccacggctccgggtccacatgggaacaggtcgagaaggacgatgtcccgccggtacagaggcgacttgaggccgagaatcccgatttcaacatcgtctggcatcgcggcgaggagaccggcggctgcagcggggcattcaacaccacttgccgataccactaccatggccggtggggggcggtaccgaagtgggagacagcatcgaagctgccgtggatcgtcctgggctgcgtgttcctcgtttccctcgccgtcattcttcgtcgccgcggcacgcgcaccgcatga

SEQ ID NO: 10016 - DNA, 912 bp, Methylobacterium sp.
atgctcgaacggtttcagggggaacggggccggaagcatctcgtgggggagatggagcgacaaaggcttgtcactgggacgcctggcctcgctgaggctttagtggacgttggggaactcgcacgcgtcgcgcccgggacctcgatcatcgagcagggaggtaccgacaacgacctattcttcatcgtggtcggggacttcgaggtcgtggtgaacgatcaccgcgtcaacatgcgcggcccgggcgaccaagtcggcgagatggccgctgtggccccgtcgcaggcccgagcggcgactgtgacggcgacgacggaggccatcgtcctgaaggtggacgaggccggcttctcctccgtcgccgaccggtaccccgaggtctggcgacgcatggcgcaggagctggcgcgacgcctcgaacaacggaacgcgctgatccgacctgccaacgagaagccgcgcgtcttcctgttctcgtcctcggaagcccttccggtggcgcgggctatcgaaaatgcgctcgcggacgacccgttcctgaccgtcgtatgggcgaacggcgtgttcaaggtgacgaactacacgcttgagacgttggaagaggagttgatgcaatccgatttcgcggtggcggtggcccaccccgacgacaagaccgaggtcagggacgaggagtggccgacgccacgggacaacgtcgtgttcgagctgggcttcttcatggggagcctgggacgtcagcgtgccgtcctgatggagccgaagggggcgaagctgaagctgccgagtgacttggcgggcattacgacgatcaagtacaacttccagccgggtgccgatgtcggggccatgatggggccggcctgcaataagttgcgcgcccacatcctgcgcctcgggcgaaacgtctga

SEQ ID NO: 10017 - DNA, 408 bp, Methylobacterium sp.
atgggcggcctagacgtgtatctcgacgtcatcgacgtccagttggctaagagcggccccgatttagccgattatatccggatgcgcctcgacgaatgctcgcagttgctcgcggtgctcagccctatcacccgggcgtcttggtgggtgccatgggaaatcggggttgccacagagaaggaacgcttcctggcctcattcgtgtcggacggcgcgaccgtaccggaatttctccaaaaatggccctacctacagagcatgtccgacctagataagtatattgcagagtctaagagcgcgcagcttctcgtcgaaaactaccggagacaggggtatggaagcacagcgcagtcgcgcggttttaggtctttccataactcgctaaaatcgtcgcttggccagcgataa

SEQ ID NO: 10018 - DNA, 465 bp, Methylobacterium sp.
atgtccatgcctgcccaattcatctcggcgctcgaagctgacagggagccgaacgcgagaacggccgcaaccctacgcaagatcctcgcgtccaatggcgtcgagggcgcgctgatgctcgacgaccgggcaggcacgcccgttcgcttgcccctgacggcctcagcggtcgaggccgtcgtggcggtcttgctgcgcctaggagcgaacgcggatgtcgtcgtcgcgcaacgggaacgtgaggtttccccggaggaagcatctcgtctgctcggagtctccagaccgttggtctaccatcgcatggacaccggccgactacgtttcaggcaggtcggctcgcatcggcgcatcgccatggacgatgtcctggcgctgaaggcggaggaagatgagctccgggaggcggccagggccttcggcgaggatacggacgagcaggagatgattctccgtggtccttaa

SEQ ID NO: 10019 - DNA, 630 bp, Methylobacterium sp.
gtggtccttaaggttttgttggacgccaatgtcctgctgcctcaacagcagcgcaacatcatcctacagatcgcactgaaacaccgcatcgagctccattggaccaagcttatcgtggaggagtggctccgcaacgttgagcccgccgtgcgcggtaattgtgagcggcggaccttgccgctcatggccaagtatttcccgcgagcggaactaccggccatgcccgcgacaccctatggatcgaccgatgccaaggaccggcacgttgcggcggcggccgtccacgtcgcgccttcggtcctcgtgacctggaatatcagggatttcgaccgcagtgctctcgcggggcacggcgtcacgcttcagaccccggaccaactcatttccaacctgtacgaccagtttcccgacctcacgtacgaagcggcgctcgaagctaaggcgaacttgtcgagatcagcgccatcttgggacgatttcatcgccttgctcgcgggcaatggcctgacaaccttcgttcagcgcatcgatgagcatcacaagcgcctctcgtacgagtgcgaggacgaagaacgctcggaggaagaagaggaccggacggactacacgggctccagcggccccccttga

SEQ ID NO: 10020 - DNA, 615 bp, Methylobacterium sp.
gtgaagtaccagccgcccggcaccgacatcctgctcaccgcggcggccttcgacatcaagcgcctgaacggcctcacgcccgacccggtcaacggctcgcgcttctccgtgcagaccggcgaggtcagcgcccagggcctggagttcgaggcgcgggccaacgtcaccgagaacctgaccctcgtcggcggcgtctcgctgatcgatgccgtcaataccgggaccgggaccacgcccaacgagacgacgggccggaccgtgccgctcgccggcctccgcccggtccaggtgcccgacacctcggtctcgctgttcgcgaactaccgcttcctcggcgggccgctcgccggcctcgggatcggcggcggcgtgcgctatctcggcgcctcgcagggcgacgcggccaacagcttccaggtgccggccaacaccgtgatcgacgcgctcgcgtcttacgatttcggctatctcgacgcctcgctgaagggcatgcagcttcagatcaacgcccagaacatcctcgacgagaagtacgtgcagagctgcatctaccaggcgtggtgcttctacggcgcgccccgcacggtcttcgccaccctgcgctaccgctggtaa

SEQ ID NO: 10021 - DNA, 195 bp, Methylobacterium sp.
atggcggataccggcgagacccgcgcggagcggttgaaatcagcgctgcgcgacaacctgcggcgtcggaaggcgcaggagcgcggcaaggagcaggggcggaagccgggcgaggccgatccgccgacccaggatgattcgccgggcgccgatgcgtccgggaccggtcccgattccgacaaaactggactatag

SEQ ID NO: 10022 - DNA, 384 bp, Methylobacterium sp.
gtggagacggatcaggcggccggcgaggccggagggcgggcgcccttgcggacgcccctggaccggggggcggtcggagccctcccgtcgcttccgcaggcggaactccacccaggtcgagaagtcggccagctcccggccgtcggcgtcctcgatgacctcaagcaccaccgcggcctcgtcccgggcgatgccgagccagtggccgatcagggcgcgggccgagcgatgcgaccggcccgtattggcgacgatcagctcgacgccacgggtcagcagctcgtggcggaaggcccgggcctgctcgcccgccccgccggcctgcccggcatcgccggccgacccgtcagggttggaaccggggtctggggaggggttaagggg

SEQ ID NO: 10023 - DNA, 720 bp, Methylobacterium sp.
gtgtccctgaccgacaagcagcgccgcttcgtcgacgaatacctcgtcgacctgaacgccacgcaggccgccatccgggccggctacagcgaggacacggcgcggcagatcggctcggagaacctgtcgaaacctgacatcgcggacgcgatcgccgaggccatggccgagcgctcgaagcgggtccagatcaccgccgacgaggtcctgcgcgagttggtcgaggtcgcgctgggcgacgtgaacgagctggtcgagcaccgcgtcgggtgctgccggttctgctggggcgagggcttccggtaccagcgcacgcgccaggagctgatccgcgccgaggccacgcacgccaaggacaacgagaaggccgttcgcgagggtcgcgagaccacgctattcgatgtcgagggcggtgacggattccatgccgcgcgcgagccgaacccggactgccctgagtgcttcggcgagggccgcggccgtgcccttttcaaggacaccggccgggccagcccgcgcgcgcggcggctctacagcggcgtgaagctgaccaaggacggcatggagatgaagctgcggtcgcaggacaaggcgatcgagctcatcggccggcacctgggcatgtggaaggacaaggtcgagcacgatgtctctggcggcctcgccgatctcctccgcgccgtcgatggaagaacccgaggcattccatcgcggggttga

SEQ ID NO: 10024 - DNA, 2307 bp, Methylobacterium sp.
atgagcgacacccaaggcctggacggcgagcgcgacgaggccccgcagagcgggcccgacgaggtcgtgcggttctggctcgaccagatcgagcgctacgagaaggcgttcggcgactggaccatccgcgtcgagaagatctggaagatctacaccgaggcgcgccgagcggagggcagctcgcgctcgcggaagctctccctgctctggtcgaacgtctcgacgctgcagcccgcggtctacgcgcgcctgcccgcgccggccgtgtcgcgccgcttcaaggattcggacccggtggcgcgcgtcgcctccgagctgatggagcgggcgctgatctacaccttcgaggacagcgacctcgacagcaccctcgccctggtgcgcgacgacttcctgctcggctcccgcggcacggtgtgggtgcgctacgaggccgacttcgagccgatcctggacgagatgggccagcccgtgatgcaggatgcagcggagggcgaggagcctcagccggccgagcgcatcgccgacgagcgcgtgccgatcgactacgtacactggaaggacttcggccacactccgggccggtactggcaggaggtcacggctgtctggcgcaagacatacctgacccgcacgcaacttgtgcgtcggttcggcgaggagaaggcccggaaggtcggcctcgaccagtgccgcaacacctcgggccagtacctcgacatgggcgcccgcaaggccacggtctatgagatctgggaccgcgacacgggcaaggtctacttcatcgcgaaggcctgcccggagccgctggaggtgaccgagccgttcctgaagctgaagggcttctggccctgcccgaagccggtctacggcacgctgcacgacgagagcttggtgccggcgccggactacgtgttctgccaggacatcgtcgaggaaattgaccagctcaccggccgtatcgggaagctgaccgacgccctgaagctcgtcggcttctacccgaagggcgatgacagctcgggcgcgctccagatcgagaaggcgctgcaggccggcgtcgagaacaagatgatcgcgattcccggctgggctgcgttcaccgagaagggtggctcgaaccaaatccagtacctgcccgtcgagcaggtgctgaaggtgctccaggggtgcatccagcttcggaaggagctgaagtccgacctctacgagatcaccggcatctcggacatcgtgcggggcgagagcgacccgaacgagacggccaaggcgcagcagatcaagacgcagtggggttcgatccggatccgcgagcgccagaagctcctcgccaagttcatccgggacgtggcccgcatcgcggctgagatcatcgctgaccgcttccagcccgagaccttgatggcgatggcgaacctgccgctgccgagcgatgccgaggtccaagcccacatgcaggctcaggccgaggcggccgccatgcagcagcagatcgcggccgcgcgcccgcagcccgtgccgatgatgccggggatgggcgggccagctccgatgatgccgccgcccggccctggcccgattccgagcggtcagggcgccatgatggggcccgagggtccgaaggcgatcggcgggggcggcacgaccgtcaacgtcgacacgaagggcgcgggcaaattcaccgaggtcgccaacgcgaagcaggccgagcgctacgcgaagatgatggatgcggccgacgaggcggtctcgatccgtggcgacatcgacacgctggccgatctcggctcgaagatcgccacgggccgcctgacggaagcgaagctcggcatcgcgcagtacgccaaggcgctcggcgccgacgatctcgcgaacggcctgaccggcggcaagatgagcgagatggaggcctatcaggcgatcgcggacaagctggcgccgcggatgcgcgtgccaggctctggcgctacctcggactacgagatgcgcgtcttccggaactcgctcccctcgctgctgaagacgccgggcggcaacgcgatcgccgtggacaccttccggtcgctctacgactatcaggccgccgtcggcgatatcgccggccaggcgctgcgcggggagatcccgcagaaggatgcggacgcccagatccgggcgctggagagccccttcctccggttcaaggaataccggaaggaggccgtgcggggcgaggcgtcgccgccgccgcccgcatcttcggccccgccgccggcttccggccagaaggtccgccgctacaatcctgccaccgggactctggagtaa

SEQ ID NO: 10025 - DNA, 1932 bp, Methylobacterium sp.
atgccccgccttccctccggagagtacgcaccgccggccggtaccgccgcgacgccgggcgccttcatcaccgccgagcagcacaacaccttcgtcaccgacatcggtgcggagatgaccggctcggcccgcgagagcgagatgcgggacctgggcgcgctagttaccacgaccggcacgggcgcggcctacgcgctcgcgctgagcacgccgtgggagattttgccggacgggatcacggtcggcttccgggttcacgtgtcgaacaccggcgcttgctcgctctcgatcaaggacgttgtcggcccgctgcgcgcggtgtccggtaccgacctcgccttcggcgatctgcccgcgcgctcggcgatccaggcgacgctcaaccgtcagggcgcgtccgcgatcttcgcgggcacgctgaccgcgaactcgaaccagatcacgggcgtgtcgagcacggccgggctctacgtcggccagaccgtgtccgccaacggcatcccgtccggcaccgtcgtgacggcgatctcgggcacgctggtctcgctctcgaaggcctacagcggcgcgacaggcccggcgctgatcaccgccgtggggccggaatggctgctggtgaacggcggcctgctggcgacggccaaccgcctcgcgatcgcgaacggccagcttccggtcacgctcaccgccgacgcgcagctcgacgcggcagccaagggcacggcgatcctcgcgagcggcaacctgcgggtgaagctgccggcgcctaccatcgcgggcgcgggctacttcttcgacctccgcaacgacggcatcggcgatgtgaccctgtcgacgcagtcggtggacttcaccggctcggtggcgagcggcaacgcgcagatcttcaacgtctccagcaccaccggcctcgccgtcggcatgctgctgacgatgccgccggcgccgaagagcttcacgggcacgctcaccgcgaactcggccatcatcaccgccgtgaccgacgtatccggcctcgcagtcggtcagccggtctcgagcatcgtggcgggcttcccgagcggcgcggcgattgtcgccttcgacagcacgaccgtgaccatctcggcgcccttcgccggcaccacgacgaccaacgcctcgatcacggcgacggtggacggcatcctgcccggcaccacgatcaccgccatcagcggcaacaccatcagcctgtcgcaggcctatgtcggcgccaccttcgtgacggcctcgctctcggcctacagcacggcgatcgacgggctgcccttcttcgtgatgtacccgggcgagacccggcgcgtgatgtgcgacgggaacaccttccggtcgatcgtgacgacgccgttctatcgggaatggttcggctcgggccggttcatccggccgccgggttacgcccgcatcgggtaccatgccgtggcgcctgggggcggcggcggcttccagggcggcggcggtggcgagggcatctccgatacggtgccggcctcatccctgcccgcgtccatgctgctcaccatcggcgcggcgggcgcgccctcggcgaccaccggcagcgatggcggcgtgacgatcctggggacgctcgcgacgctggcgggcggcaagggaggcacggcatcgggcgcggccgcggcggtaggcgggggcactgcggacggcatcaacgcaggcggagccggtaccggcagcggtacgaacccgacctcaagcatcaacggcggcggcggcggcgcgaacaacgtggcgggtggcacggtccgcggcggctcgctcaacgcgggcgcaggcggccgattcccgaaccttgcgcccggccctggcggtggcggctacggctcggcaacgaacggcgtcgccggcagcgcgggcggccccggtcgcgtccggatctacggcatcgcctga

SEQ ID NO: 10026 - DNA, 273 bp, Methylobacterium sp.
gtgacggagccgcttgaggtccgacgccggctcgccgctgggtacctgacaggccgcacgctcgaggaagccctggccgcgtggcgatcggactacgacgcgccgacctaccgcgagcggcggccgcagctcgcccggctcggcaacgtgatccggaagctcgcggccgaggccgaggcgcagggcgacgctgatgccgaccaccccgggcagaggcccaaacgcaaaaaggcggcgccccggcctaagccagggcgccgcggggacgtgtga

SEQ ID NO: 10027 - DNA, 756 bp, Methylobacterium sp.
ttggcgcggggcgccctcggggtgatcctgcctgtcctggcgcccgggcgtgccggactcgggccgcggcgtcggcctctgcggtgcctcggcctcgggtgcgcggcggccgggttctggggcctcccggcgctcgggcgcagtggagcgctccggcgcggtctgccgctccggctgccgctcgggcgcgcggtcgcgggccggcggcgtcgggcgctcggatgggtcgcggtccgggcgctgcggacgctcgggctgacgctcccgatcgggctgacgctgcgcgggagcgcgctcctcgcggggctcgggccgctcgcgggcggccggcggctgcggacgctcggcgggtgcggcgcgttcgggattgcggtcgggacgcggctcaggccgctcgcgctgggccggaggcgccgccctctccgcaggtgcccgctcgggcgcggcacgctcagggcgctcggacctgtcaggacgctcggagcgctcaggtcgttcgggacgctccggtcgttcggggcgcggcgctccgccgcgcgggccttccccaccgccgcgcggcccctctccgccgccgcgggggccccgctccatgtccggcccgccctgggcgaggagcaggggcgcgcccggatcgtccggacgtgcggagacgggcgtggcgaggaggccgggcagcacggttccggcgaggaggagcttccgcatcgatcggccttcgcggcgcgccggccacggagcggtgacggcgcgtga

SEQ ID NO: 10028 - DNA, 1218 bp, Methylobacterium sp.
atgttagcgcgcctctgcttcctcacgatggtcgtgacggcgctcgcgccggctgccgccgcgcagacgcgcgtgaccatcggggtgctgaacgacgcctcgggcgtctacgcggattccggaggaaccggctcggtggtggccgcccgcatggcggcggaggaccacatggcggcgcgccgaggcctcgacgtcggcgtcgtggcggccgaccaccagaacaagcccgacatcgccgcggccatcgcgcgccagtggtacgaccgcgacggggtcgacgcgatcttcgacctgccgccctcctccgcggcgctggcggtcaaccagatcacgcgcgacaagaacaaggtcttcgtcgcctccagcgccggcacggccgacctcaccggcatccactgcacgcccaacaccgtgcactggacctacgacaccgtcgcgctcgccaacggcacgggcggcgccctggtgaggcggggcggcgacacgtggttcttcatcacggccgactacaccttcggccacgtgctccagcacgacaccacggcggtcgtcgagaggaacggcggacgggtcctgggctcggtccgggcaccgttccccacggcggacttctcgtcgttcctgctccaggcccaggcttcgggggcgaaggtcgtcggtctggccaatgccgggcgcgatgcggccggcgcgatccggcaggcgggcgagttcggcatccggcagggtgggcaggcgctcgcggccctgctgatctccctggccgagatccacgcgctcggccccgccgtggcgcggggcctcgtgctgacggaggccttctactgggatctgaacgacgcgacgcgccgcttctcggaccgcttcgcggcgcgcttcggcggccggaagccgaccgcctaccaggccggcgtctacgcgagcgccctgcattacctgagggcggtcgaggcggtgggctccccgggggacggggccgcggtggtggaccggatgaaggcgatgccgaccgacgatccgctcttcggccgcggcgagatccgcccggacggccgcaagatccacgacatgtacctgttcgaggtgaaggcgcccgcggaggcgacgggcccgtgggacctctacaaggtgctcgccgtcattccggcgcaggcggccttccgtcccctcgatgccggcggctgcccgctggccggcctgtccgaggcccgccgctga

SEQ ID NO: 10029 - DNA, 585 bp, Methylobacterium sp.
gtgccagccttcgttgcccgcctgcacgccgccgaccgtggcgaggtaaccaaactcgccttcgagttcctcatcctaaccgcactgcgcaccagcgaggttctcggggcgcgctgggaggaaatcgacaccgtcgaagcggtgtggaccgttccggcggtgcggatgaaaaagaagcgggtgcatcgcgtaccgctaagtccgcgcgcgctcgccgttctcgaccgagccaaggtgctcgcgaacgacagcccctttgtcttcccgggccaaaagccgatgaagccgctgtcgaatatggccttcgatatgacgctccggcggatgcaggtgccggttacggcccacgggtttcggtcatcgtttcgcgattgggcggcagagcagaccagctacccgcacgaggtcgccgaaatggctatcgcgcatgtggtcaagaatcgagttgaggcggcttatcgacgtggtgacctgctggacaagcggcgcgggctgatggcggattgggcgtcattctgcgacggcagcgggccggcagacaagtcgaaggcgaacgatgccgcgagcaaccaagtcaacgggtag

SEQ ID NO: 10030 - DNA, 531 bp, Methylobacterium sp.
atgatggaggtctacgatttccacgcaaaaaatttgagctacccgaagcgttcctacgccgcgtcggacagtaagggttacgagctgattaggtggattcacggaagtcgccgcgggatcatcggtatcgatctcggcagaatggaaacagtttggaaggagcttggaagccacgcggcgctgatctacgccgcgtcaacgattgcagttagtgatcggatgacgctacttgatgtcatccgtggcggaactgcggatttcgataagcacgggcacttgctgaatagctggatggggcgagcgcgctactctgccgagacgatcctgagtaactcaacgaaaccggagctcgggcaagccaccctcacgcagctgcccacgcttccgagcgagcctacgcccgagccgcacttcgatcaggaggaacaagctcgcattaaagctgagttcgacatggtcgctattttggggaaccgccagcgggatcagcgacgggagaggctatcccggcgtggaccccgcagggtgtag

SEQ ID NO: 10031 - DNA, 216 bp, Methylobacterium sp.
gtgaccgatcacctcgacctgccgcagactgggttcgtgagcccggcttgggtcaagcggcgctacgcgatcagcaattccacgatgtatgcgtgggtcgccaacgcttacctgcccgcccccttgaaggtcggcccgcgtgccgtgcgcttccgtgcggaagacctgcgcgcgttcgaagctcagttcgccgcccgtgacgtgcaggtgatctga

SEQ ID NO: 10032 - DNA, 102 bp, Methylobacterium sp.
gcccacggcttcgagctcgtgcggaaaccctactccgctgaggaactcgcccgggttctgcgcgaggcggcccagcgagggcggaccgcggtcgagcgctag

SEQ ID NO: 10033 - DNA, 336 bp, Methylobacterium sp.
atgaacgggctgctgcgggatgttcagacgaactggttgcccagtgtccgtacggcgagccaggtcgatgcgctgaccgggcgctacacgacgagcgtgctgcgacacatcctgaccagcgagccgaagatgctcgcgaccatcgacaaggatctgggcgagcgcgcccgcaaactcaccgaagcgcgcgcggtgtacgagccgctcatcagctcgtccgacgagcgggccctctatgatgggttctccaagagctgggcggagttcacggccacggtcgaacccattctcgacctgtcgcgcagcggccggaaggccgaggccctggcgctgtaa

SEQ ID NO: 10034 - DNA, 210 bp, Methylobacterium sp.
gtgaacgaggcggcgccgagcgtggtgctgccgaccgcggcgcgacgggcgagcgtcccggcggagcggagcgcggcggacgcgcggacggacccgatcgcgccggcgagcgccaggacgggcgcggtgcggcccgcggcaacgacgatcgcggcgcggcgggcgcgcggaacgagcggggcgagcgcggtgcggcgcgcggtgccgtga

SEQ ID NO: 10035 - DNA, 672 bp, Methylobacterium sp.
atgatcgacggttatctccgcgagcattatggcctgactgttcaagatggtcccttccggggcatggcttacatcgccgaggccgctggatctctgttcggaccaaagatccttggctcctatgagcaagagctcgcccagattttcaaccagctgggtcgttacgaaacgttcgtggatgtcggctgtgcggaaggctacttcgcggttggtgcactcgtggccgcgcctcacctcaggaccgcggcgttcgacttggatcctcgcgcgcggcagctttgcgccgccctggccgaaatgaacaaggtcgcgggtcgcctacaagtcgcggagctgtgccgcccagaggatctcgttgcgttggcgggtcctaagacgctgatcatgatcgacattgaaggagccgagacgaacctcctgggcagtacgccagccgaagctctcagcgactgcgatgtggtggtcgagacgcactacacggcagccggctgcacattggagttcctgcactcctacttctctcgcacacacgacatcacgatcatcgaacagtccgcccgcgatcctgctgcattcccaccgctgatggcgctcggccaggtcgatcgcttcatggcgcaatgggaagggcgtggcccggagccgtggatcttcgccgaggctaggcgctga

SEQ ID NO: 10036 - DNA, 1281 bp, Methylobacterium sp.
atggctaccattattggcgacgcgaccgacaacaccctcgtgggtgggacggacaacgacaccatcatcggcaacgccggtaacgacgccctcaacggcggcgctggcggctctgacctgatctacggtaacgctggcgttgacaccatcacgtcgaccaagaacgtggttgtcggcggctttgtcaccgctgctgtcgacaccgtgtacggcggccagggcaacgacatcgttaactacgctggcgcgactgcgggcgtttccgttcgggcctttggtggcctgggcgatgactcgctcgttggtttcaccggcaatgacacgcttgtcggcggcgatggcaacgacacgctcggcggccttggtggcgcggatcgcctcgtcggcgacgctggcaacgacgtcctcgacggcggcgctggcaatgacgtgatctacggcaaccttggcaacgacacgatcacgggatccaacctgaacgtcgcgggcaacctcgacaccgtgttcggcggccagggcaatgatctgatcgactactccgcttcgggtggcaacagcatcatctacggcaacttcggcgatgactcggtcgtcggcgccacgggcgtttccgatcgcatctacggcggtcagggcaacgacacgatcaacggcactggtgttacggctggtactgacaccgtgttcggcggtcagggcaatgacgtgatcaactacgccaccaccgcggctgtgggtggcctgatctatggcaacctcggcgacgacaccgttaccggcggcgcgggtgctgacacgctctacggcggtcagggcaacgacaacgttgtcggtggcgctctgacggacgtcctgttcggcaacctcggcaacgactcgctctctggcggcactggtgctgacacgctcagcggtggcgcgggtgctgatacgtttgcctacgccgctggcgacagcgcgaacagcgtcaccgccggtgctgctgactacgacagcatcacggatttcgtgacgggcaccgacaagatcagcggccttggtgccgtgggttcgtcgaccaacttccgcactgtgaccaacacgtctaacagcttcaccgacgcgcagaccgccgctggtggtctggttgctggcgatgtccggtatgtcttcgttgccaaccagagcggcaccggcggctatctcttcgccaacaccgacggcacggccggcctggcagccacggataccgctatccagctgacgacgggcaccgtcgcggccacggatatccttgcctaa

SEQ ID NO: 10037 - DNA, 240 bp, Methylobacterium sp.
atgaccctggccctggctatccccgttgtcgaggcagccgccttcaccgccggctgtaccctgatccacggccggcgccaccagccgcagtgggtgaccttcgcgctgctaggcctactttgcctggtcgcggtcggtgggctcgcgctggccctggcaggcataggcccatccgatccggtccaggcaaccgcacagatttcctttgaaaatcacgctgcgggagcaatccggtactga

SEQ ID NO: 10038 - DNA, 477 bp, Methylobacterium sp.
atgcccacgcgagccctgccgctctggctcttcacgatcgccctggtgatcggggccccgatcctcaacatcgtctactggttccaggtgctcgcctcggggacgttgccgcacgacggcgacgcggtcgcgatccccatgttcgggggcgtgatcctcacgctgatgctcgcgcccctcgtcctcggtaccgcctggatctgcctgcgccgctaccatcccggaacgcggctcggggcgtggcggcaggaccggcctgtccgcagcctcctcgccagcctcctcttcggtggcccggccctggtgctcgcggccggggcggtccacgaccttctgaccccgggcccgtggtacgagcacatccccgtggctctgtcggtgccgtgcatcgtatggctcctcgccatgcgggcggccttcatcgagcagcgtggagccgctctcccgcgacgacctgcccggcacagagagccatga

SEQ ID NO: 10039 - DNA, 219 bp, Methylobacterium sp.
atgttcctgacgatcggcgcggaggccgaccggctcggcgagcatttggccgctcggtcgcgggccgacaagagcgaggccatgcgtgtggcgctcgccggccggctgcggctctgcgaagcgtcgctggcgaacggaacggagccgcacccgccgggggagggcggcgggaccagataccggatcggaagccgatactgctcggcccctgagccttag

SEQ ID NO: 10040 - DNA, 201 bp, Methylobacterium sp.
atggctgaggtcagccagatggcgttcaaggagcaggctctctcgaccagggtgatgagccgcttgggcgagatcgtctcgatggtcgaggatgcgcgcaaactctctgcactatgtgcgagcgaacctgtggctggcaacgtggccgtgtcaggtgatggcacgctctgctgggcgccgatgagcccaggcaatcactga

SEQ ID NO: 10041 - DNA, 177 bp, Methylobacterium sp.
atgcccgcggcatcgtgccccgggcgatcgtggaggccgaggcgatcgggcgctctctcgccggacgcgccggcccagaccttcagcccggcgccggtcggcggcgactcggagcccgatcccggcctcgaccgtctgctcgcggccctcgacttcgcgcggctcctcccgcgctga

SEQ ID NO: 10042 - DNA, 222 bp, Methylobacterium sp.
atgatgcgctgcgagagcggcctcgtcttcccagacctcgtagaggtacaggcgctcgtctccttcgcggtcggcatgaagcgtgaagacgcggcatcccggctcggctcgcgtcgccggtatgatacccagaaccgcacggcgcgcggcatcgaagtgttcgggttttggcgtgatccgagcgaggacggtgagcggctccgacatccctgcctccgataa

SEQ ID NO: 10043 - DNA, 843 bp, Methylobacterium sp.
atgccccgctacgcccgccgcgacttgctggcgaagttccacgccatgatcgacaggcgccagcccattatcgggggcggcgccggcaccggcctctccgccaagtgcgaggaagccggcggcatcgaccttatcgtgatctacaattcgggccgctaccggatggccgggcgcggctcgctcgccgggctcctcgcctacggcaacgctaacgagatcgtgaaggagatggcccgcgaggtgctccccgtggtgcgccacaccccggtcatcgccggggtcaacggcaccgatcccttcgtcatcatggaccactacctcgacgagctgatcgcgctggggttctccggcgtccagaacttcccgaccgtcgggctgatcgacggcaccttccgggcgaacctggaggagaccggcatggggttcgggcatgagatcgacatgatccggctggcgaacgccaaggacctgctcaccacaccctacgtcttcaatgccgaggaggcggccgagatggcgcgggcgggggcagacatcatcgtcccgcatatgggcctgaccacgggcggggcgatcggtgccgagacagcgctgacgctcgcggattgcccggcgctgatcgaggcttgggccgaggctgcgcgacgggtgcgcccgggcgtgatcgtgctctgccacggcgggccgatcgcgacgccggaggacgcggcctacgtgctcgccaacacccgccactgccacggcttctacggcgcctcctcgatggagcgcctgcctgccgagacagcgctcaccgagcgcacccgcaccttcaagtccatcctcttcccggagacccgctga

SEQ ID NO: 10044 - DNA, 1206 bp, Methylobacterium sp.
atgagcgtcgtctacgtcgtcggcacctgcgacaccaaggaggccgagctgctctacgcccgcgacgtcgcgcgggcggcgggggcgcgggccgtgctggtcgacgtcggcaccctcaggtcgtcggcactggcggatgtgccggcggccgaggtcgccggtcatcacccggacggggcggccacggtgctcggcgggtgcgaccgcggggcggcgatcgccgcaatggcggaagcgctcgctcgcttcctcgcgacgcgcgacgacatcggtgcggtgctcggcctcggtggttcgggcaacaccgccctcgtcacccgggcgatgcgcgccctgccggtcggcgtgccaaagctcgtcgtctcgacagtcgcctccggccaaaccgccgactatgtcgggccgagcgacatcgccctgatgtacgcagtcgttgacgtcgccggcctcaacgcgatctcgcgccgggtgatcggcaacgccgctcacgcggcagccgggatggccctgcgcgcgccgccgcaggcaccggccgacaagcccggcctcggcctgacgatgttcggcgtgaccacctcctgcgtgacgcaagttcgcgaggcgctgagcgccgagtacgagacctacgtcttccacgccaccggcaccggcggccagtcgatggagaagctcgccgattccgggctgctcgccggcctcctcgacatcaccaccaccgaggtcgccgaccacctgttcggtggcgtgtttccctgcaccggggaccgcttcggcgccgcgatccgcacccgcctgccctatgtcggctcggccggggcggtggacatggtgaatttcggcccccgcgagaccgtgccggagcgctaccgcgaccggactctctacgtccacaacccgcaggtgacgctgatgcgcaccacgcccgaggagaaccgggcgatcggcgcgttcatcgtcgagcggctcaaccgcatggaggggccggtgcgcttcctgctgccgcttcgcggcgtctcggcgatcgacgcgccggggctgcccttccacgacccggaggccgacgcggcgctgttttcggcgattcgcaacagctggcgcgaggcgccgaaccggcgactcgtcgaggtcgacgccgccatcaacgatcccgccttcgcgcaggcgcttgtcgccgccttccgtgacgccgtgcaggagagaccctga

SEQ ID NO: 10045 - DNA, 702 bp, Methylobacterium sp.
atgctcgtggtgcgcgacctccacgtccgcttcgggcaggcccacatcctccagggcgtcgacctcgcggtaggccccgcgccgctcgcgatcgtcgggcgcaacggcatgggcaagacgacgctgtgccaagcgatcatgggcatggtcgcgggccggggcgagatcagcctcgacggcgcgagccttgccggtcgggctccggaccgcgtcgccctggccggcatcgcgctggtgccgcagggccggcgcaccttcccgtctctgaccgtggacgagcacctgcgcctcgtcgaccagggcccgcgcgcccgctggaccagggcgcgggcctacgagaccttcccacgtctggccgagcggcggcgcaacggcggcacgcagctctcgggcggtgagcagcagatgctggccatcgcccgcgccctgctgatgaacccgcggctcgtcatcatggacgagccttcggaggggctagccccggtgatcgtcgaccacctcgccgaggtgctgcgcggcctcacccaggagggcatcgggctccttctggtcgagcagaacctgcgcatggcgacggcggtctgcgatcacgtcgccgtgatggtgaccggccgcatcgcagcgaccctgccggcggccgagctcgccgggaacgaggacctgcagcggcgctacctcggcgtcgccgccgttcaccactga

SEQ ID NO: 10046 - DNA, 750 bp, Methylobacterium sp.
atggctcccgaacctgccctccagctcaccggaatcggccgccgcttcggcgcgctgcacgcggtccgcggcgtcaccttgagcgtggcgcccggcgagcgccgggccgtcctcggccccaacggcgctggcaagaccacgctgttcaacctcgtctgcggcgacttcccgccgaccgaggggcgcatcgtcttcttcggccaggacatcaccggtctgccagcccaccggcgcacccggctcgggatcgggcggacctaccagacctcgctgctcttcaacgggctcggcgtcctcgacaacctctacctcgcggtgcgcggcggccggccgggccggttctcgttccgccggcccgggcgcggcgatccgcacctcgcccgcgcccgggcgctcgccgagcggatgcgcctgacgcacctcgaggagcggccggtctccgacctctcacacggccagcgccggcaactggaggtcgggatggcgctcgcctgcgacccgaaggtgctgatgctcgacgagcccgctgccggcctctcgcccggcgaccggccggaactgctggcgctgctccggggcctgccgcgcagcctcaccctcgtgctggtcgagcacgacatggacgtggccctgcccgcctcggacatcgtgacggtgatgaaggacggcgcggtcgccgtcgaggcgacgcccgaccggatcggctccgacccgaccgtgcaggcgatctatctcgggaagggacactga

SEQ ID NO: 10047 - DNA, 1023 bp, Methylobacterium sp.
atgagcgctcggctctcgctcccggcgctcgccctgctgctcgccgcgcccctcctcctcgggctcgtcctgccgcagccccaggcgcagttctggaccgtcaacatcctggggcgcgccctcgtctacggcatcgtggccctgtcgctcacgttcctggccacctacgggggcttcgtctctctggcgcagatgacggtggcgggcatcgccggctacgggctcgcgatcctggtcgagggggcggtgccaggcatcgtcggcggcctgccctacgcgctcgcggtcccggttggcctcctggccgccaccctggcggggctgctcatcggggcgatcgcggtgcgcacccgcgacatctacctcctgatgatcaccctggcgctggcgatggcggtctcgcgcttcgcggaatcgaacatcgactggttcaacggctacgagggcatccgcaacgtcgtcgggccgaccctgttcggggtgccgttccgccagccgcacctgttctactacgtctcgctcgcggccgcggtcgccctctacgtcggcgtgctccacctcgtgcgcaccccgttcgggctcgtgctccaggccatccgcgacaatccccgccgcgccgcggcactcggctacgacgtggcgctccaccgcatcgccgccttcggggtcgcgggcttcatcgccggctgcggcggcgtgctgacgacgatctacaacatcggcatctcgcccggctcgatcgggctcggcgccagcgtcaacatcctcatcatcagcgtcatcggcgggctcggccacccggtcggcgccttcgtcggctcgctgatcttcgcggtcttcgacaccttcgcggcctctctgtacgaccgcgaccgcttcaacaccctgatcggcctcgtcttcctcggcatcgtgctggtctcgccggacgggatcgtcggcctcgtccgccgcatccccggcctgcggcggctgccccggccgaggcccgacgccgcccggcgggccgccgagaccggctga

SEQ ID NO: 10048 - DNA, 879 bp, Methylobacterium sp.
atggcgctcgccgccacagtcgtgctgaacgggtttaccctggccgctctctacttcgttgtcgcctccggcttctcgctgatcttcggcctgatgcgcactgtaaacatggcgcacggctcgctttacttggtgggcgcttatttcgcctacgcggtgttcgagccgctctacgaccgcgacgcgtggtacgcttggtacctagcggtgccggtcggcatggccgcagcggcgctggcgggggccgccatgcagacgctcctgctcggctggatgcagggccaggagctgcggcagacccttgtcaccatcggcatctcgatcgtcgttgccgaccagctacttgcccattttggcgggacgccgcggcagttcttcgctcccgacgcgctgttcggcacgacggagcttcccctcgtcggccgctacccgaccttccggctggtccagatcgcggtcgcggtcgcggtgggcgtcggcctgtggctgctcctcgcctggaccaagctcggcctcatggtgcgggcgggcgtcgacgaccggaccatgctcgccgcctgcggggtgaacgtgcctcgggtggcgctcgcggtcttcgccctcggcgccgcgctcgccggcctcggcggtgtgatcggcgcgacggcccagcccctggcgcagggcatggacggccgcttcctccttacctcgctcgttgtggtgatcgtcggcggcatgggctcggtgcccggcaccgcggtcggggccgtgctcgtcggcctcgccgagcagatcgggcaggcgctgtttcccacctacgcagtcatcctcaccttcgggctgatggtcgcggtactggccgtgcgcccgcaagggctgatggggaggcccgcatga

SEQ ID NO: 10049 - DNA, 672 bp, Methylobacterium sp.
atgagcagcttgcccggcattcgcgcgtgcctgacgtattgcgttctgataatcctgatctggacggtcggctctacggcttggacgatgtggatcttccataggccacttgatgagcccatcgccctggcccccgcgggaaggatccagcggaacatcgagatccgattcaccgctccttacagtctcgccctcgatttcagcttcggcgcgcgacgcgcggagatcatggccctcgttggcgaaggatccgcgatcggatcagcagtagcgctacacggtcgatccggcacaacggtcccgctacgttggtctctgactgatgtggacggcaaggtcgtagcgggcagcgaagcggatacgcacggaagaacctcctacgcctccgacttcgtatcgcgcaacgttgcgaccttctccatcatccctggccgctaccgccttgaggtgaatgtcctccgtgacgtacccgagttccgggatgtgccagtacgggtgcatctcggactaccggtcggaaaggtatcgtcgggctggcagagcgagttcgcattcttcgccggcttcgcgaacgtccttgcgatctggccgctggccggcttgctcctcttggctctggccatgttgacgatccgagatctgacgggccccggatcgatgcgctcagcatga

SEQ ID NO: 10050 - DNA, 285 bp, Methylobacterium sp.
atgacccacctgagcaccctttccgcaccgaccaccagcaccctggccatcggccccggctcctggcgcgacgcaccccttccccagcgcaatagcaccgacgcccgtgaccggctccggctggcactcaatgcccgcggcatgcgcctgtcgttctgcgtcgacggcatgctcgcccgcgacctggccaccaacgagagctgcggcgggatctacccctacggcgacttcgccggcatgcacgcggccctggtcgccggcgagctggaggtggaccatgtctga

SEQ ID NO: 10051 - DNA, 198 bp, Methylobacterium sp.
atgtctgagatccgcatggatgcagaagcgcgcgccagggtcattgcgtggcgctgcggcttcgtcctggaccgcgacgcggcgagcatccagatcaagtaccccgccgacggcgtcgtcgccggtcgagtggcctcgttcgaggacgtcccaggcgcattcgtcgaaggcaggctggccaaggaggtgcgcgtatga

SEQ ID NO: 10052 - DNA, 183 bp, Methylobacterium sp.
ttgacggacacgactcccgacatcgtcgagctgacgggtgacatcgtgtcggcctacgtgtcgaacaactccgttcctgcggccgagctggccggcctgatcgcgggcgtgcacgcggccctgcagcgcctgaccggcgcggcggcggcccccgccgaggccgaggcgcccgtcgagaagccc

SEQ ID NO: 10053 - DNA, 282 bp, Methylobacterium sp.
atgccgcccgacgaccggacatatgacgagcagttgcgcgaacgcctcggcgcgggcggcgtgaaacggctgtccgagttgattggcgcggcgggcgggctcacgcccaccgaagcgaggcactggttcgagttgtcagtgcaggattggcgcgaggtcgaagcgctcgccttcctggcgctcgacgattgcgagcaacgaggagcgatcttgccgtggcatctcgttcgctggctggaccgccgccgccatcacaaacccaccacgagcttgttcgcatga

SEQ ID NO: 10054 - DNA, 399 bp, Methylobacterium sp.
gtggccacgaccgtcaccaccttcgccgagctgaacaccgccctccgggcggcggacgatcgggccgccaacacgggcgcgatcgagatcgtggtctcgggcacgatcgccgcgacggccgacctcacggccgtcaacctgcgggccggcaacacgctgctgatccggggcacgaacggcggcacgctggacggcgggcggacgcatcgcgggctcttcgtctattccggcaccgtcacgatccaggacctgacgatccagaacgccagcgcggtgggcggcgcgggcgggcttggcggcggcggcggcgccggcctcggcggcggtctcttcgtggcggccgacacggcgcacggcgcgacggccggccacgtcaccctgtccaacgtcagctttacg

SEQ ID NO: 10055 - DNA, 741 bp, Methylobacterium sp.
gtgacgggtgccagcgaagagcagatcccgcagcccgtggcggccttcaacgggcgcgtccgagggctggcgctcagccagcgcgccgaccgtgccgttgggctggcgggcgacatcgtcgatctagtccggcacgcggtctcggtccacgcgaccaaccgcatcgtgacctacagcgaccggatttcatcgcaggtcgggacgtccttcgccgcgaacgccttcaacgacgtgcagcggtccttgatcgaggccgagatccttcagaccgtgcgtctctgggaccacccggacatcgaccgcatcggcctgcaaaccgcctactggctgtccaaggatcccgccgtccggaccatcttgaacgaccggcacacaacggcacccgagccctatcccgggtacatcgccgatcggctcgcacggcaggaccttctctggctccggctcgaccgggtgatggccttgatcctcggctccgacctcctgaccaggctgcgcaacttccgggacaagcgccttgcgcactggctggtccagacgaagctcgagcgagcaggcgagacggtgccgccggccctgtacggggacgagcgccggctgctcgtccggacggtcattgcggccgatctcctcgcccgagcaacgcgagacgcttcgttcgacttcaagggacagtggcggattgctcagcgcaacgccgaggccttctggcacgggtgcacagtgaagccgctcaggtaa

SEQ ID NO: 10056 - DNA, 195 bp, Methylobacterium sp.
atgcagcgcggtctcgatcccctccgcgatgcccatggtctgcgctggcgggaacaggcggatcgcggtgccatccagaaccgcggagtgcccggtactatcgcgagatcggcgagcgccaccgttttcgacagcggcgtgcagatcagccgcagcttccaccgcgggttcggtaagagtgcgtccgggttctga

SEQ ID NO: 10057 - DNA, 642 bp, Methylobacterium sp.
gtgaatggcgaaccggtaggatcacgccctgacgccaccgttggccccggcgcacccaagcagcaggagctgttcgaggcgcggacgcagtggttccacgtcttcaagaccatgatcgattcgggtgatctggccaccctctccggctcggccgtgaaggtctacctggtggtgaagagcttcacgaacttcgccaccggacgtgccttcccggccttggagacgatcgccgaaaaatcggggctctcgctggcccaggtgaagcgggagctgaagacccttgaggagcggcactatctcaccaaggcgaaatccggccggcgcaacgagtaccgtctgcgcgagaaggtcgaaatcacggacggcagtggacggcccgcagccgtcgccacctgggactacctgccgagcagcgtgcagcacgccatggctgacctgaagaacgttctgatcaccggcgacctggccggggccaagatcgtgcacatcgagcgcctgcaggtgaacgtcacgcacctccacgacaacgccgtgaacttcaacgtgcagcagttcaacgccgacctggagaagctgccgccggccatgcgcgagaagctgctggcgaattggaaggcgagcttggagcgcgaggatgcctga

SEQ ID NO: 10058 - DNA, 129 bp, Methylobacterium sp.
atggcgcattatgtgttttccgccacaacaccgacacggggcgaggagctgtgggtcacggacggcacagctgagggcaccatcctcctcaaggacatcaacaccggatccgtcggctccttcccggcc

SEQ ID NO: 10059 - DNA, 465 bp, Methylobacterium sp.
atgctcgaccccgtcgcgacacgccttgccaggctggctcaggacgtcgctgcgacgcgcgctcgaacgcaacagcttcaagcccaaggcagcgtgctgaggcagcgccttggtcgggcacgtcgcgcgctcgccgccgcaggcgaggcatcggcgcaggcctgcaggacctcgcatctcctgctgcaggaacgcacgccggtcgtgctcgagcaggcagggttggacgaggcgccccgaacgccagacccatcactcggcgccgtccacgagcttctctccatcctcatggcgcaggcaggcggcccggagcgcctcgtcgacgtactcctcctcgctcacgaggaggccgaggccgcaggggaggatgagcgggccttgatcctggccggcctgctccaccagctcggccgacacctggcgcaccaagtcggaccccgcgccgccggcattacgctgaactga

SEQ ID NO: 10060 - DNA, 900 bp, Methylobacterium sp.
atcaccgtcgacgtgaagggcgagatcctggagctgaagaacaccatcaacaccatggtggatcagctcaactccttcgcgagtgaggtgacccgcgtcgccaaggaagtcgggtccgagggcaagctcggcggtcaggcccgcgtcgagggcgtggccgggacctgggcggatctgaccaacaacgtgaacctgatggcggagaacctcacgggtcaggtgcgcaacatcgcggacgtgacgaccgcggtggccaacggcgatctctcgaagaagatcaccgtcgacgtgcgcggcgagatcctggagctgaaatccacgatcaacacgatggtggatcagctcaactccttcgcgtcggaagtaacgcgcgtcgcccgcgaagtgggcaccgagggcaagctcggcggccaggccgaggtgaagggcgtcggcggcgtctggaagggcctcaccgacaacgtgaacatgatggcggccaacctcacgggtcaggtgcgcaacatcgcggaggtcaccacggcggtggccaacggcgacctgtccaagaagatcaccgtggcggtcgagggcgagatcctggagctgaaatccacgatcaacacgatggtggaccagctgaactccttcgcctccgaggtgacgcgcgtcgcccgcgaggtgggcatcgagggcaagctcggcggccaggcccaggtccgcggggtcggcgggacctggaaggatctgaccgacaacgtgaacatgatggcggccaacctgacgggtcaggtgcgcaacatcgccgaggtcaccacggcggtggccaacggcgacctgtcgaagaagatcaccgtcgacgtgcgcggcgagatcctggagctgaaatccacgatcaacacgatggtggaccagctgaac

SEQ ID NO: 10061 - DNA, 624 bp, Methylobacterium sp.
atcaccgtcgacgtgaagggcgagatcctggagctgaagaacaccatcaacaccatggtggatcagctcaactccttcgcgagtgaggtgacccgcgtcgccaaggaagtcgggtccgagggcaagctcggcggtcaggcccgcgtcgagggcgtggccgggacctgggcggatctgaccaacaacgtgaacctgatggcggagaacctcacgggtcaggtgcgcaacatcgcggacgtgacgaccgcggtggccaacggcgatctctcgaagaagatcaccgtcgacgtgcgcggcgagatcctggagctgaaatccacgatcaacacgatggtggatcagctcaactccttcgcgtcggaagtaacgcgcgtcgcccgcgaagtgggcaccgagggcaagctcggcggccaggccgaggtgaagggcgtcggcggcgtctggaagggcctcaccgacaacgtgaacatgatggcggccaacctcacgggtcaggtgcgcaacatcgcggaggtcaccacggcggtggccaacggcgacctgtccaagaagatcaccgtggcggtcgagggcgagatcctggagctgaaatccacgatcaacacgatggtggaccagctgaac

SEQ ID NO: 10062 - DNA, 315 bp, Methylobacterium sp.
atcaccgtcgacgtgaagggcgagatcctggagctgaagaacaccatcaacacgatggtggaccagctcaattccttcgcctccgaggtgacccgcgtcgcccgcgaggtcggctcggaaggcaagctcggcggccaggcgcaggtgaagggcgtgggcggcacctggaaggacctcaccgacaacgtgaacctgatggcggccaacctcacggggcaggtgcgcaacatcgccgaggtcaccacggctgtggccaacggcgacctgtccaagaagatcaccgtcgacgtgaagggcgagatcctggagctgaag

SEQ ID NO: 10063 - DNA, 78 bp, Methylobacterium sp.
gagtgccggcctgtcacgccggaggtcgcgggttcgagccccgtcgcccgcgccacgttctcctttcagctccgctga

SEQ ID NO: 10064 - DNA, 141 bp, Methylobacterium sp.
gtgcaggatggtgaacggctccgcacggattgctgggaggtgcggctcggcatcgtctttgccgagtcgcacctcccacacggaatgggtcctcacgaggtcgagcggatcggctcccgggcctaccgcgtcagcgcgtag

SEQ ID NO: 10065 - DNA, 87 bp, Methylobacterium sp.
atgcagtcgatagtccctatcgacgacgtcgataagatggagccgctggcgcacccgatgggcgtacggtcccgggatgtggtgtga

SEQ ID NO: 10066 - DNA, 714 bp, Methylobacterium sp.
ctcgaggcggagacggcgctggcgcgggcctcggcggaggagcagcgcaaggccggcatgcgccagatggccgacggcttcgagcaggcggtcggcggcatcgtcggcatggtctcctcggcggccagcgagctgcaggccaccgcccagggcatgagcgcgaccgccggccagaccgcctcccagtccaccagcgtggcggcggccgccgcccaggcggctgccaacgtcaacacggtggcggccgcggccgaggagctcggctcgtcggtcgccgagatcggccggcaggtctcgggctcggccgatctggcgcaggcggcggtggccgaggccaacgccacggcgggcctcgtgcaggatctggcccaggccgccagccgcatcggcgacgtggtggcgctgatctcgcagatcgccggccagaccaacctcttggccttgaacgccacgatcgaggcggcgcgcgcgggcgaggcggggcggggcttcgcggtggtggcggccgaggtgaaggagctggcctcgcagacggcgcgggcgacggaggagatctcgacgcagatcggccagatccagggctcgacggatcaggcggttggcgcgatcggcgggatcggtacgcgcatccgggagatcgccggggtggcggcctcgatcgcggcggcggtggaggagcagggcgcggcgacccaggagatcgtgcgcaacgtc

SEQ ID NO: 10067 - DNA, 1191 bp, Methylobacterium sp.
atgtcttcattcggcggttccgcgcccgagcgctcgcagctgtccgaagtgacctcggatcgcaggctgtcgcagcccctagctcccggcttcatccacctgaaggtggtgcaggggctccgcatcgtcgtcaccgaactcggtgccgaccccgacgccctcgctgccgcggcgggcctcgatcctcgactcttcgccgccggcagcaagctcgtcccattcacagcgatcggtcgcctcctggcgctcggcgccgagcgcacccgctgccctcatctggggctcttggtcgggaaacggacgaccctgggctcgctcggcctggtcggcttgctgatgcgctcctcggacacggtcggcgccgccttgcgggctctcgaagcgcatctaagcctgtacaacagaggggcggcggccggcctcggcatctacgacgacaccgctgtcttcagctacgcgctgtacgagcccgaagccgacggagccgccctgcacacggaacgcgccctggccaaggcgaccaacgtcctgcgggcgctctgtggggcggactgggcgccgttggaggtgatgctgccgcattccgccccccccaacacgaagccctacagagcattcttccgagcgcccgtccggttcgatcaggaagaggccgccctggtgttccaggcgcagatcctgaagcagcggatcgtcacggcagatccggccacgcaccgccgggtggaggaccgcatccgccgcattgaggccgctcagaccacgaccctatcagacgagcttctccaatatctccgtaccgcggtgacgcggcagcggtgcaaggctgagcgcgcggcgcgcctgcgacaggtgacccgccgcaccctgagccggcgcctcaaggcggagggaacgagcttcaagcgcttggcgaacgaggcgcagttccgcgtggccaaacagcttctcgccgacaccagcatcagcgtgacacagatctcggccatcctggacttctccgaaccctcagccttcacccacgctttccggcgctggtcgggcgtgacaccgagcgcgtggcggaagggcaactggccgcgcaccgagatcactcagctcgatgaggagcctggagccagaggagagatactggatgcctttgccccgccggatcttggtctgcgaccttctcatcgtcgccggcagtaa

SEQ ID NO: 10068 - DNA, 237 bp, Methylobacterium sp.
atgaacctccggttgcaacctgtgcgcgtccgaaccgggagcagcgataccgatgggctgctcgtttttacgggcgagtaccttgtggctgttttggtgcagctatcagaggagcatggtgagcacacaggcttctggtttctggaagccggcttcgatggtgcggaggatttgacccggccaacgttccgtgaccttgaggaggctcaagcctggatcgagcagcggatcggctga

SEQ ID NO: 10069 - DNA, 546 bp, Methylobacterium sp.
atgccccgcatcggttacgcccgcgtcagcaccctcgatcaggatctcgacgggcagcttgcccgcctcaaagccgagggctgcgccgtcatccgctccgagaaggtctcaggcgccagccgcgagggccgcgccgaactggcgaccgtccttgagttcctgcggcccggcgacgagttggtcgtcacccggcgcgaccggctcgggcgcgatacccgcgacgtcctcaacgtcgtgcatgaggccgagcagcgcggggccagcgtcacggtactcgacccgcatgtctccacccgcggtgagatgggccacgttgtgctgaccgtgctcggcatggtcgcgcagatggagcggcgcttcatcaaggagcgccaacgcgagggcatcgagcgggcgaaggccgaaggggtgtatgccgggggtaaacgacgcctcgaccgcgagcaggtgcgggcgctgcacgctgctggcagcgagcccgcggccatcgctgctgcccttggctgctcgcggatgcaggtctaccgcatcctccggcaggcatga

SEQ ID NO: 10070 - DNA, 2907 bp, Methylobacterium sp.
ttgagcgtcaccggcctcgcgctgaacggcggtttcgtcggcgccactggcggcccgcgcctcggggcagctctggcccaggacatcggcgccattccgttcggagcggtcgccgctgcgcacatggatgccgacacgatgaccgatctcgtcatcgctacgggatccggcatatccgtcctcaaaggcaagggcgatggaaccttcgaggcgccaatcagcgcgctggcaggcccccaaggtttctacgctgtggctgtggcggatctcgacggtgacgggcgccaggacatcgtagcggctggtcgggactcgtcccccggttcgttgtcggtgatcctgcgggacgccagcggagggtaccgagcgccgcaggttctgaacgcgggtacgatcttcacgagcatcgcggtcgccgatctgaacggcgacgggaagctcgacctcgtcgctgccgacccggggaacgtgaactcgaccacacccagcgcaggtagtgtcaagcttttcctcggtgacggccaggggggcttccagggcgcgacgagtcttaccaccggatcgtcgtcggtcgccgtcatcgcggccgacgtgaaccgcgacggcagaacggacatcctcgccgcaaaccggaccggcggggacatctcggttctcctggggaacgcctctggtggcttcaccgcggcggcaaatttcgcggccgggtccgatccgcgcacgatcgcggccgcggatctgaatggggacggcaatccggatctcgtcgtgacgggatccggcgcggcttcgatcctcctcagcaatggggcgggcggtttcgagccaccgaacccgatcgcgactggcggccttgtctactccgcctcgatcgtcgacttcgacggggacggcaagctcgatctctttgcccccatcatgcagggatcaggcggcttcgccgtgatgcagggtcggggagacggaacgttcctggcccctctgacctttgccagcggaagcgggaactacgtcgggtcggtcgccgacgtgaacggcgacgggcgtccggacgcgctctcgaccaagctcagcgggagcggcggctttaccgtcgcgctgaacgtcacgacccaggcggcagccctggatgcagcaacggtgagcgcgacgcttaacggtgccgcgaccggtctcgcaatcgacacgacagctccgacgctgacggcgcgctcagcgcaagacctcccactgagcggtgcgctgtctgtcaccttcagcgaggccgttgtggcgcacgatccagtgccgccgccgggcgccaacgtcatcgtcaacagaggaccgacggtcacgctctacaagaacaaccgtaacgaccctgcgaccgctatcgagacgttcagtagagggcagtggacgctgaatggcaacacgctgtcggtcacgccgagcgccggcctgcaacccggcacgaactatgtcctggctctcgacaatctcaatctgacggacgcggccggcaacgcgatcgcgacgagcggctcgttcacgatcaatccgaacacgcacagctacgcgcttgtcccgtacgccttctccacggccgcaagcccaccctcgaccggcggaggttcgagcccgtccgatccagcgcccaacctcgtggacggggttcaggtcaacaccggtatgcagaccctcccggacggcagcagcgtgccggtgaccacgatcccggtggttacgggtggccggaccgacaccgacaccgcctcgtccgccgccgacatcccgctggtcacgggcacgggcggggccacatacctcacggcccaggtcccgaccggctacggcctgcaagccctcggtccttcgacctccggtctcaatggcctgatcgcggcgatccagagccgcacggttgccggctcggccgaccaaaccgccctaaccggaagcggctcgggcttcctcggcgcgctcgcagccaacaccaacctgactgtgcgcaccatcgtgccgagcgtagcgcccggcacgacgaccgcaccgaaccagccgttggtaatccagggtcagcccttggcgcaggatgccggccagcagcaggccgtcgtgctcgatgccagccagctgcctgccggcatcacgatcgagctacgcgacatcgacttcgccgccgtcgtcggcgccgtcacggtgcgtgcgccggccgatacggtcgtcgggagcggtagcggcggcctcagcgcggtcggggcgctcacggtcacgcccgatccgctgcgcatctacggagacggcgcggcccagaccttcgtcggtggtgcggccgacgatctgctctccggtggagcgggtaccgacacgctactgggcggcctgggcggtgacctgatctacggcaacctcgacgccgacctgatctacggcaaccagggcgccgatactctgttcggcggccagggtgacgatcgtgccttcggcggccagggcgacgatcgcctgttcggcaaccagggcaacgacatgctgctgggcaatgtcggcgcggacatcgtgtacgggaaccagggcaacgacatcgtctacggcaaccagggggcggacctgctgttcggcggccagggcaacgacgtgctctacggcgggcaggacaacgacacgctggtagggggcatcggtgacgacacgctcgtcggcggactgggggcggacctctaccgcttcgacccgaactccggccgcgacctgatccttggtttcaaccagggcgagggcgaccggatcgcgctcggcggccagacctacacggtcacctcggcgcagaacggtgacgcgctgctcaacctctccggcggcggcgtggtcgatctggctggcatccgggccgatcaggtcaacgcgagctatttcgcagcctag

SEQ ID NO: 10071 - DNA, 81 bp, Methylobacterium sp.
gtgaagctcctcgtcgccgtgctcctgagcaccttcgtctacgcggcgatcctgccccccgccgtgcggttccgtgactga

SEQ ID NO: 10072 - DNA, 195 bp, Methylobacterium sp.
gtgaagagtgcaccatcaaaccccgggatcaaacatgtaatcggcacgatccgcgaccgcgggagcctcggtgccgatgacttctgctgcaacctgccgcgcttcgcagcagagaacctcgcggcgaacgaggcgctgatcgacacgctcgccgccgagaagggcttgacggccgcccagctcgcactcgcctga

SEQ ID NO: 10073 - DNA, 1467 bp, Methylobacterium sp.
gtgcgggagatcgccttcgagatcgacgacgactccggtgcgccggtcttcatccggctcagccgcgccatcatcgcggcgatcgagagcggacggctggagcccggccggaagctgccgggcacgcggacgctggcggctgcgctgaagatccaccgcaacacggtcgacgccgcctaccacgaggcggtcatgcagggctggctggtcgccgagccggcccgcggcaccttcgtcgcccgcgatctgccggagatgccggccgggggcccgccccgtgccgaggcagtgcgcggggcgaaccttcgcagctgcgccgagccggtgacaccggcctgcggcggagcgccgatgctgcacgtctctgacggcgcgcccgatccccggctcctccccggggcggaaatggcccgagccttccggcgggcgctcacggcgccggagttcctgcgatcgggccgtcatgacgatccccatggcgatccacgcgggacgcccgccttacgcgaggcgttgtgcgcgcacctgtccgccgagcgcggcctcgccgcatcgcccggcgagatcctcgtgacgcgcggcagccagatggcgctgttcctcgcggccggtgcgctgctcgggcgggacgcggtcgtcgcggtggaggagccgggctatccgctggccgtcgccgcgttccgggcggccggggcgcgggtcgtcggcgtgccggtcgatgcggacggtctgtccatcgacgatctcgaacggctggcgaaggtggagccggggctgcgcgccgtctacgtgacgccacaccaccagtacccgaccacggtgacgctcggcgcgggccgccgcatccggctcctggacctcgcccgccgccacggtctgacgatcatcgaggacgactacgaccacgcctaccgcttcgacggccggccggtcctgccgctcgcgtcgcgcgcgggcgacgtgccggtggtccatgtcggctccctgtcgaaggtgctcgcccccggccttcgcctcggctacgcgaccggaccggccgggctgctcgcgcggatggccgccgaccggcgggcgatcgaccggcagggcgacgttccgccggagcacgcggttgccctcctcctgcgcgagggcgacctcggccgccacgcgcgcaagacgcgccggatctatcgggcgcggcgggaccgactggcggacctcttatgggacgcgctgggcgaccgactgaccttcgacgtgcccgccggcgggctggcgctctgggcgcggctcggaccggggctcgacgccgcgcgctggagcgaggctgcgcgccgtctcggcctcgcggtcacgcccggctccgcccactgcctgaacgctgtgaccgcggcgcaggccttccggctcggcttcgcggatctctgcgacgatgacctgcgaaggatggtcgcgcttctcggccgtgcctacccgacgcgctga

SEQ ID NO: 10074 - DNA, 345 bp, Methylobacterium sp.
gtgcacaactgtctcgacttcagcttccggcgcatcgagccgggctggccgttccgcgaggcggggcgggactatctcctcgccgtggacggcaatatgcaggcgaacaacggcgagacgctggtgcaactggcgctggccggcgtcggcatcacgcgggtgggcaacttccacatcaccgaggaactggcgacggggcggctcgtgccgctgctcgacgcgttcaaccccggcgaccgcgaggcgatccacgcggtgttcgtcggcggggcggcgatgccggcccgggtgcgcgtgctcgtcgacttcctcgccgagcacatgcgtggcaacaccggctggtag

SEQ ID NO: 10075 - DNA, 609 bp, Methylobacterium sp.
atgcgcgacgcgatgcaactcgtccccatggtcgtcgagcaatcgagccgcggggagcgctccttcgacatctactcccgcctcctgcgcgaacgcatcgtcttcctcaatggggaagtgaacgacacggtctcggcgctggtgtgcgcgcaactcctgttcctggaggcggagaacccgacgcggccgatccacctctacatcaactcgccgggcggcgtcgtgacgagcggcttggccatgtacgataccatgcgccacatccgcgcgccggtgcatacgctgtgcatggggacggcctactcgatgggttcgttcctgctcatggccggcgagccgggggagcgggcggcacttcccaacgccagcatcctcgtccaccagccctcggggggcttcaaggggcaggcctccgacatcctcatccacgccgaggagacgcagcggaccaagcagcgcatgacgcgtctctacgccgcgcattgcgggcggtcctacgaggcgttcgagcgcgcgatggaccgcgaccgcttcatgagcgcggaggaggcgctcgactggggcctcatcgaccgtatcctcccaccacggacaggcgccctcgcatag

SEQ ID NO: 10076 - DNA, 357 bp, Methylobacterium sp.
gtgagcgacgcgggaagcgacgagttcggccacgacatcgagcaggcctacgagttgaacgagccgcccgagaaggtctggcgcgcgctcagtatcccggcgctgcgggagcattggctgcccggggcggcgctggtcgcacccgaaccgaccgccgtcacgtccgagcatgaggtcagctaccggatgcgcgaggctgccccgccgtaccttgagagcacggtgacgttccgcatcaccccgaacggcacgggcggtacctgcctgcggatcatccacgaactgacggacgcccggttcgcacacctgacgaaggtcgccgcgaacggcaacgtctccctgctacgcgccgcctga

SEQ ID NO: 10077 - DNA, 114 bp, Methylobacterium sp.
gtgcgccagaccacggggctgaatgtggacgagggcgtcgtccgggcgatctacatcgtgcgcaatcccgagaagctgcgccatctcgtggccacgtccgagcattctacgtaa

SEQ ID NO: 10078 - DNA, 654 bp, Methylobacterium sp.
atgctggggtcggtcgccgacgcgcaggacgccgtgcaggacgcgtacctgcgctggcacggcctgctccacgccgggatcgagaagcccgaggccttcctgatccgcatcgtcacccggctctgcctcgaccgcctgcgcgccgcgcgccgcacccgcgagacctacatcgggccctggttgcccgagccggtcttcgaggccgcgccggacgaggcgggcgaggacgtctcgctcgtgctgatgctggcgttggagcggctgtctccgctggagcgcgcggcgttcctgctgcacgacgtcttcgggctcggcttcgaggcgatctccgccgccctcgaccgcgaggcggcggcctgtcggcaactcgcctcccgtgcgcggcggcacgtgcgcgcggcgcgcccgcgcttccccgtcacgcccgaggcgggcgcgcggatcgcgcaggccttcttcgaggcctcgcgccgggacgacgcgagcggcctgcaacgcctgctcgccgcggacgtggtcgcctacacggacggcggcggcctgcgctcggcggcgctcaacccgatcctcgggcgcgagcgcgtgacggcaatgttccacgggctggcgcgcaagatcggcttcgtgcggccgccactgctgcaccggggctga

SEQ ID NO: 10079 - DNA, 711 bp, Methylobacterium sp.
atgaagctccctggactggtgcgcctgctggcagaggacgacgaacgcggcgagcccgcgatagctcacatcgcacgggttatccgcgaggccggtcatctgccgacgacgaagagggggcgaggagcctccgacatgggcgtccttgaagctgcgaacctgcttattgccgccaatgccacggatgtgccgagcaaggtcagcgagaccatcgagacgttccgtaagctgaggcaggtccccatacgaaaaagcgaggggggcatcacgatcgactcttcgagttggtggaagaagctctcatcatgcacgaatttcggtgacgctcttgaggtcctcatcgctcaaagcgagaatgaccgagaagacgtctgccaagcgtttaatctatcacttggcgctaatcggccgtctgatttgctaacattccgcgcagtgagatttggctggcctgaagctacagcctcgatcctgctcaacgtcgcgaacgccgagcctttccgagatggcctgcagccagatgcggacctgagcggcaagcgcttcgagatccgctttgccctaacggaggccgatcgcctcttcctcaaggatcagaagccgtccggtcgcatccacgaggtgactgtccgggacagcgtgatccgccgcctctccgacgcctgcgccgccgcatcgaccgacgcgcccgataaggaggcggtcgcctga

SEQ ID NO: 10080 - DNA, 279 bp, Methylobacterium sp.
atgggcgacgtcatcaccttccggccccgcccgcgtcctgctcggcccgccgtgcggcaccaccgcgctcgcattgagggggccgtcgcccatgcccttgatgtggtcgacgagctgatagccgttctcgacggcctggatgcgcccagcgtggatctcgtgcctgacgcggacctcgaggacggcggcgatgccgagccgtccttagccgctccgatcggtggtccgtctcagcgtgtctgggcggcaggcggaagccaggatctcgagcgcgaatga

SEQ ID NO: 10081 - DNA, 423 bp, Methylobacterium sp.
gtgaaggcgcgagcgaccgaggttctccaggcaaaatcgccgagtggctcgctcatcgagcacctgccggcagcgcgggacctcgcggacgtggtgagcctgtcagagctgtcgctctggcggcttcgagccgtgttccgcatcatcagccacttcaccgacgcagctgatgccatgtgctgccaacctcgctgcgaggtcactcagggcgagctcaacgacgttggcaagttcgtcgagtggcacgccgagctctggggacgcctcgccgatcggcttatagaggaggccagcaatcgcatcccagccgatcaggacgaggccgaggatcgcctcaagatcctgatggagcgggcgctcatcgattgcgagtacagcttcctcgctgaggctgtgcatggcctgcgcatgatggcgtcctga

SEQ ID NO: 10082 - DNA, 504 bp, Methylobacterium sp.
atgtccgatgagttcggagctatgttcgaccgcgtgcagcaggagcgcgtggacgcggcgaagaaggagcgggaggcggcagacgaagctcggtcgcaggcccggcgggacttcgacatgaaggctgcgtgcttgacgaatgtcgtgctgccgacgcttgaggaagctaaggcgggcttcgcgaataaagggttagaagtccggtttgtgaccaacgcaactgcgcccaacgtcgccaactatgtagacccgacggtgcgatttcacttcgcaaagccgcagggcagcacccttgcgctcaatgttgacgccagcgtgatctatactattaccgtcacgcacacgcagggcggcgtacagattcatcgcgagagtaagaaccaccatcagaccatcacgcgcagcgacctgagcaagcagttcggcgttggtgtggccgaccagctgacgcgcgatcaggtcatgaaggtgatcgagtcggcatttcgcgacgctacccgctaa

SEQ ID NO: 10083 - DNA, 207 bp, Methylobacterium sp.
atggcggcagtcaacgtctgcaaagcgaacatcacgcaggagaacaagaaggttctctacgcgaagatgcttcgttcatatgagacgccctctcaagtcgcctacagcgtcggcgtcgaggtgagcgccttgaacaagatgccggctgcggaccgggaagccatgtgcacggccatcaacgatcggatcaaggccggcatcgagtag

SEQ ID NO: 10084 - DNA, 276 bp, Methylobacterium sp.
atgggcaacacggccggcaccgtcgagagcgtcgcggatctggggccctactggcgcgctgcgctccgggcagcgtcgcagcatgtggacgagcaggttgccggcacggcgatgctgctcacggccgtgcaacggctcaaggccggcatgggcgtagagggtgccgccaacttcctggagatcctgtcccgcgccgtgcgcgacggcgagatggtctccatcgcgatcggcgacgtgacgctgaacctgaaggacgacggggtgcggacgcagtag

SEQ ID NO: 10085 - DNA, 2589 bp, Methylobacterium sp.
atggcggccggcctgaagaaggccgccgatcaggccgacgcgctcacccggctctcggccaagggcggcacgggcaagcttgccgccgacctgcgcaacctcggcgcctccgcctcgcagatcgacgccgtgaccgccgcgatgaagcggtacgcggcgcagaatatgatcccggccaaccgcgccgactggaccaaggtccaggcgagccagatgcggacctgggagcagagcactgtcgccagcctcaagcacgtcatcgcggccgagcgcgaggcggcgcgggccgctcaggacttcgcctccgcgcagctcgccgccgcggtgaaggcgggcgaggcctcccggaagcagcggcaggccgcgctggagcaggccaaggcgcaccgcgaggcgatccgcgagcgccgccgggacgcggccgccaccatcgcctccggtgccgccgtcatggccgcgcacaagggcaagaagatcggcctcgatgcggtcagctcggccgcctccttcgacatcgccgtgcgcaagcagcgcgagttcaccgacatcagcgcccagatccaggccgggttgctggcgcaggccaagcgcgtcgggcaggagacccagttcagcaacgaggatgtggtcaaggcgcagaccgcctcgatgcagggcctgccagcgaacttcacccccgagctacgggccgccgtcgccgagggcatcgtcgacaacgtgcgcaacttcgcgaccctgatggagaccgacctgaaggagggcgcggagatcatccgcggctacctccagcagtccggcaaggatatctcgaccaagcagaaggcgctcgccgaggcgaaccgcgccaccaaccagctcgtgaagatggccaagctcggcggcatgtcgggcgaggacgtgggccagttcgtgaagctcgccatgtcgtcgggcaccaccgcggggctgacgacggacagcctcatgtccctggcggcgctggccaagcgcggcggcctgcgaggcgacgaggcgggcaccttcgtgaagacctcggccggcaagctggtcagcccgacgaagaagggtctggccgccttcaacgcggccggtgtcgagcattcccgcttcgtgaagatgccggaccgcctcagcacctcggcgctcgaggggcagttccggatggagatgggcaagggcttcacgcccggcatccggaagcgcctggacgcgatcaacggcgacaagaccctgctggcggatcagagccggtatatcgcggccgtcacctccgccgtcgagccgatcctgggcaagaagaagaacggccaggtccgggcctcggaccggcaggtcgccgcgaaggcggccgggaactaccacaaggtggccgcccagagcgtcgacgtggaaggcctgctcgacgcgctgatgaaggccaacccgacgctggcccagctcaacgcgatcttcacgggcgcgcacggcggcaagggcgcgatcacgcagcggcagtgggacgagttcaaggcttcccgcgaggagatccacaagagcggcgacgatccggattacgctgccaagaaggcccgcgaggtgatggctggcttgggcgggtcgatcgagaacctgaagggctcgttcgacaacctcgtgctctcgatcggcaccgcgaacgaggggcttatcaagttctccgccgacagccttgggaacctggtcgacaagttctccaagctcgatcagggcacgcagcaagcgctcagcctgggcgcgggcggcgcggcgctggcgggcggggcttacggtgccttcaacctgaccaaggcccttctcggcttcgggacgtccagtgccgccctcaccggatcggccgcggcactcgacgcctccgccgccgccctgaccgcagcggccgcgaagttggcgggcggcagcgccgtcggcgatctggccggcggggcaacgaagggcaaggcaggtgccgccgggcgtctcgccaagatgggtccgcttggcttccttggctgggctggcgtcggcgcgggcgcgatgatcggcaccggcctgctgcttgattccttcgatgagcaccggcaccgaggcaacggctaccgcggcgactcgcggcggcgtgccccgacgctcggcctcgacacgctccctcagggatggggcgccggtggggtcgacgtgtcgaagggcctcgggggcggggtgggtccctacacgaccaaccgggagaagacctggggcgagtggttcttcggccggccgacgcatcgcggcgggtccgacccgacccgcatgaccctgccgctgccggcaggcatgcagggcggggccgccgcgccgactgtggcgccgaagaccgacacgaccgcgttccaggccttggagcagaagatgggcgaggtgaaggacaaggccagcgaactcaacggcatgtccatcgcgatcccggccagttcgagcggtctcggcacgatcattcagcagatggaacggatcatcagcctgggtccgcaggtcaacgccgtcatgaacgcgggcgccggcaatactggtaaggtcgctcagaccctgcagaacatgcgcacgactgcatag

SEQ ID NO: 10086 - DNA, 87 bp, Methylobacterium sp.
atggcagagctcgacgcgatgccatgggacgagttctgcgccgagtggatcgaggctgagagcgtgagccggcagcatggcaactag

SEQ ID NO: 10087 - DNA, 513 bp, Methylobacterium sp.
atgccgcgcagcaagccgctcggctggccgaagctgatggtggcgcgccgcctcgcgggcggcgccacgggctactattgggggccgccgacgtgggcgatgaaggccggatgcacggttggccgggaagcgctcggcacggactatgccgaggcgaagcgccgatgcgatgacgtgctcaacccgcagttcgatgcgtggcgaacgcgggacgagggccgcaccttcgacgcggtgacggtcaagcgcctcaccgtggccgaggtccgcgcgctcaccgccgcccagcgcgcggctgaggagaaggacccggacgcctcgctgcccttcccgatcttcgtggacgacgagggtgcgccgatcccgcagacggtgatggacgccatgctcgacgacgacatggtggcgctggagcgtgcggccgacgatttttttcccgcccggttccgggcgagccccgccgcttcgtccccggcctctggcgccgataccgggcagacatccgacgcgtga

SEQ ID NO: 10088 - DNA, 183 bp, Methylobacterium sp.
atgtccgaggcccgtgccttcgtagcgacgagatcggtcttcggtctgggcccaatcgatttcggcatgttcatgtcgtctccgcttcgctgtggtgcgaaacgcctaagcttgagggcggatatgtggcgcaggttgtacatccggctaggcatgctgggggtgcagcatgagtggacctga

SEQ ID NO: 10089 - DNA, 96 bp, Methylobacterium sp.
gtgcccctgctcgaagccctgatcctcgtcaccccgctgtgcgtgggctgtaccttctgggtcgctggccgcatctacacgggggagggctactga

SEQ ID NO: 10090 - DNA, 165 bp, Methylobacterium sp.
atgggctcgctcctcgccatgatcgtaggcgttgtcaccttcactgccgagacgggcgtggaagttgtcagggtagctcttgttcatccgatccttcagcagggcggacgcggcgttgtatttttgctcgaagtcacggccagggtaagggccgcgccccgatga

SEQ ID NO: 10091 - DNA, 243 bp, Methylobacterium sp.
gtgaccgcgcccgacaacgagcgtcggcgtctcgccgcagagtacctgcgtggccgcaagctggaagaggccctggccgcgtggcgctcggactacgacgcgccgacctactgggagcgacggccacagctcgcccggctcagcaacgtgatccggcggctcgctgacgaggccgtggcgcaagatgatgaggcggccgaccgcccccggggcagcgggcacgaaaatacccgccgcggctga

SEQ ID NO: 10092 - DNA, 96 bp, Methylobacterium sp.
atgttcgcccgccgcacacgcctgagcctcgccatcgcgatcggctcgaccctcatgctgacgaccgtcgcggccgtggcgttgtgcatgccgtga

SEQ ID NO: 10093 - DNA, 279 bp, Methylobacterium sp.
atgtaccgccgtcgtctctcagagcagcagttcgcggacgagcttgaagatctagaggtcacgcatcgtcagagcgttgggtccgctcacatcatcgcgggcgagagcccaagccgtggtgccctcatgctgatccagaccatcaacgccttcgcggcgatgtacgaactgccagagggcgacgagcccgactacgagccctcgccggcagaggtacaggctcaccgtgagcgtctgttcgcattcgtggctggtctggaagccgagctgcgtccttga

SEQ ID NO: 10094 - DNA, 387 bp, Methylobacterium sp.
ttggggcccgtcgagtgggcgcgcctgtccccggaggcgttcgctgccgagaggtcggccttcggcgcgtggctcgccatcgacggccccatgcagcgccagtaccggaggcgggcacgcgcctacgtcgctgcgcgcaaggtggtcttggagatgcggatgaacgatgtcgagttgttgccggtcgagttcggccgccgcgtgtccccgttcctcgaagcgccgatcgatcgttcgcagggccggcagcttctgaagcagtcgctggccctcgagtgcgagggtgggccctggccggcggtgacagcgagcgcggaaccctctcggcaggcggagtgggaggctaactatcaggaaaatcaggcgaaagcggctggccggacgtga

SEQ ID NO: 10095 - DNA, 339 bp, Methylobacterium sp.
atggcgacgatccgcggcctgatcttcgcggcgctcaagggcgtcgagccggacagcaagcgggcgctcgccatcgccgactatctggcgaccgagtaccgccgccacccgcaggcccagcacatctacagcctgcggctagagggcccgccccggctgctgccgccgacggtctcgaaggtcacgcacggcgagcacctctgggtgagcattacccataccccgcgccgcgatccgacggtaatcgccgagcgggcgatcttcaggtcggcccaggagttcgcagcccacctccactacggcgttcggaaagcgcgcatgcgcaaaggtggggcttga

SEQ ID NO: 10096 - DNA, 264 bp, Methylobacterium sp.
ttggcgctcgccgccctcatcggtgccgcgacgccggcccacgcggtcgatcgcaacgagacgatggccctaatgatggcggtcgccaccttcaacgagaaaaactgcccgggcatccagcccaaccggcagttcatcgccgacacgttcaatgagttcggggtcaagaccgagaacatggcccgccagccctatctcggcacgatcatcagcaccctcaacgccttcgagtccaacaagccatacttctgcgaatcaaactga

SEQ ID NO: 10097 - DNA, 351 bp, Methylobacterium sp.
atgagcgaaagtgacgacgccttcaccaacgagcagttgaccgaactggcgcttatgcaggcggagagtacagcgcaggtcgggaaggcgttggaggcaacggcccatcaggcccttgcggggctggtgatgaacgcgctcctgctgcatgaactggagcgtctcggcttcgtggactgcgaggccctgagagccgaggctgtacagcgggctctgtcgatccagcctccgcaggtgggcgccagcgtcgccagggtcattcagaccatctttgacgggaagcccccggccgcttggtcgggcgcagatctcacttccgtcaacgacgacttaccggacgcgaagcactga

SEQ ID NO: 10098 - DNA, 267 bp, Methylobacterium sp.
atgtgcgggcactgcctgcgcgtcgacgccgccgtcgccttgggcttgctccttgcttcgtccgtcgcggccctggacgcctcggcgacgctgtgccgggcgttcgcccgcgagcgctgcgcatgctgccatgcggtcgactcccgcggggcgagcctcacacgcgagaccccgcccttccacttgttggccccacgcttccccatcgacgacatcgccgacgtcctagtcggggggaacgggccgccggcatgccgctatgcctga

SEQ ID NO: 10099 - DNA, 171 bp, Methylobacterium sp.
atgcccgaacgtccccacgtcgcgtccaggccgttacgcccggaggaccgcagcttcctgtcgagccccttggcggacgggagcggaaagccggacgaccagggcgtccccctggcggtctcggtcctcgtcatcgcggtggtcctgctcatcgtgagcgccatgggctga

SEQ ID NO: 10100 - DNA, 108 bp, Methylobacterium sp.
atggtgaaggcggcctcggccacgaggtggctcgcgaacccgccgtcgcgcgtgcagccggtgaagccgggcgcatcgcagaggttctcccagccggtctcgcagtag

SEQ ID NO: 10101 - DNA, 234 bp, Methylobacterium sp.
atggccgtgacggactgcagggtcgtgggtccagtcctggtgatgacgggtgtctcgcctcggtacggcgagatggtccttgtgcagagcttcgacgacctgtctgcaatttacgagcggcccgagggcgacgagcccaactacgaatcgcccgaagccggcgaagcgcaccgcgaaatgctcgctcggcttctagctgagttcgcagatccactcccggcccccgtcgggtag

SEQ ID NO: 10102 - DNA, 387 bp, Methylobacterium sp.
ttggacctgggtggcggtgagatctggcaggcagtcgccgagcctgcagagatgaccggcgaccaaggcgtccaagtgacgatcacggcgcaagtcaatgcccccgtgacggtcgggcggctcgcgtccgtcgtcaacgaggcggtgcgggacgaggagggcccgcgcggcgagggcctccatctcgatctgcacgggatgcgacaggtcgaggacgaggatctcgcccgggccgacgctgtcgacctgatctccgtcgacacggcgggcgcggccgtggagcggggtccagagcacgagatggtcgagcgcttgcgccctagcctgctccggggtgcctatcgcgcgtcaagcctcatgcggctctgtgcacatggtcgaaggtga

SEQ ID NO: 10103 - DNA, 360 bp, Methylobacterium sp.
gtgcgccgctacatcgagagcaacctcgccacggtcgatgcgccgacgctgatgagccgcttcggcctgtcgcgcacgccgctctatcagctgttctccgaatgcggcggtctctacgcctacatccgccagcgtcggctcgccgaggcgatgcggcggctgcggcaggtgcccgcgggccggcggccggagctggcccggctcgctcacgcctgcggcttccacaaccagacggtcttcgcccgcgcctttcggcgccgctacggtctcaaccccagcgaggtcgcgatcggtgagctcgtgcccgctggcgtgaacgctgccgatccgaccctgctcgcctggctccgtgagctgtga

SEQ ID NO: 10104 - DNA, 402 bp, Methylobacterium sp.
atgcaggaaatcgatctcggaaagatcggtcaatggattgtcgggaacggtccgttcgatggtcagtgggccccaaccgatttcacggccgccgaggggcgctacccgtgcgcccaaaccggcggcgaggatctgggcgccgaggcagattcccaatgtagcgcgatcaaggagggcacgtttgcgaacggcttccgtctcacccgccatgaaggtaagtcggtgatctcccacatcgtaaggaccaccaagtacgaccagcagatcggggcttacggcatcgaagaggtcgaagttggcggttacggcatccagatagctgacgtcgtatccatgcttcagcagcagtggctcgagaacgccgagatcctgataagaggcatgcctgatcgcaacgactga

SEQ ID NO: 10105 - DNA, 171 bp, Methylobacterium sp.
atgtgggcgatgggtttcgtggtcgagggcgcgcactattacacctacgtactgccgtgccccttctcgaactcgagatccttgcgcgacgcggctttcgcggcgcggagcatgctgaagaccgctgccatgcggtccaacagggaaatgactgccaccgacttcggttga

SEQ ID NO: 10106 - DNA, 1893 bp, Methylobacterium sp.
atgaaaatcgtgatcctcgacagccttcccgatgacctgctcaccgttttgctggccgacaatgtcgtctaccggcctgatctacggcttaaaggatcgaaagcgcaggtggaagcactgcactggctgaaggctgacgccgtcgtctgcaccagcgaattggatcctgccgggctgtccgcctggcggccgggagcctgcaaggatgtggcctgcttggatctcgacgtcgggcgttcgggcacggcggtggagatcgaggaggtggaacctgggttgtggcggacgacggtccgctgcggcgatctccgcagtggatatatccgggccttcgagacgctcgaacacctctccctcacgcgcatggtcgcgaatgaaacgccgatccccagaagctccaaaattctcgcccgacgagacgtggtactggttggcgccggattggtgaacctagtcacggcgtatcaactctccagatccggatggatcgtacgggtcatcgatgccgcgccggacccatcgacggaggcgccctggctcagtttcggatgcagccgaggtggcgatgacgcgcggatgttcaccctgtccgagatggacaactacaatgaccgggcgttgtccctcaacatgaacagctactttagcaaggacgtagcttcgctggggtgggctgcatcgcggattggaagcttctctcagtccgagaacgattggatatccgactacgagtccgttcccatctggctcgcagaccgctacaatgatgacatctttgcgttcacgcgcgacagcagaaaccgctgggaccgctggatccgcgacgagccagatctattctccagttgcgaaacacgctccggcatcttgcgagtctactcagacccggatcatttccgatctgcggtcgcacgacaggaacgtatcggggcggtgatgcaggtctactcacccgatgaggtagccgtcttcgagccagccttgcgggcccccgcggcatccggcgcgatcgctggcggcatcctcgtcgtcggtttcaccgtgaacgcacataagttcatggcgcagttgatttcccgcatgatcgatctcggcgtgagcttcgagtgggaaaccaaagttcgagccgttctgaccgacgagacgggatgcgtctggggactggactgcggcgaaaagacggtcgaagcttccaacttcgtggtttctccaggagcctacgctggcgaactcctgaacggaacgcggtgctcgggccgcatccacggcgttctgggagcgtggctacgcttgccgaatatcgagccacggttggagcacagcctcaagctcgcgagaagaggtcacgtcaccgaagacgccaacgtcacggtcgcgaccgacgtccacggtcgtcccatcatgatcatcggctccggctatgggcatacgggcatcgacccgacgaatgtcgacgaaggatttctgcgaaggatatacaacgggctgaccgacacggcgcaaacgtatttcccggaggcttacgcggcctgcaaggatggcggctcgatcgaagcgagcttgaagtactgcgtgcgtccttggacgtccaatggtctgggcttgttcgagattcgtcccgttcagggcggcggcaagttcgtcgtcacgggtggccacaacactgggggatttgcccagtcgccgacgatctcggacgccgtggcggctgccctggccggtacccaacacgatatgcacatcctgtatcatcccgatcgcggcatcagcttcctcgaaagagtccgctccagagactggtgctcgaccatgagttcgatcggcacacccgataaggcggtcgagccgtcacatctctgggatgccgtcgtccgcgacgtcgcgctttcgtag

SEQ ID NO: 10107 - DNA, 243 bp, Methylobacterium sp.
atgcgtaagtccttctattcacacacatcccgccgcattgcgcgccgctcggccgaacccggccgcgcggacgggcgacatgcacctggcgcgcgaacgcgtatcgcgcgtcgtcgcacctgtgggatcgatgcacagcccgcgatcctccttgacctgacagaccagccggcggtgctgggcccggagatcgaggcgatcgagcagcatcccgccagcctcgtcgacgacctgctcgactga

SEQ ID NO: 10108 - DNA, 651 bp, Methylobacterium sp.
atgtcccttcggtacctcgacgacggcgtcggcctcgacgggacgttcgtgcttggcttcaggatcaccgacgaacccgccgagaagtggtcggcccgcatgaatgccttcaagaacaaggagaaggcggcgcttttcggcgcggccgcgtgtttgaggacaggtgtgccgggcctcctcaaggccctgggactgccggcggatcggacgatgctgataccggccatctcctcccgcgacgaggtcgcgtcgccggaatcattcatttccatgcttgccgcggcggtcgcgaggtcggcgggcgcccgcttcgatgggcaagccgttcggaagaaggtccatcagccgctccatgggatcttcgccgcggcggggcggaccgccgaactggacaaggcgggctaccaggctgagccccgcgccggcatccgccacttcgtcgtggtcgacgatctcgtgacccgcggcggaaccatgtcgaggatggcgcaggcgctgaagggcgcgaaccccggcgccaccgttcacggcgtcgccctcgggaagacggagcgacgcgcctactgcgggccgaacctcgacaacggccacgtggatcagcactgggaggaggcttggcttcgcggcgaacggaaataccgtgagcggtag

SEQ ID NO: 10109 - DNA, 750 bp, Methylobacterium sp.
atgcgcgtttgcctacaccttcccggacggacaaggatcaccgtcgagcaggccctccaggagtacggacccaatccgcccgtggacgtcttcgcctgccccgtttgcgacggcatcctgtcaatccgggcgcaagcggccctggcgagaacggcacacttcgcgcatgcccgcggcgccgattgcccgaccatcgatgccgccgcggccccgttcgaaaacctccgggcgctcgaccccgatcccgtggctcgcatccagcgacaggcaaggttccgcgcgaactggcgtcggcacttcctgcatctcggttccctggtccccgcgctcgccatcgaggagttcgtcgcccggctggatctgtccctcgaatggaacatctggtcctacgtgggactcaccgacgccgagatacccatcgtccttgcactcctggaccagttctcgcccgacgacgcgatgcaaacccataccgtgaggccccgcgaccactggtatcggttctgggtgagccatggcgcgggggccggagccgattggccctggccggagcagggcgcgaccatctcacgaggccgcttccggtaccgtggcaggggcgtcgccccggctggtgcggacttcatcgaccttgagattgtgccggtttcgggcgccttcctggaagggcccgagccaccgacgctacatgactatcgggagaacgcagtcaacgcctggtttgttaggcatccggccttcggtcgctga

SEQ ID NO: 10110 - DNA, 363 bp, Methylobacterium sp.
atggcacggcaactgctcttggccggtctgtggagcgggtccgccccggtctgcgccatcgacgcgccaatagatctcccggcgatgagggaacgcctcacgcgcttccgcgaatgcgaattcgcggaacggaaccgttggctggcttggccggtcgacgaccggccggaacccggtcgggacggtgtggccgtaacgcccggcctccgggtctgggcctgcgacgaggtggaggtcgacccgtacgcggcggctgcggggcggcctttcgacgccgagttaacgctcagcgacgatgtctcgctgggacgcgccgccgtcgtgttgttgggcctgctcagcgaccgaaggccggatgcctaa

SEQ ID NO: 10111 - DNA, 294 bp, Methylobacterium sp.
atgatggccctgctgcgtgcttggtctcaacgcaggttggatcgggaccggctggtccaggctgacgccagttcgctcgtcgagcggttcggcgaaggcgcctacgacgtcgcgcgcggccgtgtcgtcgagccccgccgagggaccgtcctcgacccggcccggccgactgggcactggacccgcgtcaagcttcggatagccgagatgtctggacgggagatcggcttggataccgcgacccggatggcgatgcgggggtctcatcttgaaaagggtgggggtcggtggtga

SEQ ID NO: 10112 - DNA, 120 bp, Methylobacterium sp.
atggtgggccgctcgcgaaaggtcgtctcggacgtcgtcctgaacgccgtcccgccggcggtcgaccgccttgccgtttcggggcggatcgtgtcaggcgccgtccctgtcgccacctag

SEQ ID NO: 10113 - DNA, 99 bp, Methylobacterium sp.
atgtcgagtagcccgcccatcccggacaggacgaggattgatgccgtggccgagaacgagagcgtgacgtcgatccttgagggtctggaggagccggcg

SEQ ID NO: 10114 - DNA, 432 bp, Methylobacterium sp.
atgaacgacaacagcaccgccttcatcgcgaccgccgccggcctcgtctcggcctacgtctcgaacaaccacgtccaggcgggcgaactgcccgggctgctcgccagcgtgcacggggcgctcgtcgggctcgcgcagcccgcgccggccccggaggcgccggccgagccgctgagcgcggcgcaggtgaagaagtcgatcaccgacgacggcctggtcagcttcatcgacggcaagccgtaccagacgctgaagcggcacctcacgcggcacggcctgaccccggagcagtaccgagcgcggttcggcctccccgcgaactacccgatgactgcaccggcctacggcgcgcggcggtccgagctcgcgaaggccatgggcctcgggcagatcggccggggtgcgcaggtgcagcagcaggcggcggagtag

SEQ ID NO: 10115 - DNA, 249 bp, Methylobacterium sp.
gtgatcggcgacatgcagctccatgccagcccgctcatgaccgaactcatcgaggactggacggaggtgcgctcgccgggtcgcgctgctcgccgccgccggcagggccatcggcagcgcatccgctatgtcgatcgcccgaagcagcaggtgatcgtcttcgggaataggatcatcgcgcatcccgatatcattgagcggctgcgggctcagatcccggagcggtcaccccttcacaggctgttttga

SEQ ID NO: 10116 - DNA, 237 bp, Methylobacterium sp.
atggcatggatccagctcacacaggcgagcggtgggcgtaagacctacgtaaacacggacctgatctatcaggtgacccaggccggtaagacgcggttgcatgtggctgtcgctgccaaagcagatgactccacaccgctctggcctatgcatatcgaagttgccgagagcattgagcaggtgatggagatgatgcacggcgctggcgagaaggtggtcagccgcctcggttcttga

SEQ ID NO: 10117 - DNA, 93 bp, Methylobacterium sp.
atgatgcgcctcgtccatcccggctggctcgccacgctgacgccggcccagatcgagctcttcttctccgcctgctcgcccacggtgcactga

SEQ ID NO: 10118 - DNA, 546 bp, Methylobacterium sp.
atggatcgcgccctcaccttcatcggcaccatcggcacggctttgagcttcctgcctggactctccgaccccgtgagatgggtgatcttcgcctccggcatgacgatcgggttgggcggtctcgcgcacatggcgtgggagagacgactggcgttcgcaggttggcttgatcgccggatgccaggacggctcgtcgcgcctccggccgtcgaaactgagcacgagtttacctcgctctacgaggtaacgaggcaggcctacgagcgcacacggagtaccttcctcggtaatgcggctgaccgtctatcaaacgacagcccactactctggtacgtccatttgcttgatgaccattttccggtcttcggaactcatccgccctcgcggatcatggaacgcttcgacgaggtcggcttcgaatacgaggtcgtcggcgagatgatcatcgcggttgagcagttcggctctcgccgctgggagaacctatcgctacgggcgagcgatgtgccggaagccctcaagtatgttcaggatcgcgccgagtag

SEQ ID NO: 10119 - DNA, 420 bp, Methylobacterium sp.
atgcgcgcggtctggttcggtctcctcggtgcggtgctggcggcgggggcggcgcaggcgaaggcctgcgacctgcagggggcagagctgacggcggacgatgggcggactttccgcgtcgtgcgcatcagcagccatttcgaccgcataaagagcccgaaggtcaacgacctgaaggcagacggctatgtcctcgctgtgattgagggtgctgggcagaagttcgtcctaagccagacctacagcggctggggcatgcccaacaatgccgctcgctcctatgaatacgaagaagacagggcggccaagattggctccgagcgtgcgcgccgagccgagcgagcccgagttgatggcacctttgatgtcctgactggacctctggagggtgtttctctgcgaccaacgcgctgtagctag

SEQ ID NO: 10120 - DNA, 1908 bp, Methylobacterium sp.
atgggccccggccagggccggccgggcctcatcgacctcttggcgaacggcgccggtgcggttgggagaggcatcacaggcctgttcggcggcggcgacgcaggcggcagcttccctgaaagcctgcccgccgaaggcacggacgggtttggagcacccggctacggccccggggatgccctcggctacggcaacggctccttcggcggcttcacgggcacgatggagaccggcggcggccgcggcttcaccggcatgaatgcgggcggcggggtcggacttgggtccttcggatcgggcatcacccaacctggcccggctccggatctttacggcttcaccggcatgaacccgtcgcagggcgtcgggcccggcacgctgggccaactcccggccggcttcgatccggcagcctatctccgggccaacaccgacgtcgcggcggccggcatcgacccggtccagcactacctcaacttcggcatgcaggaagggcgcgcgatcacgcccgagggctggacgcagacgcagggtccacccgcgctgacgccaaccagcggaggcggggccgcggcgcccacgatcggcggcggtcagcccacgtccaccatcggcgcaccgcaggcggtgaacggcctgccgccgggctttgacgcgcaaacctatctggcacttaaccctgacgtggccgctgccggtctcgatgcaggcacgcactaccgagcgttcggagcgcaagaggggcgtgcttatgcacctccgggcggcacctcgacgctcgggccacccgcatcgagcccgaccatcggtccggatggctcggtgagcgtcgtatccacgggcctcgtgccgacacagggcccgccggccaccacgccgacgcaagggcccggcccgacgatcacggcgcgcaccggcaccttcaaccccgctgaatatctggcggcgaacggcgacgtggcggcttccggccagagcgcactcgaccacttccggaactacggcctgaaggagggccgggcgatcgacacgctcggcaatcacttcaacgggcaggcctacctcgcggccaaccaggatgtggccatggccgggatggatccggttgagcacttcctgaagtacggcgcgcaggaagcccgcaccctggcgccgaccgactggacctcgccgctcacggccacgaccaacatcggcaccatcggtgcgcccgcggccacgccgaccatcgggcccgccggcaccacgccaacgatcggcgccccagccctgacgccgacctatgccccgcccgcggccacgccgacgatcggcgccggcagcgccgtgccgacactagggcccggcttcactcagccgagttggtcgcccggcggcggcatcagcaatcccttcggtttctcgggagcgaatgtgggtagcgcgctcggcgccacgccgcagaccttcgcctcggcctacccgctggatacgaacatcgggtacagctccggcggctcgccaggcggcggcggcatctccgactttgggttctccggtgctgacgtgagcgggttcgacgtgaacgcggcggctccgtctgcgggcaccgaagcctattccggtcctggcgcaacggttgacggtccccggaccggaacaggcaagggctcgtcgtcctcggctgccttcctcgctgatcaggctcgcacccgggcctattgggacacccttgcgaagccggcgagcctctacggctacaccaacacgtctactccgccgatcgccgccgcccccgtggtcccgaacctgacgctgacaaacctcaacgccgcgaacgccggcatgggcggcgcgatgctcggcagcggtctaaacctgtcgatcaattccagaccgctcgcgggcgggttcggcttcggcttctag

SEQ ID NO: 10121 - DNA, 276 bp, Methylobacterium sp.
atgtcggcgaacgctgccggcacgcccgcgcctcccggcaacagctcgcacaggacgaacgcgagcgcctcgaggcgcgccgacacgccggcccgtacggcttcggggaacgatcccgacgagaacgaggccgtcgagatcgtcgttcaggacgaggccgaccgaccgagaccgcatatgggcccgtacatgggcccgtacatgggcccgtacatgggcccgtacatgggcccgtacacgggtccgtcccggccgacttcgccgccgcggccgtga

SEQ ID NO: 10122 - DNA, 246 bp, Methylobacterium sp.
atgaccatctccgaactgatcgctcagcttcgcgcggccggcgccaccatcgaggtcatcgagatcgcggtgcgctcgctggaggccgccatggaggccgagcggaccaaggaagccgaccggaaggccaagcaggcagcccgggtccggaagcaccgggacacccgcaaggggggcattaccgtaacgttaccgtcacgcgacggtaattcaccccctgacccctccccggatggtccgccccct

SEQ ID NO: 10123 - DNA, 435 bp, Methylobacterium sp.
atgatgcacggtgaagagcaggcgaaggcgttcgcacaccacaacgtgtccgcccggatggcggcgagcgggggcgccctcctcggcaataccactgcgacggccgccaatcagctcggcggtgagggttcgcgtccgtccctgcgtaccgcgatcgagaacgcgtacaccgcccagaagcgcctcgacgagacgcattcctacgtgtcgagcctcgccgactcggccgaagcgctcgcgcagcgcatcagcgggccgtacccgaccgaggccagccccaagacgacggacagtgctcagagagccgccccgcagtccaccgtccaggcggtgaaccacgccctcgacagcgtgcacggcagcatctccagcctcggcagcccgatcgaacgcctctcgcgcgccctcggcgtgatcgagcgcgccgtcggctga

SEQ ID NO: 10124 - DNA, 384 bp, Methylobacterium sp.
atgtccacgtccctcgcccgcgccgcacgcgcggtcaccatcgccgcgtccgacgctcgcgccgaggcggcgcgcacggatcacctcgtgcacgtggcccgggagcacgccggcaaggacatgtgcggcctggccgaggccgtgcgcgaccacgctgagggcgtgagtgaggcggccgcctgggtggcgcgctgcgctgtactggaaggcctgcccgaactggtcgccgcgatcgaggcgggcgctgacgtgtgggtcgatggcgctccgctgtccgctgggtcgattgtcgttcgcccggatgcggatcgtgccggcctgctgccgacgctgaaggcgtgggcgcggcgcgggcgtggcctgctttcgcgcagggccgcctag

SEQ ID NO: 10125 - DNA, 168 bp, Methylobacterium sp.
gtgagcgcccgcccgcacttccgcgtgctgctgcgcgtgcgctggaagctcagcggcgcgacgtggctctggctggtcgaccgcgacgggagcctcctgctgctcgaggctgcccgccggacggctggcggttcgcttctcgtccggttcgcggagccgcttcggtga

SEQ ID NO: 10126 - DNA, 126 bp, Methylobacterium sp.
atgcgcgaactcctcacgctcatcgtgttcgtgctcttcctcggcgtcctgcacgtcgtcgcgaccgcaaagcgcgaagcctcactggggcggctcccggtgctgcacctccggagcgagccgtga

SEQ ID NO: 10127 - DNA, 237 bp, Methylobacterium sp.
atggcggatacgacagagccggatctcgctgcgcgcgtcgcggcaatcgaactgatcctgaaaggatggatcgcggtgtccgagagtgcgacgggcaagatctcggggccgattcgcgctgggatcgacgatgggctcgcagaggcgctggggcacggcacggcagatcccgagcgcgtgaagcagctgcaaacggcggtcgatctgttcttctcaggcatcccgaaggccccctga

SEQ ID NO: 10128 - DNA, 261 bp, Methylobacterium sp.
atggacacgtttcgcgacctcattgccgggtacggcctgagcgatttcgctgctgacatcggcgttcaggagaacaccgcgaagcagatgcggaagcgcgactccgtcgcccctgaatactgggatgcctgggttaagggggccgccgagcggaacctcccaggcatcacgtacgaacgcctcgcgaagattgccgccaacaagcgggtcgtcgcgcaggctgccaacaccgacgccaccgacccgcagagggccgcgtga

SEQ ID NO: 10129 - DNA, 114 bp, Methylobacterium sp.
atgtcaccgctcgccgccgaacttcaaaccctcgccttctacggcctcgccgccctgaccgtcctcggcgccctctgggtcgccggccgcgtcgtcaccggggagggctgctga

SEQ ID NO: 10130 - DNA, 150 bp, Methylobacterium sp.
gtgcgcctgcacgaccgcggcggcgatatcttcgccgtcggctcgatgccgctggcgaccgccgagcgcttcatcgagcagctacaggggcacgtcgcggcggcgaagaagcagggcctgtctgtgatccggtgcgagggctcggcatga

SEQ ID NO: 10131 - DNA, 228 bp, Methylobacterium sp.
atgagtgattgcattcgggagtgggtggatctcacgccagagttcgaggtggcgctcgaggacgcctgcatcgcgaccgagcttcttgctgcagtcattgacgaagaaaccagcggcaacaccgccgcgcagcgtgagttcgctaacgcagcaatgaccgatctgatcgaggcgcttcgcgacgtagaaccctgcgaagagaaagcccgccttgccctaagggggtga

SEQ ID NO: 10132 - DNA, 279 bp, Methylobacterium sp.
atgccgcgggagaagaagacgctgagcgaactcgaggagatgctcctcgcgaggttgcgcgaactgccgaacggcgaactcgtcgagggagtgaacatcgtgctgtcggatcgcgaggacggcgatccgggcgtcggtgtcttttggagcgaaaccagcgcgaccatgcgcccgctggttggtcacgcaatcgcgtacggtagcgtgctggtccggcaataccaggtcatagacgacccgaacgatgaggcgctgccccacgcgaccagctctgtctga

SEQ ID NO: 10133 - DNA, 144 bp, Methylobacterium sp.
atggccgaaccgccgcgcgcaccccctgccggcctgtccgggatcgaccgcgacggcgcgcgacgccggtcgaaacttctgcgcgcactgctgctgttggcaaccctcgccgctgtcgcctggatcgccttccatctgcgctga

SEQ ID NO: 10134 - DNA, 183 bp, Methylobacterium sp.
ttgaagtcggtgatgcagatgttccagcacccttcggccgcccacctatctgccagcaccatcgcgctgccggcattcacgcgtgtggctccgcgcaaaccggccaccgatgaagccgagatcgtgaagcgcgcaattccgctgaccattgtcgacgctcacgaatgcaagggcgacaactga

SEQ ID NO: 10135 - DNA, 216 bp, Methylobacterium sp.
atggtaggatcggcggaagagcggctcgatgccctgaaccgggaaatcgcagacttggagttgaagcgggatgctcatgtctcgatcatcgcggctttgacggatcaggggctggacaccgctgcggccaaggccgtgcttcagaggattgaggatcagctcgcggcgcttcgggtccgcacagcaaccttcgagggtgacgcgagacacatttga

SEQ ID NO: 10136 - DNA, 255 bp, Methylobacterium sp.
ttggctgtcgagcaccacgtaacccaggctgacatcctgcacctggcgctgaagctcgctcgcaaggccttcctggagcgggcgccgcagcctccccgcagcgcctcaccggtgccagtcgctactggcgcagccctcatcgccatcgccgaacagctcgtcgagctgcaggaagatgcgcgcatgagtgcggcagacgctgaggctcatgccatggctccattcggcaccgatgccttcgaggtgcggccgtga

SEQ ID NO: 10137 - DNA, 1134 bp, Methylobacterium sp.
atgagctttgagaccttccgcaccaccttcccggcccttgtcgagcagcgccttgctcagatctcgctcgatcctgatggaagtggcggcgacatcctggtggccggtgccttgtacaagatggctgcagcagtctcgaagacttcactccagggcgtagcgtccaccgcacttctgtcgagcatgtccgccagccagctgcaggcgtggctccaggcgcctgagaacgtcacggtcttcatctcggccatcagcaatcagggcaccatggcaacggtcgccaggagtcagtcggccatggccacgattgcgggctgtcccgctgctgtcgggctgatcctgggtagtgccaatgcggtggcgcaggtggcgctgagctatgtggcgatcctggccgtgcgcaaccagcctgccgccctggccgccttcgtcgccaacgcccaggcatcgcgcctgctcgcatccagccagatcgccatggacctgcttgcggccagcgccgccgccatgacgacgatcgccgccagctcgaccatgatggcggcgatcgtcgggagcggcgtggccatgacggcggtcttcgggtctgccgaagcggtcagcgtgctcgtgcagtacagccaggcaatgcaggccatggcggcgtccgccactgccatggcgcaggctgccgcgtccgccaccacgatggcggctatcctgggatcgagcacagccctggctgctgtgttcggcagttcgaccgcccgaaccgcgatccatgcatcgaccgtcgccgtggacgcgatccgcgacacgccagcagccatcgcctggctgcgagcgaacaagatgacgaccgccagcgtcaacatcggcggcaccaaccagagcgtgatcacccctgtgatggcgggggtatccaaggccatctcgctttcgatcaagtccggcggcatcagcagcgcctcagtgacctattcgctcaagaccaaaaccgctggctcgaccgaggcggcagtggtgccgctttcgccctcggcaaccaatacggtcgcggcctacaccagctttggggtgacctgcagcattaccatcccggcgaccaaaaacgagaactactaccccgtcatcgaattcgtggcgatggactga

SEQ ID NO: 10138 - DNA, 246 bp, Methylobacterium sp.
atggccgatctgggtgtctgcgtcgtatcgggcgtcgatgggatgacgtacgaggtcaacagccgcatcgatgcggacctgcgcgcgatcctccgcgaagcgcagccggacgatgggttccaggttgcgggctcgctgcgctgggccgacgtccgcgctggcggcaagacctatccgttgcgcgggctgactgccctggccgaggtcatcgccgagtacgccgagcgccgtgaggtgcaggcatga

SEQ ID NO: 10139 - DNA, 234 bp, Methylobacterium sp.
atgcctaacctcctcgaaggccatccagagttcacccgcgagctcatcaacgcggccaggcgcatcgccaaggcccacggccacaccatgcgcaagccgactgggcggatgagcctgcatgagtggggcatgggtttcttcaggctgaccgatgccgccggcaacattatcgccggccctcgacatgagctgacgccgcgcgctgtggcgaagttctacggggagaccctgtga

SEQ ID NO: 10140 - DNA, 186 bp, Methylobacterium sp.
gtggcaacccccaaccctaccgacttgaccacaccaggcacgctcgatgacgaggcgttcgtcgatgcgttctgcgcgattcctgaggctgtcgacggcctctggatgaacaacaacccttcacaggagcagctccagtccgagtacctggttggcgtcttggaagaggactgcggacatgcctaa

SEQ ID NO: 10141 - DNA, 111 bp, Methylobacterium sp.
gtgctcgcctacgccatcgacggcctcgtggcgcaaggcacggtgtacgagaagcagcaggcgctccggctggtgtcggacgcactcaccaagcgaggcatcatcgggtga

SEQ ID NO: 10142 - DNA, 648 bp, Methylobacterium sp.
atgaacctcgacaccgcccctgccgtcgcgaccgccgccctgccgcctacgcccgtgccgtgcctcgacccaaagcccggcctgatcctgctcgggcgcgacgagcgcggcaggccgcacgccagcgccttcggcctcgatgaagcgcccgcggccgaacgggccgccgcgttgatgggcttcgccaccctgatcgtggtcgaggagcatcaggggctggccagcagcctgcccaaggggcgggtcttcgagagcgggcgtgctttcgtgccgttctgctcgacccagaccttcgcccgactgctcgaagcggccgggctgcccgatgcgcccgtgcccgccagggccgctgccaagcccgctgagccgtctccgcccacggccggcagtcagggtggtggagcacctgccggaggcgatggcggggctgccaagccgcccttcggctgggccgacatcaccatcggcagcctcgtgctcgctcggggcgatgacgaggacggctactatgccgcgaccgtggcagccacgaaggcggacaaccacttcgtgctgacgtggcgcgactaccccgacctgcccgagtttagccgccaccgccacgccctcggcctcctgcaccccggcacgccgacgaagggcaagtag

SEQ ID NO: 10143 - DNA, 288 bp, Methylobacterium sp.
atgaaatttcgtccgctgcacgaccgcgtggttctccgtcgcatcgacggcgaggaaaagaccaagggcggcatcatcatccccgatacggtcaaggagaagccgcaagagggcgagatcgtagccgttgggcccggcgctcgtgacgaggcgggcaagatcaacgcgctcgacgtcaaggccggcgaccgcgtcctgttcagcaagtggtccggcaccgaggtcaagatcgacgatcaggagctcctgatcgtgaaggaatccgacatcctgggcgtcgtaggctag

SEQ ID NO: 10144 - DNA, 234 bp, Methylobacterium sp.
atggcggccgctgacgcgctcgttgctactttctcaaagcaaagcggcactcgcgaagagctcgcagggattatcaccgggctgatggatcagtaccgtatctcgcctgatcgggcgcacatgctcatcgaccgcttcggccgggctcagctggctctggagaatgctggagacgagctcatgacaaggaaacagggcgacagcgaaagacaacctagcctcatagcccagtga

SEQ ID NO: 10145 - DNA, 333 bp, Methylobacterium sp.
gtggccgaccaactccggcccaaggtgccgaggctggcggcgctgatggacgcggccgagaccgacgtcctggcgtacatgggcttcccagcggcacaccgggccaagctgcactcgaccaatcggctggagcgcctcaacggcgagatcaagcggcgcaccgaggtcgtcggcatcttccccgacgagccctcgatccgccgcctcgtcggcgcgatcctgctggagcagaacgacgaatgggccgtgcagcgttgccgctacatgaccctggaaagcatcgccccgatcggcgatgatcctctcgtcagcctgccaaacctcgcagtctga

SEQ ID NO: 10146 - DNA, 261 bp, Methylobacterium sp.
atgatggcggtcacctgcgcgacggtcgcggccgtcacgcccgtgccgccgtattcccgcggcacggtgatggcccagagcccggaggcggtgaagcgctcgatctccgcgaagggcagcgcccggtcgatgtcgcgcgcggcggccgtgccggcgaaatccgccgcgagggtccgggcagccgcgagagccgccgcatcgtcggcgagcaccggcaccgggcgcggcggctccggcgccacggtgaaggcgcgctcgtga

SEQ ID NO: 10147 - DNA, 150 bp, Methylobacterium sp.
gtgatcgaagttgtcgaggccgagatcgtaccggtcggcgagttccgcaccatggctgggcggcagcgtgagagttggtatgcggaagccatctacgccgtcgcgtacggtatccttatagccattccaatccgaaacgacgacaggtaa

SEQ ID NO: 10148 - DNA, 153 bp, Methylobacterium sp.
atggccaacgagccccagaagccgtcccaggtggatgctgtgcccggctcgggtacgccgaagccggaaagcccggagccgggaaaggcaccgaaggcttccgaggttgatgcgcagccggacaagcccaaggcggatgaggccaagcagtag

SEQ ID NO: 10149 - DNA, 411 bp, Methylobacterium sp.
atgagcgagatcattgcattcaggaaggtagaagcgccgtcgccccggatcggctcagtggacgtgctgggctcaaacgcggcgagggaagtgttcgcctggcagcgcattctggtgcgtagggctactctgtcaaagctcgcattccgcgtcgggatcgagcttgcccagtcggtggatcgcaagccagggcgtggctacgcggtgcggacgcacgcccagctgatgggcgtgttgcgtgtcaccagccgaagcaagatccaagaggcgatagctcggcttcagcgcctgggctttctgagcgtcgaggtgagccgcggcttgggcatggcgaaccgctatcgcctgacatggccgccccagatcgccctgccggatgcggatggtgacgatgacgtttgcccgttttga

SEQ ID NO: 10150 - DNA, 279 bp, Methylobacterium sp.
atgtccatggaagctgaaatcgccgtcctgcgggccgacctagcacgcacctacgaattgctgaccggcgtcatcaacaccctggcggctcaggtcgcagcatcgcgggccgtgcatgacctgctggacgccgaaggcgtcctgtctcggcatcggctgtgcgagcaggcgcttgcctatgctgagcgtgcgggcttgggcccggaggtggtcgccgtcatgtcctcgatactggcacccaccccgactgccaacgcgtcagccgggctctaccactga

SEQ ID NO: 10151 - DNA, 219 bp, Methylobacterium sp.
atgcccctcttcaattcctcagccatcgaacgcgccgagtacgacgagccgagcagcacgctgcaaatctggttcaccgggagcggaggcccgtacagctactacggcgtgccgcctcacatctatcaaggcttatgcgccgcggcctcgcaggggcagtattatgcagtctatatccgcgacaaatacagcagagatgcgcgcttttatcggaggtaa

SEQ ID NO: 10152 - DNA, 177 bp, Methylobacterium sp.
atgaccacccaaccgaccacgctgcccgaccgggcggcggcgcacgctatcgagcgtgcgcgcctcgacgccctgcgcgcgagcatcgctcaggtgctgagcgctgacctggcccggctgaaccgctgcctggccgctggcacggcccctcaggccactgtgggaggcgcggcatga

SEQ ID NO: 10153 - DNA, 450 bp, Methylobacterium sp.
atgatccggcgtcccatcccgccctgcgagctcacccaggccttccagcaggctggccttgagcccagctaccccgaacatgaggggacgagcccccaggggctcggcaccacctcctgtgcggctgagcaggccgagcttgaggccctggcagccgtcgagtttgaaccctgggacgtgccggacgacgtgctgcccaccaacgctgagtggtccagcatggcgaacccgcacctggcgaccctgcgggcagccacagcggttctgggcatgaccaaggacgagctcatgcagctggccgccgaccccacgtacgatgggctgggggacgacatggccgggaagctgcaccggacggccgagttgatgagctcgtaccgcgtcatggccgaggtggcgcacggccggctgctggcggccatggcggcggcgcagctgagaaccgcgtaa

SEQ ID NO: 10154 - DNA, 156 bp, Methylobacterium sp.
atgaggcagatcgccatcgacgggctgaacactctctccttcctcatccgcggcctagccgcgatcatcgaccagcacccatgggtcggacaggcgattttcttctcgccggtcctgtcagctttgaactggggtccgtatgccttacgatattga

SEQ ID NO: 10155 - DNA, 246 bp, Methylobacterium sp.
atggcagaggacaagcaggccgggaccgagccgaaggtgcctgcggagcgcgccgacctgaaggcgcaaggccagacctcgcccaaaggcgaggacaggcctggcttcgacctaggcggcagcgcggatagggatgcgcagcagggcgcagtgccggacacaggccccgtcagcgacccggagattgggaacgagcagccgaccgaccgcagccagctgaccagcaagaagggaacgccggcctga

SEQ ID NO: 10156 - DNA, 153 bp, Methylobacterium sp.
atggccgacgagccccagaagccgtcccaggtggatgctgtgcccggatcgggcacgccgaagccggaaagcccggagccgggaaaggcaccgaaggcttccgaggttgacgcacagccggacaagcccaaggcggacgacgccaagcagtag

SEQ ID NO: 10157 - DNA, 699 bp, Methylobacterium sp.
atgaccggaccgatcctcatcgtcgacgacgacccgcacatccgcgacgtgatccgcttcgccctcgaaaaggccggctacgcgacggctctcgcccgcgacggcaacgaggcgctcgcccggatcgcggtcgagccgccccggctcatcgtcctcgatgtcggcatgcccggcatggacggcctggagctgtgccgacaggtccgccggacctcggaggtgccgatcctgttcctgtcggcgcgcgacgaggagatcgaccgggttctcgggctggagatcggcggggacgactacgtcaccaagccgttcagcccgcgcgagctggtggcgcgggtcggcagcatcctgcggcgcggcgcggctcgaaccgccgcaacccccgagcctctgttgtcgcatggcggcctgcgcctcgatccggggcgccacgaagcgcgcttcgccggccaggtggtagccgcgaccgcgatcgagttcgcgatcctcgccgcgctcgccgcccgcccggggctggtcctcagccgcgaccagctcatggacgcggcctatggcggccgcgtccatgtctcggaccggaccatcgacagccacgttcggaacatccgcgccaagttcgcggcggccggctgcgccgaggtcgtcgcgacggtgcacggcgtcggcttccgcctcgcggcctgcgagcctcgggcgtga

SEQ ID NO: 10158 - DNA, 1551 bp, Methylobacterium sp.
gtggtgctgggcgtgctcgccatcgtggcgacgctgccgctcgtcggcctgttcttcttccgggtctacgagaacgggctgatccgcgaggccgaggccgagctgatcgcgcagagcgccgtgctggccgcggtagcggcgcgcgagatcgaggccctgcccgagggcgagcggctcctcgggccggtcgtgcgcccgccggaggatccggcggcgcgcgccgcctaccggccgatcgagccgggcctcgatctcaccgcggccgacatccttgagcgccgtccggccgccaccgaacccgcgcgtccgcccgaccaggcggccctcgagatcggcgcacgcctccagcccgtcctgctgcgcacccaggtccacaccctggccggcttccggatcaccgaccggaacggcaccgtgatcgccggccgcagcgaggtgggccggtcgctcgcgcacctgcccgagatcgccgacgcgcttcagggacggttccgggcggtgctgcgccagcgcgtctccgcgcatccgcccccgccgctctactcgatcagccgcggcaccggcgtccgggtcttcaccgcgatgccgatcctggtcggcgaccggatcgggggcgtggtctacgcctcgcgcacgccgagcaacgtggtgcgccacctctacggcgagcgcgccaagctggcgctcgccgccgccgcggtgctcgccgcgacgctcgccatcgcggccctgttctcgcgggcgatcacgcggccgatccacgccctcgtcacccgcagcgccgagatcgcccgcggcaaccgcgccgttctggagcaaccgggcccgctcggcacccgcgagatcgcccgcctcgcgcaggggctcgaccgcatggcccgccagctgcacgagcgctcggactacatcgccaccttcgcggcgcatgtctcgcacgagttgaagacgccgctcaccgcgatccagggagccgccgaactcctgcgggacgcgcagacgagcccggccgacgcgatgagcggcgcggagcaggtccgcttcctcgacaacatcctggccgacacgcggcgtctcaccgccctgctcgggcggctgcgcgaactcgcccgggccgacaatcccgacatccggggaacgacggatctcgccacggtcgtcgccggattgcagcgcgcctgcccagagctcacggtcgcggtggagggcgcccgtgaggagcccttcgcgatgtcggccgagaatgccggcatcgtcttcgcgcacctcgcggacaacgccgtccgccacggcgcggtgacgctccacttggcagcggacctcacgggcggccatctgcgcgtgcgcgtgcaggatgatggcgaggggatcgcgagccagaatcgcgcccgcatcttcgagaccttcttcaccacgcgccgggaggccggtggcacgggcatggggctcgggatcgtccgcgcgatgctgctggcccatggcgggacgatccgcgtgctgccctcggatcacggggccgcgttcgaggtcctggtcccgctccgcgccggctga

SEQ ID NO: 10159 - DNA, 78 bp, Methylobacterium sp.
atgtgcggcatcgtgggaatggtggggcgcgacgcggtcgccgaccagatggtcgaggcgctgcggcggcttgagtac

SEQ ID NO: 10160 - DNA, 150 bp, Methylobacterium sp.
gtgaccgacccggtgagcggagcgctggtcggtctgctgacgggccgcgaccggctgcgggtccgggccgcgaccctgcgcggcgcgggcgaacgccgcgcctgcatcgcccggcccggccgcccacgccggagcggtgcgacgccctga

SEQ ID NO: 10161 - DNA, 90 bp, Methylobacterium sp.
atgagcggaggacgatccgcgatccagcgcgacaacggcccggagcgttcgagcctcgccccctgcatcgagatcgcgccgctggcgtag

SEQ ID NO: 10162 - DNA, 201 bp, Methylobacterium sp.
gtgctccgcgtgcacccgctcggcggcctcggtgaaggtcggaacttcgacgctcaccttgcgccgctcggcaacgggatcgccaccttcacgggccagcttgcggtatccgagcgccttctcccgagcctcagcgaggctgacaaggctgaggccacccaggccgatgtcacggcgccggccctgaacgacggtgcgtag

SEQ ID NO: 10163 - DNA, 450 bp, Methylobacterium sp.
atgatccggcgtcccatcccaccctgcgagctcactcaggccttccagcaggctggccttgagcccagctgccctgaccatgaggggacgagcccccaggggctcggcaccccatcttgtgcagatgagcaggccgagcttgaggccctggcggccgtcgagttcgaaccctgggacgtgccggacgacgtgctgcccaccaacgctgagtggtccagcatggcgaacccgcacctggcgaccctgtgggctgccacagcggttctgggcatgaccaaggacgagctgatgcagctggccgccgatcccgcccatgacggcctgggggacgacatggccagcaagctgcatcggacggccgagttgatgagctcgtaccgcctcatggccgaggtggcgcatggccggctgctggcggccatggcagctgcgcagctgagaaccgcgtag

SEQ ID NO: 10164 - DNA, 270 bp, Methylobacterium sp.
gtggccgcctggttccccgaagaggcccgccgccgccaagcgcggaatcttgccaatcagcgggctgcggccctggtcaggtccaaggctggcgccatggccataagggccatggcggacgccctgatgcggaagggggaaattggagccgatgagatcgaaggcctctgccgtgaggcctacggcggccaacagtgcgagttcggcgcctggaatgcccactggcccccgacgctgggacagctgcgctctggcttcatccctggctga

SEQ ID NO: 10165 - DNA, 237 bp, Methylobacterium sp.
atgaggcggacggttctgttctctgccctcctgctggcggaatgcacgccgcccgagaaggcttactccgcaatgctcaacttctttgaacactttatcgcccgagcgatgaagctcgggcgggctgatctcgatccgttcggcatccttcccgtgatagacgccgtccgagccgcctattcggacactctggtggtgaacggacggcaagtcgaggcgatcgacgcgaaacggtga

SEQ ID NO: 10166 - DNA, 768 bp, Methylobacterium sp.
atggttgatatcccggcgctgcgggccgtgctccccgcttcggtccggatcatcgaggacgcggcgcactgcttcgagggctcgcgcaacggccggcgccccggtcaggacggtgacgccgccatcttttccttctacgcgaccaagaacgtgacctgcggcgagggcggagcggtgatcaccaacgatccggatcttgccgcagcactggttcaaactgttctacacggcatgtcagccggtgccgctcagcgcttccagagtgggacctaccgccactgggacatcgctcgccttgggaccaaggctaacctgccggatctcttggcggccctgctcgagccgcagatcgaccggctcgaggcgcagcttgcgcgccgcgagcagctctgcgggcgctatgaggcggcgctcgccgacacgccctttttgtggccggagatcgaagccggtgtcgtttccgcgcgtcaccttttcccgatccatgtgccagatgggcaacgcgacgcggtgcttcgggtgctgggtgaggccgggatcggtgcaaccgtgaattatcgcagcgtgccttgcctcaccctctatcgatcctctggcgtgccggacctgccgatctcgcgtctctggggtgagggtacgctctcgctgcccctgttcccggacttaacagacggggagcaggacgaggtcattgcggcactgagagcccaggctaacacgatgcgaccgtccaagatggcgcgccatgcagaacccgcgttgccgtga

SEQ ID NO: 10167 - DNA, 699 bp, Methylobacterium sp.
ttgcacccgctgaccgtctacgccgagacctgtgcccgggctgaggaggccgtgctcgcccgaaacagcccctgcttcacgacggcagccctgcgcaacgcgacggtgttcggtctctcgccacggatgcgcttcgatctcgtcgtgaatcagatgactcatgatgctcttgagcacggacgcatcaccatcggaggtgacggcacgcagtggcgccccctcgttcacgtccgggatgttgcgcgggcgatcctgctcgcgatgcgcgcccctcgccgagccatcggtggtcaagcattcaatatcggctgggagaactaccaggtcggcgagatcgcacatgctgtgcagcgtgcggtcacggttccggcacagatcacccatctgccaggggggccggaccgacgcgattaccacgtgagcttcgcaaaggctgagcgcgccctcggcttcagggcgagcctgactgtggaggaggctgtcgtcgagatcgaacgggcgatccggggcaagcgcctgagcaacaccccggcctgctacacggtacattggtataggaggcttctggccgagcggggtcctgggcttcgcctacccgatacggggccgttgcacgtgttgacggaagtgccatccaccgacgcaattatcgcgcgtgatgccgttgctggagcgccggtggcggagcgcgttcaatga

SEQ ID NO: 10168 - DNA, 630 bp, Methylobacterium sp.
ttggacggtgaatgtgacctcgttcttgaggacgagcacacgatagtcttcatcgagtgtaaggcgaagccgattacgcgagcggcgatggcgggcgatgccagcgatgcggtgctggcgtatctcgaagggattgtcgcatctcaggctcaagcgctgcagcatcagtccgtgctcgagaagcatggacgcataactttcggagacggctccgtcctagattggggaggtaggaggatcgtgcgcctgtccatgaccctcttcgactatggcacgttgcaagatcggttggtcttcgcacaactggcgtccacgctcgccaacagcagactgaacgcccgggatccagccgataagtcggcgacccgccgggcaaagaaatcaaaccaaattatcgaaaagcttcgtgagcacctgcagggcgcagagggtcttgatgaggagcttagccgcaagatctgggcacgatcccttcccactgcctccctgtccatcggacaattggcaattctacttgtggaccggaatgccgtgggcaagctagcggatgcactcatgaagccagccagttttgccaccggtagtgtgctgaaggaattctactatatgcgagagcagaaaataatctag

SEQ ID NO: 10169 - DNA, 159 bp, Methylobacterium sp.
ttggagctggtcgctgatcatctgctgatggctcacggccttatcgagcaagatggcgccaaagagatgctgccggtgttgaggcaggctttgatgactgctggcgtgctgctcgcccgaagcacgatgtcgagcgacaccagtgatcgcttccattga

SEQ ID NO: 10170 - DNA, 111 bp, Methylobacterium sp.
gtgacctgcccaccgtccgatcaggatctgagcgccgtgatcgccgtgatctgcttgctggctgggctgatcatcggtggcgcggtcgccgcgcgcgggccgccgggatga

SEQ ID NO: 10171 - DNA, 174 bp, Methylobacterium sp.
atggaccgcgagcgctcggccccgctgacggcggcgatcgacgcctgcaacgcgcgcgccgtagtgccggcccgggcgggcgtactggagaagcgggactggagcccgaaggtcgagatgcggacgccgcgctacacgacccagatgagagagctgccggtcgcggtggcctga

SEQ ID NO: 10172 - DNA, 174 bp, Methylobacterium sp.
ttggacgggaccgatagggcccatctctgcggcgccctggtgatcaccggccggatggccgagaccatcgacgccgaccgcatcggcttcgggaacctcacctactatcggacgcaggtgggcaacccgcacccgcgcctgcgcggcgtctcgatctgggcgttcaagggctga

SEQ ID NO: 10173 - DNA, 183 bp, Methylobacterium sp.
atgcttcgcgctcttggtgatccgcggatcgtccttccgaggcaggctgccgcagcgaccgttcgcacgctggccggccgcccgcccggcccctatccggcggccatggatctcaatgcgctcatcctcatggcctcggccctcaccttctcgggcttcgtcgtgctgctcggctggcgctga

SEQ ID NO: 10174 - DNA, 81 bp, Methylobacterium sp.
atgaatcggaacgccgccttcgatcccgcgggcgtcgcatcgcacggcgcgcgcgcgcggccccgccggaccggcggctga

SEQ ID NO: 10175 - DNA, 87 bp, Methylobacterium sp.
ggcctcgacgccgccgcgatcgtcgccaaggtcaacgaggtcctgcccgagcgccaggacggccgctcgcgcctgcgcctggcttga

SEQ ID NO: 10176 - DNA, 264 bp, Methylobacterium sp.
atgatgacggaggtggacaagctctacttcgcaacgaccggcgagacccatcgcctccgcgatcccttgtgtgatgagatccgccgcgtgcgcatcagacccgtccggttccgccatctgcgaaccatcgtgcgcgccagcgacggcgcctgcatcacggtctgcctcagcaagccagacgatctcggcgactacgcggatttcgagctggccggcgccttcgatgccgacctcgacctcgtggtgggagggcgcagaacatga

SEQ ID NO: 10177 - DNA, 699 bp, Methylobacterium sp.
gtgtccgctgccctggccctcgttcccgcttcccccgatctgtcgcctgcccgtgccgcgctcgtcgccgcattcgccgagcgggaaagcgtgctgcgagcctcagggacgatcgtacaggcccgcgagcgactttccgcagcgctgatcgctcggaccgaagcgcaaggcgccctgaacgctctggcgaccgcagaggccgaggccgtcaccaactggtcattcaccggcaagggccgcgagccgaagcccgacctcggcaagcgccgggatctcgaaggcagactggacgacgcgcgcgtccgcgccgaagccgctcaggccgccgtcgcgaagctcgatgccgctggccaggaaggtgagcgccgcctgcgcgctgccgacgaagcggtctcgctggccctgtccgccgtccttatggaggaggtggaggccgagcttgacgaagccgcacagctcttcgccaaggcccgcgcccgcgtccgcgctgtcacgaagctcgcctgcgaggcgcagaacacctgcgcagaagcgcatcggccccgcgccggaagcctggcgtatcaagcgagcgcgatgctcagccccgctcccgaccaatgggaccgccttggcgactgggctgacacaaagcgcgccgtcgcccagctgattgaggacctccgcaccgagccgactgcaactctttctctggactga

SEQ ID NO: 10178 - DNA, 435 bp, Methylobacterium sp.
atgaacgcgcagatcagcaaagcagacatcgcgaaggcggaagacgcagtggactatcactgcgagggccttcgaggtgcactgttcaagctcaagtggattgacgggcagagcgtcgaggacaagcgcgccgatatgcgcaaggtcttcgagcgcttctccgaaaacctgctgcgggagatgccggacagtgcgaccgcgcagacgcccgagcccacatcgaaggccgcagcgccgaagccggagacgaagaaggacgagccgacctccccggtcgatcgcctcacgaaggtggtcggcgaggtgctgagggccgatccgaagctgagcgccgagcaggcggtgacgaaggctttcgaggccgacccggcagcctacgacgcgatcgagaccgagcgacaggcgatgatccgccgtcgcggcgtttcggagtga

SEQ ID NO: 10179 - DNA, 1332 bp, Methylobacterium sp.
atgaccaaccttgcgacccttgccctcgaatttgcggatgacttggaccgcgactggcgcaccaaggcgcgaccggagcagttgccgccgccgggcgactggctgacttggctggtgctcgccggtcgtggcttcggcaagacccgcaccggtgccgagtgggtgcaggaacaggccatgtcgggccatgtcgggcgcatcgcccttatcgctcccactgcggccgacgcccgagacgtgatgatcgaaggcgacagcgggttgctggccattgccccgaacaggtgccgacctgagtatcaaccggcgctgcggcgcctcacctggccgaacggcgccattgcgacggcgttctcggctgaggagcccgaccgccttcgcggcccgcagcatggcgccatgtggggcgacgagctggcggcttgggtcaacgcgcaggcggtctgggatcaggcacagttcgggcttcggcttggccggcacccgcgcgccctggtgacgacgacgccgcgcccgatcccgctcatccgtgccctgctcaccgacccgcacacggtcgtcacccgcggcaagaccagagacaacatcgcgaacctcgcgcccagccgggtcaaggcgatgtacgaccggtacgagggcacccgcctcggccgccaggaacttgagggcgaggtgctgaccgacacgcccggcgccctttggaagctggaggacatcgacggggctcggatcaagcctgagcaggtgccgacgctcgtgcgtgtcgtggtggcgattgatccggctgtctcgacccgcgatggctcgaacgagacgggcatcgtcgctgcaggggtcgatgcgggcggccacttctacgtgcttgaggacgcctccgggatcctgacccccgatggatgggggcggcgtgcggtggacctgtacgccttccgccgggcagaccgcatcatcggcgaggcgaacaacggcggcgacctgatcgaggcgacggtgcgcaacgtcgatcagaacgcagcttttcggaaggtccacgcctcacgcggcaaagcaacacgcgccgagcctgtggccgctctctacgagcagggccgagtccatcacgcgggccaattcacacggctcgaggatcagttgacggcattcacgcccgactttgatcgcaaccgcgccggctactcgcccgaccgccttgacgctctggtttgggcaatcacggaactgatgggccgaggccagcccgatactggcgtcatcgtcatcccgccgagcatcccgaacgagcgcaagttcagctttgacggtggtggtcttggcctttaccagtacgactag

SEQ ID NO: 10180 - DNA, 243 bp, Methylobacterium sp.
atgcattcgaggtttgtaatgtgcgccattgtagatagcgcgcaattcgggaacgagatcgtccagcatgacacgtgcctgatcccaatcggtgatcaaaacgcgcggatcgacagcgacaacgtgccgtatgccgctgatctcctgacagttcacgagaccccgcgcctccaggcgagcgagcacatcgtaggcgccggttcgggtgatgcccgcacgcgtcgcgacgttcgtaatgggtga

SEQ ID NO: 10181 - DNA, 192 bp, Methylobacterium sp.
gtggccaagctgcgcttctgcgagggcttcgccaaggcgttgcccggcggatgcacagccttcgacgccaagggcctgaccagcgttgcaaccccgatcttcgtgcagtggcgcaacaagggtctcgtgaccgtctacccggacgccgacgccaaggcgaagccggtctggcagggcaaggcggtggagtga

SEQ ID NO: 10182 - DNA, 99 bp, Methylobacterium sp.
gtgcatttgagggcgcgcatcatgtgcggcatcgtgggtatcgtcgggcgcgacgcggtcgccgaccagatggtcgaggcgctgcggcggcttgagtac

SEQ ID NO: 10183 - DNA, 246 bp, Methylobacterium sp.
atgctcggcgttgccgccccggcctcgtctgcgatggccttcccctccgacgcgccgcgcggccactacggcggccactacaccggtttcgccgcggacggggtggagacgacgggcgcgctcggcgtctttggcagccgcaacccggcgagctgcccgatgagctcggcggccgagggcaacgccagccagcagaacttcctcgtgaagcagtacggccagacctctggcggcaaccgctgctga

SEQ ID NO: 10184 - DNA, 147 bp, Methylobacterium sp.
atggaacttaagggctggttgaactgggtgagggggcctgttccggccggtccgggcatcctattcgggagccttgatgcccgccttgtcgacgtggcatgccagatcgcgatgtccgacccgatcctcgacgaggccgtgacctga

SEQ ID NO: 10185 - DNA, 252 bp, Methylobacterium sp.
ttgcgcacgcggtgcatcgtggtccggctgcacaaggacaggctgagcttcggggatgcgccgatgaccatcggccggcagaagatcgatccggaaacctgcggcgacggtctcgcattcgggccctttcccgagctggaacggatggcggataagagccgccagtgcgcggcgcagggcgagaaggattgcgtgctctacacgaacatcccaacgaacatcccacgcgcggcggccaagcgcgggcggtga

SEQ ID NO: 10186 - DNA, 492 bp, Methylobacterium sp.
atggattcggcacgtgaggccgggccggtctgcgtgcgtgagccggcggccctgcgtccggccggtctcacggcgctcttccgcccagaagtcctggcctttcaggcctcgcagcgacaatggggcagcgtcgtcgagctgcgtcccgtctcggcgcgcgcgctgtcgtggtccgccgcgttcgtgacagccctcgtggtggccttcctgtgcctcgcccagtacgcccgcaaggagcccgtgcccggctatctgcgcccgtcgctcgggagcgcgaaggtcttcgtcccgcaggtcggcgtggtccgtgaagtgcgcgtcggcgagggcgcgaccgtccgcaaggggcagcccctgatgatcgtcgacacccagcaggtctcggccggggggcgcgacctgacacaggccgccctcgattccctctctgcccagcgcggcaggctcgcgcgccagatccaggctgaggaggagcgcgtggtctccgagtga

SEQ ID NO: 10187 - DNA, 204 bp, Methylobacterium sp.
atgctgtttgcgggcaccacgccgatcgtcggccagtacctgctgcatgccacgggaaccatcacctcggtgatcctgctcggcatctcgcacgtcgtcgtcaccgtggtctgcgcgatgatgctgatcgcgcgcatcgaagggaccggacagccggccgcgacgccggacgtcgcaccgtccggggcgctgcagcggacctga

SEQ ID NO: 10188 - DNA, 138 bp, Methylobacterium sp.
gtgctcggcgatcgcctccaggagccgcaccttgccgggaccgacgcggtggtcgggaccgagatcgatccggatgctcagacgggtcatcgtgcctccgcggcgcctctggccgaggctatgttcagcggtatatag

SEQ ID NO: 10189 - DNA, 225 bp, Methylobacterium sp.
gtggaggagcagggcgcggcgacccaggagatcgtgcgcaacgtctcgcaagcctcgaccggcacgggcgaggtgacgcgcaacatcgcgggcgtggcgggcgcggccgaggagacgggggcttcggccgcccaggtgctcggcgcggcctccgagctgtcgcgccagtccgagcacctcaacgccgaggtgcagcgcttcctcgcgagcgtcagggcggcatga

SEQ ID NO: 10190 - DNA, 108 bp, Methylobacterium sp.
ttgccggtcccgggcccgcacggcccgaaaggtctcgatctcggcggggccggagcggcggcgctcgatccgggcctgccggagagcctcatcggtccgatgtcgtag

SEQ ID NO: 10191 - DNA, 1224 bp, Methylobacterium sp.
atggccgggggcgcagggttgaacgacagggaaagcagcggctccggggcggtctcggcaccggaggatgccggcctgggagcggtctgggacggcgagtcgcccgagggcggggatgtccgcttcgtgctcgcggaggacggcgcgcgggtgctgcacgcctggccgggcgcgcgggcgctgctgcacgcgctcgcgccggcgggcgtgctcccgcccgcactcgcccggcagatccggcccgcggcgggccccggggcgcggatgctgcgcctacgcctcgacccgcgcgggattgcgccgccgaccctctgccgcgccgctcccggacgagccgccgacgggcgcggcctgatcctgctcgtggtggtcggcccgctgccgatcctgcgcgccggacccgcgcgcgtccggatgcctgcggatacgcctgccgaaggcacgtccgacctcatggtcgagcccctcgccgagtcccgcgtcgaggagcgcgccgccgtgcccgctccggcgcgcgcgcccgttgcccctgccgaccgggaagcgggcgcgccacgcccgggcgaccgcttcctctggcgcagcgacgccgcgggcgcgctcacgcagctctccggcgggggcgacgcgctcgcccgcctcgtcggtgcgtcctgggccgacctcgccgcctcgggccggctgcgcgagggggaggccttcctcgacgcgctggcgcgaagccggaccttccgggggctcggcgccatcctggcgctcgagggcggtgactcggtcgccgccgacctgtcgggcgcgcccctcggccggcccggccaggccttccggggctacggcggattcggcatcgtgcgcgccgtgaccctgaaggacctgacccggcctgtcgcgaacctcgtgcccctgcccgaggcgaccggcaccgagaccgtcgcgcccgagcctccgtccgagcctccggaggcggaagccggatcccgtgagagcgcgggcacgccggacccggccgctgtctcccccgtttccgtcccggtggaggcgaccgtatccggcgcgcccgtgccgcgggagccccccctcctcgccccgccctacccgctggcgccccccttcgggcgcggcctgggcacggatccggtcgcgatggccacgatggccgcgccgctcctcgcggcctggctccagcaggactggttcggctcgcccgcccgcaccgcaccggcg

SEQ ID NO: 10192 - DNA, 165 bp, Methylobacterium sp.
gtggtcgccgatcggttcgaccgggccgccatcatggccgccgcggtctcggccgcccgcgcctatcaggagccggccggctgcacctgggctgaggccatgtcggtcgcgcttaagggcgcgtggcaggcggccaagatcgccaagagccggacggcgcactga

SEQ ID NO: 10193 - DNA, 1494 bp, Methylobacterium sp.
gtggccttcctctttccggaggtggccaaggcggcgcgcgacggtcgcttggatcaggtgatacctggtcggtcgtggcccgcctggagagagccgccggcggtgacggagaaggccacggaccttgacaggtgggtgacggacctcatcgagaggacggcctccccaatgatccgcgaccgggacgcgttgcgtgagatcggcgtgacctgcccctactacgcagcccgctactggtcgttcatcgccttgcaggacgcggcacgggatcaggaggcccactcggcggcccgggcacagcgtctcaaggaccaacgcgacgcctacgtcaccctcgccacggcggcccgccgaaccatcgaaggcgagggcaaggaccgctaccaccatggggacgcaggcccccgcgggaatccctattgggaggacggggcgcgggtttgggacgagcgggtggccgcgcgcgagatcgggaaggccgcctgtgacgccgcaacggcggcactcgcacgggccgaggagttcatccagcgcctcaccgccgagatagaccggatcgcgccgccgactgcccggccggatatctggaagacctcctacgccacgacgatggggaacctgtatcagctcctcaccggggaggaggtgcccgatcacggagacatcttcggcgacctcatcaaggcgcccctcgacatgatcggaacgccgatcaagccttgggggcaggtcaggaccctgcgcaaacggttcagcgaccccgagaacggcccgggtttcggccgtggggccgatggcggcatgggtctcgaaaacctcatacgcttccggatgcgggggccaggcgcggcctgcatcgtgcacgacgccctggagcgcgccgacgtgatgtcggtcgccatgatccgcctcgccgattacaccgatgccccggtcgagaccgttctccgggagtgcctgctcaagccctacatccggcggcatccggccctgaaggagccggaggtcctgttgatccagctcggatggcaggaggagcctcgccccaacgcggtccagagggcgctgcgggagacggtggcgagggccaagggcggcgatatacaggccgccgcggtcatcgagatcctgatgaccatcggcatcgacatcgacctgaccagccggaagttcgcgagcgggctgagttggctggagaggtatgccggcctcgccgtggccgacgtgatgtatgggctataccgggagagcctacgcggcgacgagttgagcggcgcccttctggggctgatcggccagagcgacccggtagccggcgggctgatgggcctcattgatctacggatccatacctccacggaaccggaggacatcgaactgcgcgggctcatcgaggcgcgcacggaacgcgcagaggctaacatcgcgcaccacagggcgacggcagaggccgtgcggaactaccagaaggtgcctccgcgccccgccgtctag

SEQ ID NO: 10194 - DNA, 1077 bp, Methylobacterium sp.
gtgatcgagcaagccttctccacgcaggctgaggcggatgcttgggtcgccgcggaacgcgctcagggccgagagatcaggatcataggacctgcgcgcagggacgagtatttccccggtaccgtgcatcaccagattgcccttggcggcacggagaagggcatgcgctcgatcgcctacatcgcgcagacattcctggcgcaggcgttccccgaccttgcgcgtagcccccagctgcaggcgctcaaggactacactctgcacaacacgggcgcgggctttgtatggtgggagttcgatccgcctaacgacgtgccggcctctccctttgccttcggccatcgcgtcatcgtcggccacgatagcgcagatggcgctgtctacgcacgtgtctctctgtttggcagcctgaactatgccctactcctggcaagggtgccgtccgataccagccgcgcagtgatgaccgacatcgatccgctggcccttcgcgcccctgctgatacgcagaagcaggagtttgcaaaggccgtcagtgccgtgatccgcccggcagatccgatccagatcttaggcgacgccctgcggacaggccgggctgaacaggagatcaataagctcgttggtaggatccaagagttcgagcttaacaagacggcgggcgagttgatgggcacggtggcagcggcatctatcaaaccggaggccgagcgcagggctgatctaacgcaggtcgtcgcgggacaaagtcaacgtctgctcgtgattatgcgcaagtctgcggccgatatgaaatcgtcttgggctggcgcgggagggcagatggtatcatcccttcttgaagccgcactgcgtcaagaccccgcctcagcgaacggcctgagccccgaggctatccgttctcttgagctcgtgcgcccggtcttagtcgagcagatggatcgtgatctcgtcggcgggaggctcgatcaagatcgcctagccatgttgatcggaggcggaccaggagcggccatcatgctcgaagccttgatcccaaatcttgtgcggcgtgcagcgagcggccagagaacttga

SEQ ID NO: 10195 - DNA, 420 bp, Methylobacterium sp.
atgatgacggtgggaatggtgacggccctggcgctcgtcggtggccacgcggccgtggcgcgcgcgatctggccgggcgagcgcgtcgaggatcccggtcccgccctggatccgtacctgaaggctcaggcgggtgccctgtccacggtggtcgctatcaaggagcgcaagctctcggacgcgcacgaggccctggccgcggcccggaagcgcgagaccgcgttgagggtcgagctggacgccgcgaaggccgaggcgcgcgagctagtcgatgagcggtcggcgctccggagggaggtgcgccggttgcgccgggtcgaggtcctggccgcggtcgagggcgacggcgagggagacgagactgccggcgacgatgacgggtccgcggcaccgccggctgggccccgtccgttccaatag

SEQ ID NO: 10196 - DNA, 204 bp, Methylobacterium sp.
atgcacgaggatgccccgcagaaccgtaggaacggccgcccgccgttgccgcccgaggatcggcgcgatcaggccgtggacgtgcgcctgtccccgaccgaggccaagagcatcacggagcgcgcagcgcgggtcgggatgcgcctgcgggagttcatccgtcacgcagccctgaatacccgcatcgtcgcgccctcatcctga

SEQ ID NO: 10197 - DNA, 180 bp, Methylobacterium sp.
gtggcccaccgacacgtagctgatggccgggccctgtccctggccgagcgggccgcgctcctggcctacctgcgcacgccctgcctcgaccggcacggcctcgtggcgaagctcctcgcggtcgagcggtgggcctccgagatcgcacaggacggcttggaggccgtgctcatggtctag

SEQ ID NO: 10198 - DNA, 774 bp, Methylobacterium sp.
atgccgaagccgctgtcggccgagcgccgcgccctcgacgccgcctttgggatgaccagcggctacgtcctcgatttcaccgaccgcacaatggcggagtggttcgaggaggggttcgccatcgacatccagtcgggcgcttacgatgcgactgggacgtcgaaggccaagcgcctacggaccttcattgaggtcgaggatgggcacacggtcggcgctgtgctgcgcgcgctctggatctacgctgaggggatccgaaaccggcgggtcgacccccctgccgaggcggatgttgtcaccgtctttgccttcatcgagcgtgtcgagagggccgaggcgcgtccgcgcacggacgcgctggaacgtttcaaggctgatgagaccctcgacgagctggtcgccgccatccagcgcgacatcgccgtcgacaagccggccccagcgctggaccggctgcacctctactgcatgaaaaagttcgcccacctgctcgatgagcgaagcatcccgtacgaccgggcggagccgctgcacagccgcgtcggcaagtacgtcaaggcgctggagcgcgagcgcgaactgcgccgcatcacggtgcggatgctcaagagcgcgatcggcatcttcgacgaccttaacgatgtccggaacaatgggtccttcgcccacgacaacgacctcgtcgacgcggccgaggcacggttcatcttcgatgcgatcagcgcaatccttcgcttcgtgaagagcgtagacacggcacggttcgggacctga

SEQ ID NO: 10199 - DNA, 1257 bp, Methylobacterium sp.
gtgttttggtcttggcagagcgacatcgcgcagcgggtctgccgtgagttcgtccgctcggctttatcagatgcgctccagaggctcgcagccgaactcggcctcgaagagagcgagcgccccgaactcgaccacgacaccaagggcgaggccgggatggtcgacatcaccgccacgatcctccgcaagatcgaggcggcgtccgtcttcgtggcggacgtgacgtcgatcgcagagaccgggcagggcaagaaggtcgctaacccgaacgtgctgatcgaactggggtacgcgctcaaggcgatcgggccggaggccatcgtgctcgtcgccaatgagcggtatggtggcggccccaccgacctgcccttcgacctacgcaaccgacgcggacccatcacgtacaagctggaccgcaaggcatccgatgaggagttggaagccgctcgggggccgctcgtcgacagtctggtagaggctctgtcggccatactccacgtcgcgcgcacagcccgagacgcagaggctcagcccgtcggccaaccgagccgcaatggcgacccttccgtctggtttccaaccggcgccgcactccaggcgcgggattggtttggccgcgcgcagatgcgccggatcatcctgcccgatgccccgcgcagctacatgcgcatcatcccggccggttggggcaatacacctccgaccgcacaagacctccaccaccccgatgggcatgggccaaggatcaacccgctgggccgcgggaccaacggtgacggcggcctgaacgcggacggagtcctgtactacgagccgatcgagaacacggacgagacggaaaccatcgtccagtggtttgcggacagcggcgagatttggggggtcgataacaaggcagctcgcttgatcggcgaacaaaccctgttcgacatccattatacgacacgccgctgggctacgttcatgagaacggggctcgcagccttgcgggcattcggcgcgcgcggtcccatcctaatcgaagcaggcgctgtccgtctcacggatgtccaatggtacgaggtcagcccgagcgcacgggtatcgggcctgcggccccatgcctgtgcctcgcgcgcatcccgggattgggacgatgccgcacagattgcctttctgaaggatgccgcgaaccaagtccgggccgccttcggcgttcggcaagtctcgattgaagaggtcgatccggtggtgcgagcaggctggcagagcatctga

SEQ ID NO: 10200 - DNA, 141 bp, Methylobacterium sp.
atgggcatcgaagctctagtgatccacgcctaccgcgagaagaaggtcgagcgcctgggcgccgacacccggcgcatcctcgggatccggggaccgtttctgaggagacggctcgccttacgcgaacgagtcgtctcctga

SEQ ID NO: 10201 - DNA, 138 bp, Methylobacterium sp.
gtgccgttcgcgcaggagttggacctcatattcgaagcgcatctgttcgcgataaaaatccccgccctcttcgatccgccgcagcaacctggcaactgcctgcgctgcatcgatccggtagagttctcgcgcaggtaa

SEQ ID NO: 10202 - DNA, 888 bp, Methylobacterium sp.
atgggcgacattttcgcgcggtcagtcagcggcgcgctcaattttgagtacgccctcgacgaagcactctgcaatgctcgcctcgatgcttctcagttgcaaatggcgctcctcaacgtcgtcattaacgcgcgcgacgcgatgccagacggcggcacggtgactatcaaaactgaaaatttgaaaataaacgaggaagaccagcaattgttcgaagggttgatgcccggcgaatatatcgcggtgatggtgaccgacaccggcaccgggatgccgaaagaaatcctcaagcgggtgatggacccgtttttcacgaccaaggaggaagggaaaggcaccggcctcggcctctccatggtttatggctacgccaaacaaagcggcggtgcggcgcgcatctacagcgaggaaggcgttggcacgaccgtcaaactgttgttccccgcaacggaccgacccgtcaacccgatgcagcagaaacaagtctcgtcgtcggcgaggggcggcaccgaacgcattctgatcgtcgacgaccgcgccgatgtggccgagatggcaagcatgatgctggaagctgcaggctatcgcaccgtgatcgccggggatggtcacagcgcgttgaaactgctcaccagcgatccggatatcgatatgatgttcaccgacattgtcatgcccggaagtctcaacggtgtcagcctgtcccgcatggccttggttcgtaagccgaaacttaaaatccttttaacaaccggttttgccgaaacctcatccagtggcgcgattgaaagcgatcttgagtttccgatgatttcgaagccgtacacccagacggatttgctcaagaaggtccgcatcgttctgaacggaccggatggggttagctag

SEQ ID NO: 10203 - DNA, 285 bp, Methylobacterium sp.
atgacgcgtgtcagtctgccggctctcgccggtgccgcggttgttgcgggcggtttcttcgcggcttccatccccgcccaggcccgctgcgttggcatcgccgcctgcgcccagcctccggcgggcatcgccgcgcgtcccggctttgcggcgaaccggcccggcatcgtgaatcctggcatcgcccgcggcaacaatctcgtcggggccggcgccggcaacctcgtcggcgcgggtgccgggaaccttgtcggcgcgggtgctgggaacttccgtccgcgctga

SEQ ID NO: 10204 - DNA, 351 bp, Methylobacterium sp.
atgtttttcctgaaggtgctgcagggcgctattctgatcgatgttatgattaagatgttcttggaaaaactgcagtctcgcgcgattttcctcgattatttgcccccaggttttgacgccgacgctcatattgttggcgtcgtgtacgatcccgtattttcctttcggcgatccatccaaccgatattgaaccgactcgtcatattcgtcggagacgacccagaagtgccatctgacacctttgacagtcctgaagcgatcgtctttgacaacggatcgcgcataatcctcgatttgcgtaagttctttcgtcttgattggcaccttcggagccttcagctcgatcactag

SEQ ID NO: 10205 - DNA, 333 bp, Methylobacterium sp.
atgccgttgttcgctgtatcgcttctctccgagtgccgtgtggcgggtgtcgtcctgcctgacccgatgcatgaactggcgatccacatcgtccaagctcaggacgaggccgaagcgcgtgcgcggggcgcggagcttggtgctcaccggcagcatgcctaccgcaactcggacggcgaggaagtgacatgggttttccgacgcgtggtggaatgtcaggacctctttgagcgcagcttctctgacggcatggaagtctcgtcctggctgtatcggggtgagcgcctctgcctcaacgacggatggtcggcaccctcggctgcgaccggctag

SEQ ID NO: 10206 - DNA, 204 bp, Methylobacterium sp.
atggcgatcgcccgctctgacggctcagccctcggctgcgaagaggtcgagctgcccggtgaagcggcgcgggcgccccttcggcttggccggcggagctgcgggcagcacaggcaagggcgcatgcggtcgtccatacaggaccgcaccaacgatctcgcgctgctcgccacgatgaaaggcgttcagggtatgcgctcctga

SEQ ID NO: 10207 - DNA, 159 bp, Methylobacterium sp.
atggcaacgacgaccttgttggcggcgcagggccagataatcttaccggcggagctgggaacgacatactcgaaggcggaaccggaaatgacgtcatgtttggcggttttggcaatgatgtttattatcactatgccaatactggacttgatactataa

SEQ ID NO: 10208 - DNA, 459 bp, Methylobacterium sp.
atggacatcgaagacgccctcgaccagctcggccggcagatcgggatcggcctgcgcctcgacggggcccgcgcctgccgcctcgtcttcgacggacgcaccgcgctcgacatcgaggccccggcggaccgtcccggcaccgtcttcctgcacagcgcggtcggcctcctgccgccgacgggccggcgcgaggccgtctacgagatgctgctcgccggcaacctgttcggccgcgacacgggccgggccacgctcgggatcgaccgcgacctcggcgagatcctgctcgtccggcagctcgacatggccgagaccccctacgcggccttcgccgacgcggtggaggactgcgtcgcccgggccagggcctggaccgagcggctgcggcagacacacgcggagacgcctgcggccgccggggacgcgctggcgctggcgcggttcggcctgcggatctga

SEQ ID NO: 10209 - DNA, 1527 bp, Methylobacterium sp.
atgacgcacggcatctccggcctctcgccgcgggcgagcctcgacacgacccaggccgccgcgggcacgcggggcagcttccggggcgcggccgtcgaggcggccccggcccagccccgcgccgcgagcgcgctgaagaccgcgtggctcgaggtccggcacttcttcgcctcgctcgtcggcatgcgggtgagcacgacgaagcccgagacggtcgccgacgccgcctcggccacccgcggcgtgctgcacgcgatgaccaagcgcgacctcgacacgctcgacgtggcggaggcgctcgtcggcatgaccgagcacggcgccttcccgcaggatctgaaccggaccgggatcaccgagggcgcggccggcctgttccggccggccctgcaggatctctcggacctgcagctgatgcggctgcaggcgaatctctgccgcaagccggatctgctggagggcctgtcccagctcggaacgggcttcgtcatggacgccgacgagccgagcgtcgccgcgatggccgcgggcggccaggtcaacgacctcggcttcgtgatgatgtccctgcacacctgcctgagggccgagctggccgatcgcgggctcgtgcccgcggacctgccgggaaccccggcggccctggaccccggcctcgaacgcttcgcccagagggccgtggcgaacgagggggacctgcgggccgccatcggggaggcgcgcgtcgatctcgcgcgcgcgcgcgaaacggccgtcctcgacgccctggagcaggcgggcctctacacgcgggaggccgaggccccgccggaggcgccgcccgcccctccgcccgccccgccggacaatgccgccgtcaacgcgcccttcggcgaggcgcgccgcgcctggatcgtcgagacgctcaaccaagcctacctgccgcagaaccaggccagcgagcgcaccggcgcggtcccggtcggccccacgggcgccttcgcggtcgcgcagatcttcaagcgcgacatgatcggcgcgcgcgacatcgccttcgcgggcgagcggctcccgggcacggagggcggcaccgcggcgctcgacgccaacgtcgcgcagttctgccaggcgctgggcgacaggggcgcgaccaagggcgacatcctggccctgtcccgcgtgatgaaccaggcgaccaccggcgtcgtcgcctctcagtacatgctcgatccggacaacgcccccggcctccggctggcggacggcgacacggtgcccatcatcgcggacctgaagggcggggcctggtcgatcacgccgagcgggaccggatacgagatcggctaccgcgccgggcaggatctcgacggatcggcgatggcgacccagggcagccggatcttccggttcggcgagggctcgcggctcgacgtgaccctcaccttcgtgctggagcgcggcacggagggggaactcgccgtgacgggcatgcgggattcccgcatcgcgatccgggccttcgacaccgagggccggcagctcgcctga

SEQ ID NO: 10210 - DNA, 318 bp, Methylobacterium sp.
atgatggcccagcacgtcgaggtggcgatgccgctctgggaatggtcggaggacgacgtggttgcacgcctgatcgagcgccggttgccgttccctcgccactacaccgagatcgtcgatagcctcgaatgcctgtgctgcccggcgatgatcagcgccgagcgcctggcctacctcgatgcgcaccaccctgaggccgccgccttcgtgcgcccgctggcccgccggatcctcgatgccgcccggggagccgtggcgagtagcgacgcagccctcgccgatgccccgcaggccgaacccgaaaaggatgccgcatga

SEQ ID NO: 10211 - DNA, 567 bp, Methylobacterium sp.
gtgaatgcccctctccccgccggccgccgcatccttccgcggctcgcacccgagacgctggcccttcgcgagcgcatcctgtcggcgccgatcatgccggccgtcgaggatgccccctggaccctctccccggatccggccgaggtgctggccatcatctccgacgccgagcccgacctgcacgccgcgggctatggtcggccgcagggctggtccgccgagcggcaggggcgatcatgggccgagatggagacgcccgccttcctggaggagatggaccgcgcggcccggttcctgtcgtacctgcgcgagcaccgccgggaccgctgccccacccgccgctcgtccgccggatgggccacgatcgccgagggcatcatcgccgccccgatcggcaacggcgcgctggtcgccgcagcgctcgccctcgggttcacggtgaagccgcgcgcctcgacggccgaggcatggctgggcctcgccgagaccgcgttcgcgtcgctgcccgggatctcgcccgcagctcgcagctcgggcggcctggccgtggtcgccgcgagcctctga

SEQ ID NO: 10212 - DNA, 285 bp, Methylobacterium sp.
atggccctgaccagcaaagagaagcaggcggcgttccgagcccggcgcaaggctgcggtcgtcgaggtggtgacgctgcgggcggagaacgctggcctccgggacgaactcgccacgctgaagggggagaacgcccgcctcgccggcatcgtggcggccgcgaaggtctcggcctctgccgtgtcggcacgtcccgccccggcttcggtgcgggtccgcctgccggcaccaccggcggagacaagtccgacccgctcgccgacatcaatccgggtccggatctga

SEQ ID NO: 10213 - DNA, 105 bp, Methylobacterium sp.
atgccttgggacaagctggcctgcgaggccgacaaggccaagtggaaggccgcctgcgaggtgagcaaggctccctgcaccaagctcgaggagatcctcaagtag

SEQ ID NO: 10214 - DNA, 267 bp, Methylobacterium sp.
ttggacgtgggttcgatggaaaatccgctcatccgccaatgccacgaactcactgctaaggtagccggcgggtggaccgacgggcagcatgcagccggtgagttgatggggagggctcgcgagatggcagcctcccttccagcttccggcaaaagggacttcttcgccgaccttgctaagcaagcggaggccgccagccggagcctagtagataccgaggtgttcgagctcttcggacagatgttgcgcgtcgaggccgagcgatga

SEQ ID NO: 10215 - DNA, 90 bp, Methylobacterium sp.
atggaaccagcttctctgtccgccatcctgatcgccgtgggcttcgcgctcgtggctatcggccgcctcatcgccgtcttcggcatgtga

SEQ ID NO: 10216 - DNA, 219 bp, Methylobacterium sp.
atggcggttatcgaagccagcactctgacgacggaagccctagagggctacgatcggatgatgctcgaggccacgctgagggtccgcaacttcgcctcgctcgccttcgcggtgtggtcggaagtcctccgcgagctcgacaagcgcgggcgagtgacgctggtctccggctcctacgatgacgtcggcaacgcgctgatcacgcggaactacgagtag

SEQ ID NO: 10217 - DNA, 201 bp, Methylobacterium sp.
atgacgcacgcccgcttccctgatttcagcaccccggccccggttgcccgacgcgttcaggccatcgccctcccggccccgctggctcacccggcactcattctagctgcgcgcgccgcgcgcctcaccggtgagctgctgaccgcctgcgccctgatcggtggcggctgcgccctggtcggcttcgcaagcctcctctga

SEQ ID NO: 10218 - DNA, 492 bp, Methylobacterium sp.
gtggagccgctggacttcgtccgggagtacgtcgagccggccatcaccctttgggccgagcgccccaacagccctgtcctcgcggtctgtgccatcgcgcagatcgacatcctcgccgaggtcgtcgcgatcgcgcaggccggcggcaccctgtctcgcggcgagaccggcccgttccggacggaactcgggcaccgggagccggcgatagcgcggatccgagacgcccacgacagccacaagcacggccggctgagacgtagcagcgggagcgggagtagcatcacgcaggggcagaggccctggcggtccacgggctcggcctggttcctcggccgcagtcgcgtggggagcgttctgggcaggaagagcacggccatcttgctggacgatggcactcccatcgacatcgccgttctgatccgagaggctatggcggcttgggaccgcgagctgcgtcgactgagatatcgcccatcggaggaagggtag

SEQ ID NO: 10219 - DNA, 288 bp, Methylobacterium sp.
gtgctctacggcggccagggcgacgacacgctgaacggtggggtcggcgacgacacgctggtcggcgggctcggggcggacgtctacgtcttcggcgccacgtccggccgcgacctgatcctgggcttcgaccggggcgcgggcgaccggatcgcgcttggcgggcagaccgacacggtctcctcggcgcagaacggggacgcggtgctcctgctctcgggcggcggcgtagtcgatctggccgggatccgggccgatcaggtcgacgcgagcttcctcgcggcctga

SEQ ID NO: 10220 - DNA, 102 bp, Methylobacterium sp.
ggcctcgacgccgccgcgatcgtcgccaaggtcaacgaggtcctgcccgagcgcaaggcacgtacctccaacgtggtcagcgtcggccgccgccagcgctga

SEQ ID NO: 10221 - DNA, 207 bp, Methylobacterium sp.
atgccggcgggggcggtccgggtcagcatcggcctcgcctgcgccgcgccgggcaccgcggccgacgccgtctaccggcgcgcggacggcgcgctctacgacgcgaaggcgagcggacggaaccggacctgctgcgccccggcgcccgagccttcggagccgcccgccgcgcgcggaggcgccggcctgcggctggccgaggcgtag

SEQ ID NO: 10222 - DNA, 213 bp, Methylobacterium sp.
atggaccgcttgaattttcaggcctggcgtattcttgattttgtatttgaccacaagacgatcgagcgtttcttggttgaattttctatagttcccatcaagaactttgacttcgccaacagagtatccgtattccgcgtcatcaacgccctcggtctggcctatttttggatgataagccttggcatgctcgttcacggggatgagacgtga

SEQ ID NO: 10223 - DNA, 183 bp, Methylobacterium sp.
gtgaaccgcaccctgcaggagatgcgctccgccgggttgatcgtcctgaagagcaaggcgctcaccatcccggatctgacggccctgcagaaggtggcgctgttcaacgcgaactacctgcacctggagcacgagggtgcccacctcgacgcgaacgaacccggggagcgtgcgaacggttga

SEQ ID NO: 10224 - DNA, 96 bp, Methylobacterium sp.
gtgacggccaaggcggtggtgcagttcaggccgggcaaggccatgcgcgagcgcctgaacccggccctccgccagcttcccctggccgcggagtag

SEQ ID NO: 10225 - DNA, 204 bp, Methylobacterium sp.
atgatcacacgccgataccgggagccacgcgggctccactcggatcaggccgaatatggcttctacgtcaggctatccggagccgaccgggagttgatgaagcgtgcacttgaggtcgccaccgaacgccttggtggtcgccccagcaatccgatgctcctcgtggagatgatgaaggtcttcaccgatggggctgaggcatga

SEQ ID NO: 10226 - DNA, 234 bp, Methylobacterium sp.
ttgctcctgagcatgatcgaatgccgcacattaacgttcaagagcttcttcagatcgcccgaggatcagttggtggtcctcaagcacaccgttaccagcgcaaagggcagaaagatcagggtcgattggatggatttcgagtcaaccactgagacacagagcatcatagatcgactcgcgaaactgaacgctttcctaaaggatgcagacatcagcttcatcgttgtgacctga

SEQ ID NO: 10227 - DNA, 240 bp, Methylobacterium sp.
atgaagatggttgcccgcggagcgcctgcggatggcaatcgcggtctgctacaccagttgcgtaacgacaaaaagttcgcccacgaaatcggtgccctcgtccaggatggccggaagcacttcggcgaggcctatccgggccagacgcgcacgtcccacttcagcaatgatgaatgggccaaggccggctatgaagacgtcgccgagattggccacctcatgggcttgaaaggcctctga

SEQ ID NO: 10228 - DNA, 342 bp, Methylobacterium sp.
atgatggcccagaccctcgacgccatcccgcccctgcgcaacggtcggcgcggccgcccgcgtcggcgacccgacaagttgcacgccgacaaggcctacgacgccagggcccgacgccaggagtgccgggtgcgcgggatcgtgccgcgcatcgcccgcaagggcatcgagagcagcgagaggctcgggcgccaccgctgggtcgtggagcgcactcacgcttggttcaaccgcttccgacgccggccgatccgctacgagcgccgggccgacatctacgacgccttcaccagcctggctgccagcctcatcaccctcaaccagatcagacggttctgttag

SEQ ID NO: 10229 - DNA, 348 bp, Methylobacterium sp.
ttggcggatctcggcatcgcgatgaaggcggcctgggacgtggccgacgacgtgcggaccgggcgcctcgtgcgcatcctgccggactggtggggtgggacggatcggtgggtccgcatcgtctacccggcgcgtctgcaccagccccggcgggttcgcgccttcatcgccttcatggaagacgagatgacgacgtccctggccgagagcgcggatctcggcctgttcgaggctgcggcgctggcgaagctgcagccgcgcatcgacgccgtgcggcgccgtcccgagcctaaactcgccgagcctcgcctcgccgagcccggactcgccgaggcgaaacccgcctga

SEQ ID NO: 10230 - DNA, 108 bp, Methylobacterium sp.
ctcacgggtcaggtgcgcaacatcgcggacgtgacgaccgcggtggccaacggggacctgtccaagaagatcaccgtcgacgtgaagggcgagatcctggagctgaag

SEQ ID NO: 10231 - DNA, 105 bp, Methylobacterium sp.
ctcgacctcgtggagggcggtgcgggcgacgacacccagtacggcggcgacggcgacgacgtgctcggcggccagggcggcaacgatctcctcgacggacagagc

SEQ ID NO: 10232 - DNA, 99 bp, Methylobacterium sp.
atgccgttcgccacccgccctgcgcatctgatgcgcgccgccgccatcgtcgcgatcgcgggcctcgccgggccggcgttcgcccagccgaagaagccg

SEQ ID NO: 10233 - DNA, 279 bp, Methylobacterium sp.
acgaacggcaccgagttgtgggtgacggacggcaccgacgcaggcaccaccctcctcaaggacatcgacgcaggatccgattcctcctttcccgacggcttcacaacgctgggcaatggcaagatccttttccaggccaccaccacgacgaacggcgccgagttgtgggtgacggacggcaccgccgcgggcaccaccctcctcaaggacatagaagtaggatccgccagttcctccccgcgcggcttcacggcgctgggcgacggcaagatcctgttc

SEQ ID NO: 10234 - DNA, 183 bp, Methylobacterium sp.
atggctgccgctgtcgatccggctgacgaggccgggcttcgggtaggtgtcgagttcgagacgcagagccgcgacggcgcgcggggcgaggtgcgcgcagagcgccgccgccctcccccctctgcgggggagggtaccctgtgcagcagggggggccgggacgaggtcccgcaagaggggtga

SEQ ID NO: 10235 - DNA, 600 bp, Methylobacterium sp.
atgaaccaggaggccatagaaccgtattacaacgagcttgagcgagaaatgctcgacgctttctatgcacatatccgctctcacccgatgaagacgtatcttcattggaatatgcgtgataagaactatggctttcacgcgatcgagcatcggtatcgcgtgctcgggggcgagccgttttcgatcgaggacgataagaagctcgatctctcccgcctgttcatcgacatgtacggggtcggctatatcggtcatccgcgcttggagaagctactagaggaaaaccatatcgaggcgcgcgacttcctgaacggagctggcgaagcgcaagcttttgtcgatggcaaatatgttgatctgcaccgctcgacattaaggaaagttgacgttcttgcgaaccttgccacgaggtcgcatgacgataagctcaaaacactatcgagctggactcaatcaaggggactgtcaccaaaaacgatcgtctccctcgcgaaagagcactggcttgtgacgggcgttattgttctcgggggcctcatcagcgctagcttggctgcgtggcgactgatcatctcggtgtcatcgggtacgccacactaa

SEQ ID NO: 10236 - DNA, 1209 bp, Methylobacterium sp.
gtgtcgctcgacaagatcgtcgctctgaaccagtccggaagtgttcaggccgagacgctcagcatggagatctattctcagacccgcaccatcctgatcgtggtgggtctccttgccgtcggtctcgcggcaatgctcggtgtggcgatcgtccgcacgatcagtcgcgacatcgcctcggtggtggagccgatgaacgcgctggccgctggcgacgcgagcgtgaccattccacatcagggtgcgcagacagagatcggcgtcatcgccgcttccgtgcaggtcttcaaggacaacctgatccgcacccgcgagctcgaggcggagacggcgctggcgcgggcctcggcggaggagcagcgcaaggccggcatgcggcagatggccgacggcttcgagcaggcggtcggcggcatcgtcggcatggtctcctcggcggccagcgagctgcaggccaccgcccagggcatgagcgccaccgccggccagaccgcctcccagtccaccagcgtggcggcggccgccgcccaggcggctgccaacgtcaacacggtggcggccgcggccgaggagctcggctcgtcggtggccgagatcggccggcaggtctcgggctcggccgatctggcgcaggcggcggtggccgaggccaacgccacggcgggcctcgtgcaggatctggcccaggccgccagccgcatcggcgacgtggtggcgctgatctcgcagatcgccggccagaccaacctgctggccttgaacgccacgatcgaggcggcgcgcgcgggcgaggcggggcggggcttcgcggtggtggcggccgaggtgaaggagctggcctcgcagacggcgcgggcgacggaggagatctcgacgcagatcggccggatccagggctcgacggatcaggcggttggcgcgatcggcgggatcggggcgcgcatccgggagatcgccggggtggcggcctcgatcgcggcggcggtggaggagcagggcgcggcgacccaggagatcgtgcgcaacgtcgccgaagcctcgaccggcacgggcgaggtgacgcgcaacatcgcgggcgtggcgggcgcggccgaggagacgggagcttcggccgcccaggtgctcggcgcggcctccgagctgtcgcgccagtccgagcacctctcgggggaggtcagccgcttcctcgcgaccattcgggcggcttaa

SEQ ID NO: 10237 - DNA, 543 bp, Methylobacterium sp.
atgctcagccccgtaccggtggccggcatcgatgccggcaagcacttcctcgacctcggcttccagcccgccgccaaggggctgcgctgcgagaacagccccgctggcatccagagcgtgatcgaggccctgcgccagcgcggcgtcgtgcgcgtggcgctggaggcgatcggtccctacgcccagcccctcgtgacggcgctggtggccgccggcttctcggtcgccctggtcgatccgcgccggatcaaggccttccgcaccgccgagggcctgatcgccaagaccgaccggctggacgccggcctgatcgcccgctttgctgcgcgcatgagcgagcacctgcgccccgcccccgagcccgagccgatcgccctcaaggccctgtccacgcgccggcgccagctcaccgcgctagtcatcctgactcacccgtctcgtcacgccccggcactgctcgtcgtcgcagaagtagacgtgagccaccgaccggccggcggcgtcctcgatcgcgaaggactcgccgaactggcggatgtgtag

SEQ ID NO: 10238 - DNA, 204 bp, Methylobacterium sp.
atgtcggagcttcgctaccagcagtctggcacctgggccgatggaacgccgcgtctcgacgtggaggcggtcgagcatccggccgaggcaaccccggccgacgcgcgctcgggtgtgtcgcccgagcgccagagggagcgggtcgccgctgccgtagcgacgacgatccgccgctttgtctcagggggccttcgggatgcctga

SEQ ID NO: 10239 - DNA, 102 bp, Methylobacterium sp.
atgaccgtcgcccaggtgctgatgagcaccgacatggcccggctgaacggctgcctggccgccggcacggccccacaggccactgtgggaggcacggcatga

SEQ ID NO: 10240 - DNA, 96 bp, Methylobacterium sp.
atgaagttggctaggatgaagatccatgccttcgtattgactgtacctttggcagtcatgcacggcggcgaaatcagttgcgagatcgacgagtga

SEQ ID NO: 10241 - DNA, 195 bp, Methylobacterium sp.
atgatccccgtcagcatgggtcaggaccacgttatctacgtgctcggtgttgtagccgtcgcgaatatgtttgatgagacctggtgccgtatcggcataaccgccgtcaacaatatgaacagtgtagccgtaggcatcgttgccgtaacgcagtgcgatggcgtctccactactcgctttggtacctacgggtag

SEQ ID NO: 10242 - DNA, 297 bp, Methylobacterium sp.
ttgagttcggacgcacacgtcatcaaccgggctgccagcgtcggcgcgagcgaccgcttcgtgcgctggctcggcaggatcgcgaccgtcaccggcgtcctgatgttcgtctcctatctcgaccagatccagctgaacctcgccggacagaagggctcggtcattcagccgctcgccacggtggtgaattgcgggctgtggacgacctacggcgccctgcgccgggactggccggtctccttcgccaacgcccccggaatcgtcctcggagccgtcgccctgatcaccgcgctctga

SEQ ID NO: 10243 - DNA, 195 bp, Methylobacterium sp.
accctcaagcgccacctcaccacccacggcctcgacccgcgcgcctaccgccagaggtacggcctgcccgacgactaccccatggtcgcccccgcctacgccgcccagcgctccgccctcgccaagcagatcggtctcggtcgccccggcgccctcgccgagcgcgaggccggcggtcgtcgcaaggccgcctga

SEQ ID NO: 10244 - DNA, 1041 bp, Methylobacterium sp.
atgctcagccccgtaccggtggccggcatcgatgccggcaagcacttcctcgacctcggcttccagcccgccgccaaggggctgcgctgcgagaacagccccgctggcatccagagcgtgatcgaggccctgcgccagcgcggcgtcgtgcgcgtggcgctggaggcgatcggtccctacgcccagcccctcgtgacggcgctggtggccgccggcttctcggtcgccctggtcgatccgcgccggatcaaggccttccgcaccgccgagggcctgatcgccaagaccgaccggctggacgccggcctgatcgcccgctttgctgcgcgcatgagcgagcacctgcgccccgcccccgagcccgagccgatcgccctcaaggccctgtccacgcgccggcgccagctcaccgcgctggtcgccatggagaagacgcgcctcaagcaggccctcgatcccctggttgccgacagccaccgggcggtgatcgccaccctggaggcggcctgtgccgcagtcgagacggctctcgaacgccgcatcgccgccgatccggcgctggcccgcaagcgtgcgatcctgacctcgatcccggggatcggcgcgcgcatcgcgggcgtgctcatcaccgacatgcccgaactcggccggatcgaccgcaaggcggcggccagtctggccggcctggcgccgcatccgagccagagcggggccggtcccggccgccacgccatcgcgggcgggcggccctgcctgcgcgcggccttctatatggccggcctggtcgccgcccgtgcctgtccggccttccgcgggccctacaaggccatgcgggaggccggcaagccggccaaggtcgccatcgtggccacaggccggcgcctcgtcgtcctggccaacccactcatccgagaggacaaaaccttccccgaaagcaccagcgcgcttgacccgcaatacagtcgccggttgatcgattcggccgtgggggggggtgaaccgcgccgcgccccctctcccatagggagagggttggggtga

SEQ ID NO: 10245 - DNA, 1032 bp, Methylobacterium sp.
ttggtcggcgtccttcagcgcatggccaagggcgagatcgaagctgagatcacggaagctgctcgcggcgacgagatcggggccgtcggccgggcggtcgagggcatcaaggccatggtggcccgcaaggccgccgaggaggccgaggtgcggcgccggagcgacgcggccgcagcggccgagcgcaagcgcacgatggtggagctcgccgacggtttcgaggcggcggtgggcgggatcgtggggctggtctcgtcctcgtccaccgagctgcaggcgacggcccagcagatgaccatgaccgcgacggagacggccagccagtcgaccaccgtcgcggccgcggccgagcaggcttcctcgaacgtcaacacggttgcgtcggccgccgaggaactgggcgcctccgtgcgggagatcggccgccaggtctcgggctcgtccgacctcgcgcaggtggcggtggatgaggcggaccgcaccgcggcgcaggtgcacgagctgagccgggccgtgaccaaggtcggcgacgtggttcagctgatctcgaccatcgcggcccagaccaacctgctggccttgaacgccacgatcgaggcggcccgcgcgggcgaggccggccgcggcttcgcggtggtggccgccgaggtgaaggaactcgccaaccagaccggccgggcgaccgacgagatcgccagccagatcggccacatccagggcgcgacggggcaggcggtcgaggcgatcggctcgatcacggggcgcatccagcagatcagcaccgtcgcgacgacgatcgcggcggccgtcgagcagcagggtgcggccacgcaggagatcgtgcgcaacgtgacccaggcatcggccgggacccgggaggtgacgagcaacatcgcgggggtggcgcaggcctccgaggagaccggtgcggcggccagccaggtgctcgcctcggcctcggagctgtcccggcagtccgagcacctctcggccgaggtgcagcgcttcctcgccaccgtccgcgccgcctga

SEQ ID NO: 10246 - DNA, 99 bp, Methylobacterium sp.
gccggggcgacgggctggctcgtcaagcctgtccaggccgacaagctcctgcaggtgatccggcaggtcgcgccggccgtgcagccgcaagccgcctga

SEQ ID NO: 10247 - DNA, 480 bp, Methylobacterium sp.
cggggacgtctggcgctcgccggcaacggggcgacgggcggggagggcgccgcgctgcgcgcgctcgccgccgaggccggcatcgccggatccgtgacggtgggcggccccgtcttcgggccggagaaggatcggacgctgcgcagctgggatttcttcgtccagtcctcgcgcttcgacgggctgccgatcggcgcggtcgaggcggcgctcgcgggcctgccgctgatcgtctcgaccgccaccggcctcgccgaggcggtcgagcgccacggcgccggcttcgtcgtgcgcgacctctcgcccggggcggtggcggacgcgctcggacaggccgcccggctgacgcccgaggcctgggtgcgcatgtcgcgcgcggcccacgcgatggccctcgtcacgggcgactgggcccgctcggcggaggcgcttcagcacctctacgcggccggcagcgacgacctcaggctcgccggctga

SEQ ID NO: 10248 - DNA, 126 bp, Methylobacterium sp.
cggtcccgcaggcccgcgagcgaggttatcgaggcccaggccttcgagccccttcagcaccggagccacgctgcgcccgagcccccgcacgacgctgtcgacggccgcgcgtacacgctctggtga

SEQ ID NO: 10249 - DNA, 153 bp, Methylobacterium sp.
aacggcaccgagctgtgggtgacggacggcaccgcagccggcacatccctcctcaaggacatcaacgccgggtccagcagctccaccccgaccggcttcacggcgctgggcgacggcaagatcctgttcagcgccagcaccgcggcgaacggc

SEQ ID NO: 10250 - DNA, 297 bp, Methylobacterium sp.
atgaggatcgagttcgccgatgacgacttggcgcgcatatgcacggatcaagcctacaagatgggcctgccggttgctgtgattaaggcggccagaaataggcttgtacagatggaagccgccaaggatgagcgcgacctcagaaatctaaaaagcttgaactacaaaaaaagaaacagacaggacgaaggcatcagatcagtgtgtatcaacgaccagtacaggatcttatttacactctcagaggacgagcgaccgccggtccttcgcgtcattgcgattggcgacacgcattaa
